United States Patent 10,407,724 (METHODS AND COMPOSITIONS FOR SCREENING AND TREATING DEVELOPMENTAL DISORDERS) - sequence listing, part 45

SEQ ID NO: 789 - DNA, 511097 bp, Homo sapiens
ctaaattgtcccctaaatggtaggatttatttcaatgctcacatacaattgaatgagacaaactatttacataaaacataagtacaaaaaatataatacaatttatactgtacacaatcaggattcccttgttttgttccccccacaaatggcagctagagatggtaagaagggggttggtaggaaagtgtgactgcacactcagcagtgctgaggatagatcttcagaatgctttttcataaagatgaatagggttgagatacagaaactgtcaatgcaccaagagcagtaagagagcacaacatattcacttctgtaataatagctatatattttttcttataaacgtgtttgtttctcaaagctgaggcttggagcaggtgtgagttgccttccattgattggttaggtgacctccgcccacccctgctccaacttccatagttgatccaatgcagcaggtaatgagtttccagttgccacaattggtgtcttaagctgatttcagaaaacaatgcatctgtcagatgtcattaagcaacaatctgggatacagacctagacagctctcaggaagcatttacaaccagtgaattgatggacaggaaagataaaagtcatgaacattagaaatttctattgcgcacatgtaacaagaaggttttgaagaatatcaatgcttcaaatgtaaggattgaaagaaagtgtggtgtgtccatggcccccttacaaaggacccagcaatctacaagtgttctagcatagcaacccaagatccattttctcattcaaacaaaggggaaatgtaaagctatctcattgttttaaaaagctaaattataattaagatacattgtcttttaaaattaaatttaagatcagtaactgtctgcaagcttaccaagggctgaaattggctttggaggagtttcacaaaaaaaaaaaaaaaaaaaaatctcaagtttattttgtgttcacaaaacagccaacagcaaattaacgcagaatgaggcatttaacatttgataacatctttaaaagttacatcaagcggcatagcacaaaagttttgctatgcacttttgaagaatccaacattggaccaaaagtttgtgcattttcttgcagatgatgtagaatctcagtggtgaaactaagtgcttgggttaaagattcatactgtgctttgtttcaaagtgcagaggttcagcttgcttttggccaacagtcatggtaaaagagaaaaacaatcaacttcagcagagataatactattacttttcttaacccaaattaagagtgacaacttttgtgaacttgtgaagcagttttgatataaacttaaaaataatcaggcaatgttgtaggtggttctcattccatgctcactgtatctataccagttgtcaccagcctgtgtctgattttcctctatctatggacttgcctgaagagaaacagaaacaaaaacctctaacttctataggcatcacgttaacattcttattacagaacaatcactatgattttttttggaacatgtaaaaattaaagtgatgttagtttctagaaggctaatactgaagtcacctctcttctgagcatatgttgtacctattctggttctacatccccagtgagggcaaaaatcacatctgaagatgatgtgcttcttggtcattttctattcctgagttcaaagagacataggagaataattttctttaaagtaaatccaatcaatcttctccttctaattagaccaataatatccacatgaaatgataaatgatcatcttaaacaaggcactagcaactttttctaggaaattaaactaccgcacttacagagagggaagaaaatgatgctctcattttagcaacatgataaaatagttccgatttttcagagtccagattttgctctcagcttgtatttatcaaacatttgaatcattttattactgccattcatctaacatttggaatatttggcattaaattgccaaaaggctgagaaagaacaagatcacatttcaactactggccccagattttagagcaaatatgaaggggtggaataaattttcttgcttgattgacagtttaagaaacacaaaagagtgattttctacctcctctttcctctttccagatctgaaagtgcccttgactagttcctgccattgcgccaacactgtaaaacatgtttgcttgagcaagaattgatattgactccgattgcagggagtaagcttgattgcctttctatggcagatatgagctaatatgatccatcaaaaaggctgtgttttgagacagctttcactaggaagtatacattttgtgccaggctctgaattggttttgataatgccctatgtcgcttgcaatgtgaactctattttcaaaagtggataggattcccttcctcatgcttctgtaacatgtatcaaatttctgataatgcaacagatgaccactgagtatatctttgatctatctgctaaaacaatgtgtacaatgcatctttaatataagtccataggaaaggagtatttaaagagtcgttttagaaatcatcaccagcagttcaacattacatcttatttaccttttctattaccaaaagagaaaagaagcaaggattaaagcaacatattttcctttgctttattaggttaacaagcaaggattaaagcaacttattttcctttgctttattaggttaacatagcagataacctgaattccttggcttagtgtttgtagagtttaaaaaaaaatctttaaatccattataattaatgacctcaatagggcagaatagcagaaataaatttcacgatgatcccctgtccccaaacattttatcttacattgtgcatggcattcccttttatgcgtttcttaggtcaaagtgaacatttctctatgttctcccatttcacccactgcccaaagaagtaaggggctcaaatggcatctagggtctgataagataagcgtaggtaattgcagataaccataggtaatcaaatattggtaacgttgtgtcaacatgcttccccaagtgcatcaggaagtgatgaagaagttaggatgaacaaatgggctaggcaaggccaaggccatctgtaaactccagtttgtaccatatcataagtggtgaagaatttgcatatagttaaggttattagtaccgtcatagaaattgattattggaggtgtggggcttaagcacagccctgccatgtggaaaatggttatgcagtcgctgttaattttatcaaccattagtacctgttgcctctggttctgtgttccagagccatctcttgagatagaaatgctgaggtcaatggagttacccccaatgacacacacaagaaaaccccattgaagtgtaaaggatacccggaccctaaagaaagctgatggttcagggacaaagttgaagaagtatcttgacagtattggggaaatatttatgatttattctaaaagcaaaaggaacactgcaaataagcaaatgaatatttgtaaattcaaatgctaacaaggctgtgtttagacaaaacgattagctgagtatagacttgatatatgtttaaggtaaaattccctttgatattcaattatacgctaatggatccccttagagagccacttggggacatagagaccccccgctaagactttgttctttttttttttttttgagacagggtctctctctgtcacccaggatggagtgcagtgatgtgatctcagctcactgcaacctcaacctcctggctcaaatgatactcccgcctcagcctcccaagaaactgggaccacaggcacgcaccacgatggctggctaatattttgtatattttgtagagatggagtttccccatgttgcccaggctggtctcaaactcctgagctcaggtgatccgcccaccttggcctcccaaagtgctgggattataggcatgagccactgcacccagcctttgtccatgattttgacagcatgacctgctaattctaccagagactccagtgggaacactcagcaaaataggctttgactcccacagtttccatccttttgcagataaataaggaagtaagtacacctttggctaaaactctggcactctgggcagttgatcctggcagagtccaagggtcagacccatggacctgtgaagtgggcaaccgtttccgggaactgtccatagcacttgctggggtgaccaggtcctgcctttcacgtcacctacttatccgactatttcctccatttgcttcttttctatttgccatcacctgtgacccgatggggccagacccctggttcatcccaaaccacatgacatgaacggactcttcctagggacagaggtttctccccagcagggatgccctcaccctcattcaatgtttatcgtctcttttcaattcctttagaacctcagccccacacatacatttattaaatgttcttttcttctcaaatatgaatggtaactctagtgagagcctacttgaacaggcttagggaaccatccctacaaacatgaagaagctgagatgcctcatgtaagtcacaagaagcagcagcatagaaatatgctcagaggggaatggggagttctggagggaacgccatgagtctggagactgtggctcttctgtgcggtggagcctgaccacgtgccccctgagttccttagaattcactaagtccatatcattcagaggttacaaaaccccagtttcaccaaagctacatgtccctggagctacaggaagcccacatgttgtgtagtgtgcagaaattctgttcttctccttcctgtaaactgtcagtgcactgtaaaatcaatagtagatggtgatgagtctggcctcaagaaaggaccctgaatagcactgggagccactttcaaagaatttaaatgtaagactaaagccaagccagcttcctcatgaaaaccagcctatctccaactgtattcagaaataattttagaagttaaatagtgattaatgtcattttacatcaggtgcagaaaggtgtagcttaaaactatgtgttggtttttgttccacttgtaccaagaaaataggaagaaaggaagaattaaagaaagaagaaaggaaagaagaaaagaaggcaggaaggaagaacaaaaggagggaatgaaggacaaaaacaaagataaagaaagagagaatgaaaaggtcattcaggaatttaaaatgtgaaccgcaaagtttcaccaggacttccaaacagcccaggcctaaggaagagcggctttatgaaggagtttccaagacaggtgagagatcacactgtgaaagtccaacatgtgagggttcacgcgataagcgtggagtacagagccagaacatgtgaacggtagctacacagtgatggacaaacacaacttattccacagctggtaaaatacttagaatatatctgaaattatctaaacacttgctattctgtcaaataagagagagagagaaaggaagagagataaacaattttcctttgaacagtgtggtacgaaacaaaaatgggattcttttgcaatgctaatttcaaaggtttgtttatattattaacaacatgaagatcctgtagtgagggagggtgtttttcccaagtcattgcaaaagactcattaaagaccagcttcgatgccatttagaaaccatttcccatcaattccagtgaaacattcttgaaatattagaatcctctttaccagggaaaataaaatgtccctttaagcttacaaactattagggaagaagactcaaaaataactaaaatgtgctacaaagtgaaaatgtttttttcttacaagaaactgatgagatgagttgaaatatctgatgatgaaaatccagccgaggaacaattggagaaccatccggctagatttcccctactgagtatggactttgagcatgtgcatatagacagaagactctgacatatgaggaatgagtgagaggcaacatgaagtccccactgcaaagaccctgaatgtcattaatccaaaataacttacagagcccacctgccatttcaatactgtgtcatctctgtaaatctgggtatatgagaatattttgaactcaacaatattcattattaaacatagaattcttctaacactttctgaaattgtttctttaaattagaaacaaagataagggtaaaatcacatatgctaataaaattctatgttccttagtccccctactatattttctttcatagatccgaaggttcatttgtaagaacacgtttccgtgtctacccaggactttatcacatgctcagaggcatcagatgaactttttcagtcgtgttctttttttcaataattattcaaccaactgccataggttatgtattggttgtttgtgagaaaattatatatttttttccagggacctctgtgaatggtgttagcacactcttaaatgcttatcgatgatcagtgaagagaccacagggatcccaaaaacccttacttccagctatcctgacttcccaaggtacatcttgaaatgctgttgcctccatgcagggagaggtgagggtgaatggactgggtgggtgggaaggcagcactgaaataaaagaaaaggcaccagagctgagcatctcctgctcccctggcctggaggcagcaagtaacagcagaaactgggggtagcacttcgtgtggacctggcagactccagaaagccagctttacatggtattaatgctcgtggtaggggctgattgccacacattgggtatatcagagagatgaaaaataaaatgattatcattaatatcagttctttcaatattttcaataacataaaaagttgcttttagttataatttagtattttcaatactttcactaattgacatcataaatgttcaagatttttctttgcagggagagagaaggcatggagtctatccaaacgctaagtaagtggttggttattttacagactggctcttcaggacgtcactatggaccagacaggtggacttccaggccaacagcatggcaaggagcttcctggaatgccatgaaatccaaaagtcagaataaggtgagttttgcagcaacctgcagaacacatccacgcttcattgtgcctgagcctctgctccgctgcctccaccagcaccagcaatggcacagaaactgcatcaggagcaaggtggggtgcctcacagtctactgtaacttctgccggtgtggaccaggtggaattcctgggcttcccaggcaagatgaaaacactcaagctgcttccaagaatcccacagctttatccagatttggaaagttgggcaatccatggtgaataattgtttggccacattctttttcttcattttatgaaatattatggacctatgcacttcttgtggaaggagcaggtctttcagagaaagtgcctattttcttgaattacaacatcatgaagatttacactccaaagttctaaagaaagactccttccaatgtgggtggcacatttataaaataatgctcaaaaaacaaaccaatggacttgtcagaaaaataggatgaacacaattaaaaacttcacaccctggctcattcaacaatggtcaagattttcacgatgtcttatttcaatttttgttgcttttaaagacgtgtatttttggcagcaatgggacactctggtggcttgaaatgcacttgaaatgtatccaaacttcgactctgaagcctcagaaacatgggcagtcatggggcacaggccttgaggaactggggatttacaagaagccaaaaacatgaaagctgttagtactcatcataattattgagatctgtaaagtaggcattagaataggtcttcccagtgagatgtgggttgaagtatttgtttctttcctctaggatcaagttgtttttgttaaatgcctggaaaatatattaaaaaaaaacaggtttaagaatgctgagtagcatttcagaaataatataacaaggatgactattatgttgaatttgagctctctgctaagactccatattttaaaatatgttttcttatttatttgcttccccagattatttgccccatggaggacttgcctaattaccagaataaggttggcagtttgtgatatcttctggttaagttttcaactttagttatgaagttaccacgagaagcaggaggtaagaaaatctaaatctaaatctctagaaaacctaaaactataatgatttcaaattaacagacactttgactgtaactgaatatatataactaaattcgtattcatataactgaatagatatataagcagctttcagatgaccatgggtgaggacatttatcggagaccttgatggaacttatttaagtaagggcctcaggtttcaaatgccttaattgcttttcatcctgaacttattagaaggtgatcactgtagccattttctattaatagtcattaaagtcacctgcagtttcaaagagcttcaactgagccaggtagaacatatatattgagaggattaaaatgaagatgaaggagggtgcccaatggccatctgtccagggttagtctgggcaaagtatcagacaaatgttctagaaggattcgttaaagactggacagctgtccgtaccttcaacgtcctttatcttcatgagagaaacatttctgattatcttaaaagtggctgctgaatcttcagtgggaacacaggactgggtaaattaccttctgatgcccatagtaacagtgatcagagacaagctgatgtgttggaatcatgctcagaggagcccctttcttgagatccaaatgtttgttttgaaagctgttgttcatggaaggagctcgtgttcctctttgggcttcctccctactctaggagctagtttctgagaggccaggaggggcgtgttattaattcctggtgcttcattccccagatctaccatctgagtgaggggagatgctcatggcttgtggatcttggtttaagcagggtccaaggggaaaagtcaattggtgtgtctccatacaggtggtggagaatagaggccacatggctaagagacaagtatggacattgtggctcctgggacataagttctcccagccacctgaagtcgtaaggactaaagatgtttcttattctcacatagggagaaaattcagtttcaaaggaaaccaccacagcagagaaagggcatcaaaatactccctacaagtgttaaggaaaaccaggcacttagcagaaatattaaaattcacttaccttgatggcctccaccgagtcgtacttgtccagtttgttgatgtggttggttatgctggtattaaggggggcaggtgagacggggtggatgacagtcgcatcgtgggattgctgctggtaccgctggcagtaagtatagacgagcagggtgaggaggcagccgaggatggagctgctcagccccacggcgatcatgtggaacatgttgaactctagggagacatgagcaaagtgatgccacacttgaaaagaacatcctgcctagctactcaaagcactaggatgaaaagagaaagtcaaaatgaaaagcttcatccccattccaaaattaaggaaattatcattcttaagagtctttcattggaaatgtcatggccatcaagaaacttctacacagggagcacaggattattattattattattatttgaaatggagttttactcttgttgcccaggctggagtgcaatggcatgatctcagctcaacacaacctctacctcctgggttcaagcgattctcctgcctcagcctcccgagtagcttggattacagacatgtgccaccatgcctggctaattttgtattttttagtagagatggggtttctccatgttggtcaggctagtctcaaactcccaacctcagatgatctgccagcctcagcctctcaaagtgctgggattacaggtgtgagccactgtgcctggcagagcacaggatattttaagttcattctcttatgaatgatagtcttttggagtgaccttaaactttaatactctaccagaagcatgtttttattattatttaaaggtttgcacaacagtgttctgcttcaagtgcagcctaatccatggtgtacagggtttctgcagaaaagtttattcatgcacctcaatgggttgagcctccctgtgcagcagggctgtgtcctgaaaacaagggagaagcagctacttttctaatctactgctcgcctgcaagccagactgcttttagctctctctccatttcatcctatttaaaatgttttctattcacataaacacatacacttttcattatattttttgagtatgaatatgcacacattagaaagtacaaaagggtctacaggaaaaataaatcctttcctagaggtaactattatacctagaggtaactattataagcactttctcccgtgcccttccggagatactcagcacacatgtgtgctggtgtggtgtaaatactatcctgcgtaccacttttctcacttatgttgtattttgaaggtcttgtcaagaaaatggtttactaaaaagaaataagggatttgtgttaaatgaacaaaatatgatattttaaatggtcatgaaatgaccttcttttcccctaatgttttcctatttaatggcatctcttctgtctcattattttcctgcagttatgaatacaaagcattcagaaaatttgccagcatggacttatatctctaaaataggattggctcaagtgatttcaaggcaccataccaagacctgtgttatgtcggagcaaacaaaagacaacagatattccttgtgtatgttggtgaaatactactattaaagtttcaagcttttccacaaatgaaggcagcatctcgtcagtgccacatcactgggcttcaggagaattgggtaaagtaaaacagggccttatcttcctctgtgttgttatcttcctctgtgttgttagaaccaagtggctgctgcccatggggtactggcctcatgtgccacctgctcagagcacatcctgaggacaccagctttccccagagtgtctcctccacacaccaccagggtgaggggcagtgtcactaatacctttccctgacctgtcaaccctgcacccagtgagacgattggaggtatgtgctgagcatcactgtgatgctggcaagtctacctggctgcagagcaaggcctttcaggctctggagataatgagaagagcctgggtgcatcgtaaccaccccagtctgtctcctccccagggattttctgagctgtcttccctgtgctcatgatcctccctacctggaagggattccaccctgccaatgcggacccacggggctctaatacttggtgtcaaagggagggtcactgttcagtgagtgcccacctggcctaggtctacggggctctgtttgagtccttcctgaacctcatgcaaccctccagtggctgataggccccagggaagctgaacctacagtcaggagatgccatcaaggcctcacctgtgatacatggcagaggtcggatatctctctttgtccctaaaccctgaacttttccctctaagctgtgctccttggctgctccagacaatgtgttccaggaacccaggactttggagctggatctgccccttcgggtgcatggacactgtgaagggaggctgctttctctctgactcactgtcaggcaaaactcacaacacattcctgaccactgaagtgccagtggataatgcagttcccagcacagtcctgatcactcactcactcactcacaaccacctcaacttttcacttccagcttagttggtcaatggtttcagcatctttggcctttcttgactctgtcttgaagcctctagggctggagaactgccaacctgggacagacagataaagtatccaggggacatttcaccagcagccactgggactttaactgtaacaatgacgctatacttagataagcaagagctgatttcacacaagttcttacttcttctctctctgacagagctgttagcactctcagggtcaatgccttcttctgaaggaaatacttcctgctgcaccggtaactcatgtttcattataacatagggaagatgcatgatagtctccatatgcagatactgtgtcattagtcaaatgaatcattccagcaggtgcctgggaaaggctggggccagctgacatctttatgatgattatatagtctttgtgtctcatgcaactaaaaatagctctctaagacaaaaaatttgaattgaagcacatttttctgcatggggaaagtagtgcccattaaatttcttctgattttctgcatggggaaagcagtgcccattaaatttgttctgaatgtgcttactatagttctttcctttgaatatgattttctgctgttgattttgatcagtaaagatggaatacagaccaactaccctgttggttcaattggctaataatttcctgtacaatgattgattttcaacaaaatgaaaaaataaacaagtgaagatgcctatgttgtcaaaaacatccttgctaggtaactgttttcaaccattagccctacaataagattcatctaaactgcctatgccattgtgccagtgccagcagcctgaagatctaaaaaaaaaattccattctgaatatctcagaatagttcaacttcctctgatttaaccaatagcatctcagctggttcagacacacaggagtagtattttagggtggtgatgggctttgcaccaggttctcctgggttctcaaggcccttgaaggtcttccacagggtaactgtgaggctcagcaggaggaaagtgaactgcacacgtctggcagcaggcacaaatacctagccagctctgctgaggcatcagctgtttgagcctcaggctctgcatggcctccctgagaatgggaacacttataaactctgctccactcttgacctacactgtcctggacccaggcagcagacagtcctggaccctgggtgttgtccaagtgtgttacctaaccagggctactgtggctcgagcctcccgaacacaatgcttttggataattttattgtcagggctcgtttcctacggtgctttgggttcaaaactcacactggatcccactggctgaattccatgtgtgcacttgggccagtgacatcatccctctaagtctcatggtctccatttataaaatgcagattaaatacataagcactgttccttttctataattcccaagtgcaaaatctctgaaaagtaatgcttcatcagtcatctggcattaaaatgtcactgacctgaaccattttctgtagacctgaccagaacttctaggaagacccttagcatcttcacttttttcaacatctcacagcagcactgttaaggagattggttgtagaacaaccccaggccctgtgcaggtgtcacgtaatatagagtaaaggccccacatacccttctaacaaacatctaaaagctgctgagttccaaaacccttctctatttccagaggtgttacatgaagaactgtagacccttggtgcctacatcaatgctccttgtgaggaccaaatgggctttgcaccatattcttgtctataacatgtaaaacagtgtatagcacacaattagtgatctaaaaacattagagggtactaattggtatgatcatttttatgtgaactgtttgcatattcatcttgtagttggatcccatgttagcaactgttagttagtgaactcactccactgacttagctcagacacctaacattgcccttctgaggcactggggtctctgatgatatgattgcttgtcagaggggctgggactgcgtgggtgcccatcctaagctcaatggccttcacaaaactgacacagagcaggtgttcagcaaggattactgaatgaatgactgaatgaatgaatgaactaacagactgctgactgagcagacagaatgtcacagatagtgagctcttctattatttatttatttatttatttatttttgatgcagagtctcattctgtcgcccaggctggaatgcagtggcacgatctcagctcactgcaacctccacctcccaggttcaagagagtctcctgcctcagcctctccactagctgggactacaggtgtgtgccatcatgccagctaatttttacattttttggtacagatggcatttcgtcatgttggaaaggctcatctcgaactcctcctgacctcacgtgatctgcctgcctcggcctcccaaagtgctgggattacaggcgtgagccactatgcccagccagtaagctcctaatcaaggtagttaataatggtagttaggaatgataagtacattcctgaaacatgcctatgaagcttcaggttccatgtgaacatgtcagaggcaatgcctgttgggctgggctctctgagacaccctgtggaacggattaggggagcaaatgggaatctatcatcatcagtcacacatgtggaagttaaggtctcaatgtagacattggctcggattctgaaaggcggacatgggctgttccttggtggctggacagccaacctctccatccaggcatgttcacaacacagacaagtactttatgggtatatgtaaggcacagactgtaaagtccaaatttatcatgtacttgaaccagataatgttgtctttgacattcagggtggcaggaggtttgaaaaattcctctagcactataggtataaccttatgcctcattacaatttagtcatttcagtgggttggagattggaagctagctgccatggatttgtattataaatataaacaaattgtttgaattctactttactcatgaaattaactatagtgaataccgagaccactggttcataaagcttagaacccataagaatcacctgcaaggctaattgaaccaccaactgctgggaccttcccatgaggtcctgattctgtggatcaaggtggggcctgaggatctgcattcccatcaagttcccaggccatgccctggacgtgggtctacgcaccccattttgagaaccaccgatcggtacatcaaatattgactattaagcctttatgccaaggtagaatgcctgggatccatgactttctccggtttttcattcttggccaagaggcagaaaaattatagaaaacatgcaggaagggaaatgattagaatatatcagtacatccattacaactacttaaaaggaataacgtacctccacaccttttctcttctacgctactggatcttgccacagatacttctggaaaaagaaaagtcgaatcacaatgtgtaaaaggtgttcagaagacagtccacattcatgcttcatgtatgtttgtctaatgattctgaatgttatgtgacacaaagtttcaaaagcttgattaattatcagaaaaattctacttgtttctttgcttgttttaaccaacctgatatggatttggccaaatcaccttgactggggagagataagattcatttatcacagaaagataatgctatggtctctcaggctgaaagcagggaatgtgctcattttccattacaaggtgtcttgccggggggatccccccactctgcccaacacacagagtactcctgtggtattcctgcttctgagacttgttccatcaaagccagtgttgtcaccttcccggcagagggagggcccattcaccagagctcaaggacatctccagaacaagtgaagtccctcttcaggaggccactgatgctcttggcatgccacacatgaaacccacagtaggatgcagagagaggccacatctcatacatgttttaactcctgaggataaaatatcactcggtagtctagaaacaccattctttcctgtactgattttttgttagacaacaagaattaaaaatatgtctatcgttaaaaaggaaaacaataacaaccactcttatagttctgtgccgtacatgactgaggtatggtatgctaattttctctaaaatagtatcttttgcacagacgaaagaaaacaaagaaaactggcttatagaattcaactctactatttatttgtaagaggctggtccacctaacagtcctaaggcacacagtggacatatgcgcaatgatctatgcattcatatagcaccttctcacagtgagcatgcaacaagtgatcagctatcaccaacaactacacactgactttaccatgagaagctggttgaatgagggccaacctcttctccaacaggagaataatgatgcatttctaccttctcaagtatattaaagatagcataaagagaatggtgctttttctctgtgtgccagtgcatacacagcgagcactgcctaaacatttaacctaatattaaaataaccaaataaccaaaacatatttaataataaccaaatattttcatttttttgagcaaagtcttctgattgcattatagttgataaactgcaaaagacacttttcctaagaaatcttaaattcatgaactgaattcatgtttaaatctgcagttatctatagacctacgttttaaacaccttgaaaccatggggcttgatggaatcatctctatttcaccaaataagccaaataaaactctgacctatgaatcattttctctctccatgttggaaatgattttattcttactgataaatacctctgctcttacctgggatgaaattagagtcaaacacacacggccggctctccgtggtgttcccggagcactggctgcccatggggaacaggaggatgcactggcgggcgcggacttggacgccagaggcttcacactcagaccagtccgaccactccgaccagctctctgcagagaccagaaaaggggagatggggcggaatggccagtaagctcaatcatcctagactcactggcaagttacatatgtgatttctggattccaggattccatagcatatttttaatggttctgtgcatcagtaagatgtagttgtatcatctaacagatccagtacatacagtacacacgaggatgaataaaagtgcctgcgctgttatatatttgatcagatatcatgagcttaaaataaacattattttaacgttataaagtaattgtatttagacactcaataagtgaatccatgagacccagctgtgtgcagaccatcagcagcagcggtacataagtcatcaatgcagatgccattttgctatgggtaatgctcccctcaaagaaactcaaatgctttcctgaaacattcctgaaaattctccaccttcctctgtgctcaggcgagagaaataattgtgtgctcatgagagtcctgggttgctgaaagggagtctgaagctacacaattactttcttttctgttataaaaacaattccgcagagtcaacatgccaaagtcaggtgacccttgatgtagaattcatcttatctcgtgtttgctgtctctgaagagataaggtcaatgcacaagtcttgggtcaaggccaaaagaggggcattgaaaggatacttcatcccgaagtggaagatttactaggatgtgtgaaattcacccaggcatacagatgtgtgaaaagaaaggagtaagactcctatataagtaagaaggttaaaaaaaaaaaactctggatattgtttatggaattttaatcaggataaaaaggtatttttctatgcagtttgcttttttcccctttttaaatagaagcatccactttgtagtggcagggaaaatttgaaaatcaaacttgtgctttgctccagttaaagggtaaaatgtttccttagaaatgcagaaagtgccagtttttggaatgacagtgagaatctggctttaaggcccttttcaatatacatagaaccttctagaaagatgtgcaggagcaagctaaaaaaaattgtgtgtttcaatgtcaaagttagaccaagaaaagaatagctcattttcattccaggtcattccttcatgtcagtaaaccaagctatttctgggatggtggtggtggtggaggccccaagcgcctgcatcagccacagggagcttgaagcgaggagctcccacacccacgggcccaaggctggctcctatgaggtgcacttcacagcggtgctccctgctctccaccctgattttcaacaacaaaacctcagactctgttattaggctactggctttaagaatgctttgctatcaccagtttctgttgtttgctgtgctcctccacttactgatttgatgtcatgctttttctttcctttaattgcactacctctaaattacagcccatcgaccatggatgaagcatcctgcaagagtgcttagtgtccccttgtcacattttagaagtcattcctggaacacaggtctggagatctttggaagacatgtggctgcacccaggctggttttgagacaaaaaggctgcaggcgatttccccactcagacctccagactccatggggggcactaaaaatgttcgttctttcccacctttccttggactttctccctcaacacagcaaggtgtcacctgtgggtcactagtgttaattagcaaagtcaagaataaattgggatgtttcctaattagggagattgggtgttgtaacatgccatagattcagaactcgtgcttgaagcctttagcactctcccattgctgggctaaaggctttgaacacgagttctgaatctatagctcagtgagaactattttattatagatgctatgttttaaagtcacttcaagggtaatagcatgttgctaacttgcccacccccctttcagtacttaccatgatgcagtatcatcaattacaccatttatccattaaggaaagaggccaatttgtctgaaagctgtgcagtaggtgaggtgccgcttacctgggcagggctgcgtgttgcagagtgcctcttctgtgtgcagccccaggcagatgtcccctccataggccggggctggattggagcaagagcgggtcctcatatagtgtccaccgccgcatgttgctgaacattttgtccagggggaccagcaagaccacacgccatccactgtgaagaaacacaatgtcacagctcttctataatccaatcccaaccaagtgaaaggagttactaaatggaagctaagtggattctgtttagtaagggaaacaaaatggaatctgcactccagaaaggcttcagtgcataggcacacgtagcaacaaggcttctgacccctcgcagggctgcatttggagtcttcctcttggtgacagatccagttttacagattcctccctacactttttcagttccctttattcactgtttcagaaaacatttctaaatcaatcgtatctaagtacaaacatgacagcagagtgcacgagctgtcatagtaattccagcccctgagaacaaccatgaaccaccttgtacggttattgatgtaaagccccagccagctctcacctttgccatctaactagccagacaagacttaaagccaaggtaagtagttcaagtcacgagctcctttactaattggattatggtttactccctgacagtgggatagagaaaagctaacacgtcccatgaggaaggtaactgaagaatgctcggtaaattcaggcacagaatgaccaaattaagtacagccacacagacttgacactatgtttaaatgactatagagaggaatctgaaaatctgcagccatatgtcagattagatattaagggtgcagttttacaatgtgaaagttaggccgaactggttccttgactaaccatttccatgacagctcacaacccagcacatgtctctgcctgctcaagttagcctcctgaattctttaggctgggctcttggtacctgtagacccgcctgctgaatgctggggtcaggtggcccacctgaatctgggagactttaagagtcagtcctttattagctgatcttgctaaaaccaagacctcatgttggcttgggcttgtgacaatgtcaaatatgattttcagtttagctaactcctgactgtgcctctctcttactagccagatcttccttgttattgctgagtcccaggacaaagctacaggacgttgtcaaacaaggtattagatcctaatctggggttaagcacaaattgtaaccacagctaactcaattaaaaagctgaggagagactcactattgctgtatgtagacagtatcatattttaacattctttgtagcctacacaaagaaacaggagcaagaggatgccaaaatcattcagggcataagattgttttagctagaataacttagattgttttttaatatgcctgtcatgatgtattacatcattatggtgtaatgtttctttttagatattggcaaaggtaaaaagaaagcatttttgagaaaccagagcaaaaatatcatctttatgacaatattataatttgcagaaagtaaaaagaaaacaaaaatatttgaacccaatttagaaataagtttgcaatctaactggaaattttgtgattcaatagtttacacaaacttgcagaattcaacagtattttccctaaaagttatacggtatatcagacagttagaggaattgatcaagtatttgatactggctgtaatatcagcaataaaaaagccaggcatgtgttttcctagaactttaaaaattaaaaaaaaaaaaaagctctctcccatatctattctcactgaaggaagcacttgctgacagtttttttctgtttgtaacctaaattggagcttggcatcagtgagtacccttgcatgccccatacaccagggcaaaaataagtcattgtgacttatagtaatggcaagtgtcttagatcttggctttctaaatgcgcacaaggcagctcagggctcagaagggtctaatgtgtgccctagattgtgtcagggcctgatgtataaccaaccatgtgttctgtagatccctggcctctgtatggaatgataaacctgcagatgaatggccgacaagtgtgtgaaaagatgctcagcatcatgaatcaacagggaaatgcaaatcaaaaccacagtgatgtatcacctcacacctgccaaaatggctattatccaaaaaacaaaagatcagtgttggtgaggatgtgaagaaattggagcccttatacactgttggtgggaatgtacaatggtgcagctgcctcggaaaacaatgtggagggtcctcaaaaaattaaaaacagaggccgggcatggtggctcacacctgtaatcccaacattttgggaagccaagacaggcggatcacctgaggccaggagttcgagaccagcctggccaacatggtgaaaccctgtctctactaaaaacacaaaaattagctgtgcatgttggtgcaaatctgtcaccctcactactcaggaggctgaggcagcagaatcgcaggaacctgtgaggcggaggttgcggtgagctgagatggtgccaatgcatccagcatggctgacacagcgagactccatcacaaaataaaaaaatgaaaatagaattactgtaagatctagcaatcccaatcctgggtatatatcaaaaaaactgaaattaggatctctgagatacatttgcattctcatgttcactgcagcatttctcacaataaccaaaatttcagaacaacctaaatgtccatcaagagatgaatggataaagcaaatgcggtaggtacatacaatgaaatactattcaaccttaaaaaatgagatcctgccacatgcaacaacatggatgaacctaggggaggacattatgctatgtgaaacaagccagacactgaaagacaaataatacattattccacttagatcaggtatctaaaatagtcaaactcatagaagcagagagtaaaacggtggttgccagggactgggggagagggaagtggggaattgctgtatagctggtataaacttccagttattcaaaatgagtaagatctagatatctactatacatcgttgtatacctatacttaacaataccgtattgtgcactcaaaaatctgttaagtaggtagattttatgttgagtattcttaccacagcgaaaacaaaaataaaaacagagactaaatgtgctcatttcaacggttccataatcatgcaacatctaatgatctcataccaggaagctgatgtacataatatatcctgtgatattccaaacaatatttattcctgtccacatttctaccaacatgtaagccaatgtgtatgtgatctagtctaataaatcctctctcacacatacaccaactgtccatctggtatcatggtaaattctcctggcacaggatcatttattgttaaacagagagaatggagctgttgtttgaataaccgtttaagagagcatttggaacagaatccagttgctgaaacattcccacttgggagttcaaatcacaagatcacactctacctctaccaatttcagcagtcaaagaactggggaaatggatgtttctagtacagagggaactcaaaggagacctggaaccacttccttactctgtccggaagttgcttagtctgcaattgccctatgtccccagaccaattctaatgcggtgcttgctttctgtcctcttgaccctgtctttatgttacaggtttcaacccacatcatggagccataatgtaggatattgattattgtactaacaattcatattagaaaggccaaagcatttctaaaatagacatttcagaacacagatcttaatgaaatagccttcatcacaagggagcctgtacaacctggtggggaagtagaaagttgcagggccaagaaaacaaaacaaatgtaagccactgtggaaggcacagcatgtcaggggcctgagtgaggctgagccactaaaatagatttttttcccctgctatgtgaactatattggactaaaaaaataacattagtaatagtaataattaaaataataaactcattcaatattccatctccatcctcacaactgccctgggggttgttccagaaatgaaagacttgaggcatagagaggttaggtcctgggcaagtgagtgggaagctggggctggaacagtggcaggctgagcacagaacctgacacacaagcacaggttagggcttcccataactcctcccatgttgctaaaaatcacataggaatctcctcatggcttgaatcatcacccaagttagctcaagaaatactggttcatgggaagatcagacaaacacaaactcagatccatgtttctttcaaggaatcaaagcaattaattataggaaattatttttgataaaatgaaatttatacatgaaataacttgacagaagaggataacattcttgttgtagagattctagctaaatattccacccactacagtaagattaaaaacaatggcagtaaccaatgtacaattgccagagacctaaatagcaaagtaaaaactaaataactaagatttgctcaacaggcttcctgtgtgtgatcagagatgtgaagcccttcactcacagtctctcgggacatgggcaaatgtggtattgattctccagcatactgaggtctggactacataggtttgcactgcaggacagctgtgctctctgctcctaaggatctctaagcagaaatttcctacaccaactgccccctgcctggctccacttcaaagtatggactcaaggactccaagaatgcaaaggaagagagggttctgagcacaccagagatgcctaagagatttatctataggacacacaactgccagaattattcttttgactcagagtctgtccctccattagatttagtgttccttcccccatagaattattgtttgcaaaatacaaaacagaaccatctcagttaagtctgatgaaaagagtttgtgtttacttcattaggtttttaccttcattttcttttcttttttttttttatactttaagttttagggtacatgtgccaaactctgaggttgctttcctcttagctgaacattacttagcaacaaaaaaacatctgttgtctgtacctttgtaggtcaaagtctggagtctttaaggctaaatcaaatatgcattgaggaaaaggagtgaagaagaaataattagctatttctcaatgctggcgtaaattatgtaggtgaaggtactagttagatggacccacagaaggtgaaaaaaatgattatttcagcatgggcttgacttagaaaccttattatagtttatttatacacatcagtcttagaggtaaaattttttcattgattaatttaaaatgtgtttttatattctctggtttattttatttttattttgagacagaatctcactgtgtcacccagactgcagtgcagtggcatgatctcagctcactgcaaactccacctcctgggctcaagcaattcttctgcctcaacctcctaagtagctgggattacaggtacatgccaccatgccaggctaatttttgtctttttagtaggaataagtttttaccatgttggccaggctggtctcaaactcctgaccacaagtgatctatccaactctacctcctaaagtgctgggattacaagtgtgagcctccatgcccggctgatttattttcatatttaattttaatgaggaaacatatttttaaataaaatacagtgtccatttgtaattgtccactatgaacccaacagggttaaagaagagtaaattcacaggggagagtatcctgagtgagacaggaatcggcctctaactggcttcctggtgactgtgcagctcagcattcacacccctagcacttccaaccctccctgctgggtcatgcccgatcatatgtttaggaatttcccaggcaggggaagcaccactcagccctgactcacccactgcctagtgcaaggtgacatgggccactctgaataactccacaacactctgcagaatcttggcttttaaaacgaaaatgaggacagggttatttcaacatattaaagttatgtatacatggtattggcttgaccaccaaatcaactaaaatgagagcaaccaacagatcatgttaatagagtgtctctgagatgagtggtgaccctttgtacttgtgcactaggacaacatccaagtgtctgcaggaatctgcacatcctacccatggcaacaaggatagggtctggagcccagggagacaagggtgggtggagggaccctgacattcccatgacgtctgcccctgttccagtttatagcatggacccgaatctagtgagcttgcccacaggattcctctcagcccccagaggaggactccttttactggggctgtgggaaagaacagttcagtgacctttcccagcctctcagcatcagcttggctgggaaagctgggtgggcagaggaggagtctcctgaggctggagaaattcaagcagagacaccctaggaggagccaggcagctgataagagcagaaacattattgggagcctcagctacaaatctggaaactatatattttcagttttatatacatgtttattcatctatgcattcatccatccattatccacccttccaagcacccaatccaatgaattttcattgagtatctgctacaagccagtttcttgatgtaagaactcagaaagttgtatctactagaaatatgttaatattctatgcctttaaaaatgttgtatccaactccagaatgagccttcctcccaatttcccatctctgcttgtcaatttcaccaactcgtttctgtccctcgagacccagcttaagggcagcctgcttgctgtggctgccatgatttctccttggtgaaatccaccaaggggctggctccttggtggatatagccactgcacctggttgtcataaactcagtagccagtggccatactgggttgacgctgctcccaggatgcactctccctaaactcttaagtttctttctgacctggatcataacactgcatctgtgtataccctgtaaacagtgcacagtcggttactcaaaaatgtttcctgagaaatgacatgaatgaagaaagatcaattaaccaactctttgtttcctcattattaaaaaacaatccctgatgggtatttctagtatgtgccaggcccctgctgggagctaaggttgctgccatgagtgagaccaggccaggagtccctgtcctcatggagcttcagacaaaagtcaaggcagcctccccagtcacagatcagccctcaggatggccatgacgtgtgggctgaagactttccgtgggttctggacaggagagcaggaagtgggaagttctggtggaagtgttttaggtgctagggaccctgagctgcggcaggagaaaggcagaaacaggggcttgaatattaaagggaaagatggaggagtgtttcaggcattgtcagagcaaaagccctgggcgggggctctttcggctcattttcatgactctgtgcttgcttgggaattcagtggaatgaaaagccaggccccaggaagaagacccagaaaaacagctctgctaggcccacaggagagaagagtttgcgtctttggaggacttaattaatgaggtagaccttttgtgacagaagacatgaggaccaagaactggcttggcaggcccagggtccaggggttgcatgtttgatacccgtgaccctggatgaccacctgatggtacatggaggccatgtgggggagggctgggtccatcagtggcccaggaagggatcagcctccagaaggagctgatggtcactccaaaggccccagatatttcagaccacattagaaaggccggcttttccatcaggcacaacaactagagtccatatccttcgagtagctcataggaaagttttagttccttttacaatcagaagaaaaaaacatgaacacaatctagcctagatgatgtctttccccaatgcattagggagtggggggcccctgcagacaaatgtgcccagggcccagggaggtcccactgtggcccggcctatcagatctttttatacagacaactaaagttgcatgcttgtctgaaaggagggctgagagaatggtcttaatattgcttggaatgatttaggatttggtttcaggtctgctgggagaaggggtttctttttctttcctttttccactctgggctaatccaacaggtgatgacatcacacaagacatttatttatttgtttgtttatttacttttgagacaaggtctcgctctgttacccagggtggagtgcagtggcctgatgatggctcactgtagtcttgatctcctggactacagaaatcctcccaactcagcctccagaatgactgggactacaggcgtgcactaacatacttggctaatttttgtatttttcgtagggatgaggtctggctatattgcccagccttgagttcttaggctcaagtgattccccctctctggcctcacaaagtgctgggattaccagcatgagcaaccacgcatagccaagacatttattaagaacacagatctcaaacacgaagccagggagctgcgtgaggcctggtaaattagaagactctccaaggcccttgagttttcagatgttttgtagactacacaatccacttacctgggcagggcaaaatgttgcattcctggtattccagagatgggccaaggcaaggcattcccccatacttgggttcggggttgttgcaaacacgcttccggttccgaatgcccctgctgcagtcacggctgcactgtgaccacgacgtccaggctgaccaagccccgttgaccgtgtgggcagagtatctcccagcacgcaggaaatccccagaaagccctgccaaggaaacaggtgaagtgtgattctgttacaagtttcagaggaactacagtccatgctgactttcattctgtatctgctgtctgccttatttctagaactaccctctcacattccgttgagctctttttacacttcagtagccaaaaatcagtggtgtgatagcctcttatctctcaagcttgtttcctgcaattactatgaaataaggttgaaattaagaactccatgtgaatgtggtgaacctttacacagtaaataatagattctatataggtagttcgtttactttttgaagacacttcttacaaagaaaacacaactttctcactttccttgggaattctacaacaaactgccctcagacacaatgggtagagcctgccctcaaggacctccatctggaggaagggaaacataattcagacattttctaaacctattctttcagctgttaacctttcaaaggtgaattaatgctggtaaaaggggccaagtcaactgcttctggatcacaggcctgagaaactcctgtctgctctgtggaactcatgccctagaactgaacacagcactgagtgacattggcaaacgtttctatgaagtttagagcacactacctaacaaaatgtgtttcccaaggagccaagagaggcagcagcagcagcaggtgggctgtggggtgagtggggagttgctgtggcaggaatcacagccaacaggctttgaggacatattgtgggtgatgtgtacagtgagcactttcacttgttaagtcacgtaattagccatagtcaaaattttatgaaaatgtcttcccactcacaatactaaaaagtattcaataattttctcaaatgtaggcaatgtgacacaagctttaacaaataactctaaaagtatgcagtaaagttccggggaagtgtgctcagaagacaagtgtgccaacagctctcagtgttgttaagcaactctgttgtttacttagaaaatctgtttctgaaaggatggcagcatactcttcagagaaattgaattagaattgtctgtctgtgataaattagtattctgtggtgaatcaataaagaaaaactatgcacaaatcaagcctcattttatgtggtcagaggaaaatgagtcccattttgtgttttcaagatatcaataccaaaatgtgaaatggtcatgagaactcaaagccattgagatacagaagaataaaactctatgcgcacgtatgtttatggaggcactattcacgatggcaaagacttgaaacctggccaaatgcccattgatgatagactggataaagaaaatgtggcacatatacaccatggaatactatgcagtcataaaaaaggatgagttcatgtcctttgcaaggacatggatgaatctggaaactatcatcctcagcaaactaacacaagaacaaaaaacccaaacactgcatgttctcactcataagtgggaattgaacaatgagaacacatggacaccaggaggggaacaccacagaccggggcctgtcgggggtagggagctaggggagggaggttgagccatgattacaccactgtactccagcctgggcaacagagcgagaccctgtctcaacaaacaaacaagcaaaaaccaaaaaatttcatggggcttagtcatttaaaaagttatgtgggatatacttttcctgaaaaggattcatgggatatacttgtactagaaaaaaacttctaaaagataactgaaacttgcatttaaattttgtgcttcatctcaccaccctaggtggaggtcacaagatcatcctttataaaatgtgcatatttaagtcctcagttatctttctcttggtatttcatcatataccttctcttctaaatacagcaagagtttacaaaattaaaaagagtgactattattttgttacccatttttccaggtgagtggtatttgtttaagttgtacataaaatactgtatgaaagcagacttttttatttgcttcaaggaacaatgagcttgggtaatcactgaactacagtgagcagtggtgtgaggagaggagagagttaatgtcagtgagagcaataggatgaggaagcaggcttgtaaagcaagtggctcctgctgcacctgctgggcctccaggcatccaggctgttcaccagctcccaggagaagtcatggtgatctgtgacacgagagcagctggtggccgtcacacagagccacactgtctcagagccttccctgtggcaacaccaaggagatctaccaaacctccatgaatttatcccacaataaattctgtccaacgtggcaacacaccagctcggtggcacttgtccaggctatccactctgggtaaaagaccccttctctgtaaatggtggctgtcctttcgtgttgggagaataaggtagaatcacctgtgcaaagatgctaaggcagatctaagaatggccacaagatataacaatcactgttctcatcaaactgtgtaccaaggacccatctatgagtatctatttccttttctgttggtatcttttcctttggaagagattttgcccaattagaggaggctgaaaaacagaaatgaagaacaaagcaaagcatcaagctcttaaggaccaccaggctcaattcctttttctgcagttgagacagcagagctctaggaagagaaagtgaattgccccaggtaaaaggaccacttggtgttagggccaggcagaggccagatctggtttctgcctcagggctttctccatgctattactatggcattcaagggatttactcaattataaggagcaaagttatttcaaagactattctagtatccttacacaatgtgctttttaaaaacagaaacatccttttataggtacaaagagaaatgcacttccattgcctttgtgaagttttgggataaataaagaaaaaccttttttcagcttacattttagtgccagaagatgtatgaaagatcagtgatgcttccccagtacattttctgatactgaataaatctcacacaaatgattctgggtctataataaatatagtgttatctgggggcctgatttcatagtatcacttcaatatctaacttcttacagtaaggctcctttctttcaatttgtcctacagtcagttgtgctctacagggatcattgttttcaaggctgctaagccataaataaccaaaaaggaaaatgcccccttgctgtttatgaccttagagaaaagatcaaaggcccttccatggaagtgggtcagtccccacggaatcactactcaccatctgtggagcagccactggtgccgtcgctagaacagtaccgcatttcgattctctgtcttcccacttccagcaaattcggatcagccaggcgggctttgcatgtgtatcggaatcgttgctcatagtggccgccgttgtcagagatgttgacaggtgtccagggtgtccagggcgtggtcttcttcagctcaggacacgggttggtgttgcaagactggtactcctggggagaatgcgcagacgagtgttactatacggggtaaacagagcaacctcacgaagggctcctttcctttagggaaagataagggtctctaaaacaccagctcctaagacactcacagctactctaccaaactaaaaacacatttatgttaaattaggtattcaacagaatgctcagtgttcaagacatctccaaaaggaatccccacagtctctcctgtgtaaacaatgggaatgagacaacaaacttaattgcttgtgggaaaaaaacccaccgatcccataaaaatcgtcttcctttcacttaatgagtagctaaaagtacccattattccgatgttaagtttagctattttctttaaaagattgatttgtaaacctcacaatattcagtttgagattaatggatgttttaagacctgggatcacagatgtgaggtgttagagtggtaggggagccacaagataaaatgatgcaagagactttttttacgtataaggtttcccatcatctcacagctaacaccttcaaggcccttctgagcttctcctgagagtacactaaaatgtaagttctgttccctccctcccaggtacctcccttgtaaccacaggtaggaggatcctgggtagctgaacatgcagtggctttggaggtctggcacgtggagatgatgaaaatctgcctggagcacctactgatttatttgacaagcattctacatacaattgctgcagacacagagcccaacaggagggatacaggagttgaccttggatacagtgtgacataatttctccattttacaccaacgggtttcactggagggaaacccatacacataatacacctagtgatggccacaggattaaagatttttaacaatgttttattaataaaataagaattaaatcactctttaagctttatcataaaataaaataaaataaaataaattgctctatcattcctccacctctttcagttgcagattttgatacttatctccatagagctaaacttgagtttgggtccttttggtaaaacctttgaatctacaaattcctttggttttagaaatattcttgattacttcatttcatgctctccctcccttttcttgctgcatctcttatcttttggatgtaaactcatttatccattttcacgtttctcatcttttatctcatagtttccatatcttcatcttttgctttagtttctggaagatttcctcaaccttatctttcaaaatgatgattgaaatattcatcttctctactacattttaaatttccaaaagcccttttgtgtctttttttttggttcttgattattccctgttattgtatgctattcttatttttttggtcacactactttctccaatttgagcacattgatgatttgaatactctgagtactttgatgaattatttcaaggttgtagtctttctctatagcttctgtatcttctaattgctgaattccctttgcttttttggatctctatctttcttgttagattgtttcttctgtgatctgaacagtctttgttttctgctctgatttagagtggagggctaaaaagtttaactggaaggtctgtagcacagagaagtctgtagacctggtcagatctggttgagatctttaaacagaatttaagaatctttgtcagaatcttaaacctttcctgctggactcttcagagacccctgagaagactgctccagtgtcttgcctgtctggatgctggaggctgagccatggaggatctgggagctgagtggaggaagagggcagaactctcagtgtccagtagacacccacttatctcactctgccgttctcagttctgaagcacccagttaactgagcccagtgctcagaggtccagagacgctctgttttcctctccagaaaataagcttcctatcatctgctggacagagcaggtctagtccccttggtggagtgggagagaggtatggaggtctgataacttcttaaacagaagtcacccaatgttgttttgccactaacaaaaaaaatggggctgtggattcctaagctctctgaggggtctctggtgtgcattgagatgattattttcatgtatgtgctgggggtccccaagatccctccagtttctatgattagatagcaggatccataggactctgtgtgcagcagtgttctcagctaaaatgtattacggtaaaagactacaaagcaaaatcagcaaagagaaaatgcacatggggtagaagtgcagacaaagccaggcagcacaaccaagagtcctctctcagcagagtcatgaaggatgtgctcaggtcgcccagcagctagttgtgatgacgtacagggaaggtggtctaccagggaagctcactggagacttggtgctcagggttttcaccggggtctggttgcagaagcatccttgttttgcatgtaccaaaagttcagattcccccaaggaagctttcagtatacaccacattgtttgtacagacaatttaagcacagagagccattcttgccatctgggaatggtagaaaccttcctgaaatccagattcccagatgccagccaacagctagccttgcgagcaggcctttctaagaatcacaggactgggaagcattgtcttccacatagttctcctctgttagacttgaattcatgcttcttcgatgtatttccagattctactttttaaaaacaacatggttctttctctttttttctgactttgcgcattcatgccttgaaaaatcaacccctctaacactgtattagtatgtttccagtgggatagaaagcaacttgtgtgtccatgccaccaactttacctgggaacctaatacaatctttattttgtactgttttaaatactctaactagctttctttactcacaatgcatttattttttattttttttacagcggataacactcaggatttttgtgacatcataggcttttaacagaaaatatgtaaggcgatcatcgctgtttctttgatttaatactctctaggcattcctcccggcctgcatgatctctacatcaacaaatactagaaagatagatgacttcattttcttgtgtttatagcatcttttattatggcatcttttgaatgctgcctcttaaatgaaaaagccccaatgaatgccataaacccagtcatgtgaaaagccaggcacaacgcgtgtgtgatctctttcacttggaatgaaaaccacatgacaggaaagccataaacccttgtcttggaccctctgtgcctctagtgtggggatgctctcacctctggattgagaatgtcatatgccactgcccttccctccctcactccgagccagcctggccagataagaatcctggagttccttgctgaaatgggctcaaaacacatgcagctcggccatgcgtggtggctcacatctgtaatcccagcactttgggaagccaaggtgggcggatcacctgaggtcaggagttcgagaccagcctggccaacatggtgaaaccctgtctctactaaaaatacaaaaattagcggggcatggtggcaggtgcctgtagtcccagctactcgggaggctgaggcatgagaattgcttgaatctgggaggcggaggttgcagtgagccgacattgtgccactgcactccagcctgggcagcagagtgagactccatctcaaaaaaacaaacaaacaaaaatcatgtgcagtttatgggcctctgtttgaaaagtgctggtctttaggtcttaacaaatgcagcattacctataaattagtaaaatcctacatcttcataaacagatttataggataccaccaataattcttaggtttcccacactgcaaacttcattctttctatggagatgaagtttaatttttgaaatgtatgaggggcaaatgtgtttgaaagctggctcaagtgtctgcattggcatctgtgtgttggtcccagaggtgggcacagctcacggctaagaaagatcagtttagtctcttcagatctaagcctccaacaacagtctgttcttatgttcttattttctcatggttcaaaatttaacatgagactcagaatttctcctttcaagtgctttttgaggtttaattatgatacattcacttgaagtatcaaattatgaaatggtgagaaatggtatggccaatttgttttatcttaatgagcaaaatcatgaagtgatttaattctattgtgatcacttatatggcttaactgaatatgtatgttacaatttactagagaactgctgctgtaactatccaaatgtaaatggaactttaacaaaactgcacttaatactaaagagataaatgattttaaaaaggatttcaggaagctaactattatgatttggcacctaaggttcttaatattctggtgcaaaatatgagataagaatgcttactaaagcaattataaataattcctccaaatatgttccccacgtattatgtattccagtcaacagtgataaaagcactcatttaaatgtttaatcctgcaacccgggagacactctgccagttctcccttacttctatgccaagtactacagtcatggcttcctgtgttccttctgtcctctccatcttaattgcctcttctaattcaggcccccatcaccataggcctgatttagagaatcaaagcatgtagttccttaaagcttaagtgcctatttataattctgcatccactaatagactgcaaatttgtcaaaagcaagaactttgtcacgtttattttatattaccaatcttgggcatagtaacactatttggtaaatggataaatcatattgattaagtaacagataagtctactgagatgaaatttgcatacatttggggaacagatttagatagttaagtgggacctcctgttttgctgtttatttttcccttgagaaaattaaaatatctcatatttcatacattgcaagtaaagtagagagacagagacaacccaagcagaattttgataccacatgctcagagtgaagcccaaaaattacccttcaagtcatctcatccacaactgaatatgtaaatcaaatttattctcatatggaatacttatggtttccatatgcatttatcaagttctctttcagtaactaagcttggcctgctgagactgaaagcaattcacattagagaaataacaaagtaattgaattgtgcttgcaaagagccaaaacactcaagtatctacatggaagtagaaccatgctcccaggagcttgtggcaaacagaacaaagattgactggaagttctggaaattagtttagttgtacccagtaaggaaggtatataaaggaatgtggtgcattcaaaattatatggtcacagagtgtcttctgtttcccaccaatatggagtaagagaaactggattaacccttttatccaaataacaaaaagttatattaaataatggttcttaaagtactggacttcaggcaatgaaggtcagtgatcactgagtaatgggagacaacttatgggagacccatgagtgccacaacctacagccttgagaaggttcccaggccacagcatggggagcagaaacccaggcacaggctagagactgagaagacaggtttgggagctggagaatgccaaagtggctgaaattattggaaaggagaaagttgcacaaaatgaacacaccagtgatgtgcaaaaatcacccatcacgatttcaattgagtacaaatcaggtaacagaggttttgacttaaaaaatcagcaagttcatgtgagaaactacacaggaatagggaaagatctgcctgaaatgatcagagggaacactgtgtgttacccacacaggaccaggaacagtgcttgcttcaaagagcaaaaccaaaagacctcataattcaagggtcattggttggataccaaaaggggccttgcttccacagtggggaaaaattactgcagactaaatgtggctttgatcccaagtaactaagactaaaagcaagcaccaaaaccatcaaactgtttttacataacttaattatgtcctcaaagagaaccttagcatatttttaggacaaaaaaattgtctaccagtttaaattcacaatgtcttgcatccaatctaaaattaccggatatggaaagaggccaaaaacatgacccgtaatgaagagaaaaatcagtcaattgaaactgatgcagatatgacacagatgacagaatctgtagtcaacagcatcaaaacagtaattataactgcatcccatatgttcaaggaagacctcgaagagataaggaagaaacaacttgcaacatgccagctgtaacatacaaaatatttgcagataattgcaaacgagacagtatctcccaagtcattctatgaggccaactttgatatcaaaaccagacaaagacagaaagaaagaaaactacatgaatgtagttttctattcctcatgaatgagtattcctcatgaatgtagatgttaacattcttaaaaagaatttaagaaatcaaacccaaaatatatcaaaaggttaacacctcatgatcaagtggctttcatgtcatcaatgaaagactgggttatcatttgaaattcaattaacgtaattcatcatatgaactgtatagaagtaaactcatgtaataatctcaatagatgcaaaaattattggataaaaatcaaaattaattccttataagaactctcaatcaacttggaattcaaataaatttcctaaatctcatgaaggatatctattaaaaacctacagactgaatcacacttaatggttaaagcctgtgtgctttcctcctaagatgagaaacaaggcaaggatgtctgtccttatcacttttattcaagattatcctggaagttctagccagtgcaatcaggaaagaaaaagaaacgaaagtcatccatattaaaagtaagaaataattatatttttactctcatacaatatgattgtctatgtagaaactgttatggagtctaccaaaaaaaagctactagaagtaataaattaatttattaaggctgcagaacacaagatcaatgtaaatataaaatattatttcattcccatgcaccagcaacaagctaccagaaattaaaattttaaaagaacactacttatagtagcatcaaaacataaaatacttaagattaaatctcaaaaaaatatgtgcatgacttttacaatgaaaggaaatggaatcactacaatcctaattataattccaggaggcatttttggtagaaattaacaagctaattctaaatttcatatggaatacaaagttatctagaatagtcaaaatattttggcaaggaagaacaaagtaggaagacatactttctaacttcaggattcattataaaggtacaataatcaagattctgtggtataagcatcaagatagaaagactgagcaaaagaacagaatggaaagtctaggaattgacccacctgtttatggcttattggtttgttttgtaaatgtgcaaaggcaattcaatggagaaagcatagtctcttctgaaaatgatgttggaataattgaatatccacatgtgaaaacatgaattttgatcaataacttgttccatctatgataattgatgtaaatggatcatagcccaatatctaaaaccaaagaactcctagaagcaaacacatgagaacacctgtggggtcttaggttaagcaaaaattttctaaataaaataccaaaagcaccatccataaaataaaaaaaacaattaaaatgaattaatcaaaataagaagtttctgccttttaaggatcactgttaagaaaattaatgatgagctatatagtctgagagaaagtatttgcaaatcatgtatctgataaaaagacttgcacccattatgtattttaaaagttaaaactagagtataaaaactaactaatagaaaaactgctgaaagatatgtataggcatttcaacaaagatatgtgatggcaaaacaagcgtatgtaaacttagaaaaaggtaaattgaaaccacaagtaaaccactacacatgtattagaatgactaaaattcaaacaacagaaaaaacaaaagcccccaaacccaaaatcgtgtcacagtatcagatgctgaggaggacacaatgctttagatttactcagccaccccaaataaacacctggtgcatgtatttggatctggtccatagaacggaaaaagactcaattttcagaatgctacaagacaaactcagtatatgccagttactctgaagacaggttgatgatttagagatttttagatattcctggtttctttccactactcttactagtcataaaaacacaataaaatacaatagaaatgttttgaaaaaaatgtgaaaacaatattataaccaaaaagttgagtatttctaagtagaaattaatccacaatcccactgttttctatgcagtaactccatttctgcaggtttgctctatctcatacactgctgatagcattgtaaatggcacaagccatttgaaaactgtttgatactttcctaagaagtcaaacgtatacatatcacatagcctactcattccattcctctatatttacccaagagaaaatgaaacacatgcccatacaaacacttgtacctgaatgttcacaaaagctttaattgtaatagacaagaaactggagacaactcatatggccatcagcagatggatagctaaacgaataatcttatggaatattaatcagcaattaaaagaaatgaactcttaatatacaaaacaacaaagcatctgaaaataattatgcacataaaaaagccagcaaaaaaaaaaaggtgtgacactgtagaattctattcatataacattagggaatatgaaaactaatgcatagagacagaaagcaatcagtgcttatctgagatgagggagtactgggacgggtatcagggaggtgttgcaaaaggaaatgaggaaatgggttgatggacatgttcactacctttattgtgtcaatggttttatgaatgtataaataccttaaaactgaccaaaattttatcattttaaacatgtagtgcattgtatgccaaccatacctcaatagaggtacaaaactgtatggtctcagaaaaacaagcctctttctaatacatggtggcttctttgctatttagaaattatatcttcaggccaggcatggtggctcacgcctgtaatcccagcactttgggaggctgaggcggttgcatcatgaggtcaagagatcaagacaatcctggtcaacatggtgaaaccccgtctctactaaaaatacaaaaattagctgggcatggtggcacgtgcctgtagtcccagctactcaggaggctgaggcaggagaattgcttgaacccgggaagcggagattgcagtaagccgagatcgcaccactgcactccaacctggtgagagagtgagactccatctcaaaaaaaaaaaaaaaaaaaagaaattatcttgaaatcatgtcatttgcagcaacacaaatggagctgaaggtcactatctttagtgaaataattcaggccccaaaacacaaatatcacatgttttcacttatatgccagagccaaaaaaagttgatcacatggaggtagagaaatatagtaaatagagtttgagaaaggtaagtggaagaaagagaggaggatgaagagaaatggattaaaaggtaaaaacatgcagctggatagaaggagtaaattcagtatttgatagcagagtagggtaactataattaagcagaaatgcattgtacttgggtggtggacaccctaaataccctgacttgatcacacacattatatacatgtaacaatatttcatgtgtacactacaaatttgtacaaataaaaaatggtatccaaaacaactatgagtttatacattcctgtatatagtaaaatcatcgtaatttttttcatggcatttatgtttgcttatttaggactgaatatgaccagtatttgtagataaatgcttcataaagcatgcaccatccattcattttcactttccaccatatatgtccacaaaatgacactgttatctaccacatagccagccagtgcattgactatgcattacgatctttgtgtgtgtgtgtgtgtgtgtgtgtgtgtgtgtgtgtgtgtagcctgtgcatgttcctcattcttttaaaatcacttatgtctcttctaatcagtttctttggtcacagtgctttttcatgctggcacaggcctttgaacatgaggaagttatcatacaatcaccttccatgggatttggagaagtgtgggagtcacagggtaacttaggagaacttggcttccaggactgtttcttacttactcaccatccaatcctctgcaaaacatctttaaatgcttgtaatacctcccaacaaaggccatataagaggatagagaagctgatctcctaacaccaaaatgcctttgcaatccacaaccttgctttagatttacttagccatcccaaataaacacccagtgcatgtatttggatctggctcatagaaggggaaaagaatcgatattcaaaatgccgaaagacaaactcagtatacgctagttactctggggagaggttaatgatttagatattttagatattcctggtttctttccactactcttactagtcatagaatcacaataaaatgcaatagaaacgttttgaaaaaatgtgaaaacaatattgtaaccaaaaagtgagcatttctaagtagaaaatcatccacaatcccactattctatgcagtaactgaatttctgcaggtttgctctaagtagctacagtactctctacataccttatcatgcatcatgaacctttattatgccacttgtttgcaaggcggtctcccaagcatgtgagcttccccagggcaaagcctgggatggatgcgacttcaggtctcacctgggtaactgacaccctcactggctcgaagtggggagtaactgagccaaaatctctggggcttttgaatggccgcattcactttcaacctgtagccaacctgggttcttctaagtgcagaaaagcaaacacatactcctctgctttcttgctcaaaagtgatgtatgtatgtgcacaacatatatatgtgcgtgtacgtacaaaaatggaactacctttcctccttacccattattttaggcattcctttttataacagcctaaagctcaggagaataagaaaatcagtgctgtcactggaaatctttattacagaggctgtgatttgtgggcattttgcttccataaacttacatctcaaatgagaagatccatctatttattttattgtctcactgtaatgcctttaaattctcactctctgagagcaaaagccaggaattcagatatctttttcctagcaaatatcttgcaatgagaggagtaactacttttagatagaagcaaatgcctgtcctttgggaaacgtttccttctcaagctaacaattgaaatcggtgaccttgagcagaggcatctgccttttatttctaatcttccatttttaaggggaaaatgtttaaacatactataagtgcttgagaacatgatgataatttgtacagattttaagagttcttatgaggaactttggaagcattgaatacataacaaaagtctaagcgagactgtgttatttaagattaaggtttcagcaggactgtcatgaatttgcctttacaataatgcatggggacatttaccccagattctttgaaggacaaaaaaaaaaagtggcaaatattggtctgccttctgaccagaaaatttcagctgggtatgtacacacacacacacacacacacacagtcatacatatgcaacaataagaaaaacaaaatttagaaaaaaaaattctgcctataataataggatttgtatgggatggttacagacacataaacatacttgtataggaccaaactggctccattttttggcaagaaaatataaaataaaattagaataatagagtacttatggcagacatagggtaaagccatactcatgtccttgggaaaccatctcattgataaaaatttatattgcattaaaaactcttcattcagcagcataggccactaatagtaaatagtttgcaaagacctgatgattagtctatgataagttaatattttctgtttaaattgatatctaacatttttaagttttgagcttttgagaaatataaaaaatataaatacagaaactataaatataaataaaaataaatgtgaatcgcatggcttaaatatataccaacttgctttttacctgaaaattaatggcaaataatttaaataccattttcctctcctagatcatttggatgccatttaaaattttttgctttttaaaactaacactccttagcaaatgcaaaagaacggaaatcataataaacagtctctcggaccacagtgcaatcaaattaaaactcaggattatgaaactcactcaaaaccacacaactacatggaaactgaacaacctgctcttgaatgactactggataaataacaaaattaaggcagacataaataagttctttgaaaccaatgagaacaaagacacaatgtaccagaatctctgggacacagctaaagcagtgtttagagggaaatttatagcactaaatgcccacaagagaaagtaggaaggatctaaaattgacattctaacatcacaattaaaagagctagagaagcaacagcaaacacattcaaaagcaagcagatgacaagaaataacaaagaaagagcttctgcacagcaaaagaaactatcatcagagtggacaggcaatctacagatgggataaaatttttgcagtctatccatctgacaaagggctaatatccagaatctacaaagaacttacttaaacaaatgtacaagaaaaaaacaaacaaccccatcaaaaagtgggtgaaggatatgaacagatacttctcaaaagaagacatttatgcaggcaacaaacatatgaaaaaaagctcaacatcactggtcactagagaaatgcaaaccaaaaacacaatgagacaccatctcacgccagttagaatggtgatcattaaaaagtcaggaaacaacagatgctagagaggatgtggagaaatgggaatgattttacactgttggtgggaatgtaaattaattcaaccattgtggaagacagtgtagcgactcctcaaggatctagaaccagaaataccttttgacccagaaatcccattactgggtatatatccaaaggattataagtcattctactataaagacacatgcacatgtatgtttattgcagcactgttcacaatagcaaagacctggaaacaacccaaaatacctatcaatgacagactggatttaaaaaatgtggcacatatacaccgcggaatactatgcagccataaaaaaggatgagttcatgtccttcgcagagacttggataaagctggaaaccatcattctcagcaaactaacacaagaacagaaaacctaacaccacatgttctcactcataagtaggagttgaacaatgagaacacatggacacagggaggagaacatcacacaggggagccggttgggggtggctaggggaggtatagcattaggagaaatacctaatgtagatgacaggttgatgggtgcagcaaaccatcatggcacatgtatacctatgtaacaaaactgcacgttctgcacatgtatcccagaactcttaaattaaaaaaaaaaaaaactgaatgaacttaggatgaaacaattgtagcatcttctattgttttactcaattggtaaaactactaaagacctccacaaagactcaggggtaacgatgtagtttgcactactcagtcttcttgtatttcatgaggcatgtggtgttgtgtgtcctcagggtccacaggtgaacagtcctgcttagagccttcagagcagctggtccatcttcttccatcacctgcaccctgactccttcattgtaacgcagctctgatctgaggggccctctgataggaagcacccactcacacacctatggtggggagaattctaagaaaccccgagattcccaccacctgggtgtcatgctctgcataatcttctctcttggagtgttggtgggtcctgtgaagatgatgggatagtcaccctcttaatcaggttacaataatccacaacctcctcgtaccttactagaaagagattttcttttgctggctttgaagaaggaagttgccttgtggtgagtggcccatatggctaggactaagggcagcctaggagcagagaacgccaccctctagcctatagccagcaggaaatacaagatctcagtcctaaaactacaggcaactaaatcctacaaatacccagtgagcttgaaacactcagtgagaaccctgagccacagaaaagactgtagctctggccaacacctcaatttcagcctgtgagacattgagctgagggcacagtttgaattttcccagactttgactcactgaatgatcagataataaatacatgtagtattaaacaactgaatttgtgctaatttattacctagcaataaaaccctaatatacatttatgtatgtatgtgtatatacatacatatgtgtgtatatatctatatatagacatagatagagatatatacatccagtttcccactggcaaggaattttccaaatggaagactcattatcctctcgctatgatatttctccaatgctttctcatgaaaaagtttcagttaaaaaagatgaccattacttattattaatggtacataggcaatttgaggtgttgatgaaagtcctgcaagttatctaggaaggtgaggccagtggttacaattcatgttattttaaggtgcctgatactgttcagaactcatatttttgaatttaactctccagaatagtgatgaactatgcatgtgttgacaatttgtacttcaactttaacaattccattaaaactctgaagttcagtccactatttttgagggaaatgtgttgagtaagtatcttctgctttaagagaattcacagaacttaaagcggtgttctattccttccagggaagagtttttcctaaaaggcgactccacagggtactaatgagtgctacaggaaaagcatctgttgtcaggaaaaactgagaagtcttgggttaaagaaagttaaatgggtttctccaaatgagtgatcagagctgctcttggagccctttttctcaagagcttcttgcaaatgctgccagggagaatgctatctggaatcaaacaagttctcaaaagatgtgagaatttcattgttgtatgacagattctacaatcgatttactgatttaaaaactgaaaataggggtgcatccctactgttttgaaattgtatagaagttacccttcttctgcccaatgtaaacagaattcaaaagattgaggatggagtcttatgttcataaaatccttagcccattgattctgtattttaatggggaaaattgtctaaaatatccacctcctttaacactgttggtaggtaactgagtttccagtgactacctaagacagaaagagttgattcttcattagggttgatgtcttgaaaacaattttcttctctgagttcactcagaagcgggctaatcagtctaaactgtgatgctctctgctcactcccaagttcattgttctgtgttataagcaggagagcccaccaaggtctgcccaggggttctactcccttcaatccttaacctagttcctccactttctcatctataaaatgggatagaaagaaagtcatccacaatgctaattttgaagtgttaagtgagataatgtgtttatagtgattagcatagagcctgttctatatggcatctttacacggagccctggaagcaaatatcagatgcagaccacaaaagcatcagggattctccaaaatgaccactggagaaatcatcctttcttcctagaaaatgcagatggtcacaataccccataattatcctactaggaatatccacagcagggtgcatttatctaactggtaaaataagtttcaatttaacttgcatccaagtttctaggggtatcattttactccatttgtgctcatccaaaggaaaattatcttctaaatatgattttatcagagtttacatgaagctgtctttttatcagctcatattctgtaaataagtagttaagatttactgctctaaaagatagtagtagaaacatttatttaatctaaagttctcacatcatgaatgatgtatttggaacatgcacagctatggtcaacgtccctgtgacatttcatttcattgtatgcaaatatttggaactcttgggtgttttcttggctctctgtgctgggatttcatcatttaatggatctgggctttggaaaatatgaatgtgttatcagcatcactttcctacaatttaaatcccaaggaactgcattttttgttcttttattggccaatttactatgggaaattaattatgttcctcttaaattcagattttaaatgactttaaaaaataactcaggttatttaattagattcttattactgcatgaatatttcctgccagaacttatggataatgacctaagtaccataatttaaacacgtacatgtttgaaactaaaagtcaatgtagtgttgcctaagtgatactttctatttacaacacagttatgataatcaaaatatcaggttttccattcattcatccattcatccatccatccatccatccatccatccatccatccatccatccatctttcagttatcactgttggaacatctataccatgtgcaagaagctgagattcctcctgagaattctcagacaccaatggtgaaaataaacccatgaagtttaaggaagacatgtggaagtgccatcagcctcacaccaactacttatgaaaggagttaagatgcaagagggacttagtgttacataacactagcacacagtaattgtcactctggccaaccccattaaccacctgattcaggactctctgtctgacagactgacttgtttcatatacaggtgccattgtcttccttgatcatggcactagaattgcaacacatacagcattttagttaccttgagcaatcaattctgcctaaattatccatgccctaaaagtggaatatcattgctaacaaaaggaaaaccttagagaaatcttagcccctttaataaaagttgaaaatcttgatcaaagaaaataaaagacctactagtcaaaaatagtaagttatcaaaatagttggatgcaaatgttattttttaataaagcttaaaatttttgagccctggttttgtaaatactcaagatgtgtgcctcctgttccagcagtcatccaaattaaaagactagagtatgatggtggccttcccagaacatgcagccccaactgagagacaaggttaatttgaaagcccacagcatgagtggggctccttgttctccagtgatgtttctgttggcttccctcctgatatggtttggctgtgtccccacccaaatctcatcttgtagctcccataattcccatgtattgtgggaggaacctgttgggagataattgaatcatgagggcaggtttttcccttgctgttctcatgatagtgaataagtctcatgagataaaatggttttaaaaacaggagtttccctgcatgagccctcttctcttgtctcctgccatgtgagatatgcctttcacattccaccataattgtgaggcctccccagccacgtggaattgtaagtccaataaacctctttcttttgtaaattcccttgtcttgggtatgtctttatcagcagtgtgaaaacaaactaataaagcaaattgatactgtgagtgggatactgctgaaaagataccccaaaatgtagaagtgactttggaactgggtaataggtagaggttggaacagtttggagggctcagaagacaaaaaaatgtgggaaagtttggaacttcctacagacttgttgaatggttttgcccaaaatgctgatagcgatatggacaataaggtccaggctgaggtggtctcaaatggaaatgaagaacttgttgggaactggagcaaaggtgactctcattatattttagcaaagagactggtggcattttccccctgctctggagatctgtgggattttgaagttgagggagatgatttagagtatctggcaggagaaatttctaagtggcaaagcattcaagtggtgacttgggtgctgttaaaagcattccgttttataagggaggcagaacataaaagtttggaaaatttgcagcttgacaatgggatagaaaagaaaatcccattttctgaggagaaatttaagccaactgcaaaaatttgcataagtaacaaggagccaaatgttaatccccaagacaatgggggaagtgtctccagggcaggtcagaggtcttcacggcagcccctctcattacaggcccagaggcctaggaggaaaaagtggttacctgggctgggcccggggtccctgtgctgtgtgcagcctaaggactcggtgtcctgcatcccagccactctagccatggctgaaaggggccaacatagagctcagtctgtggctgcagagggtgcaagccccaagccttggaagcttccacagggtgttgagactgtgattgcacagaagtcaagaactggggtttgggaacctccacctagattttagaggatgtatggaaacacatgaatgtccaggcagaagtttgctgcaggggtggggctctcatggagaacctctgttagggcagttcagaagggaaatgtggggtcagagccccctcacagtgtccctactggggcacaacctagtggaactgtgagaagagggccaccatcctcagacccaagaatggtagatccactgacagcttgcaccatgcacccggaaaagccgcagacactcaatgccagcctatgaaggcagccaggagggaggctgtaccctgcaaagccacagagttggagctgcccaagaccatggaaacccacctcttgcatcagtgtgacctggatgtgagacatggactcaaaggagatcattttggagctttaagatttgactgccttgctggattttggatttgcatagggcctgttgcccctttgttttggccaatttctcccatttggaatggctgtatttatcaaatgtatctaggaagcaactaatttcctttcaattttacaccctcataggcagaagggacttgccttgtctcagatgagactttggactgtggacttttgagttaatgctgaagtgtgttaagattttgggggactgttgggaaggtatgattggttttgaaatgtgaggacatgacatttgggagggaccaggggcagagtgatatggtttggctctgtgtccctacccaaatctcatcttgtagctcccattattcccacgtgttgtgggagggacctggtgtgggtctgggtggacccacatggaggtgggtttttttcctgtgctgttctcatgatagtgataagtctcacaagatctgatggttttaaaaatgggagtttccctgcacgagctctcttctcttgtctgccgccatttgagatgtgcctttcaccttccaccatgattgtgatgcctccctagccacatggaattgtaagtccaataaacctctttcttttgtaaattgaccaatgtacaaaattgggtatgtatttatcaacagtgtgaaaacggactaatatacctaccaaagcctggagcaacattagccaggagcttcccaatctgcaagcagaataaatgtgttttctcacaaaagcaaatattctttctaaatgaagtgatgacatcatgacccaataatccgtttatgaatgctgttgatagatttatttctgagatttatgaccatttctttctgaacttaatttatttcttggggttataattaaatttattattgagaatactattaatgcatttgattttattttcttttttgctacagcctaaacacatttcttaggtcttctttgattgtttttttaacttaagttttagactgtcaggcagcaactctgctgctttctctgtgcccacttctgtggacttctctctacttccatctgtgtgacaatctgaaagatagacgactaagctgatagagaaagtatcaagggaacagccagatacagcacgatgtgaggacatcatctaaatccttgctaccaggtatgggtcagcaatatccctgttgctcacctgctccctaaatcggaccccaatcctggctgccattaccgacatggctgttttcacataactgagcactacattgcaattaaaatagtcaggatgtttaaatcaaatgtataagttgaacttaaacatttctagactttaaaatacttaacatatggcaatgatataaaacagttcatttatcttgaagtttcctataaaataaataattatccaaatcagtgtttaaagactgggtcttcatctgcttaaatatgatttgaaaatcattctgctgtgtgtttctaaaatataaaatggtgattaaataattaaatgggcaaacttcttttaaatttgtatttttagccacagatgtttatttttattatatttatttattttatatttatatttatttttcctaatgcatgctgtacatacattctttagtttctggctgtaaaaatcattctccttatcactataaacacacacacacactttcatatattataatatcataacttataatggaggtcacttatatgccagttcatatataaggttatctaaaccaacaaatgcagttacaaatctgttctagaagttgcctaataaggtgggatgtttcttattcaaagccctctttcaggcctatagaaaatgctccagttgttatacacagaattctgtaccatggataaatgtttttatttatttttctctcctaggaaacattgcaaaatttaagcaagtgtattgactgctttttgcttcaatttctattcacttagacaaataattcaataaggtgtttcataaaaacacctgctctttcaaaatatgaagacagtggccgggcgtggtggctcacgcctataatcccagcaaaagtgcaaaagtggcctctcaaaggggaggccaaggcaggcagatcacgaggtcaaaagatcaagaccattctgcccaacatggtgaaaccccgtctgcactaaaaatgcaaaaattagctgggcatggtggcatgtgcctgtagtcccagcttgggaggctgaggcaggagaatcccttgaacccaggaggcagaggttgcagtgagctgagatcataccactgcactccagcctggcaacagagtgagactccatctcaaaaaaaaaaaaaaaagaaaagaaaagaaagaaagtatttttttaatttcttaattttcctataaatataagtatatagaataagggtaagtgttatgttggggtgaatatagaaatctaagttttctcttatactgtgacagaaaaaaaagttagttttcttttagaatgttcctcaatattagaggttactcagctttattacaccctgaagttttctaatcatattcagatagtacattacaaaatgtcgggaatgagatgcatggttgttcaaacaagaatttacacaggcagacaaaaatgacagcagcagcaggaagcctacatttataatatatatatatatatatatatacacacacacactcatggaattccacaaaattataatccaaataggagtgtggacactctcatataagagattttgaacaggtcatggtgccagtttcaaaggcactgggctaattagtattaattgtatttctgcagtttcttgttaccagcagaataaaagtcaaagtgcttagcttctctgatatttggaaaagtctcatccattgcactgtgttaacccctcccactcccgtggcctgtatactagccacatggcacagtctgatagctcacaaatgctgtgggttcaggcctccatgcttttgccagagctgctgtcattcacgtaagattctgttctcctaaatttacctgaaaacactactccttctttgtgctaccattggatgcaatatccagtgacctgtctgtgcaggggtctccctaacagactgtgagacttgagaagactgtacttatctatttctcattcctttatttttggccaagcactggacacttgctatttatcacacagcaggcacttggcaaggatcaaacctcacagcacttcttctgtaagacatggcgctaatgcgatccatgcaccagaaaacaagcggccatcccttggataatgtttcataacttttgttcaatggtgttcaaaatctttaaaaatactgaataactctttactcaataaacaacttttaaaagataaaaagaggtaaagatcaatctgctagagttcaaatgggtcagaggccaggagtgcatccagttgtgagccccccaccaactccccccataaaggctcagcatggcacctttcaccaaagactgcaatgggtgaatatcgcagtacatttgatgaccagtcattaaccaataacctctgacctttgagatgcaggcaagagggctggaaggaatctttgggataaattatccccactcttgaccttaccacccttatttctttaccttgttgcattgaattggctgtgatctccagtacaatatggtattgaacgctagcagccctggcaggaatcctaggctttttcttgactttaacagaaaggcttctaacctttcatcactaagtatgataatgtttgtggtaagattttaataggtatccttcataaggtgaaagaagctcccattcactctatgaattattcactcacaattcatattaggatgagtgttaaacttatcaaatgtttattctacatctattgaaatgattgtaacattctttctctcttaatcttgttaacataaaatgtattatttacaagattctccacttggtcattataaatatcatattgtgaatatgactatataaatataagtgaaatgtaaatatgtgtgtatacatgtgtaatttatatttaaatcctgatgaatttactctgtacaagattgtacagtctgtacactgcacaaaaggagctgtgtgagagcgtggaaattcagacagaatcacctcttaaaccctgagtcttgaaatagggctctctgtgcccaggtgaagggaccttcagcagggtaaacctgttctacttcacacaaaggcactttcaggatagcaatgcctctggatgccatttatttctaattctcaggcccaactccatttacccagtaaccaagcactggacatattagcttgggtgaacctgctacaaaagtcctcgctttaaaacgaacttccatttccatctgctgatagctctttaacttctaatgcctttgcctactcctaaaggtggccctgaaaaatgccgtgaaagtttaagtaaagaagagaaagataatacaacttaaaatgttgaaagaactcttctctgcatgtctccttacaaatatgatgacggttgggggacttctggtgcaactgtttgatctgtgcagctggcctcaaacctgaaacagacagttctccactaatctgaatgctgccaatgtgtttcacacaatgcctaagaaactactcatggagcagctactttatgccaggcactgagaatgtcctgaggatgcaatgatgaaccaaagagacagggcacctgcaaccggggagtttggaatctcaagcgattttccaagagtctccattcgtccctcatacagaagggcacaggaaagccccggcatcaccaacttcctctcactttgtgttcaccagtgactttaccctaagatagttacgagagcatgatttataatgtaaagctgtgccaagcaaatatctgtcctccactgagatataaatgaaatgtctgcaaagtgccaggcttgtaaaacctcctttggtaataggaggcctgttgtaagtagttatgtagaaagcttatcatttttaccttcagtgcttaggctgggagttaattcagattcctctcaaaccaaggaagcacaagctgagaagctcacagtaaactcacagtcacccctactcagaggcctctgctacacaaacagcagtgctaaagcaacaaatggaagtttcaaattctgttgtgggaaaaggaaccaagtctacttagaaaaacttacaatgtccattgattacttttctttccccacaaaacatgaagtaaaagatagaagccaactgtcagaattttaaaaatcaacgatttgtatcagaatgaaatggtgtttcccttgtccagatttatcttgttatactgtagatgtacccatggggtacatctgagaaaaacagggctctgtagagctgaggatgacaatccagacaaggatagagcagtgtaggtcctgagaagtttgtgtaagatatgtgcacccgaggagaagcctgccaaatctcttcaggaaggcacacacatggaagtacatctccttacaagcactagatttgtggtttacaaaattcagcataaatcacaatgggtcggaattatttctatttcaagtttaagacacaggctaaaagacccatttgttttcatgagatttgcagttcaaaacacaacaaccctactgaagacccacaggccaacctgtattctgtcacataaaccatgagggctcctcagtggacataatgcggcaccctcaggaccataagcaagccactaccacaattctaggaaaacaacagagcctcagccaattccaatgacaacccctcttattgaaacaaacatcttggcatcaccatttgtatgacagtcctgttgagcactgacctcctgaagtctcagtaaccacccaagaaaacccaaatgatggcatgagactttttcagagaagcctggctcatgtacaaggagcttaaagttatgagcttgaatccttccattctttgaacacctgtggcttgctttcaactatgatactttctatcaggcatctgtattattcggtcttgggatctttctgattccagagtgagagctccttaaggtcaagctcagcaagtcaaccagattcatattccacccagctgcatcctgagcgatgcctcatactcatggttgttccaggcttattgtgagacaactaagctgcactagatgactagactggggttgatgtgcatgaggtgcagcatgggaaataagactgtatttgtcgaatgcacagggtgatggccccaaaagggctcaaggccattatgtttacaattttatttacaggaggaagctcaaatattggaattcgcaccattttaaagtatgagattcagatttcttttctaatgaggctctctataatagttgcatgtgctcaatcaattcttgcctgtggggacctgataaggtcctggaagatccctgccaagtattacctaatatcaaaaccaattttaatgactgtacactattactgcaggaacacggagtttcagtgctaacattttaccatttggagcagccctgcaaagctaattagaaagaatttgaaataatttaagaatatgaacaggaaatgagatgttcataagcaaatatcatggaaagaaaagttaaatgtggactaagagtagctccattttagtgtgaagaatctctttgaatgagaacacaaaatgtgttgcattgtaagagatagtaagaatgaacccaagagtagataagaacaatataatacacaagaataatcacttcatttggaaaggtggtgacactcttttcccaaattgccattacctttttaaaaaatcacacatacattaaataactaggttcatttattcactaccctacactctgcaaggtgttgagaaaacaatagtgaaaaaaatattgtccctgattgtaaaatcataaaatgtcattttttagtattagtaagctttgaaacaaattagttcatctaatagtgtagtggaaatttcttctctgaaattgaactaaatccaagtttatataacttattttgaagaaacattaaacttaaaattgagttttttaagattaggagtacttactaaggtaaataaattgtgataaggaaggaagttgtaactaaagttgaagaatgattgtgggaaaggagaatatggctacatacatatatctgaaaccataacattatgtatgtatatacaatcagatagcttccctcttttagatagtaagatcaacatgctttcttccctgtaagaaaaaataatttaaaacatgatgtaacatattttttgaattattaacagagttctactgtgtaaattttaacccaagaaagttggtacaggtctaattatgcaactgtgacagcaagctaaaagaactgaatggccgggcgtggtagctcatgcctataatcccagcactttgggaggctgaggcaggtggctcacgaggtcaggagttcaagaccagcctgacgaatatggtgaaaccccgtctctactaaaaatataaaagttagctgggcctggtggcgcacgcctgtagtcccatctactcgggaggctgaggcaggagaatcggttgagctcgtgaggcggagcttgcagtgaactgagattcagcctgggtgacagagtgagactctgtctcaaaaaaaaacaaaaaaacaaaacaaaaaaaaaccgaatgactgtgcacccccatgcctggtactcaagccctttcaggaatgatgactactcactttccagatctgtcccttgccgcatccctgtacacatcctgtagcccacaagtgactgtgcttccagtgttaggtgtgaatcccatgtccttgggttcacagcctgcacacagagactttcagggaagctcctcctcttaacttggccgagtcctgcccacacctgttggtgcccttgaccctccacacctgttggtgcccttgaccctcacttcctcctcctcatgttccactcagtgttctctcataattgctctgatggcatttattacttcgttattatttagcaatttgaattatgtttttttctcctaagccagaaaggaggctccttgagaaagtttactgtatccatctacatgggttcccttgcaccaattctttacacacagtatgtagtcaacatgttttcattgactaaatacatagatgaaagatctgaaaattctgcaaagtatagtaccacagacatgaatcagtcattgaagtcattgagaattttcttttcttccacatgcaaaattatttcaaatgaacagtatcatgtgagatcacaccaagcattagagaaattaatgatcaaagatgatgcatgtaacaggcagagtttctttcttcctcttcagtttcagacgtcaaggccttattactgaaagctattagcagttgcaagaagataagagaaataaaccaattaaatgagcttcataatgaaaactgcccagcaaatgtcagaggctcctctaaatgtctggattccatctgtctgcctctgccattttgtatctctctcttttgagtttgagaggcttattgttccagagcttctgactttatgtgcggagcccgaataattttataagacagatttcacagtccttctttcagtcactgtcatttttctcacacaatgacattagaggtccttcgaggattgctttctaataatctcaaatagggcaatttcgtgggattaggatagactgaaacagatgtggaaaacactttacatcatgatagaagcaagatgccaaataatagtgtgtgggatgttactttctcatgcagcacggcttataaaatactgtaggaatgtgacatggaatgtgaagagtgttctttgcaactcttccttccacagtagaacctcacgagattctgcaagtcaaatagatcttgaaaaaaaaatatgccatggagggaaatgaagggacaagtgttcagaaatgacagttactgtggcacactatcaggccacagagaaaaccagctatttatttacttatattgacatattttgaaggcttctaaatataaccttgtattcctctttagaaatattaacaaactaacacaaaaacagaaaaccaaacactacatgttctcactcataagtgagagttgaacagtgagaacacatggacatggggaggggaacatcacacactgaggcctgtcggtgggggtctggggctgggaagggatagcattaggaggaacacctaatgtagatgatgggttgatgggtgcagcaaaccaccatggcacgtgtatacctatgtaacaaacctgcacattcagcacatgtaccccagaacttaaagtatcataaaaaaattaaaaataaaaatatagtagccgctgttgtgccctttctcacattcacgtagaagagatctgaactaggctccagttcttaaaaacttttaggattactaaagggatagtgtttgggaagaaagaaacaatggaatctataaaaaatagtcaatgttttgaaataatttttcacactccaacacctgttgtttcttctttaattacaagttgcctcaaaaattattatgtgtgcaagttgttttaacaactgaaatgacacatgctcagtaataccattggaggcactccgatgaaataatttaaaaatggaaactgcaaatcttaagcaaaacacaaattaaaacatattgttgatataattaagcatttctgtcacttctaccaaaggaagcatggtttgccatgaggcaaaccaaacgagtataatgcaatcaaaacatattttgaaagtctctggctgcatttgtataaacatgtgaactgttcctatagcatgcctcattcttgttcattgaacattggtattaagattatattgcgtattgcaaataatgctacagtgaacatgggaaagcaggtgctttacgaggtagtgatttaatttcctttgggtatatgcccagaagacggctagtagggtcctatggtaattctatttttaattttctaaggaatctccacactgttttccatactggctgtaccggcctacatctccaccaacagagtacaatctacattctttacaccctcaccagcacttgttatctcctgtcttttttatagtacctgtcctaacaggtgtactcatgtagcaaatttctgaatacaacacaccatcattaactatagtcctaatgttatacgttaggtctttcaaggtgttcattctacatatttgctactttgtgttatttgacctatatctcctcattccccctgcactctcctgccaacctaacaaccactgttttattttctctctccatatatgagaccttttgttttttatatttcacatctaagtgagataatgcactatttctctttctttgtttggtttattttatttagcataatgtgtgccacatccatccatgctgtgacaaatcacaggatctcatttttaaggctgtataatattccactgtgtgtgtgtgtgtgtgtgtgtgtgtgtgtgtgtgtgtgtcccacagcttctttatccattcatctattgatggacacttaagctgtttccaaatgaaatggcaacctacatgttgggaaaaatatttgcaaagtatacatcagataagggattaatatccaaggtatataaagaactcatacaacatgataaaaaaaatatatatgacccaattaagaaatgtcaagggacttgaaaagaaatttctccaaagacataaaaatagccaaaaggtacatgaaaagctgctcaacatcactggtcatcaggaaaacacaaatcaaaaccactatgagatgtcaccttacgcctgttaggacaggtactctctatgatgaaaaaacagtagacttttcatcatagagaggaaaaacgagtaactatgagagaaggtggatatattaatttgttccactatagtaatcatatgactatatgtaccttttaccatcatgctgtatatcttaaatatacacgataaaatttactttaaaaagaggggggaaaaagcatactgtgaacagtagcatcaacacaccaaaacaatgtaaataaaagacaggtacccagagcattttgatttaagcctcacaagtagtaatactgccccaggtttaagtagagaccacacttcccttatttacactggtatccccagagtccatcacagggtagaagcttattctttattaaataaatggtggaataaaaatgggtaaaaaaccaaaatgctcagattctaggtacagagtgtgagctcaggtaaacctctcttaatactatgatgtatgcagggatttgaacctgaacaaaccaaatgaagaccacgccataagcagcatagtcaattaaggagatgacaatatcttttgagcagatgtatgtctctgaagctttttgttcaattctctacttacttcattttagaaaggtattggaaatgagtctgctgagaggcaatatgctggcctctgcaatatggaacctacaatgggtaatgtctcaggtgatctccaccttttctgtacattgaatgagcagagctaatatcaattagacccacaggtttcagattgggatcctggggtggggagagtgttactctcactcagtcatggcccaagtgccatatggcatggaatgtctcctggaaccatggcccagcctgtacaacaaggtgatggactgaaataggactttaaaaggtagaatgagctatacaaagatgcaaatgaatacaagagcccagccttgatgctacaagttgcacaacacaaaaagggagtacttggctgttggtaagagggacaacatcagtacatcacttaagttggctggatagccaaatctctttttaaaaaataagggctgagtgtggtggctcatggctataatcccagcactttgggaggctgaaacaggtgggtcacttgaggtcgggagtttaagaccagcctggccaacatggtgaaaccccgtctctactaaaaacataaaaattagctgactgtggtatcaagtgcctgtaatccagttactcgggaggctgaggcagaagaatcacttgaacatgggaggcagaggttgcagtgaactgagatcatgccactgcactccaggcaacagagtgagactctgtctcaataaataaataaataaataaataaataaataaataaataaaatgaacaagcaacactactccaggagactactgtcttttaatttcagtagcaagtgctcggtagaatcagaagtagacaaggtgagctacagaaattgaccaaaaacatgtgtccaatttgaagggaacatttaattgactaaaaagcccagtgagtgttctttatggataatcaattgattagctcaaatccgtcagcagcactacaatcaatgacggaagatgcatttggaaaagaatattgtctgattgtttttaaataaacttctattaagactttaaatctagagagtcactcttaattactcatttttaacagttaaaaaatctgacatttaaaaaaccagagacatgggttccatctgactgagcatttgctatgcctttaacagaatctgtttgttctgcatgtactgcctactcgtgtaggcctataaaatattttttaaattgtggccatttagtagaaattattacaattgaaatactattattgtgtctccacatataagttctaggtattttaatatcaagtattgaataatctttatcatggaatttattggaaagttataaaggaaaaatgtgtgtgtgtgtacaatttaagtcacttttacagtaggaaatctcttcatgaaaacttctttcaattaactttgcaatcactgtatttgaattattgtaggcataaaaaatttttaaaaactatagaaatgtacaacagagtcttccaacattataaataaaacatttttgtgaaatattccagatctccataccaattgcaatttccagagattgtagatgattatttatatgtcctagaggcagactcttgatggattaattcctataatccatcatttttcttttctctccatctgtgccatacatcattcttaagcttgattgcgaaactttcagtgccaaattttagaaaacttatacttttgtggccatctgctgtaccactcaattttgtgtactgatattaactttctcaaaaagcttaagcatcctttaacaacatgtggcattttcactttgacaatctttcatatttgcaagctcttcactgagatattttattaaaaaaaagaaaacaaactttgcattccagtgtttgtgaagatataatatccagtttcagcaagggagatcaattattccctttacggaagaatattgggaaatataagtgaatggattttacaaccacaatgcaatggaagagttcaggttgcaaccttcttcataaaggtcaaggtcatgtctttagctttcatggaaatgggtcacttgaaaatcctagatcatctccatcagatacagcaattattaaggagggacatgtctttccccatcagctactgaacggtatttgaagggtagcttccacaaaggggaggggaaatacaaagcagttagaatgattttgactcagactagctgaagccaccagagcttttgatttcacacatcaggctgtgcccaacaaggtggattttggggagatgagccccttggtgtccttagctctgtctccctgctttgctcctgtcctcctcctccctgacctagctactctcaaggctgccagctagtgggcagcagctccagcttcactctcgacactctgtgtgcagagaaagaaagggccttcctgtcctgtatctctctctatggagaagagagaacctttccagaaaaatgacttttctttcatgtgtcccaggcaagaattggtccacacaatggagaagccgtgtgctaaataaatatgcctggcagaaagtggagtgccatctggcctaataatgggtatccatggctatgcgatgactgggaagttctcaccagtccatgggacctgtaaggcaggagggctccagattgtgtttaaccccaattattggactgcagcctcagaaatcctgttcttattggtccattctactatggtcaggatttgttttcacaaagccaggtgtagatgtgcttttggggccgcacagcccctcagcctcctgtggtcccagctgcgggcaaaatggtggtcagttctttgccagacacatccacctggggcacacacttcccttcctgtggctttccatgttgggagtcttctctgaagccccaggagactgctgggttagtgaaagtgcagcctgggtgcatcctcaaccaatggtagctgggaaggtgacacactcccgagaggcatttacaggcttctcagaaaatcagttctgctgcccttagcagtgaccttggtgacaaaccctaataggagcttttccctctttcctgcctcaccctgtcatcctctccacctgctgctgtcgacatataaaaaaccacctgccctaaacccctgtcttgtctcaaaatctactttaaacaggggccaagctatgatgccagaattttcactctcagctcctattcccatgatgaagaaaatagtccaaaataatggttgggatcctacatgtctcggaggctttgaagaacacactgagtttttatgcactcagttcagggctagggtggcagccaggatgtgctgccctttttcagaagtgctactcacatctccataatgtttaatactccctttggaattctgcagtgcacaacctgcacaactgtatgcattgcctttggaggagaaagtgaaaaaaaaggagaaagatgggcatcacttctcagatgcatctagatatctggggctttcccaaggtttcttgcattcttctggaccctcagttacatgcacagtctgaagccaccagggattatctcaataagtgcttaactgttttcggtttttagttagaaccattcactttatcgaatctcatataggtcatatttagctagatacaacaaacttctataagctcattggtgtttaagttaatcttatgaaaactacagtccttaaccttttcaattacttatcaaatattagatgaggccacacagtgtagtgggggaaacaagcaggccaccattataaatgtctggctttgaggctggcaaccttcctacaacctggaccatctcgcttctttgctccaatttctacatctataagttggttacactaacaacaatactacttcattggattattgggaggaattcctcactcattccctaagaagcactttaaacaatacctggcatgtagcaattataatgacagatgatgatgatggtgatgaagaatattatttttatctataaaaattctgtatgttttcagtggagttagagtcaactattttatgtatttcttaaactttattttagaaaatttcctttctaggattataaaatggtattttcatgagcaatggataaacttagttgtatctaatccaggtccaccggcttgttaaagtaagaacagcttccagacacatcaataagtaagccatacaaatagcctactattcatatagggtctgcattagtaccctattcaatagtagcctatatgaatagcttactattcatatagggtctgcatctgtgaggtttcaagggtattattaagggcagcaaataaacttggaaatgggtctacgtccaatgtaaaataacaaccctttaacaaacacaaataattcagtgtgagctgccaatgttcaagtatccacagcttagcatatattggggtgacattgcccaaacataaccaaataaacaaaaataagtgaataagaagaaaacttttcatatatctcttcataacaacccacctgccatctaaggcaggactatgaatctctagaaagccacggttcaaaaatgaggaaacaccaaatatgaatacaaagggaactaacgattacaaacaagcaagcagccaattttaaaacagactgttcaattgtaaaactgtcaatctctctcaggctacctctcctctatattttatgatgaaaggaagtgccagctgtcccatttgaataaaagtacacaccattgcaaggaggttgctatgctcttgaaaatattttagtactaaaaattaaatggggaactagagatacttttttgaagtctaggaagacaggaaatgagtatttctaaaacccacaggaatacattgtccatggaacacgaagatgctgctcacctgataccagccaaataggaaacttacagataaaattgtcccagaaatcaaaattctattagagtcttataaggatatagagtcttacaagagcattcacaaggatgctcagaaaatgttttatgaaatgtatcctgaaaaatatagtatttatatcattaaattatttatacttactaaaacagcattgtcagaagttgaaattaaaacatttcttgaaataaaactacaaaaatcatctacagtatgctttaaatatcaccaaattaagaacaatacaattattaaaatttatacgaaaatatttacaataagcagtggtttgtagaaaaatcctgaacatggattcagaactctaattctgaatcagagcagtaatattaggcagatgaggctatatgcagctcctactttttaaaacttgagtaaaatgtgagcctcaaatagtttttgttgtattagtgaggttgtttaaaattgggcttacacatacatcactggccagaggcaaacacagctgagactgttgagaaatacgactggagctaaacaaatacaaaatatacctgtttggggcttttgaatggtctactttcatgggtatgagatattagatctttcccattaatctcactgttcttgttcgtatacttgctgagggagacacagcaccctggattgtctcaggacctctgagtggaaagacctggaccgggggtcttgctgtctccagttgcagggtttttgggtacctaactggttttctacaggtctcgattttctcatttggaaaatcaggaaaacacgagacgaccttccccaaagcattctgcagaccctaatgtgctacacaaaaatgtgatattttgtaatgcctgtcattattttcatgtgtcacaacctatttaaacttccaatggccacgtttcatttgctctgaagattatccattgtgccattatttgacacaaacaaatgttagtgtgttatatcaactctgactgaccctcgcagaatcccttttgacagcatgtattgattataatgtctttcttcttgacctttccaggctttctgtggtctggttcttttgtatctaggaaataaatatctcccctgtgctccctgttgctctcttaaatcatagcttgtggtcaattgtttcacgctttacatgatatttcagtaagaaatatagtgctgccaaatactaagtctgctgttctttgtaaattatttttgctgtatctgacgctgtctttggctctgatacagcaaaaaataaggtaaatctgctaaacctttgaggaaattttgagttgcattaatttaagaagtaattctatgtatacaacataacattttatatctttcttcctttcatgtgttgtaattttcagccaaaatgtagagttaagatttgtgttacgagtttatcttcgattaattcctatgctcatgatgatctcctaatagtactcttatggttggctgaaatgatcacaatattataaaaatcaagagtgtaaatcaagagaagagctatagaaagacaaaaagctcctccttcttttaagctacacttcaacctaaataggagtaaagtaaggcttatcatttatcacttaacattgggcaaataaattatacaaatggagttgtgtcattaaattctatttgtgcccagaggaccagttctcaaatgctggtccagtcccccactggcaacttgctactgggcaagttcattaatctttctcaggctgattttttttccatctccaagcagaggtaataatgaaaactgccttgcagggatacagagagaataaacataataaattttaattactcttagtgcagtgcatggcatgtagtaggcactcaacaaaagttattttatgatgtaatacaggatttcaggcaatcattaaatattaactccagtatgtgtagttataacttaatttcaatatttaatttgacatcacctagtaagttgggatttgcaagtcttcatccaacaacaattgttacagttactattgtcaaaatagggttaaaaggaaacacacatatgacagtgacaatcatttctattttataaatgtctatgttagacttggcactgggctaggatatatagaaatattaggtactatatgtaatcctctaaacagctctgtcattcaagtgttcatgcttcatatttcatttgaaaacaaccatgtggagaagtagaacagcaggtcaaatctcacagtgactcagaggcagagcccctctgacccaccaccctgctccttccacccgctctgtgaagccacaggcatgcagggctgacatgcagacctggagagcagcaccaaggaccagaggaccccagatgctcctgtgggtttagcctacttggaagtggggagtaaacatctgtgttttaagtgtctcattctgagctcactggagctatgagccaccagggagggacatttgctagaagtggtccctcaatcagctggacacatgtgccccagggtccagagaaggaatgccagggtcacagaatcatcaatttcagggtctggccctgcactttgcagagcaagacagaagcccagagggcagtgaatgcatctcaagttcacagagttaagtgacagcacaagatccaggtcctccctctgtgtctgtcaatcagctccccgaactaatccaaggctctgggtttcccaagcttttgacattgagcaatttacgagtagggattcatggagagaactaatagctcttggcaagggtccttcactgcctctttattgagattcaaataaaggcttggtgacttagtctaagacaaggatgtagaaatttcacaagtgaagctgggaaaatcctttcatgaaatttcagctttaaagtgttggcagaagcagagattcttgagtcttttctaaccgatgcatacttgaacttgaaataatcaattctttctttttcataaactgctataataatcaggaaattgaggtttttatactttccacaaacatattctgtattatataaatgacatttcattagctgactcccatttttaataagctggaactcagagaagcagctgaagcccatggataacaattaaagaaatgagactaggaaggagcactcaaacgtgagacctgccagaccttacggatggcaccctccttgatacaggagctctcagtaggaaaaaccatcaccgccttctccaaggatgacactgagactcagaaatgtcacctcttgttatccagccacacacactggtcacttcatgtctcaaaaatcaatactttttttatacttacagctactatcttgataatagaactcaataaaaaccgaaccctttgtggacaaagatttacgaactgcagctagaatatgaagaccaaaaatgttgctttagctaggtaactatcatttttaaatcaacttcttaggaattcaactgatagtatagatcttccaaacaatccaaagaaaccgagcccttcctttctactgtttgcattcctcaattagtgtgagctggcattcctgccttaggacagacagaaaccaaaatgcatgggagaagacacgtcagaagaaaaatatactcctaccactgagaagtggattgctcctcattgccgcaataacaccttcctagaagtagactaccaaaaggctaagtttggtggtacaaacaaaaagaaaaacaaacctttaaatttcccaaaaagtgacaatagtctctttggagacatatgtgttattctggatttgaaagcagtggttacatttgtttcataaactgtaattctataataaataaagcaataaatacattgatattttagaaagaccttcaatttttacatttatcatcagatggatgtcacacatacacacataggaactacataaaaatgctacattattgcttaatataatttttttattcattaagctatatttgaaggtaattataaaagtcaatgaacaatgagaaaattaatgatgtggactgttctctgaatttttcacactgcaatgtatttagaaactagggtgtgagatcaacccagatcatccattcctgtggtttcccagcaaatgagacaaaccttgacatggcaatgcagacctcagggggcacacatcatgccaccaggaacaaaacatgacattcttcagcaaaatacaaagttatcccatttgaatggttttcctagaacatgtgagtgttcataaatttgtcattttaaaattatttaaaataaatagttttaaatgtcagcatctgaaatatcaataaatatacatcgtaatgaagatttttcatggtctacagttagttcaggctgatctggaaagaagtgtctttataatcagtactagactatatgagagctacgacagtatcttttccattgtgaaggggaagaaatctaattgtaatttccaataacagaaatctccttgggtctggtgtaatatctgacaaagaacctcatatccctcttcctttctgagaatttcccaaggatatctcggctgtgtggtttttgcatgtcacaaaagcaggctttacagcagcacaaaagcattgctcagcctcacaaaccaaaggataaagatgctgcaaaggccaactggaaagatcagtgaggaagcaatttagccagaccttctcgtgctgagcttctccatcaaacctttgccactgtctgtgtccactctgtgcagccagcaccagaggcaggtgagtaaggggaaatgctgttactcttacagaagaagcaggaacagcaaaagcaagtcttttgaaaagagcttgtccaagaggaattttatttgacagtttaaagtgttaaaagaaatataacctgtaaaggcaggagaaaaaaaaaaacatgcattctcttttatcctctctgcattggcaccagcttactctaacaatggctccatatagtttctcagtccccagggtgtgtccggttcatcccacaatgttctataccttggtgtaggcctgatatggggatattattccgtgtcccaaaccgaatagagtagccatatataagcaggctgaaggctttgtgactcagaaatcagaacagaaaaactcctgggacagtttatcccatatgtgaatacttaattcacgaagcctccaggatactctgaatttcaagtattttctccagatattctaattaaattgaaaaacttgcatgatttgcagcatctagtgtgtgtagagaatcgagtacttgaccatgttgtgtttacagagcactcagtggttgcagaacatctagtgtctgccaagaatctcatgtttgcagaagatccagtgtgtgagaggacctggtacctccagagcatctattgtatggggaacatccagtgtctggacatgtcatatttatagagcatttagtatctggagagcataaggtgtttgcagagcttctagaatgtacagagcacctagtgtgtgagaccatttagtgtttgcagtgtaccaaatttgtgcagagcctctagtgtgtgcagaacatttattgtttgcagaacatctagtgtgtgcagagaattttgtgtgtattgagtctgtattcctggttctggattgtgggctgggtgtgagaagaaggctactcaccacattgcagcctgcacagtcaggcccattctcacagatcctgcggcgagcttgaatgccacccccgcattgggctgtgcaccgttcccaaggaccccagcctgtccagaacatgtgtgggggacatagcaaatgttcattgcagtatctgtaatgaggaaaccaaaatgacaaggaaactaattagtgccacttgaaaccactgacgtttccatctccatccctgcaccagatgttgaacacatgggcatgctctgcgtggaggagctttttgtattttgagcagttgcaccatacagaaggcagatgtggtgctggccatgctgtgtgtgcacagacaatgggatgcatggcagacaatgaagaaaatgctaaactcacaatgcaggatggatcttcctgtgcagccaattaaaggaaaaacaaacaaaacccttcaaacagacacccaaaaataagagtatacagaaaatatctaggtagggcatttatcttgtgaacataaacattgaaagataaagcagattacagatacaaagtcagcatagctttacttggaattcctttctcattcttgaatcaaataagcccatagttatattaggataagttaaagaaaagttagagcatgggattagcatgaaggcccaagttatatactgcttaagctattctacttttaaatttatttgtaggctctcagaagaatgccaaacaatttaaaagaccactcgttattcaaaaagaattgattatacaattttacaaatattagttctatttttcagtgtttgaatatacttctatacttctacatatttttccaaatgtcagccaaatatccaaagcctcctttatccttatcatgagtcatattatttctcttcaattttttttttttttttttttttttttttttgagacggagtctcgctctgtcgcccaggctggagtgcagtggcgtgatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcaatctcctgacctcgtgatccgcccgcctcggcctcccaaagtgctgggattacaggcgtgagccaccgcgcccagccttctcttcaatttttaacactgcaagtgaaatgaagtgaagtgaggaaagtaaacaaacaaaaaacaaaaaggaaacagcctggcattctacaggttacagctcatagaaaggaagaggttagtctgaacagcaccaaatgtagtgagacacactcggtgattcatagtccatctaagaagcccaaattcccaaatttaccttctagagaatactagaatgcacaactttttctcatgccctcctctcttgctaggctatctgccttaagaaacaagaggcaaaggttcccatctgctggtgtaagtcagtcacctttattgtcatcaatattaataaaggcttaatcctgcagggcctatgcaacaggaattgcagaaggcttcctgatcacaggtattcacagtcgaaaataaacacagggacatggacacagctcaggatgtgcaaaactatcttaatacacagtggcattactgtaattatttatgcagaagtaaatgcttttctggaactgaaaataggggcaaatggtagccagccaccaggaaaagaaacttggagagtgtagtttcctgacagtgaatgctggtaagatggaactgttttcctgtcaaaccagaaaaatttcatggggaatgtgtgggcttcaggaacagggacaatgtgaaaagtagaaagcaaggccaagctgaggggtgctgacgggatgaggcacactgaacccctgtcagcattttggaaaataatggaaggtagaaatggaaagagtaaagcacgaaagatcattgagaagaacaaaacataaaaaggcaacagggagtgggatgatctatctttaccaaatacagtggaaaactggaactttatgagaaatcaggaaacttccacagagctccagagacaaaataactccatgagagttagatggcagactcatctccaggagttggtgcttcatcttgactattctctggagcccctgagattcgaggagctcctcatatttcagtatggggtctgcatctccccagacagggcagtttagcagcaggaagagcccatagaacaaacagcaactagaggacgctggattgcaacaattcaaatgagagatactccaacctagaaaacggcgatggtgttggaaagaaggagaagaagtggtggagatggagcttggtatagtgaaagtacaatatggcaactgtgtgactgtatagaaaacaaaacaaaaacagtggagtccaaagtcagcctcttaactgaaagtggaaggcagaagacactcttacttccagggagagatagttgatgtgtagggggtgaaggagcctccggagagtcaagaaccaactgggcaagcagtttagtttgtctaaacttacacatttgagcgtagccaatggaactgaacagttatcactcttcctcatcttttccacatttaagataacacagaaacgtaaggttttcctctttaggtggtaactatagtctcccagggtcctattctcagagctcagggccactggacattcctacacgtagtaggggaagggaaaggaccttctaattaagagatcatggcctctagataggagagacaagacaaatttgagaatacaacagatgaaaagaatttgatcttaggaagtacgtgcaaatgtgtcgagttccaataagtaaaattaatatgtgtgttggttcatggagtattccaggagaaaattgacacttgttttgagaacatattttgaggaagtcaagaaaactcagaatatcagaactctcagcatttagttaaaatatctatgtgtagctcactgtgggtagaaggagaagtaggctatctccatttctaagctgattcaccagcatttaaaaggcatggacttgttagaaaacttgatcctaatttcagctttcaacaacccctctcctaaaaacaacaacaaaaaaatgggtatggaaggcagagggaaaccttaccaaaaatgtttataaaacccctgacttttaataaaaagcacagcaactgagctaccatttccccaaagcaaaataaaccatagcacacaaatcctttctgttatttgctgacagcaggccactcctgaaaatgctcagcatgttattattgtaaaaatctaccgcagggtaacccgtgcatggaactttcagccagtgttaataaattgtctactgagctgcattttaaggttgtcaataacctgccttgtttttttctctttctcctatagtagtccatgaaacaagccacaccaggatctgctggcgtgtcaccctctgaaattgcagcctccccattgagagaggtcagagggaaatagaaattactaggctaactctgtctctttgtgtctgggttttcacttaggaattcaccctggaagagactgttcagagacaaagtgcttggaagcctgtaagtatggatcctacacaattgtgagaaagtgttttcctctgaccctctccctgcccccagcccaactaactcatgcccctgagagaagcccctcttatgaagctatacaaaaaacaatgaggttggaagtcagttactttggtatctgctggttaagggttttaaaattaattgtggataaaatatctacacaatgggccagcagttggtcccctttctctagtccccaacacactgcagacttttagcaaagaatgagctacaatgtttttcaaatgctattggctcttgagtgtctctactgtgttaaagcattgcaagtcacagatgtacctcatgatgtgttaataattaagattttaattttgcccatgactgcttattctcattttgtatttaaaagtcaattaatgacctagcactgtttctctataaattatccactttttttcacaaatctagtctcttatgaaaataaagaccttttataattccatatggactagattctcagcactatatcatgcaataaagtgttctttctattataaattataaaatgcataaattatgttccattctggttagatccatgctagttgctcactgcaatctctgttaacctgaaccaatcagggcctcttctgaactattttcttcttgcttcactctaaatgatcagccctctactgggccatactgctataaatttttatggcaacagggaaactgcacgtacattaagtctaccataatatttaattcaagccatttaggaagaaaaataacttgtgaagaacatcagtttggctcaccacaggattcagcaaacatactgatgaagacaaataatcacttaataaaaaccattgagccctgggactcttaactttgagaatgcattggacaggctctaacatgttccccgtgatccccagctcctagaattcacaccttgcgtaatctcctcctattgaatatgaatgggacctgtcactggcttctaaccaacagaatatgtgaaagattttggaatgtcacttctgtcattatgttacatagattgtaataccctaatttcaagagaactttctcccttgttggctttgaggaagcaagcaaaaaggtgagaaggacccagttgtcaaggaattgagggcagcctctggctaacagccagcaagaaactgaggccctcagtctgacatcccacaaggaaatgaaggctgccaacaaccacatgatcttggaggcaggtctttctctagctgagccctgatgacatcacagctagggcctctatgttgatttcagccttgtgagaacctgaagctgtgcccagattaaaaaactcatagacaccatgagcaaataaacacctggtgctttaaatgcctaaatctgtggtaatgttattatataacaactattaacagaccgtggtacatgggagtgcagtgctactgtaagaggttggaatgtgaaagtggctttgagaccacggaatggcaggaagcagaataattttgaggagcacattaaagaaaatctaaatcaccttgaaccatccattagtagaaatctggacttaaaggacatggccagtaagggtttagaggaaaatgggataaagaactaaaactgaacatcaaaacagatggtcttcccaccacacacacaaaaaagaaaaatttgtgacgtgatgcatgtgccaattggttcaatttagccatccacaatgtatgcatattttaaacaacattttgtacatgataaatatttacaaatttcatcaaaaataaattagttattgaaaaagacaaaaacacaattagaaaaacaggcaaaatatttgaatagacatttctataaataagatacactaatgtccactaagcacatgagaagatgctcaacaatattagtcactaaggaaattcaaatcaaaaccacaatgagataccagttcatacctactaggatggataaaattaaggaaaaacaaaagtaaataagaagaatgcagagaaattggaactctcatgcgttgctgttgggaaagaacattggtgaagtctctttagaaagcagcatggtgtttcctcaaaaagataaacatagaattaacatccaatgcagcaatttcactcctagatatacagtatacacaaaaaagttaaaacagggacttaaatggatactcatatgccaatattcagtacagcattgacaatagtcaaaatattgaaaatataccaagtgtccactgatgaaaataatggataaacaaaatgtggtatagccatacaactgaatcttattcagccttacaaaaggaatgaagttctgacacatgctacaacatggaagaaccttgaacattatgctaagtgaaacaagccagacacaaaatggcaactactgtaggattccacttatgtgacatatctataataggcaaattagtagagacagaacataaattagaggttatcaggggttgggaggagggtggaataaggaatagttattattgcttaacaattacagagtttatgtttggggcaatgaaaagttttggaaatagtagttacggttatacaataatgtgaatgtcaataatgtcactgaattacacacttataaatgattaagtggcaaatttatgttttttttgtgtgtgtgtgtgtaaaagcacagtaaaaacttaaaaagtaaacaggaatatattatcaggaactggaaaaagggagaactgcattacacaatgggtgaaaactgccaaaactgctacctttgttaatatgaaaggcaaaacacataagttgaattacatagctaaggaaatttccaaacaaagtgttgaaggtgctgcttggtctcttcatgctgcttacagtgaaatgtaggtgaagaaagactgaggaatggattattaaactaaaagaacaggaactggatgattttggaaatcagtcacttttaatggcaaaagatgcaaaaaatatgaaatagctttcacagtcctttcaagtactgttagggaaggttggaatacagtaaaagctgatgtagtgactgtaaaaccttttattgtaacctcagaaagatgaaagaattggagtagtatttagttacacaaagagtcctttctagagcaagtgtgtgcctcacagatcctctcaactgcatcagatcacctctagtgagctggagggtgttgtctctcagccatctcagcagcaccccaaggtagagaagagctaactcaaaaaggtctgtgaatgtagcttttgtttagtggagtaaccttgtagaaatccattgaaggcccataatgtttttaagaaacttatttccacaatgataccagcagcttggatggaaagggacagagaaaatacacatgaaaggctgctggaaaccctgcacattctactgacaggaaggaagctgataaaactacctagctacaagcacgtgctctcttcaagaaaaagaaagcctgactcaggaagcataactaagagtccagaaggcagagccaagaaccataaaacattatgcccactccctgaacttaattaagcaactccaaacacttgctcagctagatttcagaatttatatggaacagtgattccttcataatttccatcactccacccacctactgcctttttgaacagaaatgtctaaagctgttatcctttgcctgactctccaagtttgttagtggcagataacttctccctttggctttagagattaacagactgatgggaactacacccagacagcctcttccacatgtgggcctgatgtaaataataaggttctggactttggggagatggcttaatgggataagactgagggaccttgaaagtgggtgaaatgcattcagcatgtgaggggtagggatgtgaatgactggggaacagagaatcaactctggcagatagactctatggtggccctagtgagctctgcctcctgatattcataccctgtgtcatcacctcctctaggttgtggaggcctgtgtcttacttccaaacaacagaatatggcaaaggggtgagatgtcacttttgtgattatgttacataagtttgtaatgcccatcttgcaaggagactgtctttcctgctggattttaaaaggcaagtgacaacaccaggaaggatcgcttggcaagaaactgagagtggtctctaaataacaactatgtaaggaattgaggtctgcagtttgacagcccacaaagaactgaatacaaacaactaccacatgatcttggaagtgcatccttccccagtggagcctcagatgagaccacagttctggcccatgttttgattgaagcctgctgaggccccaagcagaggatctagctaagccatataggaattcctgacccactgggactatgaaatttcaaaaagaaacgtgtgttgttttgagccacaaagtttatggaactaccactacacagcaggaggaaactagcacagataataacatttgcatcttgataatatttgcagacgtccatttcttccttttgttagtagcctctctgggagttggtgcttctactcagttcctgctactccagaaaatcttttcaaggaaatgtcagaagagaaaaagaaactgtctatacattttaaagtacatgtaaaaattaagctagagttatttttcagaaaaaaaaattatgtaaatacttctgagatttttgttgcaacaaagctcccattgaataattccacacactggagatgtcccagatgaaaaatcactaactataaacctaccattaacttagggaatcttttgggaagatcaattcattatcttgtggctacccaggatttcttgagggttgatggtgtttaaataaatatgatatacatgtatcaattattttgtatgcctagttcttagtcttttgtattctcccatggagatcatagtctccttcaatcttgagcttagtcctcaaacatctgcattgttggaatcagaatgcttttatatttcttaggtgaagagacctttcatataacatggcagagacatctaagaacctattgcttatgaagaccacagaggaaactttaggtacttggtttttctggttttcattaatctcccagtagccccctagaaagactattcaatagaaaagcttaaattctataaaaattttacatagtccctgttcttactatccatctattatttaatttcacgttttcctccattgagcaaatgctaatctacaaatgaacatttcttctttacaaaaggaatattttacatataagtccctcaaacacacttgtcatctttattgaagacaccgctgtatcttttcctgaagacaccgctgtatgaaaaatcctatgtggatgcaaacgtacgcatatgttagccacagtgttaatcagcctcttccttcctgtgtgatcagcctgggaatggtgataacacatgctaagtttgtggtggtgccttgactctagggaagcctttgtacagatggaagtgactttgcctggatgggctatacaggttgagcatcccttagctgaaatgttcaggaccattagtgttttggatttcacattgtttcagattttggaatattggtgtatatataatgagatatcttggggataggacccaagtctaaatacaaaattcattcattcacacatcaaatataccatatacacaaaggctggatgtagttttatatattttaaataattttttgcataaaacaaagttttgactgcattttgacggcaaaagtcaaaaaaccgtgtggaaatttccacttgtggcatcatgtcactgctagaaaagttttggattttgaagcatattgggtttcagattttcagattaggaatgttcaacctgtcctaggtgacaattcatagcatttaaaaacttccaaccaatttaaaattgtacaaggcttggaaataatagggagacaattcttccataataggctttcccacttatcaactggtgttagaaaatgacagggcttgcacaagactgtctcagggactgcttaaaaaatgacacaccctgcttggtaaaaatcatcttcatttcctgttagtcaaaaggagtgaaatcttaattggcaagtgaggaacacacttgaagaaaaaaaggaatgattctccttagttgattttaggttgtagtaaatacctaatagagagctatctaaacagtaagtctgttggttctgttcgtataaatactaaatgcatagcaaataactatatacagtatttttattcgaggttccagtgagctcatgtcatcaaatataaacctgctacattttaattaaaatgcactgaaagtcattcaataagtttatattagtatagctgaataagaatcctgaaagcattatgaaatttacctacttgaattctttcccaatagtgacaaattagaataaacattaatagtatatttaatgcatattaagacagattcaatgatcttgcaaaacagattcaatgattacgattgcagaggttgagcctgaaaccaaatgtctaattctacaccaagaaacaaattgttaaatccaagactaaatcaaaatgttgccatgatgtgctgaaagctcaaaatacacgtggaaaagagcccccaatttgggttgtgctgcagcttcattgagggtatttctgaatatgccctcccatgccttccagaggattaactgagttctgaggaaaaccctaccgcacctgcccagtagtgtctgcatccgggaccttcttaggtcctccttggaactggagctttgagatctgtctggttaaattctcacaagagtaagtctcctgcagacgtacttccagagtctccaggagcctagcacagcacagaggttcctgggtactctaatcccttggcaattgctcagcggagccagcccagctgtgtaggcaccagagcagcccagtgatgctgtcgacgaggctttgatcaaaattaaaggatgccaggaaaagaagaggacgactggctcagcggaaagggatgccacacataagcttaggcagatccaaaactaaaaccgcggggaactcgacctggccggaatgagagtaagcgtgaggctggcggtgctggcagcagggtgggcacgtacctttcctcgcggttctgtcccacgcacacccggcccccgtgcctgggagtggggttgctgcaggagcgctgccgcacctggaagccgatcccacaggtagtgctgcagggagaccacgaggtccagggagtccagcctccgttcctgagggaagggaagcaatgcaatcattaggtcccgcaggctcagagtccaagccctgtctgcacccacggccaaatgcctgtgttcctcaggaggatcacgcttggggctgctcaggagagaaaacaccagccaggggactgaatggactgcaccctgtgaatctcaattcctgtgtctgcagcccccaggcatctggtttatagccaagataggaaatttgagaataaagttttaagtgcaccataaataatggactatattagaaactatcaaaaaacttgagtcatgaaaatattaaactaataaagaataaggttatttcactgaaaagcatttagaaatgaatccctacacctctacagtttaggattttttggacttgtattatatcatttataatctatgagaagtgcacctttggacaaaatgctcatctaaaactgccgaaaatgctatcttttaaaatctattaatatcaatgaaaatcagtaactttcctgatagcatcaaattgataaagagtgttgtactgttagaataactatcaaagctttaaaacgaaaatgttgtattgttagaataatattcaaagctttaaaacaaactttattaaaaatttaaaaaggatgtttaaattcagattattggctatcttttcacagattgacagagacataaagagtgcaaataagaagtgcaaattgcatataactaaccatgtgtatttatgttattacacatacagagtaatgtagatatataaaaatataaaataaaaataggatgaaccaatttaaaaaatttttttaattctattgacagctctagaaatgttttagtattgtattttttccttaaaatgcttgtattcagactggttataatttaagtgtcccccttaacacgttgctcctgctattaaaaaatacataggtttttttttaaaattttatgtgttaaaatatatattaaatccagattccaaacttccacatagacggtctacttcatgcagaatttttttacttctgcaatcacatatgcatttctttggatatttgtcaccttcatccataagatttacatttcctatgaaaaaatattagctcacattaattctcatttttacttcgtgtatttccttttaaaacatggaggtcaacaactatgccactgaaggtcctgctataaataatatgttgaatatatcatattaaaaataatttcaaataaaaatttttctgagaaaattcttagaatatttcatgttttcctactttactgaaacctaatgatttaataaaatatgtagtaatagctttatgtatgatattataataaacctgctctataataatataaccaaaattatcacacaataagacaaatcttcccacatttcttataaagataatcagctagtatcttataccctgctacctaaaatcttaaaaattatccatgttattcactgaattatatttaaaaatttaaatagcagttttaatataaataaattacatttaatttgcaaagtttcattacatgtgcaaaaagttgttagatcatgaagcaaatggtgctttcaaatttgtttggaaactcttcattttttaaatcttttagcaaatgtggattgatttttttttttttgagacagagtctcgctctgtcgccaggctggagtgtagtggctctaactcggctcactgtaacctccgcctgctgggttcaagagattctcctgcctcagcctcccgagtagctgggattacaggcatgtgccaccatgcccagcgaattttgtatttttagtagagacgggttttctccatgttggtcaggctggttttgaactcccgacctcaggtgatctgcccacctcagcctcccaaagagttgagattacaggcgtgagcgaccatgccaggccacaaatgtggaattttatgacatattccatttacaatatatggaacatgtttgtatatagggtagtaactaaataaaagtgtatataagtaataggaaaagaatatctgaggaaagaagtgaatgcagctttacacgtatatgtctattacccagacctgagtttccatacttctaaatgctgcttagaggcagacacagtgaccaaacaagtcacataaagtaaacagagatcaggagggggtcactttcacgattattagtacaaagcaatccacttacgtttttaaagcctcattaaaactagttcactttctagatttttaatcttaaaataactactagttgcattgcagctctgcttagaaaatgactttccaactagagcaagaactgaagacagatcgataaataagttatagcaattcatttgataatcttctttttccatgaaacaatatgagcaaagagtattagctacttgttgtaatcttcaaacaacagcagtttgatagtttttgtaagttttacccaggcatctgtggaaatcatttcatttaatagaaagcatacagtacataatgcaatgttgatatgcctgtgtcccctgtaatacaaaacaaaacaaaaaaaaaccctaatctctgtggccctgatttgctcctttcaccttggtggtgagaaaaatgtgagcagagggcaaagtcggccttttgctcctgcactttactttcctggcccacttcctcttaggtgcatgtgcctgcatgacctgggctctcctacaatttgatcacccaatctgatttccactgttagtgacttcataaacaattgtcccagagactttttttttcattctaagtgggctcatggaaagcagataatatgtttaaaaaatactgcaaattaatgaacaagtgacaaagaagcataaagactgatctcagaagtgttcctgatacttgctttaaaatttctctgtgatcatggtgttataggtgcaggggatggagagcaaacagaatatagttgtaaaaaaaataaataaataaaacaaacaccaccacagtaagcggaagcaacaggaaagctattcaataggttatcttatttaaactgctctcttgattacccagtgcctaacgttagctcaggtgaggtgctctgagctccaatatcctatggagtagagcaagtcgatcaaggacttggcttcttctacctcctaacctagtgttattatatcctacccctaatggactatttgtagatatattccatgaaaagactattaaataacatggatgttttccttaaacaaagccaatcatattgtccaaattgtaaatacttttcctaatctaatgaagagtatgtgaataagcgtagatctgtaatccaatttatagtttaaaatctccttgcaaaaatcatgtaagttttaaatggtgaatgtccctggtgtttcaccacagttctctccaaaagggagttatattataaatgatgtcccaaactcctcgagaatctgagtttaatacacagcagcacaactggcgtgttctgagcggcacacctggaacagttggcgatctccatgccagggccctcgcactgccagccaccacactgcggggccgggctgtcgcaggagcgggttcgacagaggcaggatcccacggcgctgccatctgtgtgcgtgcaaggcgtccacggagaccacacaccaaagtgcccatccacggtgagattcctggtctaggaagcaaaaccaagcagaggtgtcagaaaaggttaaagctgaacacataatggagtaaaaattaaaaatccctcataagacaatcaaaactcctctagaatttgttgttgttgttgctgcagttagaaaaagggccaggcgcggtggttcacgcctgcatcccagcacttcaggaggccgagacgggcagatcacgaggtcagaagatcgagaccatcctggctaacacggtgaaaccccgtctccactaaaaatacaaaaaattagcctggcatggtggcgggtgcctgtagtcccagctactcaggaggctgaggcaggagaatggtgtggtgtgaacccgggaggtggagcttgcagtgagccgagatcgcaccactgcactccagcctgagggaaggagcgagactccgcctcaaaaaaaaaaaaaaaaaaaaaaaaaaaaaaaaaaaagattgcataagggagtatttcaacgtaaagcagcagaggtgattgctggagatggtgaggaagaagcagggagggagacagggggaaaggggagacagaaaataagaagaggaagatgaagaagaagaaggaaaaggaggagggggaggaggaggaaaggaaggagaagaaaaaggagaaggagaagaatgatgggaggagggctgagaagagaggaggaggaagagtgaaggatactagtgacttggcatcaagttatggacaaattgtccactaatttggaaaatccaaaactaagaggaactggagtgaaaaatcacagctgcacaaccccattgcatgtttatgtgcctttaaaaaatgaaagcttagtaacatttatcattaaagacttggtttggctctcaaactgaaagcattcaattcagaacatatttaaagagtatctattaagcagctgcagcgcttctctttgttaagaatatcccagtcaaacctgttttctgatcaacttctaagagcttacgggccagtgagaaacagctagacacataactattactccatgtagaatccgacgatggattcacgaacaggggctatcggagcagaggagagaacacccaacatgctcacaaggtctgggaagagcaacgaggagcctgtgttgagtcttaaaaagtgaagaaagagccaagtagaggggctagcaagggctggcaaggatgaaggcagaggaatgaggctgccaaatgcaaagggcacatgggcattccccatcagtgtggggtgagctggtggttcaggggagcaacaccaaggactgaggaggaacccagggcagggaccttatggggaggggtcagggagccccctgagcttgctggtgtggcacctctgaaggcactcaaggggagggcatggcatcgctgggacatgcatgaccagctctggtgtggcggaggcaccagcatgtacctggctcattgaagaagggacggcttcttgccaaatctgataagcaaatctgctcaggaggtggcagtgctgctggaaggagagactcatggggcacagccttacatcacatgcccagaaaccagcaaacagagctctcctcagaaaggcaatgggaagaaggcctaagtctaagcctcctgttttggttgttgttgtttttgagatggagtctcgctctgttgcccaggctggagtgcagtggtgtgatcttggctcactgcaacctccacctcccaggttcaaacgattctcatgcctcagcctcctgagtagctgggactacaggcacctgtgaccacaccagctaatttttatatttttagtagagacagggtttcaccatgttggccaggctggtctcgaactactgacctcaaatgatcagctctccttggcctctcaaagtgctgggattacaggcatgagccaccatgcacggcctccaaacctcctaatattaatatggaaacttcagcatccttgagaaaatctgagcaaggaagacctttggtgatgagtgaaccgcatgctttcaccttgccctctgcagctggctgcacccctcctcctctgccagagttctcttccagaaccatccactaccatcggaaagactcatcatcctcacatgaaacaactcacaggaaacaactctatgtaccatacagttcattctcttcgggttacaaactatacccatacttcgccatttcagaataatgctgacaccatattttgtgggtaaaaatataggcaaactttacttttgatacatcattgacccaaatacaataggaactaacatgaaaagtgttcgttgtttttgacatgaccggttggccaaatccaattgctataattatgactatccctcctttctaaccaaccctctaacattttctatccagtaaggtggatgggattgggaatttccttccatacctggctatctatgtaagaaactgtggcaaaacggacggaatggagctgcaccatctgttagagcaattcttttctttttgtaaattttactttaagttctgggacatatgtgcaaaataatcaagtttgttacataggtatacatgtgccatggtggtttgctgcatctatcaacccattacctaggttttaaactccacatgcattaggtatttgtcctaatgctctccctccccctcacaacccaccctccaacaggtcccaatgtgtgatgttgccctccctgtgcccatgtgttctcattgttcaactcccatttatgagtgagaacatgcagcacttggttttctgttagagcaattctaagtgatacactggatcctacccaagaggaaaatatccccatttccaaggtctcggtggcctccctattggctaagatgaaaagacagtgcctactctgatcatgaggttctctgaagaccgtagagctttcttggagaaccaagccttgcatgacaacgtgactcaagccactaatacagaagattctgtgttaaagaggcaaagaccctaccatttgggattttcaacattctcctttcacctgtttatcagccctccctcttgtctccagccaaaagactcctgtgtcagtggataagaggtcactttcactgtgagcaaacgtagttcctatgcttacacatcctcgcctgctttcacatccagactcctgcttgctgtgcaaaccttgctagtattgttttgactgtcaaaagcatgtctcttgttcatggagccagcctcaagcaataacggtggtcagacagaatatttgcatcatagttacacaatatataggtctgtactattttgactctttgcagtgtgggcccagttaagaaaccttctagggctgctgaaggccccagcagacaccaccatgggagctgtgaccatcctaagcctgcaggtgggagggaggacagggtggctggagcaatccttagttgaagggggtaagggagtgatacccgtcttattcctcctgcccatgcctctcattacctgagcccaaggtcacaagacagcaagggaaagaggatcggacattggatgtgaggaaggtcagacccttgaggcagagagttagtggggagggagactgtttgagaggctctctgggacatctgttcatccttagcctcacttctctatgaaggtgtaacagctccaagagttcatcttgccctccactcagaaagccaaatgcactgggaacaacaggaatgacagcaaaaaaaaaaaaagagctgaattattacagggccaggcaagtgaggagaacagaaagaaattcctcaagcctgactccctgagaattcagaggctaggggtttttgagggtactttggcaggccggggtggggaactgaaacagttgatgaaatcacagcagtgttcaaactgccttcaggcagctgagtcagttcctgagagggggtctcggactacaggacagcttttggtcagctgaagtgctaaatctgaaaaatatctcaaagaccacttctttaggtttcacaattgcaatgttatctataggggtgagttagagaagttataaatcttgtgacccctggttacctgaatctgtggtaaccagcttaaagaaaagcaggttaaatgtcagcaggtcattgctcatgcctattcttcagcaaaggtcaagcccttaccattgtgaatacagtttcaatctctgaatacgaggacagggaggtaagttttccttgcctcaaaatttaaccataaactaaattcctctcacagttatcttggcattggtctctgtgttattatatgtaaaacaaaattacataaaacaggttagcctgcgacgttaaaagcaaggtggaatcagtcatgctggaattctctcatcacttctaattctgcaaaggctgttccagaggtgtgaggggtcattcaggttgggatgctatggaggtcaaagcagttctatcctggatgctaatccaccatgctgacttctgattaacccaagttctgggaatgcctctaagatttccagtttacctattgttccttgtgtaagagcatgtacttagcgcaaacagtgcccttcagcaaattcctaggcattccctctgaagcacatatacactttccctatggctcataagccctgggaataatggcatggagatctacctgtcctgcagctgcccaagagcatatttctctctgtaagttcccaataaactcaccctgtaccgacaaactgactttgtctgcctcactctttggtttcttgggtccttctgtgtttgggggtttatttgcacatatgtccctttcatgaagcagatgcatttgtgatttttttgaaggtttataaatccccctaatattaatcagaaacatttgacatggcagaattgggacaaattagagaatttgaggcaaagaagagctttccaagcccctttggtctccattttctcatctaaaatacaaaggaaatgaccagggaggttcctaggatctccttagctctaagaggtcataaggaaatcctaaactcataatgatatagatgatagaaatatctaagactgtgaggccagaaggaagtacaatatgatggtgacaaccgaatgaagacggaaacagaaatcactcagagttccagtccacgtgattccttaaaataatctcctgtcctggagggaacctgagaatttccacttttccaaagaggctaaggtagggacaccagccaaggtaaatggatttttatgaagaaagtactttgaaaaaaagaggatttgcattcattatgggaattattcctcaccattgtgaggtggagcagagggaggaggaatctgtggtgagttgggctggcaccaccggccatgcttctgaacctcaaacaggacatatctgaggccagggttgaatcctgactaggctataagccaatcatggcaaccccttcagttgggccagtgctgggtctagaaaccgacatgtgacccagttctggccaatgagactcaagaggacactgcaagaggtttctagaaactattttcattcaaatgaagaggaggaagctttctctgctccttctcttccttcctgctttggacatggttatgtgtgaatatgatacttggcaatcctactgccatcttgtgagcaagaggagaaggcctagggaatcaaagacttgctcatctgctgtcctgcctgaattcggcagcagaatcagccctgaaactgctgcctcacgatataccacaggatgaaaatagtccttaattaggccctattcacaggaaatttaattaccattaggcatatacagtctatatgatttaatttctttatgctatttttatagaaaaattaaactaagattcatatgaatttgataatatcccaaagaatccctagctacttatttggaagatgtaatctgaagcactggtcttccttttctccactgccccagagtttctccacatcggcactattgacatttgggctggataatttgctgtaggggctgccatgtgcataacaggatgtttagtgacacccctggcctccacccactggatgccagtgccctaacacccccagatgtgacaacccaaaatgtctccagacattgctaaatgaccttgggggcaacttttttcctgattgagaaccactgcaccagacattctttgttcattttcttttggcctagcatgaattagtagggtcttaagcaaagagatgctataaatgttctctttccaaatatatgaatcggcaaaagaggagctcataagaaaggcacagggaaatagaggaagaacttgaaataagtgatggctaatgaaagaatgaagaggaaagaggcaaataaaatagtgcagaaacagttaccaaaccctggaaagaaaaggaactgcattgggcaaatcacagtgagaacacacagcaattgcactctggcagggtaagaatgtgagattcagtttctggccatggccggagtagttgaagactttaagggcagcgttttcaatccaggatcactgtagttggttctactacatttcagaatgaggacttgcaatccttagaaaagtacatgggtctttgggtgcaggttctctgtgttgcatttaagcacttgctcattttgaccctgagtatattcgtgtaagaatctgcctagaaagcagatccatgaataacaatctaagttctgtggctttactttttcatatgaataggtatttttatattttcttaggcttccttaaacagacatcagacacatatctagaataaattatctgtagttgtgctatcttccagatttctgcaatgaaagtttctattaggggtatgtgtattatactatttaatattaaacattagaccttagtgagacatataccatgtagtggtagtttcgtgtatgccaggcactgtgctttacatgtattaactccttgaatcttcaacacatctgtagcacctacagcccattctacagatatgaaatgggctgagatatgataagtaagttgctcaaagtcactctggttgtaaaagacccaagaatcaaacaagctagtccagagcctatgatctcaaccacttcattctgtaaagtaatttgtagatccttctttggtgagactctcaaagaaattagcttcaagtaattttacccccaactctgtaatagcaaatttcccttcatctaggaaatagcaggtttccaagtgctagctaaggaagattcaattttgttaccaagcaccatctacaatcctatatttgatttgttcatgtccatttcattaatttcaactgaccaaggatgtagatgcatttggtgagtgcagaggtccctggagttcatctttagattcttactatattccaaccactattgtttcatgacttaattgaagtcttatttttctattctgatattttttcaaaaattaaaaaaaaatcttcctttttaaaattttcatgtacgttttgccatagaatgtaacaaaacagaatgttagatatgctcctcgggaaagcttgtctcatgctatgatatcaactaagcatcatccctaagcctatctctgcaaatgagttacacaggaaatgcagtgcctccaaaaagaactaagctgaagcactgtgcagcctctgataggatgggtgaactggggcaatagttatctaatacctctgagccccacctcttccatttataaaatggaagcaaaaatatccatccctggggatcacagtgaacgttaaatgagataatccattgaaagttgcctcacatggcactgagcacacgttccagacatacaagtaaaccttagttctcttttctttctcttatattaagattctatcacaaaattcagaaataatctctcacctactctctaagcatcatctgttggtgatgaccgtgtcacccctgctttggaaagacgttgagagcttagaagggcattatcctgaagattaggtataatgtcaaaaatgttgaatttaaatcctggtttctttcccagtgcagttttggaacatttgataaaccccttagactatagtctatggtactgccatctaaaagagggctctgggcttgatcactgctaaagtccccttttattctaaagaccctaactacataatggcattgaggagaatcctgttattaggagaccccctaggtgtttatttgctccttgtattttgttacttattacatgatgtatagctcattttgcatttctgtaaaggaatacctgaggctgggtaatttaccaagaaaagaggtttattttggtcacagttttgcagactggccaagaagcatagtgctggcatctgcctctggtcctacaaagcttacaattatggcagaaggtgaaaggggagcagatgtgtcacatggtgagagagagagtgagagatgctagggtctttaaaacaaccaactctcagctgggcgcagtggctcacgcctgtaatcccagcactttgggaggccgaggcgggtggatcaaaaggtcaggagatcgagaccatccaggctaacacggtgaaaccccgtctctactaaaaacacaaaaaattacccgggtgtggtggtgggcacctgtagtcccagatactcaggaggctgaggcaggagaatggcatgaacccaggaggtggaagctgcaatgagctgagatctcgcaactgcactccagcctgggcgacagagcgagactccatctcaaaaaaaaaaaaaaaaaaaaaaaaaaaaaaaaaaaaaaaaaaaaaaaaaaacctgtcatgtgagcaatagagcaagaatgcagtcattactgaagagagggaatccagccattcatgagagattcgcccccatgacctaaacacctcccaccaggtcccaactccaacactggggatcacatttcaacatcatatttgtggggagtgaacatgcagactataatacatgatgcattttggaatagggactcattacatcatatggtaccctggtcatcatgtatccacaaagggtgtggatggtattcatgcataaataaaactcaagtagattcctaagactatgctacccttgttaaacaacattatgatttatgcaggacatatatattattctaatcagtctagatatgccaatttagattttactgatgcacttcaaatctcttaaactgagagtaatgttttcaattacaattttataagcaaacagaacattaatcaatatgtgagtaaactattgccctgtcatctgtactatagaaacccataaacatttttaaatagggatccctctgtagaaaataagtcttctttaagtccctaattccctagaaatatttattgggggtcccttatccaattcaaactctctggatagcagaggatttaagccactgccatggcctgaatgtgctccttccaaattcaggtgtttccagtgtgatactattaagaagtggaatcctgaagaggtgattaggtcaggagggctcctacctcaggaatggatttggtacccttataaagagttgtgacaaagaaagttggctgtctcttgccctcccaacttcttctaggcgggacacagcaagaagcccctcaccagactaagtagtggtaccttgatcttagacttaccagccttcaagacgatgtgaaataaatttctgtccaatttaaatcactcagccttatgtattctgttgtagcaacataaatggtctaagacagccataagtcacagccactgcatgaagtttgactagaacactaactttgggaaactcagttgtgctatgtcattgatccaaggtttgtgaaagtttacttgggagggtcacacacaagagggtctgaggttgactcaccatcatcaatattcctgtaactcttattgcactcaatgtaacaggatctcctgtctttcattatgcagcttgcacttttacatgaggtataaaatatttggtctcattcaaaaatccctcagcttataaagcttaatttcctttggaaagagatacatacctctatgatctatatacgtagaagtaggtaacagtgtttactgattgcaaacttccctctgcttttttttgtattttaccatctctaaaataaactggcatcttgcaatccatgagagtgttttttgttgttgttgtttcttagcaacatataaagcagtggtacacatcacaaccagtggcatatcagaaatgattatatatgatagatttgcccaataaaattaagcccttgttccatttcagttaaaaaataacacggaagaaaattacatttcaatagtttttttaaatacctaagttaatactgatgtatattaatgcaaatcatttacatctaggtcatctccttctaagagacagatttttagaaagagatgtatagttagataatatgaatttctcattttcaaaatggtagcctatataacccagaaatatatatggtttcctttcctgtgttttgtgcaaaatgacataatttattgtcttttgttgccttctttgtatatgcttaacttatctaaagtgtatcttgatatgtgataaaatacattgggtgggatgacagacatagttttgtgtaatgaaataccctgtcatcagaagaagcagaccttgtaatgagtgttttgctgactgagagccagatatcacatctcagctttatttttgaaagcagagatggtagaggaggcagccttgacaccatggcagatccttgttaccttctgatcttacttgttaaaaactcaagtaaggtcagaaggcaacaaggacctcaggtcctctcagtagtaggaaacaactttagtgaccatcctctcttcacttctgaaatattaaatctttccttttctttctttcttttttttttttttgagacaggtcttgttctgttgcccaggctggagtgcagtagtgatatgctttggctctgtgtccccacctaaatctcatctcaaactgtaacccccacatgtcaagggaggaacctagtgggaggtaattgaatcatgggggtggtttctcccattctgttttcctgatagtgagggagttctcacaagatctgatggtttaaaagtgagtttctcctgaactctctctcctgctgacttgtgaagaaggtgcatgcttgcttcttcttcactttctgccatgattgtaagttttctgaggcctcttcagccatgcagaactgtaagtcaattaaatctctataccttataaatgaccggtctaggtatttcttcatagcagtgtgaaagcagactaatacaagtggcatgatctcggttcaccacagcctcaaactcttaggctcaagcaatcctcccacatcagccaccagagtagctggaactacacgtatgcaccatcatgcctaattaaattattttacttttctgtagagtcagggccttgctatgttgcccaggctggtctcaaactcttggcctcaagcaatcctcctgtctcagcctcctaaagtgctgggtttacaggcatgagccactgtgcccagccaactctccatttaatgactaaagacatatacaatacatacattcattataaaccaagtgcgtgggtgtgtatttctggcccatgaactccagcccacaaacactagagcacagagggaaagcccttctaggttgagggtcccacggggacaagctgcctgctgggaagctcccattacagatagtaataattacataattagtatctctcagatatatactaaaacaactctgggtcctagacaatggccttattacttaagaaacacagctattatcttgtgccttttttatgattaaaaatgcaagatcaaagatctgcaagaagatttgctgattcttccaaagtgtatgtctgtactttggaaccacatttcaggtattaaacattatgttttatcaagctgcaaagaatgaaaggtgagcacccttgtgttcttagtatttttcagaaataggaagggccttagaacaaacaatgacatttttctaaccattttaaagggattttgcagaaaaattggctactaaaataatagatctgaagttaaataatcatgaggacccacagctaatcctactaggaagctgtccagagcctagatgtggtgatgcacacactgttacagtgaaggccccttgattcggtgccaacatttgggaaatgacactggtttgaatagccccagacttccttgcttcatcctgtctggtttctggttttccgactttctttttttttttttttttttgagatggagtttcgctctgtcgcccaggctggagtgcagtggcacgatctcggctcactgcaagctctgcctcccgagttcacgccattctcctgcctcagcctcccaagtagctgggactacaggcgcccgccaccacgcctggctaattttttgtattttttagcagagatggggtttcactgtgttagccaggatggtctcgatctcctgaccttgtgatccacctgcctcggcctcccaaagtgctgggattacaggcatgagccaccgtgcccggcctggttttccgactttcaagctgaaggacaggctttatgaatatgtggttgagataacagaaagggtaagttctttggtgggaaacaggctgactgttgcaacgccttcgcagttctaaagcatggaagaaacagcaaggagttcacacactgaatgtgccacacctctgtcttgcagagatacagcagaactgatgggcagagatcagcagttttgtaaaggcaacatgacttatgacttttccattatatggaagttaataactgttgttcatattctatgagaacacataagagaatttaagatgattcaatgaaatgttctaaaggccaaaaaccctccaaaaacaaacaaacaaaaaaaaagcaaaaaatattctaagtactggttcctataaatgtggacccaaacacatatatcagcaaaggaaaccatgaaatgtgcttttcttggattcagtctggctctcaatacaggtgagtttctcctcattccatagagtcctctatgggaacgcacactaggcggtctcttccagaccttcctgtgaccttgaacaggatctacgggttggccccacatgaaggtgaaagtaatatcctttagtttattcttttctcatctttccttatgtcagcctctggaattatatctcccaaaagaaatttgtgggtgtggaagtttctcttttattagcgctgtaaggggcaaaatagtccacaccaaactctggagggggaaaaaaaaatccaagaataaaacaaaccataaactccattatcaaatcaacacagttttctgtgaagacatttctcttcaaacagacaaaaaaacctataacagcattccacgtggccctgtgcaagccaagagctgagtgatctgagagagcacagactgggtttgcaaaaatggttctcatatgaaaaggtgcagacagcgtgacagtgtgactgaggatcgccaggggagcatggctcccatgggcagcattttcagaggatggagaaggtgggcactcaccggacacgcagagatgctctgttcccactgcgtcatgctcaggctctcctccaggcttgtgcatttcttcattaccacatcccagccacagtaagggtcctgggccccaatgcaggtgctggaaacacacaccaaatggtcaacagaaaggtcgctttacccatgataagatacacaagacaaggcgaacctgtcccttggcagagaggtatgggatttcttacatatgaagcccaatgggtatttaggctgcacactggagagcacagctatctgcacactccagtaagtacctaatattaaatcatttacacagacattttgaaaaatctatgttttaatctaacatacatgacagatgactaaagatgagccaacacgagcattttgctgtcataaatagtgctaaaatcaagattctacaatgttcaaaaacaatatagctgtgctcaccactaccgtcaccatgatcatccgcctcctctttacaacatgtattatttgtttaacacctactatcatattaactataatacaaactatcatagcatgcagacgcttaaacgatttgataggcaggttttatttactgttaccatcaccataatcatcatcgttattaccaccactttattgatgagaaaactgaggcacagaaaatctgagaaattagcccaacaacatgcagatacatccaaaactcttcaacatgaatagttcaaactcaaaaaataggagcatctttcatttgtttactgtagcttaaacgtattaaaattttcaatttaatagtaatttcatatagttgtgtctataatatcctacatatgatatcagaagtattttagatggcggatattttctttttaactttgtctaaatgaaagagttcatacactacatgggcattattagatgagggctgtggcctttacattataaagacaagcaaaggtaaatgagggaggaagaagacggagatgatagcgatggagccagaaatatacagaagataatgtcatgggcacgcaggacattgaacctgggaattctgtgaatgcaccaagaagttggaggggcaggaagcagatgtgaggaaagagagacaatgccagcatggaggtgccaatgacccctcttagaggcaggatagtacttacagtgagggaggtcctgttacaaactagtcaaggactagaaatctggtaggaccagaagtcatggcttaaccatcaaccctgtcagcagggaggtagcgtaagtaagtaatgatgagttgttcatatttataatacaaaataatcattgttaaaacaccaaatgtattaatcatatataaagcagttttctaagaatgtgacttatatttggtcatttaaaccccatgacaaccttattaatacagtacctcaattaggcactacattgactgtcgctttgaaatgaaaaaactgaaggagggaaagatcgatttgaaggctgtacagctagggaagatatgtttacagttgataaatctactgataggtagtaagttattatacaattgtcatttattaattacctaaagaagtgcaaatgatttaaaaagctgtttctcagaagtagggctaggttggggtacaaaaatgtatgaaacaactacctgttcctataacctcattaaaactccttgatatgcgaccatatgcagacatgacttccattcaaaaatacaaacaaggcagttataaaggacaaggggaaagcctatttccctagtagtagtttatactgtttatactaactcacatattctgcagatattttatccatacatataagcatgcttgtgtacacatatctatatatacatatatatattttgttattgtttataggcaaatatatgttttatataataatgatatgcaatacacacaaatgtgattgtgcacgcggtttcgcattttgctttctacaaccaataatctattattgcactattcttgtcaataaatatagctctaccttactccctttaacagctgtatagtgctccatttctttgatgaaccaacatttatttaaatttccctttcattttattttatttattttcaattttttatttccataggttattggggaacaggtggtgtttggttacatgagtacttttgtggtgatttatgagattttggtgcacccatcacccaagcagtatacaatatccactgcatccaatttgtggtattttatccctcacccccttcctacactttgcccctgagtccccaaagtccattgtgtcattcttatgcctttgcatcctcatagcttagctcccacttatgagtgagaacatgcgacgtttgcttttctattcctgagttacttcacttagaataatagtctccaatctcatccaggttactgttaatttattcctttttatggctgagtagtattccaccatatatatgtatcacagtttcttcaacctctccttgatggatgggcatttgggttggtcccacatttttgtaattgtgaattgtgctgctataaacatgcatgtgcaagtgccttttttcatataatgacttcttctccaccagatagatacccagtagtgggattgctggatcaaatggtggttctacttttagttctttaaggaatcgccacactgttttccatagtaattgtactagtttacattcccaccagcagtgtaaatttcccctttaaaattattaactttaccctttaaaagcaaggctgcagtgctcatttttgtatgggttttctatatgataaaattttattcatgtagttataggcattattaaatttggaccaaccaacaatatgggagtgcctctgctgcctcaccctgttacacactggatgttaccatattttttaactcacccaaagggtgagtctttcagaaagctggtatatgaaaaaaatagaatttcccaattgtctgttttcatttctttcagttgtgtcttaggttaaggcttagcatagatgaatatactttttaaacatttgcattttccatgtgtaaacttcctatccatatccaattcctgatttgatctctttcatgagtcattcattttattacatggtcactggaaggggtgatttttgcattaaaatgcagccctctctgagtaatattttccctgtttgacatttttttcttgagatatacatgttataagattttatgcagtaaaacttatgaacacttttctttatagcatctaatgtgtgttccatgttaagatctttctcacttaaatcttcccaacttaaagattaagcatcaaacattatagaaagattaaagattatagaaacatcactcccccgattccttctgattcttctaaggtatcattttttggctccctatcctttatccacttgaaatgtatttttctcctcctcataaacaaacaaacaaatcaaaaatcacaaatacatattaaaaaatctaaacatctcaaaccccacacaaaacaaacaaattcaggtgttagaggaagagtaatagatgtgagtatggtttcttttcccgttattcaaatgacatccttttcaattactacaagtttataacagagagtgtgagcataagcattttaaaatctctagctttgggaatatgattcccaataatgtactattttaaataaaaaattattccaatgatcagtctcattgaataaaacttgaacctgtatttttattgtagaaaacacataaaaattttctcaattctcaagacacgcaattgatttaataacacttttttgtgcagggaatagagaagatgagaataaactatcacaaccaatgactaagaccatgaaaagtgtgcatttattatccaggtgtcagcaatttcttcctgagtaactttgcatgtgcagtgttgttctgtagaaaaatgcccagaggaagttgctggaaatctggagacccttcaagtgcaactcatgagacagacccgggtggggtgagcgctaagagtccttctgctccctgctgtgactccacctggctgtgccaatgagatcgaatctgagagtgtcttcatcttactaaactagccaaaagtgacatatttatatttgcggctcctatggcaaacctgagagtaattcttttattgacaaaataacatagtgtatatcacatatgggaattctctgtgtatgattctttacacagagcaaaagcatagcgaggctacacttagagatcattcaaaaggcctgcattccttttcgtgtttcttattaaagcaacatgaccagtagttaaaattaaacctccaaaaagggaaaaattccacgggctcctcacgtttaccccagacttcccatgcaaagctgcttggagacttaaaacaatgccacagtgttagagggaagtatttcaagctgttttaagtggaaagctgcatgtaataacatctctttcttctgatgattccaatggttctgcacgttcttaacattacacttatcctttaaaatgttaaaatgtctttacaaacacaaatgcccattcaataaaatatcatgtatatttaaatataatttcctcatgcaaaatattttacaccatgggcaaaattctgatgagatctacctttattctaaattatgtcttaagaaaatctattacacaattttatttttggaagctggatctctttaagaaactgtggaaaatcatgggtttccaattaatgcagccattgtgaaagtggcttttctgtattccactttgaaaatgtttttccttgtgtggtaaatatttttaataaaagttttagcttgatttaattattctaaattgtaaacatatgtcatagcatcattttgtaccccataaatatattctgttcaaatataattatcaacattcaattttaaaatttccataatgtgttaatgaccttacactattctcattttacatattaccctggtatttgaaagtatctgaatttagataaaaatgttagtcagaatccgaaggtttaatttttttcaaaaacacacttattgagggtattttttagagctaaacatatatttggagacaggccttaattctaaaaagcaggataaatgtctactttcctttccacatgacaataacatcaacatatatctaaagtatttctttacattttaaaaatttgcaattacgttttttgttagttggagtaacagaaaaataagtttattcattaaaatattttcactgtatttctgaaaagttgagatttattaataagtacaattcctcgtgcctattagattatctaagtatcagtgatgactttatctggcttgtcactgtcacactaattatcattaggtcagtttatttttgatattaagaatttttgccattttgttaatataaaatgtattcttacacatgggattttaaaagtgtttcaatcatgtatcaattcagcacatacttacgagcacttgctatgaagtcaactttgaaagtgctgggtgtaccatggcaaacagacactgtcactgagctccaagaacttcccatttggttaagaaagtaaatattaaatagttacatgataaatatcaacaaccagttgcaaaggaagaattcaaagggccataagagtctggtgaatccccacttcgatgggtgggtgagccttggatgagaggatatgtagggactggaacaaatgggatgaacagaagtgacccatttgataggcgccagcaagaacagaacctttttgcagagagatcagcttgggaaaagcactcagtggggagagaacttggagagtttgaagaactggtaaaatggaggctggacttgggctgaagcttgaggagagaaatgggcagagtccttgggctccactaaagattgagggtttccttgcaagtgttgcatactttaaagtgcttcccaaatactgtgcaagagccacacttcaaacatcaatattaacttctattatcattacaatgattgtggtagtgatcaaactgcctatgaattatcccttccctaattcctatgaaaatctgtcccattcctaagtaccatgttaccatatacttcataagctattcttgtactttaagagctgcaattaaaaacattatctggccaggcacggtggctcatgcctgtaatcccaacactttgggagctaaaggtggctagatcatttgaggtcaggagttcaagaccagcttggtcaacatagtcttgaaccatgttcaaaaatagaaaaattaaccgggcatgatggcacatgccatgttgggaggccgaggcaggagaatcacttgaacctcagaggcagaggctgcagtgagctgagatcgtgccattgcactccagcctgggtgacagagtgagaatccatctcagacaaacaaacaaacaaacaaattatcttacaaaaaataagactgaagaaaattccaagtagacaatagccttcctgagacatccacagatccttcaattggtaaatccaactagaacatacattttcattgttttcctcttctgcaaaactagaacaaaaatacctattcacagggctgtttggagagttatatcgtgctagacagtatataaaaaaggtttttttgagatggagatgcatacagttgttataattagtccctaagcacaatttcaagttattatacactatggatttctgaggtagttgaaaacattctatattgaaaatactaagtccagcaataattcacattacatgctatgatttgtaggtgaaattaatgtacttgatttcaattagtgattaacttttaatacttttcatgtattaaaactactcggcttaacattaaataacactgatcaaatacaatggctgttttttacatttcattttgcacttaatattaaatttaaataattgacttatactggcactaatattaagcatactaagcatatgttcttttagttaaaacccataggcaaatataacatttcaattttcctgaaaaatctgttttaaaattgaacaagattgatacacattttacagtaaagcatttcaggaaaattgataatttaaaaaacagtgatgggattagatagagcacatgtgaaataagcaagtcaaaagttcttcctggatctaggacttgtgattaacttggtttgccagctttggtttctgacctgatgcagagaccccgttccactccctctttaagcactgaatcctgagctgtttatcttgacctccttgtgggcttcaatcattgtaaattttctctagaacaaatataaagtctttctagaaaggccaagactgcctccaggacaaagccaagaaaggcagcctcttccatggctaggattgtaccaggggaccaaaaccaggacaaaggaggcacagggtgtttcaatggcccaacataaaccttccatggttccacgatgtggaagtaactcaccaggaatggcaaccagaaacagctgtgtctatgtgctcaggaagaaaagaaaataattactggtcacttcattcagggagaaacccacaccattggtattccacattctctattccataagtaggcataattataggtacctccaaagttcaccctcccccagtgtcctctcctcttggctaattaagatttaaaatgaagacacaattacttatttgctatataacatgtttttctttttcaagagaaacacttctgtgaaatagggtttaagggtcaacaattatgcctgaagaatgcagaaggtgtcaagtaatacattttaatttttactcaaaaccttaaaagggcataagtccagaggggaaaatatgtattattctgttttcttataattcacctaacttaacagtttgactgcaattgagtggaagaggttcaatgccaaggaacccttctgtgtagtacagcccacccctcagaaagaacatttgtccctctcagcgggtagttacagcaagtgtgaggtctgccttgaatgtggattctctggtgccctcatgactgctgggcagccggtgacagtggtgaaggcaagcacctggctctcttcacacttggccttgtgtagccttcatcagtgcctgaatcccagttgctcttgtgtggatagagacatgttcacttgagacagggaattattgcaaatccatggacagatgctcccgctgcttggatgaggccatgctgacatcactcacccaagcacatcatgtggtcatgctagagtctcatgaactgttgatttgccccggcagagtcaggtaacaattgaatgaaaggagaagaatcctcctctcagacaacatgaagttgtttgaaggcagagcagcaaatgattggctggtcagtttaccttcagtttagtccggagaccatgagaagtatatgtgggcaaagaaggcaaaccacacataaaagagcagtctgtcatttttactttttttttttccttctctttcttgtttgttcattcactttttattttgacttacatctaggacagagggagactttgaatcccagccttcaacatagtgtgcagaaagtgtaaaagaccactcacaggcaatgccagctcagaaggacctgcatgaactgagtatagtattaaaacaggaaaggaactatcttgtgtcaaattcttattaagtaccagccccctaacatagcctctctctctttatctccaataacacactcctatggaaacagggttgagaaataagatacaaagactttgagtaactggcttatggtcacacacacaaaagccccatccagaaccatctgaatgcaaagctcatgctctttccataggcaagctgttttgcaaacatatgagaacagttatctccttaagaattcactggactatgcagcaaataaaaatcttaggagaagtccaggtgctcgtatttagaataactcaggtgcaggggtctggagccaagaagtggtggcagctcaagctttcctatggaattcttacataactttaaatttgagagctcaaaagcaggaggcctgtggagtagatattaaagaagaaaacttttttttttttttttttttagatggagtctctgtcacccagactggagtgtagtggtgcagtcttggctcactgcaaactccacctccctggttcaagcaattcccctgcctcagcctcccgagtagctgagattacaggcgcctgccaccacatccagcttttttttttttttgtatttttagcagagatggggtttcatcatgttgaccagactagtcttgaactcttgacctcaagcaatccaccctccttggcctcccaaagtgctgggattacaggtgtgagccactgcacctggccaagaaggaaactttttctttctgatatcctttagttgtgtttctcaactgaagtacaaacagttggtaatagattttcaaactttacccagctgactgttgaaaacacacattgccatttagagaccaaggacacattctctttgtaaagcagtttcacgtgttgatgggttcttacccaccctgcccagggtctgggggtgttaccttacgacaacactggaatacactgtgctccagcccaagcctaccttggaacccctcttatcatgtcttcctcactgtcctaattagcacttaccacttttgttagtgccagcaccaacaaaaactcggtgcatttactttctgccatttctctatttttaaaaacagatttaatggtggcatccatataatgttgctgtgctttattacatttttgttgtgtcatacagatgtcttcataggtgtcgcttaatggcttcagaataactcaatcagagaacaatcgttgaaaggatgtatcataagtggtgattaattcccttactactggaaattgaaaattagaacactggttatgatacagatatagctttaaaaaataattggagaggaacattaggtgaggagattaggtcctagtgtattccgggatcagactttaaagataaatcgattttggaataaattctaaggcaactccaaggtccttcggttcagttccatgacagcaggtgattttacttacaccagaatttcttattacactctgagtcctctgaaggcagggtcagggatgcctcattcatcatcctctatgcagggccccacttggtgtttggcatgtattgagttcaataaatataatataaaggaattaattacaaaaaatccacattctctagaggttaaaccaaagccagcacaaacaaaaactcaagactttgagatttggcaaatattaaattcattctgaggggataatatttactttgtaaaatgggtacatgtcaaaatgtcctcctgaatgtttatttgattaatgaccaaatgagtaaggttgtctggctgggagaccacgtggagaccctgcaatttctctgtacacattgtatgctttttccattggcagatgctgtctttagggaatatttaattaagaaaggtgtcaacctattaactccggcttttaaaactttgacctttagagcaataaacatcctgtagtaatctaattttccatactaattttttgatgaggtgttaatttctttaactaaatgatactattaaaggctaactgcattaagaacgcccaaataccagttcactcaatagaaccaatgtctttttccttttctttttctttttctttttttcttagacagaatcttgctctgtcacccaggctggagtgtactgcaacctccgcctcctgggtttaagcgattctcctgcctcagcctcagagtagctggttttacaggcttgtgccaccaagcccagctaatgtttgtatttttagtagagacagggtttcaccacgttggccaggctagtctcgaactcctgacctcttgatccacccgggtcagcctcccaaagtgcggggattataggaatgagccaccacgtcctgcccaatgtctttttcttaatggtccatctttccctctagtcttataaggcacaatttaaaaggtgtgactcttttatatgtaagctataatacttccagttcccagattttctctcctttcccccaattagttcattaagcaaaaataaaacaaaccaaaaaaaaaaaaaaaaaacccacctaaggcccaaaggctttcaatccttttgctactgtatgatattgccacatttttctgcaaaggaattttattttgtcacaagaattttgcttcctttcaaggtatgaagtaaattagcagataagggagaggcagaatgtccatttgctaatttaacaaatattatatttactgacccttttttgagctggataccaggctgggggcttcattgaactcagaagcacagaggaagcccaggctttgggagcttatgttcccacagcttgaatgaagcctgtgctggcatgcaggaatttacagtctactttctgttctatgataaaagattaagtgcacactctttcaatgaatgttaaataaaaaattaagattgtatgagtaagtatccaaagggtagaaaattccatggtgttcagaaaatattagggtacagattaacctatgtaatttaataactcatttgataaatgaaatacctaattttctaaattagtgttattaaggaacattcatttattcaaaaggtagatgataatctaacttaggggtcagcaaaccacacagcctgtggccaaattcatacggccacctaaacttttcctgaaacacagaactggggaatgttcctctctggtgactgttcatgagtgcacagaggccacagggcaaggcttactcacaagtgacctaagctttggccccaggatcctccctggtcctggaacgcgggaggattatgaggaactgctgcaaaaccattcctccctcatccctatgtcccaggaaggctgtcaggagcttctcattgctttccaggttctgatgaggtgtaaggctttctgccccttcatatacccgcactaggatacagctttaggctctaaaactgccaggctacagcatggaacgggctcctgagagtacagtgccttagtcctcctgctgcactgtcacctggccattttgttttgttttgttttggttttgagacagagtctcactctgtcgtccaggctggagtgcagtggtgtgatctcggctcactgcaacctctgcctcccgggttcaagcgattctcttgcctcagccttctaagtagctgtgatttcaggcatgcgctaccatgtccagctaatttttgtatttttagtggagacggggttttgccatgttggccaggctggtcttgaactcctgacctcaagtgatctgccctcctcagcctcccaaagtgctgcaattacaagtgtgagccaccatgcccggctgccccttttgttttgatgtcatcctgtgggacaagggatgtggtgagtagactcattttctgctctttttttggctaagtaataaactgtctggatctaaaagcggatcacacttttttcaacagacaaatccatcagccttgcttgacccacacatctacccattcattatggtctatggctgctttcacactgcaagggaagagctgaggagtttcaacagagactggacatctgtgcagcctacaagtgtttctctctggccctttgcaaagaaagtttgccaacatgctgatccactccacacagaggccttaaaatgactttaaaagtccacatcagggccaggtgcggtggcctatgcctgtaatctcagcaatttgggaggctgaggtgggtggatcacctgagatcaggagttaaagaccatcctggccaacatggtgaaaccccgtctctactaaaaatacaaaacttagccagacctggtggcgcatgcctgtagtcccagctacttgggaggctgaggcaggagaataacttgaactcggaagatggaggttgcagtgagctgagatcacaccactgcactctagcctgggtaacagagtgagactcgtctcaaaaacaaaacaaaacagaataaaaagagtccaaatcagcggccctcccatcaccacacctctaagctgttcttttcttagccttgaagaggtacaatcagtcacactacttggaaggctataacattttcttgtgggagaaaataacaacctgatttctagacaagattattagagcacaggtcctgtggctgctcttttcctcctgaattacagaggtgggaagcctatgagttcttggccagagctcatagggtagcaggttctgacttcgcattggtgtttacacaaggcaggaagtcagtgagtggctgctcttggctgctccatcctgtgcctcctcatggagactttttccactaaattaatttattcattgtagagacaggtctcatcatgttccccaagctagtcttgaattcctggcctcaagcaatcctcctgcctcagcctcaagaagtgcagggattacaggtgtgagtcaccacttccagccttttcccactttaaagaccacatgatgctactcgaccatgagccaggtgcatggcctggcccacaggatgaggtcagctttcctgtcttcccctgttactcatggtactcatagctgggccttcccagatccccaaattcctcagaaattagtgaatgtgaactcacttttgcaacttatacacagatgtggtcaataaggcctaaaatgaaaaaggatatgcatgaatagtgcagtttctctggtactctacatccccagagatcaccaccaattccaatgagttagctttgtcttttgaatgattttctcactctatctattaaatggctgtgctaaaaaaaaatgctaacatcaaaacacaatttttttactcgtctttgaggtcaaacttgacggaaatataattttgaaatattgatcttttaaaataactttctaaggcaacagtgctatgttctgatcagtcacaacacacgtgtggtcagtacaggcaggtgttctctcaccactcccaacccccgccgcctgaggtcccaggatctccttaagaataaccagggaatggagactcagcttagaaagctttggaaaaacagagtataaaacctccttcatgtttgcttgatccagtctgatggcaagcagaatgaggaagaggctaacgggaagggggttgagcctctctcagaagacctggcttctgcctgtctgggtactgaccagctctgcctctcagtttcacacatgaagagtgcaatccagcagctccttcagctgaaatctgaccactgaatgggtggtcctcgttgtaccggggcagcagaaacaaccagtaatacaacatgggcctggggcagtctcggctctgacccaggtctcatgttgcagtagctatgtgactttgagcaggacaccaaaaatatgagctgccatttcctcatctgaacaatggatatggtatgctactttactttcaggattgacataataatcccgccaaattctcacaaaatctagcatattgtcagatatgtgaaagaaatttgtgaaattgtatcagttatcatttatacacattttaataaatgtcattgtgcattgtctttggaaaaaagactcaagaaaattaaacatgtaaacatgatttagaaggagatgggtaatttagataagcagtttccctttttaaatacttcaagattcatttataagactggttttccaataataaatggcattactgagattctatgatggaaagtatattggcaaagaaattagtatccaatcgttacccaattgttttcctattcctatttagtgtacttctttaagcatctttctgaaagattaaaattgcttttgtcaaaaaaccccacaatttttccttataatttataaaaaatgtttgtgcagttatttttttttaaagattcttttctccatggaatgttaactagggagggtttcctatctttctacaggagtaggataatagagaaacacattggaaatattcagagaaatgcttgggttgaaatctttagttttcttttctcgaatgaaatactaaaggaccaggcaaaaactaaccccctctgaggaagggcacacagaagactatagtctatcagttgaaaatgaagttacgatttcttactgcttctctcagagtaaacagcaggatgattaagctccagctataaatgtcaagctccttccctctcaggagcccagtgaagacacaccagtgtcatcattctccttgaaaggaaagagggaacagtgaactcctccccaggcctctgtgcctggagcaccagctcctgtggatccacaagtgggctggcagttcaggtgcatgagagatgccagggacactgtgcctctcatcactgatctgatgcagaacttagttcctaagttgcgtgtacaagaggctgagcgattatgacccagactcaaggaaggagagcaacctgtaaaagatgaattgcctcatgctctgtaagccatgcactcccattctggcaccagaatcaccctgcagacagcacaggcctgcggcttcctgtgggttatcccgtgtcaccctccaaaaaggtcatccttcactgagctggagttgaaagactggtgtccttctagatatattccagctatgacatcctgttggccagaccccaatcctgttacccactgaaccaacagcaactggaggaagaataattccttccctaggctagttctgcagggaacacaaaccagaacacatttcaagcagccagtggttaaatttaggaagtaagcatatataagaatggcagttaataaataccactagctgttattaatgttcacaatatcattatgattagctgggaggttcctggcattattcctcaactctctctctcatttcaaaggagacattaaagacttcattttctagaatcatcttgacaggcttattgctgtgattacacatcaaaaccttccttccacctaagaatactcactttgcagagtgcttaaattttatactctatatattatcctatttgagtctacagcaattcacatgtgttgagtgacaaagtgaattctgaaatacttttgcgacctgggtcaagaaacagcaacaacagggctgggcgcagtggcacacgcctgtaatcccagcactttgggagacagaggcaggtggatcactcaaggtcaggaattcgggaccagcctggccaacatggtgaaaccctgtctctactaaaaatacaaaaattagctgggcatgctggcacatgtaatttcagctactcaggaggctgaggaaagagaatcgcttgaacccaggaggtggagattgcagtgagccgagatcacaccactgcactccagcctgggttacagagcaagactccatttcagaaaaaaaaaaaaaaggcaacaacaggtctgttccatgaaccctagcttctgagttccaaagccagtgtaacttggcaccttgtttagagagagagtggcctgtgtagggtagatgtctgtgagtgatatatcaaaaaggactatttctactccaaatctgcaattacaccctgctttaggagtggaattaaacaagatgcctaagaacatttaagattctgatttccccaagggcgatcttttgtcagggatcagagtgtatatacaatctcccggagtaaagtgctggtcaggtgtgtgatgtatacagtactttttcatttcctaagtacctgggccaacatgtttccaaattaaactttaaacacaactgtggttgatcgtggatgtcccacggaagataagactggcctgagggtgaaggaagatgcaatgactcttgggtttccctgtggctggagacctccctccctaccctctctgcaggctcaggagagaagcagcactccaggggagctggtgccaaggacagtggcgggggaggggggggtgtcccggaaagtgggtgccactgcagcaacatcaaccactccttcttctcaaggggttatcagcatatgagctgtggtcgagaaggacgtataccttataatattttttgttatttctatattcaaataaaatacaagcttgaggccaggtgcagtagctcaagcctgtaatcccaggactttgggaggcagaggtggacagatcacttgaggtcaggagttcaagaccagcctggccaacatggtgaaaccctgtctctactaaaaataccaaaattagccaggcatgatggcacacatctgtattcccagctacttgggaggctgaggcacgagaatcacttgaacctggcagccagaggttgcagtgagctgaggtctcaccattgtactctagcctgggtgacagagtgagactgtgtctcaaaaaaaaaaaaaaaaaatatatatatatatatatatatatatatatatgtgtgtgtgtgtatgtgtgtgtatgtatgtatgtgtgtgtgtgtatatatatatacatatatataagcttgtgccagattaacatattaatacagtcatcaaatatcagtattaccactgagtgttctaaggcactgaataatttattttaaccctgacaacttcttacaggtattataacgtggctcctcctctgaggagaactggtgggttattctcatcacagtgaatctattttaatgaaagctctgcatcctagagcacaggactctcagaggcatgaagggtggctctgaggccattcaacttcagggcatctgaagcctccctggctctctctgggtgggcccttcacacacacaccagtgcatcctgaccccggagatgccctacctgcgtgtgcggtagaactggcacctcttcagggggatcttgaccacgtgctcccgcaggcccacgaacaggacactctggctgtgcaggatctgcaggctcctgatgggctccctccgcctctcagggaagagctcaatctcttccagcaaacagctgcttgaggtctgattcaggggtacccgcactttcttaatggttccgtaatctatgaaggtcacaggatgaaaaggaaacaaggtcagagggtctcacaaaccaatccctggttaaacagagtgtgctgtgtatgcagccatggatcttcagccaggaaagccatctgagcatccttcaaaaacagtacacctggacaccactgcagaccagttaggtcagctgcactggatgtggggcccaggcagcagtatcttttaaaatgatgctctcatgtagcaagggatgaggactaatcatgtccgattggacccttccagttccaagtctcgggatggagagctcaaagtagcaagctttgtgccatcccatggaaaacatcaggaaagaaagaccctcaagggacgatcttggattcttagtgacagagatgctgattttggtgcccagcagggcaaggaaaatgcaatgtgattggcagcttcaaatatccagtacgactgtgatgccccctcctccttcctgccacgagaagtacaccctcctccatctccctctctcctctgtctacattagctccttctttcctcctagtgcttgctctttgggatgattttcttgggctcaactcctccaaactttctttcttgtgcttctgagtattaatttctggcctgatccaagccctccccgctccaggcttcttgctccctgggtgtttctgtgcacttatttatctgcttgactgctagcactgctggagggtgagcggcccctgagccatgcagccttcccagcttagggggacacacagttgaaacgaacattgctctcccaggtaccctgtgctgcaccccgcaactccttgctgacaccctgcaaatcccaggcatgaaatccagccttctggaagccgcttagagatccactcaagtacctggaatcatcctgaaggccctgactgaataaaaccttccatgatcccgagtttcaaaacatcatggttcttattttgcaaacacagaaaatgagtttaaggagttattctaaaaccagaagtagtcaagaatatttgacttcaaggcctcctatcaagcaattcattgcaaaagaccttggataaaatactttacatttttctctctctatgaaagccatagagatggaggctatttgtgtttaaaaaaatacataagcagacatgttttagcctgaatttactttaaaaagcatatctgaaacatctccagtgagcattttctgattatacactgactgaaaaatcatgtagacagtattggcaaacaattgcttgctttcattttaagctaactggttaaatatgctactttttaaaaaggtcaatcatacactgaagtatgctatatgcggggaagattttaaaatgatcttgaggaaagagcatgtatttgtgttcatgtaaaagggtgaggacaaaagagagaacgagagagggaagagaaaggggcagctgtggcgtagagaggcagacattttagcaaattcacagttcacagatgtaagcatgtaagaaaaaatttatgtcttaattctataattcaaattaattttgacttggacatcacagttcataagcttgttggaaaattcagcctcaatgattcttaggtctctctgcctggggtacagcgaagagtcaataaacttacacagcaccaaggaactaacagggacaagatgggggcttcagggaaggtgacatcagctcacatgtgtcagccacaggccctgcaaggaggtccccatgaggcaccagcagagggaggtgtcagccttcctgtggagcagtgatgggcatagagcctgtggctgcctttgcgacatcattacacaagaggacatcatctgagacacatgttaggagggaggcaggggaagcaaggctcatgggagaacttatgtgagagacccctgggtgaaacaggagctttcatagaagttcaggggtgggtggcctgcctagagtcaggatccagctggaggatcactgtgctgtgaccagcgtcacactagttgttcaccagcctagagtggcatgggaaacagagtttacagaactatagcctatctgagaatttaacaaagactcattgctgtttattatttattttgttgaaggattatgattctgagaaacctgcccaaattaacaacagtccaaatgtcaatatgctcatatgtatttcaaattcttaagtaattgtggaaagaatcaaatttttaaagatctgtgatagtttgacttaaaagagtgagccatctttgatcataaacttttactgcatatttctgcataccttgtatctgattttccaactagtgggaactaacaaaactacagggcttagcatttcagagcaaagtgctcagcgtgggcttgcatgctggtccacaatggatgaccgtgcatccttcactccctggagtgtctagtcatgtgacgagtcccctccacagttcccccttccctctgcatcaggtttagcacacaaagacccttcctgtctccttgaagctcttccttcccctgcctgtgccctgcccttgttctgaactcctgcatgctcacatgtttggtcacagccttctcatcccctgtcctcatgattaccctagggtctgtcttcaaagccgggatctgtcttcaaagctgaatgttggctctgtatctgcaactcaaccgttagggactggagacaccagaaacttgacaggcctccctgactctccatgtggcctaccagcatgtcccacctcctgtgaccttgtctaagggacagcagcaccataatcccagggccgatgatgggacctctccttccctgtcacccacagctcacctagttctcgtccacccgcccctgtcatccctgccactcctgcagcttcctctacacctctgtcacccacatctcactgcatctagaggcaggctccaggcatgcacatggtggccccatgctccttcatgcctccatccttgcctgtgcctctctgtgctctggcaacggccaccaggaagcacttgcagcccaagagcctgtgattgtggcataccctggacatgcagctcctttgcctgaggtgacaaatgacaatgttattttctttcagtggcagaaagacagagatggccctatagaagagacaccccgaaaaaccccatagatttctatttgacataggaggacaatagcaggaccctggtggatcttgcaaagctatttgtatttggttgctgtttttactttacaacatttaccatggttttagttactaacttacttgttttgtggtttttacacttgatcttaggctccatagggaaaagaactatgtcagttgtgtcatatgatgtatgtgtagtggctgctattagggccagtagagattagatgtttcatgaatatattctgctgaaagactgaacaaatgagtgagggaaagaagtgtagccagcctggaatgagaatgtcattattactcccacatttgctaaagagcgctgattaatatttttcccattataatctctagcaggagttatgatattagtcagtgtgaaggtgaaacaacaaacatgaatttcaccaatatggaaagatttcaacccaagatgtcataaactaaatatgaatgaagaattggtttcatccaagaaaatattaactccgaaaatttgccacaagaaataaagccatacaaaacttctatacttctgaaatttaatactctaaccaaagttatttgcatgaaaaaaagtgccagaaatatgtaaaatcttcttaatcattctttaacattcagagatcaacaagtaaaaaaaaaaaaaaaataggcatttcctgtccatttcagttccccttcccaaggagagacgacaatgtgaggtggagctgcagaatcagtgctgaccagaggatgctcagaatggacactgcttcagtgcaaactctcatagtatttgccatttgtgaaaatgtcccctactcattatgctatggacacaaatctgagtgtcatctatttatagtttctctctcaaatagaaaactatagatactcatcatgaaagggacagagctacttcaagactttaaatatccattagtgttgatatggttattattcaaaagacacaaatacttgtaattacatgaaaacatcattaaatattatacttcactacatatttgtctcatcttagcagaagagaagggatgttatattctagggttaccagattaaatacaggctgccaatttgaatttcagataaacatgaataatattttagtattagtatgcactattcaatattattcatgatttatctgaaattcaaatttaagtgtgcagcctgtatttatatttgctatatatggcagccctattacatcacatctcctttgatcatcttggcaagctagtgaagatatgttggatatatgtagcaacatattcctactttataggtgacgatattgagttttagagaacagaactgatacatattttctatgaactggttagacatgaaatgccttttcacttcaatgttgatgaatgaaataaaggattataacaatggactccacagtgaacattaattataaggctattactgaggatacagactgaaacaggggaagaggtagttgtgctttgattgcattgtcctttttttctatccgctcttctagaagtcatagaacttagccaactggagggcaatgaaaagaaagtcagtattctaatgaatgctgaaaaaagctcaatatcattgatcatcagagaagtgcaaatcgaaaccaaaatgagataccatctcatgccagtcagaatgattattaaaaagtccagaaacaacagatgctggtgaagctgtgaagaaataggaatgcttttacactgctggtgaaaatgtaaacagttcaaccattgtggaagacagtatgatgattcttcaaggatctagaaccagaaataccatttgacccagcaatcccattaatgggtatatactcaaaggaaaataaatcattctactataaagccacacgcacacatatgtttattgcagcactatttataatagcaaagacatggaaccaacccaaatgcccattaatgatagactggataaagaaaatgtggtacatatacaccatggaatactacgcagccataaaaagcaataagatcacgtccttttcagggacatagatgaagctggaagacatcatcctcagcaagctaacacaggaacagaaaaccaaacaccgcatgttctcactcttaagtgggagttgaacattgagaacacatggacacagagagggggacaacacacaccagggcctgttgggggaaggggagtaaggggaaagaacttagaagacaggtcaataggtgcaacaaaccaccatggcacacatatacctatgtaacaaatctgcacattctgcatatgtatcctgttttgctattgttgttgttaagaagaaataaagaaagaaaagtcagcattctcctccattggaagactttgtctgtcatccatctcaaggacaagcagaggcacatctgtgtcagaaggcaatatgttcttctggcctcaatgaccccctccctctgtacatacaaggtggactcgagcatccttgggcaaacagtgaaggaccttcctgctcccttaaaccaactgtttaaagagagtaacatgcaaagaaaagttcacataactatagatgagtagaagttatgtgtataattaaatgttggtgtttctgagaataagataaaaggatgatttcctaaagaaacaaggaccacataacatgctgtcaccagaccaactctcgaacaagcaaagggcttcagtggcatgcctgccaatgagaagaagagaaccctcctcggcacagatcactacattgtaggtctaaacaattcttaatatatatatattttttgctggtgaccaatgcagtcaaagaagaccaggagtaaacctgatgtcaggtataaaatgcagaggtaaaactggattaccataatgacagagatggtcccttcaacctctacaatctgagtcattaggaaaatgaccaaaagaaaaagcaaaggtcataaatgaaaatagtttacaaaggtaaagtttgcacactgtcacacaaaacagtagtagattccattggaaacatgactactggagaagaaatgtttacacaatgcttatcaaaagacaggagtgtaacttgaaaaggacaaaaagaaattacccccaaagaattccagccacaagaaatgacccatgaaacactgaatcttatattcccagtccccatcccacaggaaaacgtgttcatgtcctggaacaaataagttactaagtacactgtgggaagaataactggaaagagaaatgtgttttttagtggggaattttttttttttaatgggagtttgaatgaaatactgttcttagagcagaatgtggcagtaagtaaagctaccaggataaattcctaatgcatttcatgggaacgcagtgacctgaacgcgggaactggggaagcagcaatagcaattaggatccccacaaaaaccctcaagcactgaggtttaggaggtaggaaccgaaagggtttatctagactagcactgtccaatggtgacacatcagactccacaaaagtaatttaaatttttctagatgccacatttaaaatggaaaaaaggaaacaggtgaataaattttaattatatattttacttaacccaaggtttccaaaaaaattatgtgatatatcatatgtaatcaatataaaatatttggatcttttatatgaagtgaaatccaagtgtattttatacttatagtccatttcagttcatactaaccacatttcagctggccagagacacatttcagcaggctgtggctaatgtacgggactgcctgaggatgtacaggggtgtcctggtgctgctctggagagccaggtactcctggctacacgcaaacaagagacaagtccaaacccacaacatcatgagcttcagttttctgcatttcacatattgaaccttgccctatttttcaaatatagaggtccttctctataagtgtttaaaaatccctgcaccaggtcaattgcctcctctttcaagtaagatgatggaggttcaccaaggtgaagtgacagctcacagctacacggccagtaaatgtggccatgagaatggaacctggtctctaaatccttacctggacacctgctatcacttgctggcacacagctcacaggcagtggcagatgccctgtgggagtgaatgccatgtaggtagttcatttcagaaacttattgatggacagaaagcaatcacgaccattagaaaaggttatttctgtttttcatctgtttgctttgtagagttttctatctaccaagaagtcaagttagttcctacttttctttggagtatagcttctgtgtctcttttatgaataaccctgactgacctcccaaacagaaacactgcggccaacatgattttccatcatccagagcctgaataatccacatattaaagcaagtgcaaatcacaggggaaatcagatgtatttattcctaaattaagctaacaaggaaaagcaagcaaaggtatatagcatgatgttcaaacaaacatgtgtgtgtgtgtgtgtgtgtgtatatatatgtgtgtgtatatatatgtatatatatgtgtatgtgtatatatatgtgtgtgtatatatatgtgtgtgtgtatatatgtatatgtgtatatataggaatatatgtgtatatgtgtatatatatgtatgtgtgtatatatgtgtgtgtgtgtgtatatatatatatatatatatacacacacacacacaaaccatcttttcttccttaatgtaagaaatgcagtcgatttccttaatccagcaagatacattcttggggagactatgagtgatcctactgattttggtcatctctaaatttgaaccttctttcatcattatattttccaagttaacctttcaaacagtcaaagatatgatggatgttaaggttggaagggacgtaaaacaatattttaaattgtgcagttgagaaaagcaaggtccagaaatgttaactgatttccaaaggtcagactactgggccagagtttaggtcctgttcatacggatcaagagctggtttctgaatttttgaaggtatttttgtttcaaaagtataaaaagagacatatgcaatccctataatggtgcctcagtaatagtatagattgtgagttcctaaaaatcaggtgaactgatacaacagcatattaaatagcagttgttattccaggaaaagatgcagctgtgatgtatagacatgtgcttatcttatcataccactgactacacagaaaactagtgtctaaaggatgccaagcccagggcagatcagacttctctatcaggcttcaagctcccatttctatgggctcatgaagcaaacagggaaacagacgatgaaaaaaaaccttctattgctgtttcatttaaaaaaaaaaagaatttagatgacaaaggatttgtttaaacattaaaattgacaataaaaataagccccttaaatcactatttgctatatataatgtagactctcatgtgcataattcaattatcagtggtgaaaaattaaccatgttttttgctctgggggaaaatagctgctattttttaactttcaatgtttaagtagctaacatgaattttatggtttgaacaagattccgttttgcatcttcagagtactggccaatttaaatgaacacaaatgtaacaatatctcatttgtaaggtaaatatgccttatactaagatagagtctgttatgagctgaactgtgtccacccaaaagtcatatgtttaagtcctggccttcaggacctcagcatgtgactgtatttaaagacaggctctctaaagtgatttaaggtaaaatgcaatcgttagtgtaggccctcatctgatatgagtgttgtccttataaaaagagaaggttaggatacaggcacaaaagaaagaccatggaaggacaaagagagaaggcagccatctgtaagccaggaggagaggcctcaggagaaaccaaacctgccgacagcttgatcttgcacttccagcctccagggctgagaaataaatttctgttgtttaagctgctcagtctatggtactttgttatggcagtcccagcaatattgtattatataacaattatatattatgtatataatataatatatatttataatataaatatttatataatataatatatatttataatataaatatttatataatttatataattataaatatatcatataaatatttatataattataaatatatcatataaatatttatataattataaatatatcatataaatatttatataattataaatacatagtatatataattatataatttatataattataaatatagcatataaatatttatataatttatacaattataaatatatgatataaatatttatataatttatataattataaatatatataatataaatatgtcaagagtaggatatagaaataatagattctggcatccagataaactgttaagcgcaatttaaaaactagattataaatatttttttgctttcctctaaaatattgtgattcaaattctaatacggaagcattataaattatatattagattcaatctttttaaccttgtactataaccttgtactcatattatgaatagcctattatttgtaaatgttttcatttatttcacataaccacctttatatgtagttctgatctagaaaagtcgcagggaatgtcataggacgtataacattttgcaaaattaatgcattttgatcaacaatatgtaataattcatatggttggtgctactgcttaaaacctttatgctactgcctctggtgattttgggggaaattcagagagaactaaatgagcacttaagaatgaactttcaagtacctaaagaaaaggtctctgattataatgaatttctttttgaaggatttctagaattttagctccatcaacatttgaaaattttacggaaataaatctttagaaggaagaaggtaaagtgggaaacgaggggtggagacaggagggaaaggaaacacagtgaatccaatataatatttaccatcacaacgagtaaaaacagtgcacaattgtccatacttgtgtatgattagatagccttctatcatcatgagtgcatgaacaatgaaaaaatttaatgcttaaacagtatttacgtgaaagtccctgtgtctcacgtgtataatggcttaaatgctgagacacctgggaacactgagcaatcaaaaaatactcaaagaagttattttgtctcaacaacagcagcccaaaacacttccaaaacagaagataaacatatattttctctaaggtgcaataaaaaacttaaagggtagaaatgtaatatatctgatatatataaaaattcttattttgtatgaaaagaaaaaagtcctacccacaaagaaaaggaaacgaattgaggaaaatgtgatataaaaatagattattgcaaagcattggatggtgaaatctattatctggattccattctctttttattaattctgtaacttttgttatagtttaaggtatttttaaaattattcagccttcagtgtgctgaatccaatagagaaattaaacgtgtgaggaagacaagtggcacccctgacaatggtcacttgtgacaaggctggagattcatgtggacaaggaggccactaacctgggaagctaaattagtttatttccagttgtgcatttggattctatttgattctctgccgctatgtccaagaggcatttctagtgtttggctcatcgacccagagtcactgcagagtaaaagaaaagcttttgtatttgtatgtgttaccataccaagcattatcagcgaggtaatgatgaaatacccgcttccactcactgggcagctcgtcaccatggcaacagatcattatataaagttcatcaattcagctggtcattatcccaaagcagcagacagctaatatgttaaggaaagttctttctcttaacttgtaaacgagcaaatgaattaaattggtcttggcactgggagctcaatattacatttatatagaaaaggagaattcagagaagaaaaaaaggtcttcttggctagtgtatgcttgaaaaggagaatttaattcactcagttaccagattcaactaatggcttattttttccctgaaaaggatagtcagtcggtttaaactttcctggtcataaattaaaagcaaaattttaaaatcacaaagtattaatattttaaaccatattctcatagcctgaccctctgcatgtaagttctggagacccggcactaggggatgcagcctgccttgttcactgtgaccctgttggtttccagaacaaagcctggcacatagtaggtgctcaagcagagacatgttcattgtgtggcctctggggcacaacagcccaggttaaactccaggctcccacaatcacaggccgtgtgaccgagcgcagatccctcatatctctgttgccttctccccagtgcccagctcacagggtcggcggccactaagtgagtttaactgtatgtttgtttggatggtacctggtacacaggacacgttgtataagagtttgctgctattcttttcttattaatgtttagcttgtaaatgataagtcctattcaagttttgtctaaaatcagcaagatccctgctccaccactactcactgtacatatgccaggaggagaaatgacaactcttttacagctgctttggctgccttgctgaacaaaacctcaaaagctccttgcagtaccctaaatcataagccagcgcttataggaaatttaccactgcatttcctgtgaataaaaaccatattacttttaaaacaagagtgcaattaatagagccctctgggtatcctttctaaactctcatctaacccacagcttaaatataactccaatcattctgttaaggaagcaattcaagtttctgaaaggaaattacttgccttagatttattgtatctaaattacaaaacaaccacccagttggtaaggttggcagcccttctctgacagtcaccaggcaggcatccagagtctaaattaccctctagcccccagtggtgaaatttatactgtgtctggtcccattagttgtcaattgagatggttgagaaaaatctatgctaagcacttttgcacttttgaaacattaattctaaaggaaaaaaagagagctctcttactcagtggaataagaaaattattttgtcatttttctcagtggctacattacaccaattacgactagtgcctgatgttccaagctgtttgttagctcgttatgagctttctttaggcactgtcttatccatttctatgatttcaaagaaaacctgaggctgccattactgacctaaaccttcctctctggcttcaaagaaggatttccaaccaactctcaggcgtaccgcatgcaactagaactcagtatacccaaaactggaaactcaatgtctcccctttgtatcaaatctgtccatgcacctgaaatcctgaatccactggctaggatggaatagtcaatatgactatcctactgttcagcttcatctcctatctcttcacccacaattgcagctcatttcaatgtctccccctttccagaacaccccaggactttctagatctgcatgctttgcatattctgtgccctctccaccaggcagccatctccccatcccccaagagccagctctcaggcctctggtccgggtggagtgggaaccttttctcacctcccaggccagctcagtttttccaaagtctgtgtgcttatggaaggtattcttccttcaactaagatagtgcattaagtcaaaccaaagaataaatgtccatcttttatgggacataagctttccttggtgtgatatgctgagccttatccttattcatgaccaccgtcatgctctcgggatacagtaggccgtcagttgagtcttagtgaatgaacatatgaggatttcacaattctagaatcatgcctcagaagtcaatctttaagctcaaggtggaaatatgtctttcaattttcctggttattgccaagaaatagcagaataaccatgttaaaaattctataggtgtccagagcacacaggtcactcctaacttcctatgcacccctctcactgcccactccactgaaagttgcccaagaggtgagaagctgaagtgagatggagtggggtggggatctgaaaaggaaggtgtgacaggaggagagccgtaagtacagcagagtggttcccaagctttatgactagagaagctactcagggagaagcctgagatggaccttccaggtgcatccctgagaccgtgatttgggaggtctgcagtgggcctgaggaccatcgtcaatcattaacaaacattctaggtgactctaactcaaaggatctaggatttgaccaacaataaggggctgtttttagtccatatcaccagatgccaacagtgaggtcagtgatgaaggagctttgagtcttgactattctttaactgccaggagcccttatgtaaagggcttagcatggtgccaaggtcaagggaagcactttatgtgtcttcatcattgttaccatgtgggtgagggggaggaggatgccacggccaagggcctccctccatctcagaagctcttctttccatatattaaaactgctacaggaaaaaaccaatgggcagggatactaccttcaacctgtgagtgacaggggctggatgtacactgcttccaatttaatgcatgataaatagtgtgattcttgcttgacagatgcaaaatctgaggctcgcagaggcttcctcattttctgacagcacccagcttacaagaggtggagggaatatttgactcaaatgcccctggaacaaaggcttaaatgctcctccaggccatgttgctgtggcttgatccctttctaagtactttattcatatattaatctcattcttgttctaaaatcatagtgcattaaccattacccaaagagttacatttaacacacatttgagtcattccttaatgacatcacaagactcagacccctctgccaaaactggaacctccttaaagttaaggatgaagtatttgagttagaaaagatgaaaaaatcctgggggtctaatgtacagcacggagactatagctaacaatgctgtactttacagttgaaatttgccaagagagtagattttaagtgtccttaccacaagaaaaaagcaagcaagcaggaaaagaaagaacaaagaaaagggtaactgtgtgacctcctgggtatgttaattaacttgattgtggtgatgatttcacaatgtgttcgcatattgaatcaagttgcagacctcaaatatatacactttgtattttttaaaaacccataataaccacctcttaagtttctcctatatcttgaatctcacacagtaagtaatgtgtcctctctccatgcttgcttattagtcatggagtaatacatatataatgagtttggctttgttcagatagttggatgatagccacggcatgtaaacgtgtcacacccttgtttagtacttactaactggactttccttctaggagcagaactgtgtaatgttcacgtgatgcaaaggacacatttggccaagatgggcttgctcacctgacattcttctatcattttccatctgctcttgaacaaataaaaccctggcatagtcagacgctctcccactctcctctcccttcaacacatagagcaactttggtgtggcctctagtcaggactgactattccttcagctgcttcatgacaaggaagggcctccaggctgctcaggtctgtgatgggccactcaaatgacactgccctcatgataattacccactcagaactaccaactatttgccctaggacacaaatactcattagttcatttgctcattaggtgaatatttattaagaacttatttgggtcatattctggcttagctgctcttgctacaaaaatatcaacttccaaaggttttctgatgtttggatactgggctcaatgtccactgatttccttcacccgagggaaagtgttacttgcagggaattattttcactgtcagtattccatctgggaggtgtgagccacagttaatggtgcatatgaattaacaagtcaggagtgacaatgccccccttttctagcctaagtatgaacagggtctgtgcattctgagggctttcaaatgcttcagtgtcctaccttccatgtccagcctggtagggtggaggaacctcagctgtgtgcatgaacatgggtgactcatttgcaagaaatgtggaatgaaaaatacatgtgaaactttgatacccaatacaattcttgacttttgtgaacttattttgaagtagatacccatgcatgtcactagtactttgtgccatactccactacccaacatgtacatgttataggaacctactcttagatgcaaatatattaagtctacattaaaaaatgagagacaggacatgcatattgaaataggctgaatatttgtgcccccctacccccagatttagaggttgaaatcctaagtcccaacgtggtcatatttggaggtggggggctttgggaagtgattaggtcatgagggtggagccctcatgaatgggattcatgcccttataaaataggtctcagagccctgccttgtctctttcccctgtgagggcacagggagaaggtagctaattataagccagaaaagggtcctcatgagaacccaagcatgctggcatcctgatttcatggcttttcatcccccagcactatgagaaatacatttctgttgtttctaaatcacccagtcgacagtagttttttatagcagccaggaccaagacaagtatatgataaaggagaccctttcattcaccaacagtcctactggggagtttccagccatcctttgggtggtgccctgtacagagtttgacatgaagcctacactctcctccttcctcgcccccagacctacatattggttgggtcaaaagagctgagagaagaaggggctccatatgggagaggggttggaattcctctgctatcctcctgaaagaaacagaaaaagtgaaagaaaaggggtgagagtgaaaaactagaatgatggcaaaaagatgcctacacctccatcaatccttccttgtgaacacaggtcctcccataatctattcaactcacacaattctgtccttttttttcttttaaaacacgctctggggaaggggttgagttggtgtttgacagtgagagaaattcattcaccctgaatatcaacaggatctggtgagcataagcccaaggattggtaacagaaatgatggggagggctgtggacttcctaggcaggaaattgagagtctgaaatatgaaagcaaacagcaaacatctggagggcaggaaaggcccagttggcatctgaggggcaggagtgacaagttttcttaaacatcagtttggagaaaaattgttttaaattgggactcatggtcgagacgacaagctgaaagattcagtcactaaacatgctccacgctaatgatgcagagtccagggcccccagctctccagcttccattgactttccagtgagactccccaaatcttttcatgggtgcagatttatttatgatctatgaggaatctcaggccagttcttattgggcagcaggaaaatcatgagtcttaaccaattcattgctttccctaactgggatgtagatggctgagagggagccgggttccaacactagatatatgtcctccagctaaacacacaggctgcggcaagggttccagtcagacagcaagagtcagaagacctggaggatgagaggtcagtgcctggagatgggacgagagggagcgggcaccaacttacagggcacagaaacggctctaattctgagatggggatatgtcctaggacacaggacaaagctcagacaccagagcaaagaactgatcacttgagaagatgtcaaaggccaggtcactcaaactgggtgaaaggtcagagctgagccaggacaaagatgaggtagcattgagcctgggcccccgagctcctggcatgccctgactccaaggctggaaaactccagaatctagggaactagaagtgcaggttaagtgttagagggtcccacagacaagctgccaggtgagtcactgcaggtcagcaactccataaagccccagacaactggctattatccaatccgtgcacagagaaatgaatgctgcctagagatattaaaaatgccaacaccgtgtaatcaatatgatttctaattgaaggaagattatagtttaactcaaagagcagcagttccttgtgacgattgccatttaaagacagtttaccaaggacaaatcaaggcatttgtggttgaaactatttttttcactatgaatcagtgttcttccgctaaggacaaggtcagatttttaaaattaatcaaatgatcacatcattgaaggcctaaatgaagtttctactctgacaattaatcttggtgatcacttcaatactaaaaatcataacttttttaactaaaatcccttaactgtacttgggcattcaaaaaattaattactaaatttttatcattgtcacaaacacatgaaaattgaagcctacagaaacctctaaactgttctgggtgtgtagaaatcaaattctacctggcataactgaagatcactttaaaggattttttactaatttcagacaataatgctcaatattttagttacacatgagaacaattcttaatacatattttctggttataagaaagaaatcttcagtttcttgagcaaattttcctttcctttctctcaattttaattcctcaaagaaacatactatgtatttaacaagattcactatactcagttgaaacacagtggttataggtagcaagaaatgcccttctaaacaatgctttaatctcaaaatggtttaaaactttcaaacatagctgagctttcacagccttcaaaatccagaatctggtgataagtgttctcttggtcagaaacttattaaacgtgtgttgattgctcttaaatgggaaaaaaattcaaaagctctttactgctgtttccatattgtttctgttttgggattagtcaaaataatgaaatggcactgttgaagatctgaagaaaggaggaatgcacacagggacagatggcttgctgctttccaataactcattcattcagcatttattttgcacttactacagtcagaaaattccagacagggaaagttgttttcttcacccggtttttttttttttttttttttggtctagaagaataactggctacataattataatttcagatattctcaactttaggagcatctttagtccattcagggtgctatgacaaaataccatagactgggggggttatcaacaacagagatttatatctcatagttctaaagcctgggaagtccaagatcagggtgcctgcagatttgatgtctggtcacagccacttcctcacagatgacaccttccttctgtgtctcacatagtggaagaggtgagggatctctttgggatctcttctattgggcactaatcccattcatgaggaatccatcctcatgacctaatcacctcctaaaggctccacctccagataccctcacattgggaataaggtttcaacttattttcaatctggagggacacaggcattggtatcattgcaagagggctggttaatgacaggctcctttgattcttcaaacaaggtctcgttaacacattgcatgtcctcagcttctccaaggaaatgttgatctgatgagtaagacaggatcgtgtaggaacagcattgcccctagggacatagctcaaaacatcattcctttcttaacattatgaaaacataacattatgaaactccacagcatcctttggtaacaattctgtttaaaccccagaaaataccatacttaagaaacgtagtgttggacttctctaggtttcaaaaaggaaagagagatgaaaatattataaaccaataaataatggagcagatttttaggctgtgttttgaaacaaccaaaataaaagtaattctgatgttacatctctgcaagtgacaaatactgtttttcccatgcctgggacaagtatgcagttagacttggccattgtcaataattgcaccgctgtaaattacagcttactgcagacattctggtgaaaggaaatgttctaagtgttaatttgctgggagatttgaggcgagtttttttccactaatgacttccaggtgggaactgcaatattgacagttgcaccttacttcctactcccaaccctctcttaatcccagatatgtgaaatatcttccttctgttccttaaggtatcttggtatcctcatcttctctgcaaaggcttttttgaaaagatgtggtgaggtaccttttcttccagtcactctgctttgtaacaactcctggaggaaagttcgtctgtaacaccattgttactgctattttatcacgcactggaggatgcacccattccttccatgtccttcagaatgcactgctgtctgttttagaatttaattacagaggtcaaggcctaaatgtgcttagtaatgcctggtcatcattgccaggcaggggccatctatacaagttaacaaggatgacaggatgtgcttagatccaaaataaaaacatcagatactcaaagccaaggcagaaaaaaaagtcctacaaggaatttgacttctatgattagctgtgcttccactttgcaccagtaaatacagcccaagcaacctcactccttcagaaagtctctgctaccgtgcccttcatgttagactacatcataataggaagctttactctacagacctttgaaggcgtaagagacgacagctctgtggtgatctgagcttggagtcagagaggtctccctgagcaaagattccatttgttaacacatcacagcagaatcaaattattccacattttatggttctaagaagtattttgttttctgatttcacagcttagagaatgactgtggtgggccaggtgacaggaattttatatattattctaatattcagcagcaagtgggggtgtggtagagttctaaaattctgctccctgcatccccaaaggaattgcaaaggtcatccagatcccgtgtgttcatggagggtcaagttactcccaagcagtggatactcttttcttgcaggattccttaaattctctcagtggtccttgaataactgggtatcagagacacagcatgccctgggacagagatgcagtcacctcactgcctgtatttctgcctccagttaggcacatgtttatgcctccagttaggaaatgaacacccatcccattggcagtacaaagaaaggaaagaaagaaagtgcagagatggctagaggggtgcaagcagagatggcggtggcccttacacgtttaacactgacaggtaggggtttggtttgttcactgacttgatttcagttagtgggaaattaccctttgaatgccatacaacatatggcatcttccttttgtccttctcttctacattccagaatttttctttttcattatacacatttgctcatggagcacttgcaaaaatggaaaataactccgtttggtggaagcacttcagccaggtctggataactagatgtagagcaaataaccaacgtaattacttgtgcagctcaaaccagaacaatttctccctttaaataggaacagcctcgtaattggagtcctagctgtttgctccaaggaaaaccattttacatttaattttaaactttcaaaattaaaacatatttagagggtttttgggggatgagaataagaggtgtcatctgtaagacagagggcatctaatagacctcctaccataggcagattcctaaaacagtccctatcattcccaacccctggtgttcatgttctatgtagtcctctctggtgagtattggccagacctatgaatatgacagtgtgtcactcctgtgattagatcatgtgacattgccacagtgaaggaattctgcagataaaagattacaaataagttaatttcaagttaatcaaaagctggatcatcttggatgagcctgacttaataaagtgaaaaaccctaaagggaagactgggcctctctgagaagagaggctctccttgctggttgcatagagtaagtggccacattgaagaagggtatgggtggaaagctgcaggtggtcttaggatgtgaaagtaaactctgccaacagccaggacaaaactagggccctctgtcaacaccatgaggaaataaactttgttaatgaactgaataagcttggaaactgactcctcactagtcaagccttcagatgagactgcagccctagctggcatcctgattgcagcctagtgaaaccctgaacggaggacccagctaagcagtgcctggggtccaggaccatggaaattgtgagctaataagtgtatgatgcttgaaattgctaagaatatgataatatgttgtacaacaatgcaagaataacacatcctctgaataccctatttaacaccttgttgaactgtgtgtgaagcccagggtcccctctgaggttagctgtcctgctcttgttgaaaaaaggggccccagttctggcagaggtgacccagttcctattcccaaagctgatggtgtcagaggttggcccctgacccaaggatggccactctgccagctgaccagcagcctcagaagtggcctagcctgtagcatgtggcacattcaggataatggtgatctggtattcaggtcagactctccctctcaggaatgtgagttaaagaatgcacagatgggtgaccactgatggggcagcagaaatatgtatccttaaaatataccccattgcttaaaataacccaaggatttcctcactgccagaataatctaattgaaattaggtagaatttaaatagaattatcagatagggacaataataaagcccatgcttacccagcatgtgggtgccactgtaactggactgctccagcaacacaacagaattaatcccataaacagactcagaggagcaggagcagcagtgatcacagttgattcattggagtgacagtacttaaattcttcctatttggccagatgcatagttacttagaaaccagaaaactggggcagttataggctgctgaagtctctttggaacctggttaccctaaagaattgacttcagggtgcaggttacagaaaatgaaggtagaggacaagatgagtgctttaaatgatggagtcatttcagatgttcttctaattgcaggtataaagacacaactgtgggaaacagtgatgttgactctatcccaatatgcctgaggttctatgagggcaggttgtgttcctgacatagcctcatctgaacatttggagggcttcattctggtggaaatgtatgtgtattttctgttgatatgcattttctgaagtcagtgccttgacttggccttcgttgaagattgacttgttcatctttgttcacaaccatgggtgagttccacgcaggtcctgagaagccaccaaggctcatctccattgtctcttcccaaactggggcatcccaggatactcctaggagatgcaggcctgggctgctgccaggtgaccctaaaagacatcctgcatctcacaggttactagggttatgtggattttgactttgaacccagccttagcaccctattagaactctaaaactaagcatgaggatactggaaatggacacacggggacacatgtcaagaatcaccatccaacagatgaaatggattagctttcgaagacttaatttttacatatttgtcagtataatttcagttctatctctgatatccataaacaccttggcagaacttataataaattggaatttacatgacagtacatcagataaattgaaaccttcagcctgcctcattcaaaaccaacaaaattgatgtctcatggtgacagaacttggatttattcctcaaaaaaaatttagttggtaaatgcttcttatggagaaaataatttttaaaaaactaccgagaatctcattatccaagttaaatcaccagcagaatctgctcttaaatatttgtttaaaaatattctcatcagaatatgttgaacaaaggaaacactttcagttatgttcaatttgcacacttgggtcttacaaaagtgagctcctgagtgaggaaaaaaaatgtataagctctctttcttttttttttctctccttttttttttttttttgttgagatggagcctagctttgtaacccaggctggagtgcaatggtgcagtcttgggtcactgcaactccatctcccgggttcaagtgattctcctgcctcagcttcctgagtatctcggatcacaggcacatgcccccacacccggctacttttttttatttttagtagagacaggtttcaccctgtttgccaggctggtcttcaactcctgacctcatgatccgcctgcctcggcctcctaagtgctgggattacaggcatgagccaccgcgcccagccagataagctctcttttaagacatgccagtattctgtatagataatagttaaaaagtgttggtaatgattgtaaaatatgttttaccacaacaaatgatatggatgaagatggaggagccatttaattgaaagcccttagtacctataaagacctatgttcttatcatcaactagaaaagtcctttgtaaaaacacttgcagattcgtcatcaaattagcagtcaagtgggtcttctcataactgaattttccaggataaatatctgttaaaaattcctaagcctgtgtctacattatatactccagtaactcgtgttctacattagacatgtctcatgaagctttcacgtagaaaatggtttgaatgtccctctgtagaagtagagattagacttagcaaaaaataagaaaacctggggcactgaatcaagattatgaaaaatcctcgtagttataataccatcatctcaaaaagaaacaatactaccctaactgggtttttgtataagcaagaggacagcaggtttgggaacaggaatccactgggcttcatctcctagccactaccattaaacctgaaggagttatatcaaaaatttgtatcaggcaggatctgtatgaaaaaaggtaaagataagcaattttatttacttatgtattttttgtccacagaccacaatttttactactgagggcaacttccagtcaatactaatcatgtgaaacctgagaggaaagtcacctgtctcaggtgggtccaaagcaaagcaaggtggagaggaagcaagagaccaagaagaaaacaggaaatttatctgctccatgaagatgaagttggttgcatcctatttagaacatactgggaaatttactaattcataggttataacttcatattattttgtggttgggagaccaggcatcagctactaaaaatattcagaaaacatgtttaaaagctaaacacattaaaatacaagaactaatgctcccacatttaatcaaacaaaacaattagttgtttttatagcattttaagtggtttggcatatactaaattatattcaacactattttttcattttaatcgggcctaaaacaaactcatactaaagaactaattgtgttcatggagttcagggagtaggagaagaccaggctactctttaaatttgactgtaagagcagatgcagtgtggcaaagtctacccaggtatattagtaacctaggggtgctgcaataaagtaccatgttctggtgggcttaaagcagcggaaatgtatttgctcacagttctggatgctggaagtctgaaatcaaggtatcaggagagccatactttcttaagaatctgggtggaattcttgtctcgtgctagtttctgagggcagctgtccattccaggtgttcctgggcttgcatttgtgcactccaatctctgcccgtgttatcacatggcattctcctggtttgcctcttttctcatcttacaagcacaccagtcatattggattaagggtccactgtactccagtatgacttcatctggactttactaattacatgctcatgctcaaaggccctatttccaaagaaggtcaaatagggtactgaagggttaggaatttcaacataccttctttgggaacacactttaacccacaccaccaggtaattgagttgctattggttgctgcaattattccctcagtaaatgaaaaattcattaaatgttatcaaagaagcactcaaattatgtaatgtacccccttcagttgatgggagccccttacataaagaagcacacgtaatgcaagtccagacttggtttggatttataatttctggtgagaaggacagaatttggagtgaatgtaaaaaaaaaaattccaacatgatagtttttcacaagttaatacttgttcctgacacttagatagttgcaaattgcttagaaacattgagtgagataattctcaggagtgatggcagccgtaaatgtattaacttaatttctggtacccagaagggtatccttggggtctctaaagtcttatgtatgttggacaaagggaatgtcaagttctgttcctcactcagccttgccctactttttttagataggaacctgaaaaccttgaaaattaggtgctagaaaaaaaaatttgcagggagaaaagaaaattagaaacagaattttagcatttgttgagctagttggccactatcactcttgcagaagaaacttctagagtacatagaacattgtttgtcttttctacaagttcatttggaaagtcatattgatctcctgactttaaaaaatgattcgtagcaagcaaccataaaaagatactcctctgtacttaaaatgagtttggaagggaagagtgagaacaggggaggtccctggttacatttcctccctggtgctcagggcaaagctaagtgaaggtgacaggcatgagtctcaggcccccaggtacatcagggcatctccgcttttttccctgaggttattctgacctctgcccccaacccttgtgcacctcagaacctccccaacttggggacccctctttcttactccctcattcttcctccttggtgaaatgatgcccattggcagtagtaaatatttaaaagccacattcataggttcacaggatctaacctgtactgaaaacagtcaaaattgcatgtgccaaaaccccaaagtccttacaggtggaattccatctttacctagtattaatacccttcaaaagcactaaacagcatggacttcaggtgctgcccttagaaactattctgttgttgcctttctcacttctccagtggctggtttttcctcaattggcagcccccctggcaccccaccaaacacacacagtcacgcctccttccccagctcacaccctctcttggttccctttggtgctttattttgaggcctaactcagcccctcagccaagtcctctccttccccttggcttctcagcccaggttctaggtctgcatcttggaagattggggatgggattgatagaaacacgttcctctgaggtccggaagggatgcgacagtgagtatgtggagatggagaggggggactagaaacatttacagatgcatttccccatgacaggtgcaaaactgtctgctgacacccacaggtaaagtacccttgccaaccccgcatggtactcgattcaatctgctgtctcccccaaccccctgccccatctcactcccagccgcagagtccctcatctattaagaagttgtctagatgggtatctatttcctgacctctatctcctcctcaactcaccccaatctctctgcaccccaattttccatgaaagacagcacaacttccaactttaatggacctgtttctctccgcacattgcacgtttcttcttaccactgaaagccctgcctcccccatctcatcttcctgtttcgttttttcctatttaacatttaatgcaactgcttgttttattgcttctgccccccaccccaaaaaaaaatacgcttcctgaggacagggtgtctgtctgtcttgtccattgctgaaccctctccagtgaattttggcacaaaaactccagtgtcttcttttcagcaaaggccacgagaagtatcaactgtccaaaccaaaaacatcaggagtcattcttaattgcacccattctctcactcctccaaaacacctgctgcatctgtcagcttctcttcaagaaattaaccaagagcagcatttctcaaactgataggtgttccattatcacttctacaagaagacttctcacatttttcctgattgtcccctcacccatgaaattttactacagatattctgtactgtatatttgcttgtatagtccatgtctatttgaataaaaataagattttttgtccccctaagaaccaatgtttgcttcattgagggtgacatctgcctatcttctggctgagcatgccatgctcacctcctcctagaccaccttgatgacttcaatagctttgaccccagcctactcttccttactcagttacaatgcaatgacatctagaatgcctgcttatttttatacaatggcggatcctgtagcaatacagtactgttggtttagaaagaaattgtaccccaaactttaccctccttctaccctttttgttatcctctgattaattctccaggatgtatagatagtaatctttgaaaacatgcatcatatcatgtaacttcttttctttacagaactttcagtaattattattatgcttagattaaaatctgaatttttaaacatagctagaaggcacatattagctatccctgcctgcatctggagcctagaaactctacagggttgaatgaactccaggcattgttggatctcttactgtggttgcctagaaaacagagggaaggattcaagtatttggtgctaatgcattactgggggtgcaatcccagggctgtgtggtgagggaaaggaatagggagcaggaaagagcaggaagtggtgctatatgatttgttaccatggggctcttcctttatgatgaaacagaaagagacatctgcttggctacatgagaagcctgcccttggacagccgcctggaggtgaaaatggaaggggaattcaccagttgcgttctgcccatacccgacatccctctgggtgaggcttgcttcatggagagttcatcctcctgcacttctgggctgcagctaccagctcttccagcacctgcttgagaagccatatcccactcccagaagcgtgcgatctcatccaagcccaggtgcagcaacagcgccacagacgcctgaccaccagctgctcagcatcaactggaggaacctcctggtcctgcccaggaatctgtcagccacgggggcagctgaggcagagcaaatggccaagggttcagggtcaagtaaggctgagagaacctgcggttgaacttacgacctgaccaatgagcggtccttctctgttgtctgagctcattatgctccattgcaccccagagccttggctcacgtgacaccttattgcttcttcctcagatagtaaaatgggtccccaacacctcacttgccctctttccacaacgtctttcctgaggtttttgttctgattttcttctttggctagcagccaaggttgtctgtttttgaagtaggaatcacagatacattatccctaaattttccatgtacctttatttttgatggaaagattagcctagaataacattcttgagtcacatttattttcctctaatgtgtgtatatattgttctacttgaaatctggtattgagtgttcccctattttggttttactttctcaaaccttctctcatcatttggctgaatttagcccctaattagtcttatttcatgtttgtaaaagagatttttggttttctattccttgagattttcatttttgtgagtgtctgtttttttttattcttggatgagtataacatgctcaattcacattttctttttctcagaatattgcataaccatgtttcacagatttatacagctgcagagtatcctgagaccatgtgattttttttcatttttagttttttttttcctcctcaatacctaaataattatttctgtattcttggaatttaaaaacttacctggctagtgttcctttattctgaattaatattgcacaaatacagtatgctttgaaatttgcagactcaattcttcctttattgcagggtaattttctccaatagtgtctttgggcacaagtttttagctccacagacagggttctttggttcaaagacaccaatcactctgtgtggtccattgtctttgtgggtccttcatatttaaaaccttatcttttatttctacattttccaccttaatcactgcaaacatttactctgtgtctaagctttagctgtgtttttgtttccatgaagtttctaatttaatttttactcttgtagtagaatagcacgtcattttgatcttctatttattcgcttatctctgtgaacttccttttcatctcattttgtttctttcatcatttcaactctgggtactgactttatttacatttctctcccttttttttccaagcaaagtaactttgtggcacatgtcctgctcctgctgggatgccttctattccatttgcttttctgtagactgaagtgacaggacagggatgcagagaaggaagctcagcccaggctccctctttgttgaaggtcttgagccttcatatttttttttcctttttgagacagcatcttactctgcttcccaggctggcgtacaatggtgcaatcctagctcattgcagcctcaaattcctaggctcaagcaatcctcccaactcagcctccagagtagctgggactgcaggtgctcaccaccatacctgcctaattttaaaaatgtttgtagatgtgcagttccactatgttgtccatgctggtctcaaacttctagcctcgagtgattctcctgttttgtcctcccgaagttctgggattacaggtgtgagccactgtgcccagctctattttttgagatttctataaatatttcattccacaatacaattaaccttggggctaggggaagagaaggaaacagaggtgataaacatggcacaatctcacatgagttcagcagctagaagcatataaacctctatatgaatgtttcctgctttatattcatctattagctgcccctgatttttctatgtaaaattttgcaagtttgaaatgaaaaacaatgattcaaaatgtgtgtgtgtatgtcttcttcctttacatttctttagtgcctgataggtgtttttatataaatgtttatgaattatcctctaactaaaacaatttataaaatataacacaaaaagagatcacattccttttaaaaaatatatttattgagatataatttgcatgccataaaattcacccactgatttttagtatattctgagttgtgcaattattgccacaatctaagcttagaacattttaagattatatacaatttaaggttcaaatgcttttctaaacactagaattgagttaaagtgaaaataaaaatgatatatctcatcctagaagggagaatagaaagcccaagactgaatggcattgtgggggagggagcatagaattagaacaaccatggccatgctgtggaaaaagcccagagcggcagccacatgtctggaccaggagtgcatgtgggactgcgagggactgtcacagtggtggggaagagccagtggagaagtgtttccaagtcaagtaagggagaaactcccagaatacctgattgctcagcatgaccttaattttgtctttgtagagaactcaatagcatatgagactccgtcactaacagaactccagtcataaatattctaccatttccacttgactctggctctgagaaaatcttcaaaaaccaacttacaaaatattagcacagtcatgattcagataacatgcctggccctgggtggatggacaccaggagagatacagggcagtagcatgaaaatggacccagaatgtatctggggaagactgctgactcagcatagtggcagcagtgggaaatgccaccaaagaggcaagacgcagatgaactacaccagcaagagaagtctagctcacatggatctgtagacaatatggacaaataaaataaactgacttttcaaacagccattggctggtttcctcccatttgcatgtgttcatgtaaaatcaaagtaaaagaaaatacacctaccaccaaacctggattcccaagcctggaaggatatcaaactgattctgcaagtaaggtaggaaggactctagcttcacattcattagttatgaatgtcttacccatgctctatcagttgataactcgtttaactcctggatatggtatagcaagtgcacccagactgaaaggactctagcatgtgtgctcaatatcagattcttttttagatttacctttttaattgttttaattgaaacatattagatatatatattttcaaggtagatgtgataattagatacattcatataatcaaatcacagtaattgagaaatccatcacctaaaatattatgttttctttattctagaaatatctgaattattctagatttttttcaaatattcaatcaattaatgttaactacagttgccatactgatctattgaacaccaggtctcacttctatctatgtctgtatctgtacccattaatcaatctctctttatccctcccgcttctatatcagttttaaaatcaaatgagatgaatttccctggtttgccttgatgtaactactggggctagttataaataagagaccggaaaaacatcagctttttgaattcaaaatgtcaaaatctctagtctttaacatttctgcttgttgggggttatttggctcttagagggttaaattaaaatgtatattattataccttccagtattcaattccttggacataaagactgtatgttaaaaaaaaatatcccttaaaactgaatatcattcttaattaaaatctgaaaaaaagactatatctccttcaaaatatattaaacagtgctataagagtaaatgaaaagatccacaagttagttgagacatgaaatatgtaattatagaggttgttcagttaaaattgtcaagccagtctaaacaagctgaaatgctttctgggaattcacttttcagtagaactgcttttgtacctgccctgggtcactgcatatggtttggagcagggtttgtgttgggccccgggtatctatggctgttttctgctggaaagtaccttcacccactacaaagttctcctcctcttgagtttaactaacaatccaactagtgagagatggaaactgtcaaagagttctacatatggcatctttacccataatcccaacttgtgattcaaattaacagtatcttgatgtacatgtacaacacaattgaatttgtacacaggcagtagatcaaaagaaaagccaaaaatcaggtttgtggaacaataaagcgaatctctgcgaaatgcatttgccaaatggcacatagtatatcaatatcggaatcagatctgcacatcagacaggatcagatggtctggaatccctgcggcagctgagtcctgagctactctcaacacggtgtgggggtgagggtgttgggagcagcagtccaatcatgctatcattcaaaacagacatgtgcaagcaagtttctagaaacttttaaatagtggttttaaacaatggtaaaagaagttgcttgtagctatggactgaatgtttgtgtccccccaggattcatatgttgaagccctaatcccccatgaaatgtaattaggagacggggctttagggaggtgattaggtcattaggattggagcccttaggaacggtatgagtgtccttataagaagagacataggagagaagatctctcttcattctgtgaggacacaactagcaggcagccatctgcaaacctgtaacagggccgtcaccaggaaatgagtcatcagccaccatgatcttagacttctaaccttcagaaccatgagaaataaatttccgttgtttaagccacccagtctatggtaatttgttgtagcaactgactaagacactcatcaaagtaaaaatagaggagtttcatcagaaatcctcagaagttcactacagttcattataaacacaagagaagcaaacatgacctacttggacttacgtggggagtacgtccaaaggctcaggttgagacctcaggctgctcttcactgacccattcaggtctactcaagaatagcctcaacccccatcaaaatccctcccactcccaaggtactaaggaagtcctcaactgcctcctagaattggaagaagatggccctattctccgtgtcatcagcctggacatttatggtgaaaaactaggaactcttatggaagggtccagttcattcatcccacaaacctattccgtgccgggtaccctggggaaaattaaggaaatacatgacagaataaagagaaacaatccttcctttctcttaacacaaacaaaaatcaacaaaatcctttccttgacctcccatcccctccagataactcatcaatcctccatttcccttccctgaaaagcttctagaggagatgccctaagcagctggttccatctgacttcggccagtgctcttcctcctctccagttcctcctcttcccacagactggccctgaggagcagctgtggcctccatctgcccactcagtggtcacatctgtccttaccttacctgaccactcagtggcactgcctgccactggccagtcccacatctggctcattggttgtttcccttatgggtgcagggctggccctgccttctcagtccctgcttagcttcatcatcacctcctggcggagatcaatgctaactagcaaatgcaggagcttgctgggctgtctctgcgcatctgctgtgtctgctcaccgtcaccttcctggcatcttactgactgctctgtttattatctgctgtccccactagaacgtaaggtccagcagggcaggtgatgcctatgtgttcaccagtttccttcccagtgtttcaaatgaactccacaaatagtaaagattcagtagatagtagcaacttcatgaaaaaaaaaaaaaaaactaactggtaaatatgtggtaaatatgtaactaggaattgagaggttcttagaagaaaaaaaatgtatattattatcagcaacaaaaacagtaatcgtgatccatgagaaatgacaattatacagaacactggacaaagaatggggaggggcagactccaccatgagatggctctgtatgggaatctgaaggcaggaaagagaaggacaagcccacagagctcagccaggtccctacagctggcctcacacacccagagccgtctgtgtaatgaactgagatggaacatgctttctacactctagttgctttggaaactgaagagacctaattgtcatttgtaatttgaaagtatcactgcctacatttgctgtaaatgttccattatttatgccccaaaacatattctttgaacactgccatgtaccaccatccacgcaaatattttgctgaaggcactgtttttgaacaaatgagaaataaccatgacaatcccaagataatatttcacccaacaacatcttccaacaaagcatacctttgtcttaaattatccaaattcaaatggtcttgccaagaaaagacttattttatgaatagttgaggaataatagcaaagaaacaagccattgtctttccaattaaagttatgaccaatatagtgaaaatagattgagatttccaaaaagagggacagaggctgaggaagataagtgagcatcgcgggttttgctggttgcaaaaagagacatcaggcgtaaagcttgaaattgaaattgaatgtttagaatctaaatctaaaacacaaaatcagaagatggtagaaaacccctcagagggggccagagctcctacctgtggccaaatagatgatgtggacgagcgcttctctgccctgcaccacgtcgactgccacgtgggaaaagcggctattgtcctccatgaaggagggcactgtggtcactggctgtaccacctcatgcatcagaatgaacttctgagcatcctgcagatttctctcggtcaggttcacgtacaggccctggtccacggtgccacactgaaagggaagacgggccaggttaccagagccggcagcctggacacccacagctggctgtggccaccctagctggaaagtaacttggaaatcaagtaagccacaatccatcattgaagtatgcaaacatgtctgcttctccatcctccctgcagcccctatccttagcatccttttcatgttagatttgaactcatatcttgggagtctcccaacatcatcataaatgaactgatcagaagttaaaaaaaaattaaagtgggagtgattgctaactttaaacagcagatgcatagaaactcctcctttcccgtcgagttacttgaaagctgtctggttaaacacatactattatatctgcctgacaaattaggtagcaaattgaaaatgcaacaatcaaggatctcatatagatgtattagtttttctactgcagcagggggtctgtaagcaaggcatggatttcaagctgatagcattaggtcattctcatctgtaagatcgaacagcattcacatgggctacaaaaatactgtgctggccttactgttttctacttgtatttccaattagaagaaattattaaaaaatgtttagagtccaggaatatggaaaagaacatggcaaatttataagaagaacaggagatgaggaggtaagggaaatggggaaggaaaggagaggagtggggagaagagagtagaaaggaataaagaaggaagaaggaaggaaagagatttcagatagagcaaatatcatggagatgaacctgggatatgcaaggggaaattcagccctgtacaatgctgggaaataaattcagagctgtgttgtggggaggctggcagatgttatataagactgtttctggcaaggatgaggtaaaaagagggatagaaaggaaagcactgctttcttagagccaagctcagaatcagaaactactaccaatccttctcatgtctttcataaactttaattcctggtacaaatggtgactgatccccagtagaacttcacataagtaggtttgatggaaaagaatttccaggcccataccacctgaaactaccctttataacatgtcatgtctaatatgtggttttataacaggtgagaggtgcaaacgtataagatggaaattgctttttgaaaagtagatgagatatttgtatagcatttgataaaatgctccataagccataaaatgatgggatgattgtagaaaaagagaatctgagagttaaacggatttcatgcatccagtccaaggcttaatttactatcacacccttgcaggggcaccccaagttccacaggcaaggactgtgtgagtttaggtgaagggctcagccctgccatgacccaagtgtgagtttaggtgaagggctcagccctgccatgacccaagtgtgagtttaggtgaagggctcagccctgccatgacccatgtgtgagtttaggtgaagggctcagccctgccatgacccatgtgtgagtttaggtgaagggctcagccctgccatgacccatgtgtgagtttaggtgaagggctcagccctgccatgacccatgtgtgagtttaggtgaagggctcagccctgccatgacccatgtgtgagtttaggtgaagggctcagccctgccatgacccatgtgtgagtttaggtgaagggctcagccctgccatgacccaagtgctactctggctccgtggctctcaagccacatggaatcaggtgagtggcagctgtcctgccacatggtctgaggtgaggtctcgcctctcagtctctgtctctttacctgtccggtggctaggaaaatagttaccctgctcatttctcagggctactgtgagaccagctgagataatccgtggaaagcatttgtaaattaactggaagtccttataaatgccaaagaacaagacaatgtgcctggcactaaagagaagccattcaactaatggtgaatggtaaatgcattggtcttggagcaggacagcaattctatggtctgttgagcttcagtggccagagggaaatgagtgaataaacaaagaagggaaggaaacaatgagtgaatacacaagtagttgtaattgggggggggaggggatgtgctaggaaagtttatataattacagtattaaatagtaacatttggaggtcagagacaagtccttacctgtcaacacatgttttaaaaaatgaaaaagagctctactaggcttgatctaatgtctacgcagaaaggttctagttctgagcatgatgttacgtgtggtggtttacattcctgaaatcagtggtgatacccaagtcacggcggcagttagctgcctacctgctgggtgaagtttgcacacaggtcttgttttgtaagcatagtgtttaaaaaaaaattggtatcttgaaaaccggatggcataatatacaaataagaatctcttgctgttcttaaggaacccagaaaaattggacacctaacagggagttctcggtggcaggggtgaggcaggatcactcgctacgccttgtcatctttatttatatatcgcctgtatcaatcttatttatgactgccagaattgccaagaattggttttgaggtatactctactacttcttggtttattttgctggctataatattccacccagtgcttctatttcaaatagttggaagagtattcagagttatagaatctatgtattggatcataagcaacccacttagctctctaatacctgaaaattttctagctttgccttttatgctggactcccgctgtgtccgtgtggggcactgtgtgactccctgggttcaccatgcaagaagaaaacaataaaaatagtaaaagcacagccattgctctcatgtgccctacaatccacaacagttttcatgccaacatctcttcaagtaattcagtcagtaattctacaatttttttaaatgataataaatatttgcacttttgtttatttacttgtttctaggacaacaaatccattcttgttccagcacactagtgcatggtggtcaagcccacaatcacctaacctcctgcaggagtgcccaattttaatggtccctttgttcacttactcccttgcatcttgctgcaaacatgcttggcaggccgggggcggtggctcacatctgtaatcctagcactttgagaggccgagacaagtggatcacgaggtcaggagttcaacaccagcctggtcaagatggtgaaacctcgtctgtactaaaaatacaaaaaaatgcctggcgtggtggtgggcacctgtaatcccagatacttgggaggctgaggcagacaattgcttgaacccaggaggtagaggttccagtgagctgagatcgtaccactgtacaccagcctgggcaacagagcaagactctgtctcaaaaacaaaacaaaacaaaacaaatctgctttgcatatcaaagggtcctgatggacaggatcagatctacgcacttgctcctccaacaactgcctcctcatccacttaactacatttgagggtctattcgtccatttcaactccatcctttcagagtgacagtaatcaaagctgcacagaaaattctggagtctgtcacagctcagctgtgccactgggcctcggtgatgttttatatcagtgattgccgcgtgtcttactgagggtcagggtctggatgactttgaggactgcagcctctaacagggcagggctctgaagcaccgcctagagtggtttatatattttgtccgaaaaaaatgatactttttgttgctttgttactgttttgagatttctatattaaatgttgaaatatcatgcaccatctctcctaacccattcttcttcctgaatccaattctgctttctgcttctctgattaattagctacttctagtatgtaagtactgcacaaaatcctaaatgtcagtaggaaaaacaagaatttaaaaaatctaaccactttccattgttggttattgcaaacataaggcctcttatacatgtctggggagggatcgttagttcaaattgaattcccactctatgccagtctggatggtttcatgaatgtctgtgaggatactttgccagtgtggttatcaaatagagtaaacataaagaaaacacttgctgtgtacttgtactaggagttatacaaagaatcaccataatctgtaacttgagctccattggagtcttaaataatactcagagaagaacagctcaggaatgcaagcttcctgcctgaaacgcatgccaatttctgcatgcttcattcattatgctacatggactggcttccatcccataatgagagtaagccattcagtgtgacactggcattataaaaccagtcgctcctggccttaggaaatgagatttgctgtgtgctgcaaaggtatcctgatgaacgggctacaagttatccactgcctggaggtggtaaggggctatgaagtttactaagccacgctgttcacagtaaggccttctgcaataaaaacatcactgtatggaaaatacagtaagcattattaattatttaaccttcaggattttattatacaaaggactttcttaaaaggagtatttcctgtattcaagaggagaaaatgagacgaaatatgcatttacacaacatttgatatgtagaaggcaccaaataaatgattcttttttgatttttagagacagggtcttgctctgtcacccagactggagtgcagtggatggattatagctcactgattgaactcctgggctcaagcagtcctccatctcagactcccaaatagctaggactatagatgcatgacaccgtgcctggctaattttttttattattatttttgtagagacagggtctcactctgttacccaggcttgtctcgaaatcctggcctcaggagatcctcctgccttggcctcacaaagcactgtgattataggcatgagcctctgggtccagcccttaagagttatatttatcaaatattttatacagtaaacaatgcacattattcagtgttatcaaaatttactcctaaactatttgcatgcatttttatccctttccccctttgttgatggaaatatgcaataaagatgcataatagatagatgtgtgataaaaatgcacataatttgctcaaggaaagcagcacatggaaagatgacatgtaagccagccatcttatttttaatctcatgctccttcaaaagcttaaagacaacaacaaacacaaaactctttcaaaacaatcataattgaatggtccttgcaaaaatcaaagtaaagtataaaatcactgaacctttccatactcccagttttgggagtcccagatacaggacccacttctaccactgattaataatagtaactaatggccatttagttggaataggctaggattttgcatctgaggaccgaggttggaatcctcacttggctacttatcagctgtgtggccctggccaggtgatctgccccaggcccactgtctttccctgcacatggagaaggcattacccaccatagcactgccaccagtgtgcaagctgatctatctgaagcatctagcacagggtctgggacttgctggtgctaaaaatgacagctgtgataatgatgatgatgatcttaagaaagctgtcagaaggccctccagggaagcctgctgctatggacccaatgtctgtaagccacccaaattcctaccctccagtgtggctgtatatggagatggggtcttaatggtagtaaatgagggtaagtgaggtcataagggtggggccctggtccagtggagctggtgcccttacaaaacaggaagagataccccaaaggtgtctctccaccatgtgaaaatgcagcaagatgtccacctgcaagccaggaagagagagccctcacctgaaaatggccctgctcacgcttttgtcttgaaggtctagcttctaaaactgtaagaaaataaatgcctcttttttaagctacccagtcggtggtgttttcttacggtagtccaaactgactaatacacctgccaactcaccaaacatgagtaaattgcttcatctctttgggtcccagcttcttctgaacactgggagatggatgactcacaaagccctggaagcttgaacctcctgcagttttgtgataacagatgaagggcctccacctcctcttctttcctcagctgcctgcatcacattctgtccttcccaacagggaatcccaccacatttgccaattagcgctctaatcctgtttgtgtgtctctgctgctctgtgccctggaccccattcattagaatgtcattcattagggatcagagattctgaggacacagagcccagcatcattagtactaattgaagcctggattcctaacctgctgcagaatgctggcctttttccgcccagtctcaggcatcacagctgacaaaaggccctttctgggtccaggcgccacagttcacaaaaggccttggtctattgacattagccagcagagtatggggctgtccatgaggggccagggagacagctgcatggtgcatgcacccgcggtttaaattacccttgcctgtctacacaaggcttctgcattcttcatgggggatgccaacagtgcccctttgccccccgaaaattacctggaagtgggggtttgggttgggatacggtagccaggccgagcgcgagttttcttggtacttgaagggcccagagaaggcctgcgcgatggcgctcaggttgaagacgcacacagctgaggccgcaatgctgttcctgggagcggagggagagagagaaggcagtcagagagctcggcagcacctgctgacctccccctatggactgggcagcagctgtgacctacagcttccagaggtctcaagaccacagtctcttaaagatcccaaaaggatgaagtcagagcgtgaatggggctcccctgtggaggaacaaacatcttggtacagaaaccaggctagttagcatttaacaccttgtaatcctgtcagccaggattaattcactcagttgcaacaggggcaagagggaatttgaagagctagctatctgcttcacctttcaaattctggaataaaaagacttccttctccaacggatggcgtctctcatcagcctcatgcagttcccttcctgacctgtttatctggtcactttgcccagcagcagggaaagctgtttgtgtgtgtgtgtgtgtgtgtgtgtgtgtgtgtgtgtgtgtgtgtgtgtgtgtgtgttttaacccagatatttgttttatttgtcatcctttaaaaaaatcaactcaaagtattttataaaaagtgactgtctgactcttcatattttcttttaatgtaaagtagattttaaattcaaagggtcaaagagaaaaatttgacatagcactgacatatgaaatcctgaagccataatttagaattcaggctctgagagaaagtcataaatgggagccctcagaaggtcagtgccctctgactaagtatggaaacagcaacattatttggttaagtaaatttgcattttgagctcagtccgggttctcaaaggggaagtggagataaaacaagaaagcttacatatattttctcttgctctgagacaataccacaagcatttctcatcaattttcttttcctgcatcaaaggaaaggtcaaactccaaaactgaaatacctaccttatatttctttgatttgataaatactgaataggaactaggctctattccaaggactttactaattcccattcatttaatcctcataaggtgaaggaaattcacaggtaaggaaaaccaggcacaacgaggacaagacccttccccaatgtcagccagctactaaatggggaagctggacttgaacctaaggctggctccaaatgcccggattttccccagtatggctccaaatgccaggatttccaatcctttgcaatatctgtgggtgaagtagacaggattctacttcaggagagcagacagtaaacacatccttatggaaaagtagggccttgagggtattgtgggccttctgcattttctccagaagtccagcaccaaggacaaggctcagcatgatgcatacagggcctggcgctggaaaataaaggggcgaacaccagctatgggtttgttcactttgctcttttgactcttcattatccttagagagaatgggagaagttaaaacacaagtacagggaagaaactggcctttgaacatgtgagtggactttaataaggacaagaaaataagtgtgctggagtaagaatggctagacacaggatatcccatccaggcatgccttgggccaggtgcagaggcaggcaaatgggggatattacgaataataacaatatttccctgagccccctgctaagcacttgatacagatcatctaatttctcactgagaacctacagatcctgagaagaccctgacttacaggtaagaaaacagtagcacagagagtttacgcagcccaagtcacaggctgcagagaaataaagcaggatttgtacctgctttgcatggggccccaggtttccaggcagcttccaggtaaaggaagaacctaatcttcttcctgctggcataatgtttctctgttcactacaaccaccaggactgaatgggctgacctgggctctggtgtcacccagagactcccctggatgtcccagtagctgccagtctgagcatcctttaatagtgttgtgggaacacttcttcctgtcccctgtgccatcccctggggagcacaattggtatagtatagcccatgcctgcccctctaccctttcacttgctgtgctctgggggcaaaggacgggcctgtgtgactccactgtgctcctccctctgccctccccgctcttcctaggatgggattgtctacaggaagtacatattcactcgcttcttcagggtctccagacctgtgggcaggcgagggcagcccaggtctagaacatgaccttgagaatgagaaggcttaaagctggaatcagtatgaacaagctcacttggacaacagacctgcagccacctgttccaatctggcttctatcagcaatcaaggtaataacttacaagagcaataaaaaaatcctaccccccaccgcaactttactatctttatatccatatctatacatagtaatactttactacaatctctacagtttactatctacactataaacaactacaatggtaagccaccatttttagatacctagaaataaagccaaatctttagagactccattgtagtagcacaccattttctgcaggccaacccatgctcaagtgactgagaaaactacacagtcgtgctaggaacagaaggagtcggaatggttatcttttccccattcccctagtgctgagaaaccttgacgaatgtacagaggcaaagcaacattctgagccctgaagctcagcccagtatcggacagctttctgattcataagacctctgatcctccttttctttccgtttgaaaaaaaccttgtctgagacatgaaaaggaggtggaaaatattgtgaaatttgagttgggcatattagaaatgcattctcaagacccaacacaaattagtattccagggagaaaggggagatgtagcacttctatctctaaaagtatagattccgtacattgggtgacttctgacatgatgggaatttgcaacactaaacaaatagtctagagtagtctgaaacttatttttgcaactatctaaattgaccatacaccatcttgcaatattccaggcatggtacttttataacttctgaaattggtgttttgttttgttttgcccagagccaggggaatgaagagctaagtaaaccagactctccttgtgcataaaactgatgtcaactgagcaaatgcacatttatcttgggtgtgactacactagtttttaaacaaggttttggaaagaaaatcaacttcagaaactgtaaattgattttttaaagtaacttatcaaagagaagaaataatctctgggttgaagaccagatttatgaaaataaagatggccacggtggagcaaggatatgtgtggagccatccatactagccttatttttctaacctcatgtcagaaagaagactcttcatggggggtaaaagttgttattaagcaaatactaacacaagttaagcagtggagagaccaggaagagaaggttaatgaggaaataagctgcaggtaaagggactttttagaaataccactcatgggcaggcatctgatgcccaagagatgaaaaagtaaattaaaatacttaggaagcagaaaggacatcatagggtgaccagttgtcctggttcacccaggaaaaagaggtttccttagttacagggctgtcatcaatgctaaaactgggataatctcaggcaattcaggactgttggtcatcctacctcatttatcagcacttccaacccatccagattttgatcctttactttgcatacaaatattcagcttttgcttaaagtcttaagtcacaagacaagagatttcaaaggtgatccaaatcagaacccatagtgtaggatcagcagcagcacagccagtgtgtaggaaagtgatgctcagagtctcaatgtgagccttgattcctgggtttggcacgtgctcctcctgagtcttacacagcataccagctaaggataggaaataactctggagacatgtgatactccactagattaagagtgaaagagatcagaaaacttcataagcttaagacagccgaaatattgttcattctaaagttaggagtatctccctgtcccacccccagacaaaaaatactataatttttacaaaaatatttcaaaagtataattgacatttacaaaatgtgtgctcaagtaagcaatcttctagaataatagtgtaaaatgcagctatggaaaatgtgcatttcaaatatgagcaaggtttaagcaagagccatgttatctcaaagatttcagattctccaggcaacactattttcattatacacaaatgcatgacttgcatatagaaaaaatatacatataatatgtatcagtatttcaaaaagtgcccagaacacaatggcaaatcaggaaggagcaatttataatagaataatttaatgtcactatatcctaaagattgacaaaaactttcttgatttggcgtatttttcctaataccagtctcacaaatcacatatctttatctaacatgtagtctactgaaaagtcctctttttttgtctgttagcccagtaaattaagaaagattttctctaaagtaaatttaaaacctcagaggtcaaagaacagaagacttattcagaatgagtaagagagaggggagaaaaattatttcaagttacatacacattggtggtaaagatgccatagatcaaatccagctcaggcaggaagaaagtactctgcaattcgttgtagtaaaaggggacttccccaggacgggagcagttcaggcgagccttcatgaatgtggtccaggtgtcttccagcaggaagcgcccaccaatatcgttcttgcacacccgggcagctctggagaacactgttttcccacagtcatgctctactgcattttctcggaaaaagaagtaggtaaaatttccgatgtcataagatgacacaaagtttggctctggaaacaatagaaaagagggaaaaaatctcaacattcatgtcattcccttttggtcttgcctgctcagtatttcatccaaagagacgtggttttgtttagataacacctggttcctataggactattgggaggccccgtgagcagcttaatgatctacactgttgggaaactcagtgtcatacacagattctaaataatgggaagtcactggtatgattacacactcaagtatcccgagctaaattagggctcaagttaatgggacgttaataccaacaaaaattggcagcaaatatttgcagtacattttagagcaatatgtattactttatttgcaaattcttacataaccttcagagagggagaaaatatgattaaaaagatgaaatgtggttcagaatatagcagtctacaatcctatttgtgtgcaagacaacaaaattatttgacttatatacattcctgtgacttcgacataatgtatgtgcttttactaaggacgttaaaaatgttttcattgttgggaatgaaaataaagactaaaactataaggtgtgtctggaattagctgtagcaatttctgttgctatggtgaccatggaatagtgaaaaacaactctgattttcttatttctggtttgctgggtaaaccatttagaggagggaagagtatggggatggagacattgctttgtagttttctggtctcataattagttttaaaatggggaaacaaagaaatggcaaaattatggcaaagcctttacttaatcaccaagatcttcaggaatttaggaaatatacattatcaactgaattttacatacagcatttgaagttttagcttcctaacttccggtttgaaaccagtgataatagagatagtacattttgagatacacatactccgtaatatttgcttttaaaactctaatcacaaggttttattcttcgctatttctaaatgctattcattcaatcagcaagtatcttaattttctggtgcaaattaggataattatagcagtaacctttggtgtccaaaattaatggaaagatacagacaacaagtatattcacaaagacacattttcagggacaattagtttgttggggcaattcaattggccttgtacctttccagatacaattgcactgcaataataacatgttactggcaggacaactaaaaatatgtgtggctgcaagataagccattaatgttaagagtaagacacataaatggaatcacctaaggtctgaagtgcagaagttgacttcagacattgacaaagggttgggattgactactctgttattctgtccaggaagactattgccaattttcaatcaatacctatattcgatattttcacaaaatgttttaatttaatccaactttacattttaaaaatgtaataaatactctaaatggtttatgtatgatacttttcccttcagtacaatacgttgttaagtcattgaagtatatcaagtaatatactgaggtgattttaatttataaaccgtccaacatattcttaagtcactattgctttcaccctaaatgactgtttaaaaaaaaacttgaattgcataacattgtaaaagatggaggttagatatctttactgtgatagtatgctttaatatcctggagagatgttcacaaaaacagcagattacatatctgtaacttgtgtttttggaaaataaagaaaatactgggtggtgggtgggggggtgttaagtctgtgtttactgtaagtctccaaaacagaattacctgatgaagcaggccccaaaagcaaagatacggaacaatttcaaaaccatgtgtaaagaaaataatactggcatgtctaattctaaataagagtctaaattattttggaatgggtcctgcaccctggctaaacaaaactagagtttgggaattgtactaaaaacaaacaacaacaacaaaaacagcaacaagcaacccttcctaaaatgtggaaaacaaagagagaaggcgtaagggtccaagtgtgtctagcccgggacttaggttaccagcacacatgcaggaggtccaccaaaacttatcaaatacactcactattacccacttctgctattaacttggggacaaatggcatgaaaaccacatagtaaatagctccagtttctcaaaagtcctgagctgaaaaacgagaagatacaaaggaagaaagatcttttatggtttccagctgaaggatgagtttataataaaaacagctaatatctgtagaatgctaagtcttgtgccaagatctgtgcttggtgctttatatccccattgaactcacaagaatcacagagctaggtgctgtgctattcttcccatttcacagatgaggacactaaagcccagagatttaataacttgtccaaattcacataactagcagtgggggatggggatggaaagtcctgaatccattagaccgggggtcaccaacccccaggacatggaccagtaccagtccatggcctgttaggagtcaggccacacagcaggaggtgagcagcaggcaaatgaatgttacctcctgagctccgcctcccgtcagatcagtggcagcattaaattctcataggagcaggaaccctactgtgaactgtgcatgtgagggatctaagttgtacacatcttatgagaatctaatgcctgatgatctgaggcagaacagtttcatccctaaaccatcccctctatcctccctgccacccccagtttatggaagacttatcttccatgaaactggttcttagtcccaaaaagtttagggaccactgcattacactatactgaaaaaaataaatagtgcttgcaaaaagaaaacaatcaaaagctagcaatattcaacaggatttgattttctgctttagaaaaacaatggtaagctcttggctggacagtcatctttccatggagactggtaagcaggtttactgaggaacagtctaaggggggtttcagaaccaaccagagagacaataaatgatgagatgaaactttaaaccacagttatcatggaagtcaggaatgacacagaaagaagaaaaagtggaagaagaaacaactttaaggacttattaaacaagaacattgttggaaagtgtttgacccaactccagagggtgtttcaaggagggccaaccatagcctcagagagccaataaatgactttcacgaggtcattctgtaccctgtgtctgttccagcaaaccacatccacttttgcagacaaggagaagactgagcaatggcaggtagactgacccacagtttcctctttccacagagagcctctaccatatctccaaaccaccctgaaccaatgttataagatcacaacgtccattttagatagaaatgctcaaatacatgttttccttttggtttgcaaaaacaacaaaataatttgtattcagtgtgtagtgagtgctgttctctaattcaccacacagtgcaggtcatgttggtcagggagtgagactgcatttggaaacacatcatgcggccctacactgatccttcaggatgagggtggacccctgactgtgtgacctgccattaactcgggaaacacagtttcttgaaaagtagagcctcttgaaattcggctagcatcctgttcctttttcaaagacaatgaaaaagtgggaataattgtaagacagacagtcaaatagctcttatatttattgatataaatttggaagtaggggatgttagagtcttgccaggcaggatgataagatgaattttgttttccttccattatttaagttctgtcttttctcaaaatgcaatccaccacaaactagtatctgtcactcctgagtgaattgaacaagtcagaaggaaaatcaggtattttcttcttgtctacaatggataggagtgcatgaaagagagatctgaggtatgttgctaactaaatcacagtaaaaacaggcacgtcagctgctgtgtaaacatatgcatggagaaactgttttttctaatgtttgtaaaacatactgagttatgtattaccgtgttgtacaaaatatatcatgttaataagaattcttcttcatgatataagaacttttattttgcatatttacttacataatagtgaccatacagataggactaccgagaagtgactcaccatatatgtaattacaagtgatgcgaagaaaaacatcaaaaattttgagatttcgaccacgcaaaaccaaatactgagaatccaaaagaagcctcccattctatattctttctattccaatgcctaaagcatcaatatgggggtacaccatattcaaatggctcgatctgatcattgagcagatctttaataggttcttgatataaaaatatttgtacacaatgggaatgaatattaaaggcacaaaggaatcccaactctacaaaaatcttactagaatcaaagtcaattataaattattttgcagtcaaaagtcgccttgtgagacacttgccaaagtcaggctggaaaatgcctgtacacgatgcctgtgactctgccctggttggaccattgacatctgatattttctgttgttgcatctgacaatcagacctagtttgcaaagctgtgaaaattaaatgggctgatacatagcaggatgccaataaatggtggctattattattttggcatcgtgtacaggcattttccagcctgactttggcaagtgtcgcacaaggtggcttttgactgcaaaatagtagccaccatttatttactctcaatgtcccttggaataatttctgttgaacagaacttcacataatgataatgaatgatcaagtgtatatatatatatatatatatatatatatataaagcttaaaggtcattagaattttaggagcataaataagtcatactgagttttgtttgtttgtgttttgagacagagtttctctcttgttgcccaggctggagtgcaatggtgcgatctcagctcactgcaacctccgcctcccaggttcaagagattctcctgcctcagccttccaagtagctgggattccaggtgtgcaccaccacacccggctaattttgtatttttaatagagatggggtttctccatgttggttagactggtcttgaactcccaacctcaggtgatccgcccacttcagcctcccaaagtgctgggattataggcatgagccactgcccctggtctaccatgctgagtttttaaatagcaagctatttcacaaaaataagatgagttaacggaaacaatattcagatgtgacacacagccagcagttttctgttcctaaattgttggtatcagtcagtacaaaatgccttccataagcattccctgattttagaccctctctgtattgggtacattgtttccattgtcacagtttatgtagataaaactgctgtagaagcttccagggcaaatctatttttatctagatattcattaaaattaaaagcggataacttaaaattaaattaaattaaacataggttaaaagctactggtaggctaaagttcttttcctgaggtttctactaaaagacagatgatgatagatagatagatagatagatagatagatagatagatagatagatacatagatagatagataatagatagattttaatagatggatgcgcacatttgtgtctgtgtatatgtgtgtatcacatacatgagtatagagatatatgtatacatggctcaatacttccacctactggctgtgtgaatttactcacattatttaccagtatattttctctgtttcctgtttttgaataacaacaacatccaacatacagtatcattgtgagaatcaaacgcactttgctggtaatcatcaaaatacagacctctatttattaaaaataactccaaaaattaatataaacacagatgtgagtaaatagtatcagtaattaataagataactcattgagtatgcattccgtatatcaaattaagatctacacttattccatcaagcctgaaaccaaacacagtggcagggaccatgctacagacgagcctggagccggccagagtactgctctaggcatttcctcactgcctcaaggggctgtcctgggcactgggtgctccttagtaaactgatagacacagcccgtgccctcaagagcagtgtgaggagacaaacaagacagatcaacaagtgcttacagtgaggacaagggtatggagggccagggcagctgggagaaacagaggatcagaaaggagagaatagggaaagggcagaggtgaggctgagaaggggccacccagacaaggatgggggaagagaacatccctgccagaaggagcagcctgggagaagaccataaggctggcaaggaatggaatgaagccacagtcaggatcaaagagatcaacaggacgggaggtggaaagccaggcaaagccaggagcccataacaaggagtatggatttcaactgccattggagagacaccaaagagttttaaagaaaaacttatcactccgtttcctgggtgtgtggtgtgggatggggtaggaagttggagccaagtgcatccttggtaactattttcacagcaatcagggccttgcatcctcaggtgtgtcactcattgagccccttgacagaaaaaagttattgctaagacccttgcagtaggagtggaaagacagttctagcacatttgattccttccttcttcctggggaatatgacccattgaaaatacactactttcatgaatttgctgattcaagtaggaaccacttttaccaaggggaaatgggctggcttcccctaaatgagaagcaccacttcttcacaccgccctacaagtccaaaactcacacctacaattctccatatctttaggtcaataggagttttattaactggatatgtgtctaaatgttctagttcaaagtgacagactttagtgtctactctgctcttattccattccaagcacatagccctctcttataaaattctgccaaatcacacactcctattagttatatatcatttcatgaatatttctgaaaattgtcaaaacacaaaatttctattcgccatgttcatttttctctgatgatattttaaatttacaggttcacttctttgaagaattaatcatttaatctgccagatcaaattaatacaaggtttttattggaatgttaatttaaattttaaaatctggtaaatattttaactcctaaaaaatatgttaaaagactgaaagaaaaccatgtaagattttactgaaagaagacattgagctccaacattattcagttgttatcatacttcttcccaataagctactgtagaataaggaaacgtgcatgatggctctggctttgtctcctgagttgatctgagctggggcaaaaagaagaccaagacacagggagccgacttcccaatatgtggcagtgagtgaacaaatgtcagaggcccttgactgggataaataaaaagttcaatagaataatatagagacaaatttatagaaacacataaatctgggcattttagaaacaagatgacaacatgatttatgctctaaactgggatgcttttaagaaggaaaggaggtaacattagtcatcaggcaaggacatcaagagggattcaagactgtcactaggaaactgctagaatctctagacaatgaacattgagccatttcccaattgttttagcagttctagtacacgtctgcatgatatcttcactacagtgaggcatcccttcttgtagtggatttattctttatgaggtttccttgactcatgtatatacagttcatgcaagtatccccataatgtggtagcaggagaaagaaagatttactcatcccttttcttttggaatgcacaaattaaaatctaaaggtagtaaaagacctttggcaagtatattggcaagtgtagaagcttcctcacatgactggagaggacctgtggctccccagcttttaagccctctgtgctcgatgtacaggatggagcaatacagtgttttcagagcaccgtaagaactgactcatgtcacttaaccacacttttgtacccataaaggtctgcattaaattaccacacaggcttttctactttgggtttaacagccccagtttattgcaccatgtatgcaaggctacaacagtcaagaaaatgctctcaaccttttccagagtccacatacccctcttcatggcagctcatgcatgaaaatgtgggcatcgggagagagagatggaggccatttgtaacgctggtatttcctaaagtgccaactaaacaaagggaaggtcagcagcttgtaaaggaggaagggtgcaagctctggagtggatctgttttcaagcgctagctcaggtatgcatcaggtatggcctgtgtcagggggcaagtccctctgagccccatagtgctcatctgtagaagaaggataatgcaatctcccttaagaggttgtaagaaggatggcagatgacatggatttggagtcttccatctacctagcatattgtaaatagctactgcgactcttccttgcgggtggtgtaataactacaagtaacagatactccaataagtacatggacaggcaggcgatatgcatggaggccattgatttaaaatgattcctgaccctcaaagataataagattagatttacagcacgatatctgaactgcagccatcccacaaggcataggcaactggcaatggctgctgacaggcttgatcaggcctgaatattagaaaagggcatctcattgtgctgtgtcacatgtcacacaactttgctcaacacactttccatccatgtcatctcatcttcaccctagcaagtttaaacttgaataagatatcagccttggacttgtaatgctgaaaagaacttattgttcacaaggtcattctttttaagcatctccccaggtgcttatttggaaaaaaaaaataggctgctgactatgcagtcttgattctattctggctttacagagcttctttttcttgacaaatacttgcattttggtacccacatatacttcattcccaatcctcatttgtctttgttttgcttgttctctgacctctgcttccatttctgaatttccagctgtagcgaatcttgtcagtcgagagagcacctcttgcagaccagtcacacctccaggtactgtgctgtgcatacccttccaaacaggctctcactgtccccaggttggagcccaacaaagtcacgccaccctagctgtgctcaggctgttcagagtcagcacctggtcccaaggagaagcactgagctccccaaagcacctctcttcaggacaagcagaaagaatttctccttgacttaagcacggaggagattttcatcctccaagtaaattatcattaatcattagaaggttcatagttgcattttaaagacctcaagggtctacttaatgcttgagtaacatcatcaatgtatttcaaacaaacagaatttaacattgttaccagaagagttttctcaactagaattataatagctcataaaaaatgatacagttgaaaagacaatgcttgtggatttcaagtgagttcacctccatatgaaatcctggccaaaatctcagagactgcaggacactgtggagttccctgggagaactcagtgggataagtacacatttccaccagagaaggaaagccagctggtctctgagtgttaataaggctacgtggattagatgttcatgctgagttattaagcctcatttaggagttagtttttccaagttcctactcaagtttttcctctgtgtgcaagcacataattccttcaaaactcacaaactcaatttgcacaatattaatttggaaatgtattttcaccttttcatgggtttattgttccccaacttgattgccagtttcttgaaggcaagttttattgcttttctattttaagcatcaaccattaaacatttattatcctgccttacagtaatcatttcaaagttattaacgattaatattttaatgcattaaagctgttaaggtatttctctaaacacataagtttgttttaagagcgactttggcacaggagaaaatatgactttgaaatatattcattaccaaacacataacttaatgttccagattcatccagaatgtcatccaattgattgtactgcctttgagaaatgacaataaataatggctggaaatggggggctaagtgagatgagggctcaaagggaagatgttataaatttttggaccaggttcaatttcaaatatgcatatctgtgtttttgttgctgtttaattctgatatataattaatagaacattctcccatgtttaacattattcacatttctgctatttgtgaagtgtgctaatgtcttactcattcaacaaatatggattaatcctcatctatgtttcagacactgagtaagatgctgagcacataaagcaggcttccacagagcccctgcccttaaggaattcataaaatagtggggaaaacaaagaagtcaactatctacccattgtcttcatctattccagctgctgtaacaaaaaataccataaactcggcagcttataaacaaccaacatttctttctcacagtctggaggctgggaagtctatgatccaggcaccagtagatgtggtgtctggcaagggtttgctttctggttcctagccggcaccttctcactgtgtcctcacaaggtgggaggaatgagggagctctccggggtcttgtttactcgggcacgaatcccattcatgagggactccacctttatgacctaatcagctctcaaatgcctcacctcgtaataccattacattgaaggttcaattttaacctacgacttttgggaggacataaatgttcagaccatagcaccatttaactcattaattagaaaaaatgtccgttgagtgcttactttaatgccagcactgctgtaagcatgtgggacccaggagtgagaaaaagacgttaagtcctggtcattgggaactttcattgtagtggtgggaggaaataacattaatagctgaggctaaaactgaacatggtaagaagagtcaaaagggctagataggagggagctgtgatctgaaataaggtggtgaggcttgggttccattaagaagatggcatttgagcaaagactcaaaaaagatgggacagttggccagatgggttgtctgggggaagagctttccaggcagaacagcgcccagcaaactctagcccatgggccaaatcctacctgctgcccattttgtgaataaagttttattagcacccagtcacactcatgcatccatagactgtggagattttcatactatgatggaaagattgaaaaaatgcaacagtggccatgtggactgcaaagcctaaaatatttattcactggccctttatagaaaagtttgctgagctctgaaaggcaaggaagaaccagaggcactgtgtggcatttcagaggctaaagccaagggagcacatagatgaggacaggaagggaacaggagggccatggcagcactctggctttctctgcaagtaaaatgggggctctcgtaaggttggggcaagagactgaccaagagctccagtagtatgggggaaagtgcaacttgaacagtgtgagaaagggatggaacagacccaccagagactggggaaaatggaaatttaaactaaactaactaggagccagaattagccaggaggcaaaatcaagcaaagtgaggacaaaataatcacaaactgcaaagcaacatggtgaggaaggcagaatgcgcccccgaaactgcacattgctccttaaaggacaccaagcatgcatgcgggaaaaatagcaggagccagggctgtaaaaacaggcagagccagatcatagcggccaggcaagaagaaacaggcagaacccacaaaggcttccagagctcgggccaggcctgctggccctctccaatccagcttgtgctgacagctgacagcacctcccaccatctagagcccctgcagaggtgcagaggatcagggggaagggagtgtgtattcatcagtatataaccaataatgctgttggtgtcataagaaattgcacctggaactgcagtataaaatccaagagacttagcttgctaaaggcaggtttttagaaccataccagatatttatgatgggtttctgcaagatgtggtgggaaggttagaattctggtaggtccttactcagggatctctgtatcccggccagatgtcaccatggaaaagccagtatcatcatttgcctgaagattagttctgaaactctgggtcctggggttgcaaaaggccacagcatgtcatgctctgcccacacattctgatgatgcatgctttgtgcctctgtgctcctcttaggctagactatgagagcactcatttctgccatccttccctgtagtcttttgagatagtaattcagatatagaataagcaacacaagatcgagctcactgctaactcaagcatcagcaatgctcaagagttttagcattgttcaactcaataatgaatcttgacttgctggatcttgcattcttgagacttgcggaggagagaagcgccccttccccagagacataggggcagggagcgatgcacagtggacaaagcagcagttcaagtgaatgcattgtccatagcagtactgtagagagaggaaggaagaaacatgtaaaacagccctctgccctgggcaaagcagacaggagatcaccatccctacctcaggactcatgactctcacaggaaacaagaagacaacgccatctgctaacaatggagatgatatggctgatataggaagcctgagaagtaaacagatttaccagcagtagaagaaagagcattaagattgtcagcagaaagtaaggcgttgtgacttcagatctcaacagttgagtatttcttcctttggacagtgttatagtttaactgtacccatcccccaaccaaaaaaatatgttgaagtcccaacccccaattttcatgaatgtgaccttatctggaaacagggtctctgcagatataatcaagttaagatattccaacatgactggtatccttataaggaaaggctaatttagagagaggcacaggaagatggccatgtgaagatggagacagacataggattgaagctatcataagccaaggagtgcctggggctactagagctagaggaggtaaccatggtttctcccctcaaggacttggagagtgcatggccatgccggcaccttgattttggaccttcagccttcagcattttaagacaatacatttctggtagtttctgatggttatttttatttctgtgggttcagcggtaacattttcttcttcatttctaattgtgtttatttggatcttctttcttttcttctttattagtctagctagtggcctatcttattttttttttcagaaaaccaactccaggattcactaatcttttgaatgagtttttatgtcttgatttccttcagttcagctctgattttgattgtttgttgtctagatgagcactgtggggctcagagagatttgccctttaaacacaggctatatatgatgcatacctgagctaggactttggggttgattaggtcctgtttcttctagctttggggttgatttgttcctgtttctctaattctttccattgtgatggtaacctattaatttgaggtcttcctaactttttgatgtgaacatttagtgctatgcctcttcacactcccttagctgtgtcccagaaattctggtatgttgtatctttgttctcattagtttcaacgcacttctcgatttctgccttaatttcattgtttacacaaaagtcacccaggagcatgttgttcgatttccatgtagttacatggttttttgagtgattttcttagtcttgacttctatgtctattgcactgtgacatgaaagtgtgcttggtatggttttggttcttttgcagcttctgaggattgttttatgtctaattatgtggtcaattttaaagtatgtaccatgtgacaatgagaagaatatatgtcctgtagttttttggtggagagttctgtaaatgtatatcagattcatttggttcaatgttgaattcaggtcctgaatatctttgttaattttgtgcctcaatgatctgtctaatactgtcagtagagtgttaaagtctcacattattattgtgtgtgagtccaagactaattgaaggtctctaaaaacttatgaatctgggtgctactgtgttgtgtgcatatatatttaggatagttatgtcatcttgttgaactgaatcctttaccattatgtaatgcctgtctttgtctttttgatctttgttggtttgaagtcagttttgtctgaaattaaaatggcaaaccctgcctttttctcttttccatttgcttggtagatttttttccatccctttattttgagcctatgggtgtcacttcatgtgacacaggtctcttgaagatagcacactattgagtcttgcctctttctccaccttgccactctgtgccctttaaggggagcatttagcctgtttacattcaagattagtattgatatgcatggatttgatcctatcattatgttgttagctggttattatgttggcttgcttgtgtggttgctttatggtgacactggctgcgtgtttaagggtggttttgtattagctggtagcagtctttcctttctatatttagtgctcctttcaagatctcttgtaaggcaagtttggtggttaacaaagtcactcaacatttgcttatctgaagagaatcttatttctccttcacttaggaagctaagtttagccggatatgaaattcttggttgaagactttttctttatttttaatttaagaatgctgaatataggcccccaatctcttctggcttgtaggatttcagctgagaggtccactgttagcctgatggtgttccatttgtaggtgacctgtcttttctctctagctgccattaacattctttctttcatttcgaccatggaaaatctgatgactgtgtgacttggggatgatcttcttctgtagaatcttgcaggcattctctgtatttcctaaatttgacttttggcctctctagcaaagttggggaagttttcatggatgatatttgaaatatgttttccaatttgtttgctttcttcccctccctctcagggatgccgaggattcatagatttggtgtctttacctctttacataatcccacaattctcaaaggttttgttcattccttttattcttttttctttgactgtcttatttcacagaaccagtcttcaagctctgagattctttcctcagcttggtttattctgctgttaatacttgtgattgcattgtaaaatccttgtattgtgttattcagctctgtcagacctgtgaagttcttttttatatgggctattccttccttcagcttctgtatcactttattataatccttattttccttggattgcattttgctgtccttctaaatctctaacttcattcctatccatattctcacttataaatgagaggtaaatgaagagaacttatgaacacaaagaaggaaacaaagaacactggggtctacttgagggtagaggcggggaggagggagaagagaagaaaatataactattgggtactggacttaactcctgggtaataaaataatctgtacaacaaaaccccatgacatgggtttacctttgtaacaaaccttcacatatcctgcagaaccgaaaagttaaaaattaaataaatattttttaaaaaaagagaataaatttctattgttttgagctaccctgtttgtggtactttgttttagcaacctaggaaacaagcacaggcactgtccaaaatgtcactgaaggtatggcttgatgaaacaattcattggtggctgtctgctggctgcctggaagtttgggcagaacagtgcccagtatatgagcacgcagtaaaagttagtgactgctctactgggcgtttcatcggtttgtccaataactattggaaacatgcagagggactacctaaatgcataagcaaattgtctcatacacaatttaatcacagttaatcggaatgcaaaaattttgctgactaaggttagcagctgctataccctcccaacttctcctgctgagacaattttctttcctcaacacaaaaatgttgcaaaaaactgaaaagcatgcaaaacaaagaagtgagttttgttcatcattatatgtaagcagctgctagctgagtggtggccttctagaggatccaagtcctgctaatgttctggaagtcacaagattagatggtgatggatgtagcttgaatgtgccagtaaagatgaggaaagaggatgttggaaggtgtcagtaattcaagaaccacaggcccaaataatcactcatttattcagtcaacaaacatgtattaactccctactacatctcagacattgtatcggactttggggagttcacagtagctccccttatttgtggagtactgactatgtgccagacactaatacttatcatcttcgttgtcccactttattctcacaatgtccaggtcaggtagtcagtgatctgcagtatgcagatgaggaagccaagaaccagtaagacaaatttatgccccaagggccaagcctcagatcgtctaactccaaagcttctactgtctatctcaaagcttcacaccacatattactggctattctgtggagagtgggtcagagaggggctagtgcagcatttcagatgaggaaggcttgaacaagcacagaagtggaggaataagaagaaagactcaggtctgggagccactctaaaagtggtctctgcaggacctggggttgagtgggtctggaaagagagggaaggagttggctgagatttgcaggtgtctggctcagatgagaggtgaaacatggagcctgctctgggctgagttttgtctcccaaaacttatgttaaggtcccagcccccagtactccagaatgtaactatactcaaaaacagggtcttcaagtgggtaattaggttaaaatgaggtcattggagtgggctttaatccaatatgactgctgtccttataagaataggaaattaggcaacaggcatggacagagggaagaccatgtttagaagatatagggagaagatgacatctacaagccaaggagagaggcctcaggagacaccaatcctgctgacagcttccttttggactttcagcctccagaagtttgggcaaataaatgtctgctgtttaagcacccaggctgtgatactttgtcatggcatccctagaaaactaatacagagcccatacccaagattgaaaaacaaagaaatgaacatgaatggggtaggctgagctgaaagtactgcaaggagcatccagctggaagtgaacatcgcatctgtggactaagtcggagctgagaccagatctgtgaatggtcctcagtaggcgggcatggtgtgagtcaggggagttaaaattttggaatagaaaaaaaaatgtgattacatatacaccatggactactactcagctataaaaaggaacaaaataatgtattttgcatcaacttggaaggagctggagatcattattccaaggggagtaattcaagaatggaaaaccaaatatcgtgtgttcttacttgtaagtgggagctaagctatgaggatgcaaaggcataagaatgatacaatggtcttttgggacttgtgggaaaggttggcaggggagtgggggataaaagactatatacagggtacggtgtacactgttcaggtgaagggtgcactacaatctcagaaattaccactaaataacttatccatgtaaccaaaaaccacctgtgccccagaaattattggaatagaaaactaagaaaaaacaacaaaaaaacttcaggatagatgggaatccaagtaaccaaaaaccacctgtgccccagaaattattgaaatagaaaactaagaaaaaacaacaaaaaaacttcagaatagatgggaatccaagtaaccaaaaaccacctgtgccccagaaattattgaaatagaaaactaagaaaaaaacaacaaaaaaaatttggtatagatgggaatccaagaaaagcgtgtggaatgagaagagtgggcagaaggaagggattgaggacagaattcccagggataagcaaagcttaaagaccagcggaaggaaaagagtcaaggacagggcagacgctcaagccacagcgtgcactacctaagtatggtacagcataaactttctgtaaaagaaacttcgaggcaacaatgtcatccttccagtaagatagttaaggtaatggctggaaatcggtcctcaaataatgtaactagacactgtgggactggggagaaccacagcagcgccgcatggtgggatgcaaagggcagagaagatgagaattgcctgaagatgggagtttaagactgccgtcctcaacaaagtcagccaataatggagggcaactgatgggacagggacttaccctccactcctcctgtttctgctgagagaaaattgccactgcatggccaccaaagcaggaagacctacgccttcaccaccccattgtagcctccttccgcaacaagtccaactctcaaattttattttgctcacttggttgaaaactcaagagagaagtctgagagcatcatttaatgggtccttaaaatcaccatgtgaaaggggagcattcttggacacggcagaactaagggtgtttgtttttagcttgttgcggtttctttgtttttgtcttacttaagagaaaaggcatccgaacattttctttttttttttttttttttttgagacggagtctcgctgtgtcacccaggctggagtgcagtggcgcgatctcggcttactgcaagctccgcctcccgggttcacaccattctcctgcctcagcctcccgagtagctgggactacaggcgcccaccaccacgcccggctaattttttctatttttagtagagacggggtttcacagtgttagccaggatggtctcgatctcctgacctcgtgatccgcccgcctcggcctcccaaagtgctgggattacaggcgtgagccaccgcgcctggccccccgaacatttttctgaaatcatgagtcatcattagaaaggaagaaatttgaggttatggtgaaaagaaagataatggataaggcagaaatattgtccaaaaaacgaaaattactccagaacacagcagaaagaatcagctacagaccccgagtgacaagaagaggtaagtttgagggcttactgggaaaaaccctttagaacctaacatttctctgtaaagtaggaggaaagataaacccattgagaatccctgggagaggctgggagaggactggagtgggggtagttgcaaggggagaggacaggaactggggtgcttagaccattacggagctgacctgagggcctcactgaagacagaggctccaccttttctgttgccctttctaccacaggacgattctcactagcaccccagtgtttaagagacacagaagccaaggggtggccccccctggggctggatttggtgggagtcagtgcaggcgggcaggagtggaaggagaactaaaggaggaagacctgagacaagggcatctggcaaagaacagatgggatgcaaagcctgtgtcccaattaggccaggaaggataaatgtccctgtgttcaggctcagcagggggtggaagcagaacctagtgtggttagagaccagaatccatcctggatggaggatcaatcagagaagcgaatcagggtcaactaggagtggaaatagtatctcagggctcagcagtagcagaaagtgccctaacaaaacacaggagaggtatgaagacaacacttcatatgcaataactcagggtcctcaggcagggctcttggttttctatcctaggagagagggtcttcccaatgtaggccagggaaggagtgtgggggagggcggtggaaatgctgctttcctgagaaatgcaggctattcattgtcatgcaaattgtgctgcccttgtggcctgagtggtagagccaccgtattgacctctgaattactttcagtgtctgcagttatcagatcttagaaatgaacagcagaatgttttaggaatcggaaacattaatgcctttgtaaatcaaataacaatgttatgcctgagaagactgtgataaacactgttttagctcttccattgcctggatggcaacacatgactctccaatggaaaaggagaattcacagatgctgacaaccaggacgctgaccgatactgaccacctgatcagctggtggtcactcagtcacatgtaagaaggcagctagtgtttgtaactcatactatgacctgaattgtttttccaggatattcttaaagtgtcactttgggaaaagagctttttactttgcttctggcaaatgctaattacaaagcttttattgggatagggattcttgatttttaagtggaaacttccttggccagtcagaatcaacaaacatatggaaagaacaacttgaagctgcacagatgaaagtttcagggccaaaaggggaccatccacatagaatcaactgattcggttgaagtcagttcaacagaaatgatgttaatgggagaattctagttagtgcttcagtttgggaaaacaattcatgtttccctttggaagcaatagagtcatttagtttacttgagaaagttaatgacgaggacatcctttttttcctacaggacagtcttttaaaggcaatctctgatgattaggttgactgtattatttggcaaaatacttgcattgaatatatgtacacgtatccatggttttgcatatatgatgagtctaaagcagtggttctcaactagagttaattcccccctcccagggggtactgaaaaattgctgaaaacattttttgttgttacaactgggcagaggaggatgctactggcatataatgactataggttgaaaatgctgctagacatcctactatgccaaggacaagacccaccccccagtcccacaactaagacaatttggcccaaaacatcactagtgctgaggttgagaaactctggtctacataattagctgatatgtagcaaaagtctactaactctcaagatttcacttttgtacaaactatcaaataaatgcttggggcaatggattacacatggtacatatacattgtctttgtaggtgtatgtgtatgtgcgtgtgtgtgtgagaccacactcacacatgaatgcacagatatacagagggctgcatttcagctgacacacatcagggctttgtacacagcgaacctcaatttggatggttgtcaccatcttctgattgctcagtaagcaagtgaccaagttctggcccagaactgaaagaagccttctaagggtttctggtttctttaaaaataaatgcatggatgaaaaggggagagggatgtggctcttcttcgagtggatgttgccacatgtggatgcaatacctgaatttgcagcaacaattttgcaaccacaagcagaggtggcctgagggcccatctgccagactgtggatggcagagactgcagtgaatactcgcctccttattaactgagccactgaatgaataaaccctgaagatgcctactactaacttctaagtatgtgagttgatacattttttacatttttaattgtcatactttttggagttacctatagacaaacacattcttttatacagttgctgaaaattacatgccatgttagtaatttccatttctagacacataaaatggaagttaagaagtaatgcacaggagtctacacatgacaagctgtcaaattttctagacattaaacaacaatataaaaaaaaacagcaagtttctataagtggtcatatcaacattagccatattatcatggttagagtgttgcgaatatcacttctcttccaaatactaaatagccatatgatatcctgtttatcattagtcctgaacaagcgacactttgatttctttagaagatgaagaattcatttttatttagagtgttgtagtttgcttttgagcaccaaatcaccaggaatcaaagacaaatgaggtgagaaagagggagtgacggaaggcttaccattgagccatttggagttgtactgcgccgtgcggagaggaggtaaaatgcctaggcttcggtaaatggcaggatcacgtcctggaaaatccatggctgtagcagcatagagctccccaccagctgtgaggagcgctgtggaattgtgctggggactgtagggacagcgggccatgccactgatctgatcatggatctcagtcaggttgctcaactgtgggggaggatgagagggaaagcagttatctctgcacaagcccctttagtgatgcttatggtcacacccaccatcatcacagtgacgcttgtgcaacagcctctcgggggcccatggggcaagatgaccaacttttacattccaactgatgtaaagagcctactctgctcatggtaagacagtccatcaatcagtttctttctcatcactttagagttactgaaccttgtaccactgaatactcacaaaataagaaataagatcattgtatatatgcctttgatttataatgcacaagtattgcatacttttccactttaatataaaaaccagtgtcaatatttacagaaataggatcacaataaagaattatgtataattgcctgggcacagtggctcacgcctataatcccagcactttgggaggctgaagcgggcagatcacgaggtcaggagatcaagaccatcctggctaacacggtgaaaccccatctctactaaaaaaaaaaaaaaaaaaaaaaaaaaaaaattagccacgcatggtggcatgcacctgtagtcccagctactcgggaggctgaggcaggagaatcgcttgaacccaggaggcggatgttgcagcgagccaaaatcgtgccgctgcattccagcctgggaggcagagcgagactctgtctcaaaaaaaaaaaaaaaaaattatgtataattctatcaatataagtgaagcaaaatataatgaatagccccaaaaaatgtgttcacaagtaaggatgtgtggatattcaacactatgtggcccacatttccaacactttctttcttttttttcagttttcagagagatagctaagcgtcttggagtcatttcgtatgaatccagcttcccaaatgctggattcccaaccagccattgaatgagaaaagctcttgggtactggtggaatctttgctcaatttggttcttggttctcgcctgagaggtattggagcagaagggtcaggcccggtaggtacaggcacactgcttgctctgctatgagatgtgtacctgggtaagttccttcagctctttatgtctcaggttcttctttcataaaagggggccccaaagagtagcgatcttgtggggcagatgttgaggactgaaccatggcactggtgaaagcgcccagggcagggtgcagcacctagagagctccctgagtttcacaccccttatcatccaactcctccctttatttccaataactgaatgctaacctgaaatcatgaacagtaaaagcagatggtcaattaaggtcttgaggaaagttgtgcaaccagggaatgaacatatttcttcatgatattcccagaggaaggttgcatttataccctgaattaggaagattccacgtgtgttctactgaccctgccatgctactgctatggtgtgtgcagctgaaaattactctgtcaatgattgccaggttaaagacaagaaagaggatcagttataactggactttgcctagggtgcaatttcttagtttgcttatttttttttacatacttcttatccaatttgtaggctaattttttcttcccttggattgtgattttagaccattttaataattttaaataaatataaataacagtaacagtatctctaccataaagcagaataagacaaaaaagaatatgtttaggattaatgtttaaagtcactggtggaaaaaaatgctggttggaatagtttagaaacatatttaagtttaattatacaagttataattatttccagttatttatctaattgatggtcctgattagaaatatatcaataaatcaaatatttattcaatttgacaaaaagtgctttagaattgaacagcaacaccttggtgtatagaaattcatttaaaactagtatttttacacaatgttttgcctcttctgatattaaattcttttgaggcacaaaaagaagccataccgagcggttggtgcagacaggcgtgaatgcattggtcccacaggtgaataaccggtcgccacccaccagaagcacccggatgtagttctgacattcctcctgagggaaaataaataaattaattaaaaatatatatatatatgtataatgataaacatgctaacaaagtctgagcacaagaagaatggtgagaaggaatacattttatctaataaatatgtaagccattaataaaatgtaaaccattaaaacaacaaataaacctttcagatattgaccaaaaaataacaacagagctattaaacaatttgatttttatcaaataaatttaattgctgtatctgcaccttgtttgataaaaaatatgaagataaatacatgttcaattaaattctcaaagcatgcatctaattttgacagaaatgatttcattttgaattgtatctgatagtagcacaaatgctaaatggccttggacgggtattaggaaaataaataaaaggaacctattagatgtcgctcgggaagcagtgccttggaaaacttcctcagactttgagaaaatgctgcaagcgctttttgatcagaaggtcacatgagaaactctgtacacaaactggagcaaattttactttatgggatccaactgcatattttaaatacaaagcaagtatctatatgaatttttttttttttttttgagacggagtctcgctctgtcgcccaggctggagtgccgtggtgcaaattcggctcactgcaagctctgcctcccaggttcatgccattctcctgcctcagcctcccgagtagctgggactacaggtgcccgccaccacgcccggccaattttttgtatttttagtagagacagggtttcaccatgttagtcaggatggtcttgatctcttgacctcgtgatctacctgcctcggcctcccaaagtgctgggattacaggcgtgagccgccacgcccggcctgtataggcatttttaattcattgattgaaaagtgaaaatatgcttaatgaggacaagatgttcgaaacatttgggacaaaaccctaggctgagggatactccaagaatggagtactttttgtggttgcaaagtgttcttagaaaaccctgggtatggtcatagcagtgatggacatgtgagctggagagctcctcacttattcagcaagcattcactgagtagctcctctttggtagccactgggttagaagtctcaatccaggctcctggcagaaaaatacaggatcatgacaattaccacagagctgtccatgcactgtaatgaggacacacagaggaatagcatattacgtagctccaaaggaacagggaagggaagaggtgtagagaggcttcctgaaggagctgacaactaagtgttaaataaagtgtaaggtttagtgaggcttcctggagggggtgcttgtaggacacctgttggactttactgagcaaaggagggaaaagacactccactcaagaggagcagactgtgtcaaagtgtcgtggctagagaaagcatggcgctctcattgtgtacagaggagctcacatagaagccgaggagcctgaaacaggccaagtgtgcccaggtagtgagttcacatgttactctgaatgtgaaaggagccattacatgttttgactgcgtgaagtattgatgagctctcatgttttatcactgaagaagcactcagaaaccaatgtgcaggataagctgaagagagaagcctggagtcaggaagccaaggaggaagtcacttccataactcaggctcttgtcatttcatgcctagaccaaggtagtaggtgtgaaaggacaaagccagaatagtgagtcaattgcacgccatggcgaatgaatgacgcacgaggcatgaaagatgctgcatgataacatgatgatttgaatcacatcatgctggaaatcaggggaatctggatgtaatggtatagctcatcttctcttcaaccaaatggacccccactctagatgaaagtgttaatttcccataacccagtctactgcatagcatcgagacagcggaaatgcatagtgctaatttctgtattttctttactagagacagggttctgtcatgctgcccaggctggtctcgaactcctgggctcaaatgatcctcccaccttggcctctcaaagtgctgggattacaggtgcgagcaccactcctggctcagattggcttctaaatgtaaagtgaaataccaagggtggattatcctcctaacattattcctaacagtaatagtaaccacttatcattggaagctgaactgaggaagatggaaaacaaccacaaagacctaagtagacttcagaagaattaccaaatgctcgtaaacagtagacagtgaatctggtaactgagaaaggtacaccagaggtgggaggcttgtcttgttttgttctcttttgtttttattcctggggaagggtcaggagagttctaaagggaaagaacaaaacaaaagacttcaaagaaccacacagtacttccttcccaggctgaagagaacacaggagggccagggaagaaactagaggggtacgggagcctataaaggcaggcagagtgaggataaaagaaggaagccgatgcctgtcagaggagacccacaaagacatcttccagaacacagggctgagcaagctgatggacttaatggatgacacagacatattaatgacaccatcataaggactgggatggaaaattacaaacagaatagaagggtgaggttttgtttgttttttgatgctgcttttagaactcttttaaaagcaaggcaagatgtaataaaactttttcctttaaaaaaaaaaaaaaagcaagagcttgccccaaggtaaaccacaaacaacatgggcaagggtaatttgttccaggagaatcatctggattgaaaagatgtgatttcacagcagagttctacagccctggtgaagagaaagcaagggcctccagtcaattatggaaaggagaataaccaagatatcaaatatggtgtttacgttaatttcccaaaggaagaacaaagtgcaaataagactgtaggttgctttcttttgtttttgtttttgttttttgagacaagggttcactctgttgcccaggctggagtgcagtggcacaatcgtggttcactgcagcctcgaccacttgggctcaagtgatcctctcacctcagtctcccaagtagctcggattacacgtgtatgccaccacccctggctatttttttcttttttttttttttttttttttgtagggtcaaggactcattatgttgcccaggctggtctcgaattcctgggttcaagggatcctcctgccttgtcctcccaaagtgctgggattgcaggcatgagccacagtgccctgcaactataggttaacattcctgaagaccactctcaaggttgacgaagaaccagcatgttggtcagaatgtgtgataaccatggtaaccatggtgcagcagtgtgccagggaggggcagtgcaaacccagctggtagtgtaagaatatcagagaaaaagtaaatgaggaaagggacagaattatttcaattagggcagagaatgaaagagcacgttctgatcattaagaccacgtgagaatacatgaagacactggctctattattggcgatgagccacatccccatgtgtcactggtgttcttcgcagaacggagtgagtgtgtggaaaaaaaggaggaagatgtcagggatccagatgatcaggcaaggaggtctgtgcagaatttttataaaatgatggagggtggccccagccctatggaacccagaggagcctgtggcaatcaggagctaatgaaggagggtagtagtgtagttggccccagccttaactagaggtctgagttatcaccaataacagtaggtgtgctcattcactgagtcctacaggagcaacgagtggaggtgggtggtattcgagtttcttcttaactgtcaagagcataactcagtcacccaactggctaagggcatctcacgtacttcccgttcttactcccttaaaggcatcctcatgtttaattcacagattgtgaattccagatgtgaattccaaacaaattcatttaaaataataaatgttttgaaaagagagattgggacaagttcaactgaaacagaatgtgaaaacacagggaaaaaaaagaaagtagaagtatttagcttttgagcagaagataaatttgggaattggacagtcaatactgtgaataaaaggaaatgagtggctgggcacggtggttccatgcctgtaatcccagcactttggaacgccaaggcaggcagatcacctgaggtcaggagttcgagaccagcctggccaacatgaaaccccatgcctactaaaaatacaaaagttagccaagtgtggtaatgcatgcctgtaaccccagctactactcaagagactgaagtgggagaatttcttgaactcaggaggcggagcttacagtgagccaagatggcgccactgcactccagcctgagtacagagcaagactccatctcaaaaaaaaaaaaaaaaaaaaaaaaaaaatggaaatgagtaaccgttccaggctgtgtaataattagtctcctcttgatggtgttttcaaaactcaaattctcttgcagatccactggcaacgcactttgccaatctctgttacaaacgtggcctttccatgggttacctgaacttgcttgaagtactgcttggagtcacaatgtagaggtagagtcacaatgtagaagtccctttaggagattcttttaaaggtttctcttataaatcagcatacttaaatgtctatgattttccttttgtcatctaagaattttttcttctagcccatttctgtaacttgaaaataggtgaagaggatttaatgaattctgattttccaagaagtcacagtgcacatctccaaggcctctagcagcttgctgccacaaggcttctagggttgataatgagagtcatctatctacattttgatcacagcacttgaacattaaaatgacccatgtgggcctgtgatccacagacgtatcaacctgtccttgacttcaaggcaattgatagccgaggagcatggttgctgactcatagaaagggcttttacatggagactggccaatacccacttggtctcaaggacacaaggccccagccccagcagagaaaacatgttttagggctgttttcttaatgaattaattggttttgtcatatagcatttcatgatttttttttaaacaggtatgttctgtggatccctcaggtatctcttcagcaatacccagcccgtcgcccagcccactaattttagggaggaaaggtaagggttagaaggctacaggctttatgttaatcatagtgctcccagtgaaatcaatgtgtcctcttcataatgtgttatctttgtcagcatcaaagtgctgaagaagagcaatttacaggaattgcatgagcctttcaaagttgaacccacatcaacctaaatcatgattacctggtgactcttgcaaaaccatacctaaccaaatcagatgtatgtgtgtatgtgtgtgtgtataaaggttgtatctatataattgtatacatgtattacttgtgaatatatgcacatgcaaatcacagatgcaatatgtagagataaacactcatatacatatattacgtgctatgtaatgtacagtgtattgatatataaaatatactatactgtatatatgtacatactctattttcaactgagctgacttcatgggaaacctttttggatacctcaattaaaaaaaataaaattaggtgtgcataatctaattttaacctaatgttagtatttaacctaaagtaccctcaatttttaaagcaattacataaaataaaagcagggctacaatgtgtcccatgtattgattaactcacagctttcaaaatattggcacttaggtacaaaatgtcaagatccagccctacaccagcaggcacttaggtagtatggtgtcatgagtttcttctcctgttcactaggagtttacctctttaccagcataatttgacaacttggtaaacaggaccacaggatatgacagggagaacaatatacatagctctggattctaatcaaaaccctcccactaactagcaaaataattctaggaacttggtgtcaaaaatcctgaaatgagatcatgaacaaaaacttttgaaaatcacaaagtgtaatagaagcatacagcagctctttcattcccataataatcagctgtgtttcctttgtaaagttcctaaatgtcagagtgggaggaacgtcagttcagacattatagcccaacacacacaaggaactcttgttaggtcgtgagagaattgactatttgtgtttaaaataatatttgtgtaaaagatacttaagtagttatagaattcagtttctataatgctatgtccagaagaactaaatacaacaggttttattataagtttttgaatccataaaaacagattccccacccccactttttttcccccatggaatatttaagccattgcaggcaaaggcactccctctttcccaagggagctgaacattttctaaataaaatagaattcaaactttacaagggcttggcagcttcagtacctaccttcttttcaaacctggcccaaataaaaaatctggataacttctcttgaccctaattccctaaattgtacttttaatggattatatgtgaaatcatatctgtgtctggatacagacatcccagggaaacaaggggaaatccatcatctctactctcctccactctgcagcaagctgaggaatgctcccatcagaacagcaagtgggcacaggcagtgtcctccctgcacacccagccacctccttccatgcatgcattccagctcagctcagcagctaaatgcattatgtgcagaagcacagaccacttttctcagagtaggaaaaaaaaaaaacaacttcagtttaaattgctggcattcttctcatttttgagatgtcacattttgcattattctttttatttcagggagaagggaaactttgtaattctgttctcataagaacttcagcacaagcaaaactacaaaacagctgaattagccttctaagctcatgaccactaagaaaagtcttcattccattcacccaaagagacgttacctatcagtcaaattgactgtgagaatgttctctgaattggctcctaggaactgtcaaaatggggaaatgtgggttgtctgaattctgagttcagggggcagtccttcggaggctgcatttggtccagttgcccctgttcataggggctgccttgtttctttcccttctctgtcccaggagctgggcttggtcagccagcttggtcacatcatggtcattgttcagttactatgttaagaaagcaagagagatgccaaataagaaagaggaacttataaaggtgggtgaagagccctctcctctcaccacccatgaaccagcccagtgctgtctagaccaacatgtttgtaaagctactgcatcatttttgtacacaggaatttccaatgcacacagctctgctacataaactgagctgtacttcgaagcaacagaagttatttaaactgtctgtgaatttatcaatatacttaaggcaacctaaaagaacgtgtgatttatctttctcagagtacgtggtgcttgacactcatcttcatctgtcttactatattagtgttaaaaaatccattcacaaatgcggtttgagtcaattaataattactaagatttcccattatttttaatccattaaaacccaaagcatgtgaaacataaaggtttgattttacttgaaaatatttgtttccctcatttgctttctgtgtatcaagaaaattcaattaagtgtagtaacgattggtctcctccgtgaatcgagggtatattacctatcggtcccaaaagatggccttttcctaatacttctctgggttcaatttacttaagttctaagcaccaaacaaccaatgatcacggcttaaggcaaaacgtgggctagttcttcttcagcagaagcaatttttcaccccaagtagaaataatctattagcaaaaggcaaccacatagattctttgtaaattatggacttccagactatgaggaggaaaaacccctcgctacatgatggaatctgatgctttgctttagtaggacaaggagtataaggagactgaagctcataaaggggaagggagttaactgttaatttttaaacgtctttgtaacaaatatatacatgtaatcaagatgaaatatgagaggactctagggagcataaaaatcaaaataaacaatgcaaaagtgacaaataaatttgccattttggaaattaaagcagggattcccgaccaggtcaatgtctggcaatgtgtttcctgccatgtatggaatagctgccatgtcaaagcataatctggccccaaatatcaataatgatgaagatgagaaaccctaaattaaagttcactaccctggtatgggcttctcatgttcattcagtcattcagtggaacatctttaaacgctcaccgtgggctgggagtgttaagatcggacgaggaaatagcactgggacctgggagagggaaggagggtggggcccctcaggtctgggctatcagctaaacattttcagaacagacactgtgacaagtgtgcatcaacaatatctgctgctaggttgctcaaatctgaatagtgcttattgatgtgtccatgagacccagaaagaaagaaaaagaggagaggaaagagtcaaagtaccagaaggaagataaagacaagaagaaagagttgagaaaaagcaagagggagagctaggtcactgtattagtctgttctcacactgctaatacctgagactgggtaattttaaaggaaagaggcttaatggactcatagttccacatgactggggagtccacacaatcatagcagcaaatgaaggggaagcaagacacgtcttacatggcagcaggcaagagagcttgtgcaggggaactcccctttaaaaaccatcaggtcttgtgagacttattcagtatcatgagaatagcacagggaagccccacccccacaattcaattaccttcccccaggtctcttctagcacacatgggaattatggaagctataattcaagatggagtttggtggggacacagccaaaccatatcaggcatcacacagagcaacccctgggaggcattgatatccccaggcaaggcccacggcaggccttgagagcatggaacagtggtgcttgcatcagtgaatcttactagttgaaataaagaaagccatctttccacccctcacttcatgtaagtctgactccaggtcccatctcattccttggcacaggtggtcttatttaaaggactgtgctctgaccagtgaagtggggccgagggccgagccacacaacccccacattgagactcaaacaccacagggaggaaaaaggaaactatttagaaatcacctcttcaaaagtcctatacatcatttctacaaactcaacaagaaggttataggggtccccgatgtgtgggctttagattatttatttattttggggagcatttgaggatatcacattcgaattctttgacaattggagtacctttaaatctccttatatctctgatgatttaactcagaggccttttctgcggttaaatatcttccagaaaatacccttcatcaattcctgctttatttcccccttgtctccaagtgtttccctggctaagactgcattttcctccttctcttcttcctactcctttattcagggttgggaaaccccataactaagctggctgacacttgcctcagtgtctgactcccacagcgattcagttaaagggcagggaagcagacaatgaaattgggtaaaaaaaaggtacataacactcttttataaatacagaagggggaggatcttttgccagtgctctctgcatttgctatatttttttccccaaactattggtcctaggaccaactttgcatagcaagccctcttttctactctgtgtataactgctgtcttctgtaacccaaagcataattcaccattggaagtctgtgctccaatataaagtaagaagatcactaacagaataatacacagtgagcctgttcacaagctgcagaagaatttcctcaagttgatcatgaataattttctcaaagacacatagtcttcctggaaaggcaaagaatcacgcatctttttgagccagagaaacatttgaaagaagcctgcaacatgtacaattgctcaagaaacacatttccaaccttagctataaactgcacattctataggaacatgggatgtagattttcgtatgaaaagagagtttattataaagaatatgttaagataaagaatctatcacaaataatattttatgtaataaatttatttgtcatatcattactttctagatttagctgtaaagtaagaaaggaggaatttaaaatatcttaaaaattcaggcccatattttttccagcgctatcaatcaattaatttcttatcttagtctaatgacagaaagggcaaattagctctgatcttcttatgttctgaatcctttttggaaatgattgattgctggggttaattttaatttagtattaaaaacttgagaatataccgtatacatattttgaatcttgcttttttcactttacatggcaccgtaatcaggaatactcttcatatcaacatgctttatatagtgtagagtccttcaagacagggtgatggctgctcataattgcattcttcttacctttgatttgcctttgctgtaacaggcctttttggtagcttcatcacactcccattccacagcctgtagaaaacaccaaaacaatagcagtcatggttttgactaaataaaagggaaaatataaacaaggtaacaaggcactggtaaccagattaggaaatatggctgcatcctggcaccaacattttcatactcatagaatttacaccaaatacatgaaatttagtcatgggcttagatttagctctaatattgaagcataaggaccttcccccttactatttgcttttgggtagtaatgatgggatgcttagatctagtcactgttagaaaggaacaatgagttggtgactatagcactgatggtagaaatgatcacttcagtgaaactatggaatagacccagacgaggcttaagggagaggccttgagacaagataatttaaatattaattttaacatttttattttattcaaataatatgtcatttatcaatattcatagataatgaaggatgattttgcatatccttactaccaagatatacctgtaaatgataatcaatcaatagatagctcatgcaaagaacatagctaggatttttccccagtagcagtcattttcatactattattagctctgactaaatgtttagagccacagcttttaaatattttttctcagaatttccaaatctcacttatgctgattaatttgctatgtgtgcttccacgtctgatgctaactcacaaatgaaatgtgtgattagtgaagaaaacagacagggcttgctttacagaaaggatgcctacaggcatccatggcctagctctcgtgaatagttttttgcgcaaattgaggcacctgggctttttttttttctcttttctatcattgtatagagtgtgaacttttatagggtaaaaatatttttttcattctccatacctgttatcagaattattattttctattttactattaaaattggatttctgaaggaacagggatgtgcggtaattcaatcattaacagaaagacattttgagatagagacttttttctgttaatttggactaatgtcaaataataaactaaaccaaaagcaacctagtgtcaaatcatatgaaggaaaataatggcttcacccttattttttagtaagaaatgttttctttctaattatccaaacttgggagaataacaaagtcaggctaacaccattctctaatatcttctgccttccaaagaatgttacataacagagattaaatcatacaacactgcatcttgtataatttatgttacttggcaaatatgagtccataagaaaagtattctagaaagaaccacttcagtgtctttgaaaccaaaacaatgctataactgttttcccttgtgcagacttgaagatttttgtcagtgtcaacatctgataagagaatttgttaattccttctgtgctgtttccctgttcataatgtttgatggtaacaatacagtcatagctaatcagcatctgatgcaaacacatgatttgaattccataccaggatgacaaatattttcatgaaaagcaatgacacctccagagaaaacagcctcccatacagttgcataactatatccccatgaagtacagataaaataaatgaaaataaatgtgttgttgttcatctgatttgacctttagtatattcctttcttagatctctttacaaaatattactcagtttttttgtatttaagtagatatccacgtcttggcctttacttaaacttaaaacagtattgaggattgattaaaacagtattgaggactgaaagaatatgatatattctttcagcagagtaaaactcattataactttgattgtgtattgccagaggtttcagtattacatatcaccaagaggaactggtgttacacaattactaggaaaactatacagtgaaatactttagataaagagtcattcacggtggctttcattggtctagtgattttgttaaaagttaaataataatgttctcttctataaacatgaaagctataaagagaaggattagtcccagggctaaggaagaagaatatttaccaaatgccatcaaaattgttcagatcctgcggctgaaatggcaaacaaacagcttcacaagtctacctaatgcccaaatagcctttgcattttcaagataaatattggccaaagattgaaagggaaaataagagaagaaagaatgtgagagttttaaaaaatatttcattatttttatccagcataccaaaaaatagcaactgctcttacaagtttattagaccaataataaatatgacaaatcttacagattttctgaagatagtgattagaaagaaaaaaaattaatttcctaaggcattttattacagcctcactagcttgcctataatattcaaatccagaattaattaaagaccatgattgtacagcttttctgttcactttctacctgaatagagaacaggataaagggaaattttatattaagaatggaactttacttattccagaagacagcaggaatatatacatattattggatagcacagaatttgaaaaggaatagaatggagaaaagtggcttttccagattatactagaatgggatgctccagattcatcccatagtgtcctcctattcactaggtcagctagactttgcctatttcatcacttgacagacatgaaattaaaaaaaaaaatccatcagagacaaataagagtatcaatgtacctcctctctgtgggttcttatttctcacagtgacgcatttttctgtttgaaattaggctgtttgtttaacctggtcacaacttccttattcttctagatccattctaatgaaccaaatacctcttaatcaagccttctctttcatttctcagtgaaaatttttattatttcatgtatcatgattatagaacaagtctcactactgatttgagaagccacgtgtccacttgtattcaaaagatgtttttccactaacccaaacctatctttacaatagtcaaaacaagtgctaaagcattctacatttcagatctcaacccaacattcatagtctcatttcctgagtctcccttttaaaaatatttaatttttgtcatcttttgtctttttctatttcaggatagcccagtagagaaaagaaatatttctactctaggctattcaatattttgtctgcattatatatttcagcagcagacatatagcagtaatattgtggttacttgaatattcaaagattagatacagtaggcagtgagtttgaaacacctacattttaaaagacacaacgattcctgtttgcagtaagtttttttctgtaaatacatacaaataatacctgtactaaggaacaactcacagaagttttgctttatgcaaatacattaattatctcctttatttaacaaatattcattaagtacctaccaaacagaagacactcttctatgtgactgacagaaggaaaaacagacatagagatacacatcagatattaatttacaatacagcataagtgtattccatcagcctagacagaattatgttaaatctgaggagtcaacagtgttcattttcattgttatagtagccatatgcacgttaatctcaggtccagtgacacactctaacttataatatcattagctttcaggatgtgacaaacatacaaagagagctacaaaaaaaaaaaaaaaaaagaagaggcttatggaaaacccattttatatctgcataaatcctgggtatgcaacaaagcccccattgtttcaaggtacagcatccattggaccgtgttgcacacagacatactacggttaggataaatggagctgtgatctcaagagtaaatcagatagagaaaagaaaaagagattggctctttttatgtatgtgttacatacatataaatccacagttctcagaagtatataaacaaagctgtgtattatcacactccaccgccagataagttaattagatagggaccagcaaaggcagacacttcataaaaatgaagagaacaacattctaggcaaatgggctactactctttcagcagatggctttgctaattagatactggcaaaagataacattaaacaaaactagtttaattacacaacgccaaaaattaacaaccacctgagggctttcttttttcatatgtttacattcatattcttatgtcatgtattctgcgatgcgctgggaaatgttacattgccatggcaattataaacaaatcgtcagggtatgcaagactatatctttgttcaaaactgaaacaaatgcaaatgagttggaactagaaacaactgtgatttgacttgaataaaatgtcaacctataacagtaactttgagagaggacatctttgctaattataataccttcatggtcacacgtgtcagggtcacacaagtgtcacttgagctagaatggcgtgcattgaacgaaaaaaggcagtaaacatttcagtcaatttggaaggatttgttcgatgttcctctgcctttacttcctagtggatattcaatgtgtttgttattttttcacattaattttcagtatactttcatttccgtccatgtcaaatacaagcaagtacaattataacctcaaaatcaaaagactagccaaacatcttatgttctcactggtatgtgggagctaagctatgagtatgcaaaggcaaaagaatgatacactagactttgaggacttatggggaagagtgggagcggggcaaggcataaaagacaaccaacgtggtgcagtgtatactgctcgggcgatgggtgcaccaggatctcacaaatctccactgaagaacttactcatgtaaccacataccttctctaccccaataacatatgggaaaataaatttttttttaaatgatcaatttcaaaatttagaaattaacttaaaaaagactggaatcgcattagagtcatatcatcccactattttttgattctcatacactgccatcatctaaaattagaagaaatatcttaactttagaaatacctatgaaaatgtgttataataatttttaaagcccttatgctaatgcccaagattttctttcacataataacaccacattaaacttacattgataaggaactgcagagtggtgctcccagcctgttgaatgctcactgggcgttctgttctctaattgggagttgacaatgtattcattccctagagctgttgtgagaaactaccacaaaccaggtggctttaaggacagaaatttattcttacagttctggaggctcgttggcagggttgaatccgactgaaaactttgagggacaatctgtctgggcccctctcccagcccctggggtctgccgctgacctgtggtacgacttggcttacagggcatcactggaacctctgcctcactcatcgcatggtgttctccttgtgtttttctttgtccaaatgttcctcttcttataaggacaccggccactggattaaggcccactgtattccagcaatgagctcatcttaactaatgacatctagaaagactcttttttcaaataaggtcatattctgggaatctgcatggacatgagttttggggtgatactctacaacccagtacaaacagcatggcataagagatttggagaaacaattcatagtcacaaattagggtcattgctttgccacaaattagttgccaattctcaagcaaaataatggtaacaatttattaaatgtgtgatgtgctagctacagtgctaaatgctttctatacacttacctcgtttaatgtgagaggtactattataataagattttggatgaggacttagggtaaataacttgccaaaggccacagagtattaagtggcagccccaggattggcactttataacttggatctggagcctgttatctgaactactctcctgctatttaaattgccaaattaagtgccccttcttacctgatttttacagtttctttgttttccaccccgtaatttagaaaaatacatatctgaagcagagaaatttgtgcatgtctaagttcagagctgttggcattcagtaaatattaatcaaaaaagccattgattcccttgtcatagaatgtattcatgtctaaagcctctgggcccattcacagccctagaatcgattttaaaaggaccatgatttgcctaatgaaactctaaagtcaagaaaggtgcagccagggtatgatataagaatcttgggttggttttgtgaaattaaacatcttctgtataagaacacagtttgttcttgacacagcagcaatgtcctgctttcaaaattcagtctgaagacccatcacttctattaagccctaccggggcttcccacacctcctggattaagagccaaagtcatctagaaaattctgccatgtccaggtacttatttcctagtgcccccaccccattcttttacgggtggcatgggtttctcagcatggtctctgaacaaagcagacacattccctatggcctgtggacttactggccccactacctggaatactttcctccagatgcccacctagataatggctgtgcctcctacatacctttgttcaagtgtgagctcctcgctggaccctatgtagccatatatgtatatgtgaaactgccatttgcttcctcctttctcactagaaagcaaactgcacttgggcaggcagcttggctgcttggtacacgtctgtatctgcagcacctaggacagtgccacatacacaagcactcaatatctagctgttaaacaaattaacggatgtgttaatagaatgccctgcacccatgcccttggaagtcgctcaggtgtccttctagagaccccttgtagaatgggcacatgaggcttggcagcccttgagctggttgggtgagcctaccacgtgttgcacctctgtggcaaaaacatcccacaagaatttctcttccacacttcaatttgccctgacactgggaagaagaatatgaatgcatccgctctgggaagacagaaagggaaggatcagaacaaagattttactactttttcagcagtagacaacgtttttttaagtaacatcttcagcctaatctcaaacaaaaggagataaaagtggtatagtattccccttctctgcagttttacttcttgataccgcagtcaactgaagttcaaaaatatgaaatggaacattccagaaacaaacaattcctaagttttaaattgtggacaattctgagtagcatggtgaaatctcaagccaccctgctccatcctgcctgcggaaataaaggatccctttgtctggagtattcacatgtctatgttccctgcctattagtcacttaggagccctctcagttatcagatcaaaaaaacatagcacacacagtgttcagtactatcagaaggttcaggcattccctgggggtcttggaacctatcccccgtagataagagagggactaccatattatgtcaaagtcatgctttaagtgcaaaattatactaagtcattagaaaaatgtgagaccaagtgactgctgagtcataacaccctcggtatccaagcatttctgtattttgttttggttgcctgcttttgaaaaaaacacaaatttataaaaattaatagttataaataagaccactttgaatctcagtaaattggcagtacaaattgaaatgacagcggacaccttattccgtactctataataaaccagggaggccaagtaatgtcacagtaaaagttaatttactgagtgaaggattctaaagtcttaaaattctgtacatggtatacatttttggtataagtgtttcttaaataatgggattaaagcaatataatatctcaaatctcagaagcacctctagaatctgagggttctgagtaacacagttggcaagtcactattttaaggaaccaaatttatctgataagaaattttggggctggacctggggtcagacagagaaaaacaaagtgatggaagatgagttccaatgaccctactcctgaacacgaatgaaccctgctgggatgatcttttgaaagaagaacattagagagagagaagaaaaacagtatcaaggacattataatatctggtataaaatttaaaaccatgattgtcagaccttgaagcatcaaacgactggtgcacttcaaaaatatttctaaggtaaggctcataagagccttacttcttggttgcagggttttacagaaattattttcatgaatgcaagtaggattggtttaaaaaatggtgcatcgtcaaatttgcaagactaaatgtagcgaaaaaaatcaaatcactggagggatggctatttttatacatgaatttcctaaaagtattagtataaggaacccaattcaaagtcaatcaagcagggataaaagtattgacatcggagtggattgaattcccaaggactggcttgcctagtttaatatttcccaaatgcatttggtggaaaattgattgcatctaatgttatattttctctcttttacaacatacaattatatcttacatcacatggatgatgccatccaagtaccacaatatctgtatactgttcaacagaaatgtttgctagcaattagatatatcacaagcaaattagaattagatgttttatctgatgtaacatttattctgcatatgtagagatattccaaaaggaataagttgattatagaaagttatgaaaaatgtcacaccaaccgagcttagtaagactatctgaagattgtatgggacaccaatatgaattcacaagataaaattttaaacaatatgagaagcagcatgttagcatgggattctctgtaaaaccttgaccaacactaggaaaacacaacttgatataatgaagcctgccttgaaaatacttttacaaggctaagtttgtggtgtggctttgaccaaatctttctttcacacgccagttaactactgacaataatattctagcactattggtaaaagtgaagattaaccatcctgtccctaaaacaaaaagaaatttcacagttatatgccaaggtttcatctgggaatatagttaaagggttcaaaagggactgcatgtagcaagtaagaagaagtaccaatctttttattttgaggcaacatgaaacagatgtagaaaacgacgccagcaaccacagcatgaatgcaaatgaaggtgcagaaaccacgcaactctttgttgtttggcttagaattttattttactgatgtgaatgaaatatttttatattttcaagaggaatatcccatttgtgattttgtgtgttagatttctcttgcttaaaatgtaaagccacctatattggcatcattggtttgagtcctattattgtgtattctggccaaatcttaatgaagacattctgtatgaactgtcagcctaatagccaatattgatgtaaatatatggatgtttgctttcagtttctccataaatcttttctatttttctagtcttctgaaactggcttcatgaaaacaaacaacacttcatacctgattactttctctagagttctgggttaatatctatgcactagactcactggagcacttacaaaacccagattatgaatgtttcctggggaattgttttatactcatggaacaactcagaatttattcattattcaagttaaaaatgcttgcttcctgagatatatcctatcaaagtcaacaaagattgactttacttccagcttgagaacatattgatctattttccagatctcaagatatatgcaaaaccctccttatgaaccttattcagcattatttccataagcttttgttttcagctacaaaaaaatgaacacgaaaatttgttttctagtgtaagtttggtagtcattgtttactctcattttaaataaaatgtgtaacaggataatatactctgttcaagaaacacattatttactatattatcacaatggtaaatgagcacttagtgaacatgactgatacattcatgtcctagttaatattgaacactctcataacttaatgaatatctgcttaaacgtattaaatcaaataaataatttagcattaaacagcaattgtgtggttttgccatttatttctccaaacatttttctctcttctataatttgttcatttacatgccagagatgtcctaaaatattgtcattactattattaagatgtttgataagagctccatctaagaaaaaagtccaaaagcatttcaagtgtgagaataagagttggtgaatttttaatgtctgtaacatctgggatatgttgatggaaaattgatgccttttgttataattttacaacaaaatgaagagaacatgaggcactccttcccttccatctatttaaatcattccttttgttatgtgattagccagggttggcaactaattgccaaatgttacaacttcactcaatttcctactaaaggaatttgattttgaaataaattaattgcctacaccaattagggccttgaaacacaactttgtgtatatctgagggtggagcattggagtaggatgaacactggtcccttaaaagatatccatcatcatctctgcaacctgtgaagttaactcatacggcaaaaaaaaaaaagaaaaaagaaaaggactgaagataattaaattaaggatcttgagatggagacattaatctattattcagggagcatctcaacatcactgaaaacattctcatatgaagcaggcagaggaagatgcggagcatacagaggagaaggaaatatgaccgtggaggcagagatagtgatgaaggagcctcaagtcaaggaggccggcagccacccgaagccaaaagagaaaaagaacaaattatttcccccaaacttctggagaaagtgtggcccgggggacccctttattttagtcgcataagaattaatttggactcctagcctccagaactgtgagagaaaaaatttctgttgctctaacccaccaagttcatgataatttgtcacagcagccatacaaaactaatacatacatacatacacatgaattacacacatgaacacagtcacactcaagcgagtttaggagcatggggtggacatgttagtatctgtgtgtccatctaccaaacatctgggccaggcccattgtacgaaattggaacatgtcatcccaaaatatgcctttgtcatgggattattttgagctgattattttgagaaagcctagacacaggagaagctctgaaaacagagtagaaattgtgtttgtgtaaggtaagcttacatctataaaggaaatctctatttgtaagggtgtctcccctactgtaccaggaagagaaatatgatcctggtcaggagataagtcaatggagaagccactgacttaaatgtgcacaacaaaccttactccggctaaccatgccatttctggtcacgttgccattacttacctctcccacacacttctttctttaatctagctgaagatggtatttaagcttgaattctaagatatctctttgagagtgactcatttccctgggtatctcccgtgtgtgtaagacataaacatatttttataacttgtttttctattgttaatatgtcttttgttacaagggcccagctgagaatttagaagagtagagggaaaattatttcttcctgccctacaatatatatgaaagatgtagttgttgatataaaagacctcttaaggaaaacatgctgtgatcttgggcgtcttgaaggggaacactcaacccagatgtagggatctggagatggatgaaggaacatttcttagggaggtcaaggcttgagctggatcttgaagcaattgaccagtgagtgaataagtggaagagtagatgttcaagaaaagcaaatgaataagctggtgcaaaggcctgaaatgggaagaaaggacatctaagctggagaactggaccccagggtggggattggagaggtctctggctacacgctgatatgcagctcaggacaggcctcctgaaccatgctaaaagaagttagttcagatttatttttcatgagttgaagaaaagccatgaataaaattttaagcaagatattggcatggtgagagacaagtagttgagaaagacttctctgtgggtataagacctggaaagcagtgtggctgtagtggtgaatacaaggagagtgatgtagaggtcattgcaggcaaccagcaggtaggcattgggaacctgaaattagcagggacaatagggatagaagaagggatgggtaaccagcaatttagtagtgggaagggcactgtcttttgatcatgtagatgtgtgggtggacagcagtagcacaagtctgcctaatctacagtatgaaactaattcccacccattccttaagctgggtttggactgaatgccacacacaattctgaactgctttctttccacccccataagtaactttaaccttagacaaataaaactacctatacgatcctgtttaaagaaaacacaataagacagtaaatcttccaaaatagcaaagtagttcaagaaaaaagaccgaattcatacaatgttttgatcatcacacttttaaatcaaacacactttagttcattggtaatacattctggatttttaaaacaaatggaaaaccaaccaaagaaaatcttatgaatcacatgaaagttacctttaaaactgtaggaattcaaagtaattcagtacaagaacttctttttcaaagtaatacaataatgatttatttgtttggaattctgtgtcctaagtcaagcaaataagatataaaaaattacacaaacataaatttcaaaatgagagaaaacttacaactcttgacttccaagacatttagcaaagctaaagaagttggaatttaaaagtggaaaaacataagaaaaatagactaacaaattaagattttcatatctattagtattacatttttcttagattttcacatgctatggttttaatgctccaccaaaatttatgttgaaatttaattgctgttgtaagtattaagaggtaagacctttaggggacaactaggtcttgagagctctgtcctactaaatgggactaatgccattgtctcaggagtgggttagttataactggagtgggtttctgagaaaaggataaatttgggctagtgttctccctctgtctcatgagctttcttcatatgatgccttccatactaggatgactctagtcagaagctggcaccaaactcttggacctcacagcctccagaaccatgagtcaaataacctaatattttatataaattacccagcctatggtaatctaacagcagaaaaagtgctagacatcacatctgagaaaaattctgaaaagagccatgctattaaatgctgatattaattgtctccaacctagaagagggagggcatttcttccttaatcagccaactttagaattcacactaaagtttcagctgtactgtgtctcaattataattcacaatatcaacagcaaaaattcaatgctattttctaaaaatactttaggtatgactctgatttctcaagttttgactatgactatgagtcatgactaccaacatttagatcagcactatgagattaaccagaaccaatatgtaaatgtatacggcagaaagccatcaatcaatctggagtggacacaatgtttccaagtgtaactataatagaggagcaaagcaaaaacagaatcctggaatcagacaatgtgtgacagtacaacagcctaaaagagctgccggcaagacatattgggaaagttagtccaaaggagcacatccatgctcaagagataagaatgaatcaactcctgatggggaagatggctggtactcttctgcccatcataactaactctaccctcccaacaatctagggtataggtaccagtattacattcatcttacacagtaggtagaaaggagcttaacaacttgccaaagattactgagcttttaaatggatggcctgggattatgaagtcaggccaccctggctggctccagggtccacaatcttaacccacgtgcgatggactctttcagtgaatgagttggcaggatctcccagattcctaattccttcctgtctcaccagagttctattgacagattgagtttgtttgctttgaacttgtcagacaaaataaaatgtggtgcttttgaaaggcccttggtgggaaagcggggaatgaaatggtttggctggagagagaacactactccacatcttcactactgagatttcaacccagttgttatgatttcagtgctgatttcacaaagtcatcgattcgaaagcttcccccattcccaccctgtaatctgaactctgaaagtacatggaaaacacaaaagtaaacttaattgtgaatagtcttattattctgcaattttgtgtaattatccaaacccacttgaaataataacagaggtcaagacaaagaacatgcacggataaacatggatattgttccataacctgacacattatatgtgggttaagatctttacactatacaaagaaaattcaaactgggttatatttcctaagcgagtttatacgttgaattaggagaatacagcaaaaactatcccatggagacattatgcaaactggtaagcatggaggtcatcaagccttatgtactggagatggtaggacagatccatccattattcaagcacagccaagaaagtgcacttgaagttccaatctaagattctaagattccatattcttcctttatggtaaaagatgggttccaagtttcccatatggaatataatggccaagccctttcttatacagctcagagcagggacaccctggggaggtgtgaagaaccgtggaagagatgaagatgagggcctagtgcactcttgggctctcacccttttgcatgggctagctccctgctttctgacctgctccctaccagaacacagctcttcctcatccccagcctcactatccccctactctcctctaattggagtatccacctcattagagtctccttaaatggtctcagggctgacaataacacaacaatttatggaagagctaaacattcctccctatgctatcacacaggcaatgggtaagtactgcattttaaatttagtgctttctaggacaatcataccccaaaagagctctaatatgtctgaaacaagtaatgctaacagagttgtctgcctcatttcctaatgcttcaagctcttattaggctgaataattaagaaaactattttttcttctttgtttttccaagtatgataactttcttccatacatgtctatataagcttttactcaaggacagctgatttaatgggttgtgatgacggataattaagtctcttaattattctcttaggattattgtagctgtgaaaatcaagccacatacacatacattcaaacagcaattaaaaatattgaattgctttttaatttagaaattatttctggttttggaagctatctctggccccaatatgctcatcattatatttgcatattcaaagactttatcagtcttcataaccattttgattggtctacctcctatggtgttttgacaaatattattataatctgttagatttatgttcctactaatacactatccaggtgatttaacaaacatatagtgtttcgttatccaattttaatagaacctataaaaatacaaatgtaactagtccaaatgtggtacaaaatctcatcctttcaagaaacctgaatctggttattaccaaaataattccttcctgtgccatctacaccagcctctactttccctttaaataatgatgagcctcaagagaaagaaactcaacattaggaaggagcttctatattgcctttacatgaataacaaacaaaactattatagcatgatcatcctaagataaaacagttaactttgctcctccatgcctaacatcattaaggacattccttgaggttcagtaatgtttaatatcaatagattcacaacatacaaaatagaaatagaaacattatcaactatataaaatcacttgattggttctctaccaagaaaatgccacaaaacaggaagtgttaactctccagtaatattcctacatagtcagtggaacttgtaaatgtattcaactaatatttactgagcacctattatgtaacagaatttgggatataatatgagcttttctaaagcctgctgtattttagaaattcccagcctagtaaaggcaagagaaaaaaagtaattgtaatacaagttgagaagtaaaggtatatactgtaagaacacagagagaaaaacacgtttgtagagaagatggaggattacacagcgatgcccagcccagcagccacctgagcaggaatgaagggaagatagaagttcttgagagataagagagacgtatgcttgctgaaaacaggtaccaggatgtgcaaagtctgtgagaagtggaaaaacatctcacattcatgaaactgcaagaaatgtgtatggctgaatgccacaaggaatgttgaggaataagcagatcttgaagctggaaaaacaggaaaggtcagaccatggtgtttcatacaggatattgtttgaaaataggattttttttttaaatttaagagttttaagcagtaaggtaatgccatagtttacatatattaagccatgaaccacagtaggaggcaggaggaatggaggacacagagcattataaacaactgcccaaggccagaaagcaagtaaaggagctaagattcaaatgtgatcagatgcgcagtttagaaggatgacttgaggaaaaagggatagaatgtatgtgaggatagaatacaattaataaaagattagctagtttaagcccgtggtgataaggcaacgaggctgaattcaataagcttgaataaggctgaatgcactgtaagctgtagactagacagaacagtataagtacacatttagggaccatcaatgagaacggggaaccagcaaaggcatccattgctctggacaaaaggttatgaatctgatctctgaggtcagtttaaagagctccatccaaatgatgatagtatgaaaaactattctactgttcaggaaagaagttagtttggaggtaaagacaaaacattccttatcttgatttttgtatgtctttgcttgggaacaaaggagatacagtgatgtaagtgtggctcagatgttttgtttattttgactttgcttcttttgaggggaaaggaatggaacaagaagtcacctacaattgctcacacaatcatccatctgcatttgtcatagctggtcaacatgcagggtccacaccaaggtgctgaccacattatgggtatgattaaggatgaggaccctcatgtgaaatagctttgttgagcgtgagaaacaatgtgccctaacacaaagacatacggcttgatcaccatgaagtggggatcacaacaattcactacagctctttttcctaaagaacagaacaaagtatccattatagcatttgacaatctaagcattccttctgggaccaccttctgcccatggctcatcctgtccaggttttcttcctcatcactagctgctccttctcagtctcctttagcagactaagctgtgtttcctccaatggtggcatggccctggcatctgcttcggatccttcactttccactcttccttcctccttgggtaatattaccttgttttatgacagcaaacaccatcagtacaacacacctgcattcctgtccattactggaaagtattaattcttccacctctctcctgggtatattccttggcatatccaaaagcatctcaaacgtaatacatgtaaatcaccagccatgatttccctctctgcctcccaacttgcttctcccctagtgttgcccatacactacccacttagttgctctggtcaaaggtatacaagtcatccttgagtcttcttgtttcctcactgccaacatccaatccaccaacaaatcatgttgactggaactaacaaacaaaactttccaaatgcgtccatttctctaccagtaactcttgcctaaattctaatgcaatttcctaatggatgtccttcctataactttgtcccattataaccctttcctctatgactcacccaaaagtatctttttaataagaaaaatagatgatgtttaataccttcgagtggcttgccatttaggtacctaaaacacaattcaaagtcttgggcctggttcacaaagcttgaggtgtttctgcctccaattctctgaccccgtgtgtcaccattcctctactccttgagccctgtgatccagcaactctaaacctctgtaggttcctttagccttatccactgttccctcttccaaacctttgtattcactgagctctctttcccaaaggtgctttccctcacctgtgcctgactcctcaatattcagatattgactcaactgccactctataagagtagaccattctttgccaccctatctacaagaacttcataaatactttctatcacatcactgcatttgaattcttggcagcacacttaccagtttctaacacttttcctaactattaattgattaaatatctcctccaactataataacactgtaagagaagtccttcccttggttcaacactttatttcctgtacttggaagtctgactgccccataagagaccctgattaaatatgtgctgaaggaaggaataatctaggagtttgaaatgagtttacttttgcaaacttctgtctgaaggtaggaatttcaaggcgagagcctcatcacatttgtcatcaggtgaacctggttttaagagtataagttcaagattagcatgaagagtgaaaaaatcagtttgcatttagttttcaaattcatcttgcatatctatgtgatgtgaataataatctctgaccttcttggttcataaaattgttgtgagatttaatgagatagttacagaggcactgtataaactctcaggcaaagtaatttagtagaaatagttgggtctgtagtcttctgtctgcatcaccaactggagagcttattcatggcatggaggaatttgctggtacattgagtgagtgtggcttaactggggcggtgggagttgccacctggcccttgaagagttttgcatctggcaataatccagagaatgactccactgagaggtaataaacacagagaaaactctttacctatcatctctatgaccttctcacagcgtcttgtattggagacatttcaattgttccttggatggaaagtagctcaccttttactgtcagcaggacacatggtacatgtgccattacgttgggaaatggctgcacaactattctaagtggaaaagtaaagctctacacatctgtatactacccacatagatcttttttttttccattctacattaaatgtcactgaaagtagatcaaatgaagtgcaagctcccatgtcatcctggaaaatgtccatgaaaacagtcagcattaacacaaaatgtgtggtttatactagggactgagattctattttgctctaaaaaaaaaagactataatttctcctgacagatgaggtcagtgaataatgtttaaaatagatgacgtccccttacttcttacccttccccttggtcataaggcaccactagtggttcagaacccccagcattacaaccaccattacatgcatcaaggtggtggtcagggcttgcagatgttttattacaactctaccaaggggcatccatgggagggttcagcaaagcccaggaacagggtacacaggggtgtgcagggcaagtcagcccctagacagctctgtacccagtaactgaggcctcagaaggcagagagaagccaagtaaagggcaaggagggtgttagggtgttttgtttccttccttcgaggctatagatgataccactacaccctacaactagctgccagcacctagtgcaaacatgctgagattttgacctgctgaatacacatttggactgaatactgaaaagtcgctgagaagaaacacaagggggaagaactgtcaaatggcatggcatattactaacataaaaaaagaagcattcctgttgatttgaaaagaatatcaagagaagctagaagccttaccatcgccccttcaaataggttatcaaatgctagcttcagtcctaactctatattttcatgtaagttcttaaattaagaggctcagggaaccaaaattttactatgcaatgaacatcttggccattgggttacaaatgaattgatcaaacttactttgtcttgggattggatttaggttacctattgaagactggtagccaaccaggcgtgctgtctttcagtgaggtggcaagagaccacaggcctatctcattctgtcttctccactcgcaggctcaaatgccaaggcctcaatgcactggctctctctctctccttaagtgtacaagacaatggaagaagtcttgccctaatcacccttaggttatccaggggaacaaagagctgggctgaatcctggtgatgagatttactcaagtctttttatttccctatccctcatttttcctcattgcttgctggatataataaaaatagcaacctcaaagggtcttggtgagtattaaggagtgcttacaaatagcatttaatccagtgtctgcacatagtaagcctgtgatattgttaactacataattacttccactattatttgtcttttcttctttctttctttttttttttttttttttttttttccctgagatggagttttgctctatagcccaggctggagtgcaatgtcatgatctctgctcactggaacctctgcctcctgggttcaagcgttcaagcaattctcgtgcctcagcctcccaagtacctgcaaccacaggggcctgccaccatacctggctaattttgtatttttggtagaggtggggtttcaccatgttggcgaggttagtctggaactcctgacctcgggtgatctgcctgccttggcctcccaaagtgctgggattacaggcatgagccaccaggcccggccccattattttttacaaaaagcctttttaatcccattctaattcttttgctatctgcctttcacttggaaatacagctacaatggaagagagaaatgcaaactgcttctgggcaaaatttgcttttaatattctcaaaaggtttgtagtaccaaatttttccccacatgttcacttgaaattattcttcactttgggggagatttaaaaataaaattttagtttccatgtagttgagtggctttgagtgagattcttaatcctgagttctagtttgattgcactgtggtctgagagatagtttgttataatttctgttcttttacatttgctgaggagagctttacttccaactatgtggtcaatcttggaataggtgtggtgtggtgctgaaaaaaatgtatattctgttgatttggggtggagagttctgtagatgtctattaggtctgcttggtgcagagctgagttcaattcctgggtatccttgttgactttctgtctccctgctcctgaatgactactgggtacataacgaaatgaaggcagaaataaagatgttctttgaaaccaatgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccactgatcccacagaaatacaaactaccatcagagaatactacaaacacctctacgcaaataaactagaaaatctagaagaaatggatacattcctcgacatatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcgtcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattggtgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggcattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggaactcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctgcaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactcaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacatttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaactcttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaagccaaatgtccaacaatgatagactggattaagaaaatgtggcacatatacaccatggaatactatgcagccataaaaaatgatgagttcatgtcctttgtagggacatggatgaaactggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagattataataaaaaaaaaaaattaaaaaaaaaaagaaaatatatttcttataaaataaaatattttcgaaaaaataaaaataaaaataaaattttaaataaatgcctaaggaattccaaatgatttggcaagctaaatccattctgtcaatagaaaaaaaaaaaaagatacagatgtctctgccaacaaaaaatcggttcagaatattaggttgtttattgcaatatttgtatttgaagaaacccacaatggttctgtgcattaagaatttttgagaatttgttatcattgaaagaaagaaaaattcccattccccattcttttttactccgtcctccaggtcatctaagtcaggggtccccaacacccaagccacggactggtcctggtccatggcctgttaggaaccaggccgcacagcatgaggtgagcagcagacaagtgagcgttactgcctgagttcctctgcctgtcagatcagcagtggcattagattctcttaggagcatgagccctattgtgaactgcgcactgcagtgagggatctaggttatctactctttatgggactctagtgcctgataatctgaggtggaacagtttcatcccaaaatcaacacccaccctttccccactgccccaatgctcgtggaaaaattgtcttccacgaaactggtctctggtgtcaagaagactggggaccactgatctaagtcgttagaactcttgtattctaccattcaacctttacctatgacatgaatttaggttcttgcaaaagaaagagaacataggttttcatgcctgtgattaaatgcctatgatctgtactttgccatgtgattccatggtgggaggcaagttatcctcatcgatcacatttagagtttaaccacatgagctactctaaagaagatgttctcatggctgagttttccctgtgtctcttgggtatttctcaatgtgcactgcatttagaaataaatctcaaagtgctctgatgacgtatcttttctcaaacacacattcccctcatctctccccatctcccctgcagaaattgataagaagtgaatttctctagaaaatctagttttgttgttgccattaaactaattttaggattggaaactcacatatatggtcactatgtgcctaccttctttttaggaaacatgagtctgtgatgaaagatataagtgaatccaaattcaagtttaattttggaaaccatatggtaagataagaagagaataaaacatagccttcaaatagatcacattagttttcatttagacctattatttactatttaagaacattttacatttgccaaatacatttctataagccaagaagaaccaaatttttagagctagaataaagacagaaaaaagcaggagcccagaaggaggaaaagaaaggaaaaagaaggccaggaaggtgagggaaagtgggaatagtcaaaggaaagaggatggcaaggacaaagaggaagtgaaaaaaacattaaaccatctaggctccaagtaaataacgcattttatttcaatatgtcaaagcaaatcctagaataacgtaccaggcacttgaaattaaaatacagccatatgctccgggaatgattttacaaagaaatgaaggcagaactgatgtcagctgaaccacttgagaagaaaatgccctacagttctcagcttcggggttccaggttgctgggggtgtggcattctcatagtgacacctcccaccctgaggtcatagtgacacctcccaccctgaggtcaccagcgggttaatgttcagtttgcccttggtagatcctggcaaccaggaatggcaacataaaaaaggaagcacatctctgttttataattttatgtatcatatttgaggacaaaaatatatctttccaagtaaaatgaatctagttcttaagtaacaacaacattcatcactctcaaaagtgtgaggggctggctgacttcggggtgggaagaaacatggggcgagggtgcagtggggaagaatcaagtttctttacctactaagtacattatcccttgtttcaaaccccaaagacgtgaacagagattgactttgatctgaaattccttctaatcttactttgggagccttcattataatgcacatgcatttaggaataaaagttagggaaaattcttactatgtggattgaatgactgaaactgtgagtgaatggtctgttgtggatgaaataaggacattccccatagccccaaaccaccgcgagacattttggtgtgagagtaaaattcagctccacggtcgtgtgctagctcagcatctgggaggaaccaggagggtctccaacggcctaattacatattcccctcctgaggctcctcttgtggatgaggtgctctagacaaataacctccttattagaaggacaggcccagttcctgcctatccatgaggtgtgggcttcagctccctaccagaccatataatttatctaacaagtcaatcccatccttctatggaaaccacaggcatcctaccttccttccactgtaaggcctgcctcccacagccctgtgatgttcaactcttctgccgcgggactcccatgtggctttgtgtggtgtgtgcggtcctcctgctccaggctgtgagtatatgtgactcataaactgctgctgatctcatctgtccagtgcctggcgtcccatgttcagctatccccataactctagggcaagggatccctccctcacgaataagacaaacaaaaggaaattaaaacaagcaacttctgaggtctgctaaaccaagttcaagtgagctgtccacttagcgtctgtttaggccactgcaaggctgctttctccctaccctgcaagtctgggttccagacacaggattcagcaagccctggctggctctccagcaggcgctcttgagaatgttaagggctcagcaggcacaccgtgttttcatgttcagggcctggcatctgaaaaatgctaggcggagaagggcagtgttttgcggaggaagaccaaagagtaattgctacatttcaacattccttgccccacggctgccctgcttccaaatctctcccacattttctcccacttaccgcgaaaaaatccatttatctcacatttcccaatctgtttgtgaacaaaaggcatccgtcctcaatgccgcactgtatgagctccaaatactgctggtgctacgtctgccttgagggcattttaggagagcagggaatggttcgagtctctgaatacaggttgatgtttccaaaggagagaacagtctatccatggttctgtgttttagtttgatatatcagataacacaagatgccagagttatccagggcacattttaaagcacaagtgagcttctgtgctaagtatcttataaatagagtcttctggcaaacttctgcttttaaatactattattaatgagaatgaatggaaataaatgatctggagggtttcctgttattcgtgacaatctttagagggccatggctccttaaatgacgagatactacacattttaaaagtctctatcaatctaatgataaaatgctaagttgaatacaccattattatttaatgtaatttcaggctaaattagaaacttttatctggtcccgtaagatagtgttagaaaacaatattttatcttctaagcaacttcttctcaccctcatgagaaagaatgtaggaagattatagcaatgaaataattataactattctcttttgatgggacaaagtaagcatgattaacttatttatcctacagtaataaaggtaacttgtccagctcagaaagcccatgaaactctagccaacttgtggccagaccctgtgtaactcactactgaaccccaagttcagactgctgaataaatcaatacaaactcaactttaccaaagcagtatcaatatggaaagttcagcaagctctggatattggaagagtaaatatgaacacctaatacaaaatacctaactaggtacaaaatgaaggagagagattttaagtatgcacctaatttaattctcagaagactcccttaaaatcccattgtacagattagaagcctgagattcagtgaagacgtgatataccttacagagctctgcccagctagaaagtagcagaatcaaggtggatttctaggttgctggctcaaaaccttcgaacagctctctgagtccacattgcaaacagcaggatgaggctcttacctgatgttcacattcagaaaagattagattcttatttaatatatgagccaggaagaatttcagctgagaagcccgccacactttgcaggcttctgggtttggaaaaactcacaacataaaatctcatctgaatctcctgtactttgcctctatatcgcgctatcaagctgttgcccgatccacttgaaaactctgctgagctgaaaccatcaattccttgtgacagttcattgaatctttggtccactttactttaggaagttcttccttaaactgagtgacatcaatcaccccataccttgtactctttagttctgggtctatgccttaatgacacagagataaattcttaactggtttccacattattgtgcttttcttatttacagaccctgaaatcttcctcctgggtcttctagaccagtgtttctgaaagagagtattccttctctcatttctcagataaaaggcatctgattcctctgactgccctggtctctttcttcactcttctttctgattagctagacctcaaaagtatagaattcaactaaaatagttaaagataaaaagacacatctgagatcgacttcagaatcatctctggccggggtgggcatgggcgaagtggataaggaaagagatgagaaaagatttacagaacacgtggataactttttaaattggcagctgggtacaaagggttttattatactattctctttacctttgtctatgattgaaatttttcatgataaaaagcttttttcaaaagtgtagcatgcaaaaacatgcatatgacaggatctgttagaggaagctaagttatcacatcctgtatcataataatataaattgagtaataaaaatatgattaaaaatttgagccatgtaaatatgctaatttgtgccttctgaaacacctatagtattggttatacctatagtagttggttcttgttgttcttgtaggtagtgcatttagcacaattgtagggcttcttatttgcccttgaaaattttttattggtagatttcatctgttaagaatctatggaccctaaagctgtcaatcagctgattcacttgggatgatcctcaaatatttttaacacatcgataaaaatacagagacaggctgagtttagaaacctagagaatcaacttccaagacattttctgtgtgtggaagatgtgcacagctagcagttcagtctggaaggatgactgaacaaacagtgataagaccacccattcactgaggaaaacacagaaaacggcgtcatgagactcccagggaaggaaatgtaaagcttactttttatccttttttggcaacacagttcagaatttttcagtaaatagtaatgtgatagcactgatctggaatttgaataaagctaaattatgatggaactaaaaatgccatcttaataaatactactgcccccaggccataagagttgatacagaggtaggaaatattgaatccataagtgagcaaaagataattagatgttaataaagaatttattttccccgcactgtggcaaatttcatttacatcacacttcataaataatcaccttcaacacttcaacagattgctgtaatttatcataaatttttaaaatgctaccttgtatatatataattaatcagcaccaactgcttgaatttgtaattgcttaataatttggggataaattattatctgtgttttaaacatactaatttatttttaaagtaagtatatttctatttgttttagaaatgatgacaatttccagatcaagagctaggaaggcatacaacatttacatcgtacaattaccttctggatgctaaggacaaaacacatttttgtttctccaggttgcaagatctataggctgatagaaatgcatccctctgcaacaacacacagcacatgtggtgggggaatgaactgagagaaaatccgcgggatggagactgggagcctcatgcctctaatttgtcatcacgctgaatcatccaacatcctcacctacaacaaattactgagactagcaccctgcttactcccttccccagctctgtgagagacaccttggcgccagatggcaggcaggagatggccaggcagataatacaggatctcctgtaggcatggaagcagtagaaatagatattaataataatcacctattgtgttggagctgtgacttgtatctgactcagtagaaagacaatggagatggctatggaattcctaaaaagtacaagaacagtatttgtgttctggcttggttttgattagctatgcaaccttgagcaaatggcctcacctgtctaagttagcgtactcacttgaaaatatggggagaaaataataaatgccctaattaccaaaaaatggtgaggtagagcttgaaggagataatgttcatgaaaatattcttgttaacactaaaatagaatagaaacattgtaattacaactgctgttgtaagagtagcaaaagagacataaaatataaaatgtaagattatacatggtggtgaccttaaggcttctataaatttttataaaatatctatttatattctctatgtctatatacatagtatgaaatgtaataaatctgcatatgcaaaacataagaattagttctaacactcacttctgagttaggaagccagtgttattaaattccgtatgacaatgaactccatccagtcccctttttacagctgcacagagaagacttagtagagtaggcctgagactgtcatcctagaagggcctgcttgcaaaattggccccttagctggtttctgggagctcagatatcaggagggtttccacaattccctgttaaaaacggctcactgtgcctcaattattaatacatgcaaggtggtttacgcaagcatctgctttccttccaggagtctgcaattttaatacattccaggcagagaggtcctgtgtgatctgcccgcaggagaaacccagggcattgagcctctctggtagacaacactctcctcgtgttgtcacaatttgctgatggaaggattaagtgcatccagtgtgattccactggaagaagactcttggaagatcacaccttgttttcttcatgatctatccatgcacctcttgtctttgctaatttttttttccttcactgtaataaatcacagccatgcatgactacatattgagtccttgagtcccggagaattattgaacctggggtgatctacgagaacctcaattcaatagcattacaaatctatatggaaatgacaattttcagagatagatgacccaaaacttgagcaagtcccataggaaacaataacaactctttctagattctggccagaaaaggaagtatgaaaggtactgagagcgggggaaagtcgagtctggttggaaacacagcattcactttgggagcacattctcaggttgcctgagaactgactagagatgcttccaatatacctagaaagcagcagcccagatttggcatactctgatgttggggcagcgggtgggggcagggggaggagggtttccccaggacaaggttaaggagctttgctttacctggaacttctggtcaaaaaagaaaaaaaaatagattaaatataagccataatgttattgagatctaagaggcagacttctccaatgtacatcagagtagcaaactacagcctgtgggtcaaatccagcccattgcctattttctgatcacttgcttgctaaaaataggttttatattttcacatattgaagaaagaatttgtgaatgtttgctttctcctttttaacataaggaacttgatacggttttgttctctgtccccacccaaatctcacgttaaattgtaacctccacatatcggggaggggcctggtgggaggtctttggatcatagtgacagatttcccccatgctgttctcctgatagtgactgaattctcatgagatctgatggtttaaaagcatgtggcactcccccgtttacttgctctctcttctgctcctccatggtaaaacgtgcttgcttaccctttgccttccaccataattgtaagtttcctgaggcctccaggccatgcttcctgttaagcctgtgaaactgtgagtccattaaatctcttttcttcataaattacccattctcaggtagttctttatagcactatgagaatgaactaataaagaaaattggtaacaggagtgaggtacggctataaacataactgaaaatgtgaaagcgactttggaactgagtaacagttaggggctagaacagtttggagggcacagaagaagataggaaaatgtggaaaaatttagaacttgctagagacttactgaatggtttttgaccaaaaggctgatagtaataaaaacaaagaaggggactgctggcaagatggcagaataggaactgcagctcccagcaagatcaatgcagaaggtgggtgatttctgctttcccaactgaggtacctagtgcatctcattgggacttgttggacagtgggtgcaacccaaggagggcaagccaaagcagggtggggcatcacttcacccgggaagcacaatgggtcagggaactccctctagccaagggaagccattagggattgtaccatgcactccggcccagatactgcacttttctcacgctcttcacaacccacagaccaggagattccctccagtgcccacactaccaggaccctggggttccagcacaaaactgggcggctgtttgagcagataccaagctagccacaggagttgttttttcataccccagtggcacctggagcaccagcgagacagaatcattcactcccctggaaagggggctgaagcctgggagccaagtggtctggcttggcaggtttcaaccccacagagctcagcaacctaagatctactggctggaaattttcactgctagcacagctgtctgagctagatgtgggacgctggagcttggtgggggtgtaggggagtgtctgccattgcttaggcttgagtaggtggttttaccctcacagtgtaaacaaagccactgggaagttcgaactgagtggagcccaccaccgcagctcagcaaggccactgaagccagaccatctctcctctctgggcagggcatctctgaaaaacatgcagcagccccagtcagggacttatagataaaacccccacctccctgggacagagcacctgggggaaggggaggtttttggcagagcttcagcaggctgaaacatccctgcctgatggctctgaagagaacagagatctcccagcacagcatttgagctctgataagggacagactgcctccttaagtgggtccctgatcccggtgtatcgtgaatgtgagacacctcccagtaggggccgacagacacctcatacaggagagctctggctggcatctggtgggtgcccctgtgggacaaagcttccagaggaaggaacaggcagcaatctttgctattctgcagccttcgctggtgatacccaggcaaacagggtctggagtggacctccagcaaactccaacacgcctgcagaagaggggcctgaatgttagaaggaacactaacaaacaaaggaatggtatcaacatcaaccaaaaggatgcccactcagagacaccagccaaaggtcactgacttcaaagaccaaaggtagataaatccacgaagatgggggaaaccagtgcaaaaatactaaaaattccaaaaaccagaatgcctcttctccaaaggttcacaactcctcaccagcaagggaacaaaactggacggagaatgagtttgatgaattgacagaagtaggcttcagaaggtgggtaataacaaactcctctaaggtaaaggagcatgttctaacccaatgcaaggaagctaagaaccttgaaaaaagttcttgaaagttagagaagaacataaatgatctgatggagctgaaaaacacagcaagagaaattcgtgaagcatacacaagtatcaatagctgaatcaattaagcagaagaaaggatatcagagattgaagatcaactcaatgaaataaaggtgaagacaagattagagaaaaaagaagtgaaaagaaatgaacaaagcccccaagaaatatgggactatgtgaaaagactaaatctatgtttgattgggctaccttaaagtgacaaggagaatgaaatcaagttggaaaacactctgcaggatattatctaggagaacttccccaacctagcaaggcaggccaacattcaaattcaggaaatacagagaacaccacaaagatactcctcgaaaagagcaaccccaagacacataaatgtcagattcaccaaggtcaaaatgaaggaaaaaatattaaaggcagccaagagagaaaggtcaggttacccacaaagggaatcccatcagactaacagcagatctcgcagcagaaactctacaagccagaaggagtgggggccaatattcaacattcataaagaaaagaattttcaacccagaatttcatatccagccaaactaagcttcataagtgaatgagaaataaaatcctttacagacaagcaaatgctgagagattttgtcaccaccaggcctgccctacaagagctcctgaaggaagcactaaacatggaaaggaacaaccagtaccagccactgcaaaaacataccaaattgtaaagaccattgatgctatgaagaaacggcctcaactaacgggcaaaataaccagctagcatcataatgacaggatcaaattcacacataacaatattaaccttaaatgtaaatgggttaaatgccccaattaaaagacaaagactggcaaattggataaagagtcaagacccatcggtgtgctgtattcaggagacccatctcatgtgcaaagacacacataggctcaaaataaagggatggaggaaaatttaccaagcaaatggacagcaaaaataaagcaggggttgcaatgctagtctctgataaaaacagactttaaaccaataaagatcaaaagagacaaggacattacataatagtaaagggatcaatgcaacaagaaaagctaattatcctaaatatatatacatgcaatacaggagcacccagattcataaagcaagttcttagagacctacaaagagacttagactcctacacgatagtgggatattttaacaccccacagtcaatattagatcaatgagacagaaaattaccaaggatatccaggacttgaactcagctctggaccaagtggacctaatagacatctacagaactctccacaccaaatcaacagaatatacattattttcagcaccatatcacacttattctaaaattgaccacgtaagtggatgtaaaacactcctcagcaaatgcaaaagaatggaaatcataaaaaactgtctctcagaccacagtgcaatcaaattagaactcaggattaagaaacgcactcaaaaccacacaactacatggaaagtgaacaacctgctcctgaatgaccactgggtaaataacgaaatgatggcagaaataaagatgttctttgaaaccaatgagaacaaagacacaatgtaccagaatctctgggacacatttaaagcagtgggtagagggaaatttatggcactaaatgcccaaaagagaaagcaggaaagatctaaaatcaacacacttacatcaaaattaatagaactagagaagcaagagcaaacacattcaaaagccagcagaaggcaagaaataactaagatcagagcagagctgaaggagacagacacatgaaaacccctcaaaaaaatcaatgaatccaggagctggtttattgaaaagatcaacaaaatagatagacttctagccagactaataaagaaaaaaagagagaagaatcaagtagatgcaataaaaaatgataaagggtatatcactaccgatcccacagaaatgcaaactaccatcagaaaatattataatcacctctactcaaataaactagaaaatctagaagaaatggaaaagttcctggacacatacaccctcccaagactaaaccaggaagaagtcgaatccttgagtagaccaataacaagttctaaaattgaggcagcaattaataacctaccaaccaaaaaaagtccgggaccagatggactcccagcctaattataccaaaggtacaaagagaagctggtaccattccttctaaaactattcaaaacaatagaaaaagagggaatcctccctaactcatttcatgaggccagcatcatcctaataccaaaacctgcagagacacaataaaaaaaaaggaaaatttcaggccaatatccctgatgatcatcgatgtgaaaatcctcaataaaatactggcaaaccaaatccagcagcacatcaaaaagcttgtccaccacaatcaagtcagcttcatcccagggatgcagtctggttcaacatacacaaatcagtcaaggtaatccatcacataaacaaaaccaatgagaaaaaacacatgattatctcaatagatacagaaaaggccttcaacaaaattcaacaatgttcatgctaaaaactttcaataaactaggtattgatggaacatatctcaaataataagagctatttatgacaaacccacagccaacatcatactgaatgggcgaaaaactggcacaagacagggatgccctctctcaccactccaactcaacataatattggaagttctggccagggcaatcaggcaagagaaagaaataaaggttattcaattaggaaaacaggaagtcaaattgtctctgtttgcagatgatatgattgcatatttagaaaatcccatcatctcagcccaaaatctccttaagctgataagcaacttcagcaaagtctcaggatacaaaatcaatgtgcaaaaatcacaagcattcctatacaccaataacagacaaacagagagccacatcatgagtgaactcccattcacaattgctacaaagaataaaatacctaggaatacaacttacaatggatgtgaagggcctcttcaaggggaacaacaaaccactgctcaaggaaataagagaggacacaaacaaatggaaaaacattccatgctcatggataggaagaatcaatattgtgaaaatggccatactgcccaaagtaatttatagatttaaagctattcccatcaagctaccattgactttcctcacagaattggaaaaatctactttaaatttcatatggaaccaaaaaagagcccacataaccaagacaatcctaagcaaaaagaacaaagctggaggcaacactggagttacctgaattcaaactataatacaaggctacagtaaaacagtatggtactggtaccaaaacacatatatatataccaatggaacagaacaaaggcctcagaaatatcaccacacatttacaaccatctgatctttgacaaacctgccaacaacaaacaatggggaaaggattccctctttaataaatggtgttgggaaaactggctagccatgtgcagaaaactgaaactggatcccttccttacaccttatacaaaaattaacccaacatatattaaacacttaaacataagacctaaaaccataaaaaccctagaagaaaacctaggcaataccatgcaggacataggcatgggcaaagacttcatgactaaaacaccaaaagcaatggcaacaaaagccaaaagagacaaatgggatctaattaaactaaagagcttctgcacagcaaaagaaactatcatcagagtgaacaggcaacccaaagaaagggagaaaatttttgcaatctatccatctgacaaagggctaatttccagaatctacaaagaactcaaacaaatttacacggaaaaaaacaaacaaccccatcaaaaagtgggcaaaggatatgaacagacacttctcaaaagaagacatttatgccaccaacaaacatatgaaaaaaatgctcatcatcactggccattagagtaatgcaaatcaaaaccacaatgagataacatgtcatgccagttagaatggtgatcattaaaaagtcaggaaacaacagatgctggagaggatgttgagaaataggaatgcttttacactgttggtgagagtgtaaattagttcaacaatggtggaggacagtgtggcaattcctgaaggatctagaactagaaataccatttgacccagcaatctcatcactgggtatatagccaaaggattataaatcattctactataaagacacatgcacacatatatttattgtggcactgttcacaatagcaaagacttggaacctactcaaatgcccatcaatgatagactggataaagaaaatgtggcacatatacaccatggaatactatgaagccatataaaaggatgagttcctgtcctgtacagggacatggatgatgctggaaaccatcattctcagtaaactaacacaagaacagaaaaccaaacaccacatgttctcactcataagtgggagttgaacaatgagaacacatggacacagggaggggaatatcacgcactgtcaggggggtgcggggctaggggagggatagcattaggagaaattcctaatgtagatgataggttgatgggtgcagcaaaccaccgtggcacgtgtatatgtatgtaacagacttgcatgttccgcacatgtaccccagaacttaaagtataataataaaaaagaacacatctagtagagacagtattgacttatcaatagacccagaaaaaatgtttaaattaaattttggagatgtgtttattttactttatcagtagttttaaaatcagccgtatttactaaatgttattaaagtcatgtaaacttaaaaaaaaaaaaaaagaagtcccagctgatgaggtctcagctggtaatgaggaacatactgggaagtggagtgatggcaacccttgctatgcttaagcaaagagactggtgacattttgttcctgccctagagatctgtggaactttgaacttgagagagattacttagggtatctggtggaagacatttctaagcagcaaagcattcaagaggtgatctgattgtttctaaaagtgtatgttcatatgcatgaacaaagagattatctgaaattggaacttaaaaggaaagcaaagcataaaagtttggaaaatttgcagtatggccatgtcgtagaaaagaaaaacccattttctggggagaaaaatcaagcctgctgcagaaatgtgcataagtaaagaacagctaaatgttaatcaccaaggcaatggggaatatatctccagagcatttcagagaccttcagggaagccctctcatcacaggcctgcaggtctaggagggaaaaatggttttgtgggcgaggcccagggccctgctgctctgtgcagcctcagaacacagtgccctgtatcacacatgccccagctccagctatggctaaaggggccaaggtacagctcaggctgaggcttcagagggtgcaagccccaagcctcagtagcatctacgtggtgctgggcctgcaggtgcacagaaggtgagagttgaggtttgggaacctccacctagatttcagaagatgtatgtaaacaccttgatgtccaggcagaagtctgctgcaggggtggacccctcatggggaacctacagtagggcagtgcagagtgggaatgtggggttggagccccagtatggactccccattggaacactgcctagtggagctggcagaagagggccaccatcctccagaccgtagaattatagatccaccaacaacttgcactgtgtgtctggaaaacccacaggaactcaacgccagcccatgaaagcagccaaggggcgtgtaccctgcaaagccacaggggcagagctgccaaaggccttgggagtccagcccttgtgttagtgtggcctggatgcaagacatagagtcaaaggagattattttggagctttaagattgaatgatggccctgctgggttttggacttgcatgggacctctagaccctttgttttggccaatttctcccatttgggatgtgaatatttgcccaatgcctgtacccctactgtttcttggaagtaactaacttggtgttgattttacaggatcataggtggaagggacttggcttgtgtcagatgtgactttggacctggatttttgagttaatgctagaatgagataagagtatgggggattgttgggaagccctgattgttttggaaatgtgaaaaggacataagatttgggaggggctggggcagaatgatatggcttagctctgtgtcccacccaaacttcatgttgaattataatccctgcatgtcagtggaggggcctagtggaaggtgattggatcacaggggcagatttcccccttgctgttctcatgatagtgagtgagttctcatgagatctgatggtttaacaacatgtggcacttcccccttgactctccctctctctctctctcctgcccaccatggaaagacatgcttgctttccctttgccttttgccatgattgtaagtttcctgaggcctccaagccatgcttcctgttaagcccatggaactatgagtcaattaaacctcttttcttcataaattacccagcctcagtctcaggtagttcttgacagcagtgtaataactgactaatatcaacttgcatatgaccattttgtcactggctaaaatattaactatccagccctttccaagaaagaggtgactgaaccctgatgcagaatgatgagtgtctgagggacaggattttagagcaatttcttttaacatgtattttttcttggaggaattccatcctaggagtaggaaaaaaataccgatgtcaaaagcaaatctaataccagggctttgtacactgacagatccaggatccctaattacagattctgatttttactttacatttactgcagcagatatctctgtattcaacagattccatttgttaataaatggaccaatcactacaaaaagcacatgatccctattgatcttgtcaatgaataatagaaaagtaaagaaaagaaaggcaaagatgaaagtgggaaaggtccttcaagaccacctgagcagcatcattcttcacaggtgagaaagtgaagcacatctggacacaggacttggcccaggtcacacagcccttgcagaaccaggactccctcagcctgaccccgtgttagtgcctatgtccctcaacaggaccagggttactattcataggagaagctctcacttggccagcctcaaattatatcaaggatgacaatctaaaaatgacatttgaagtccagtttcctacattaaaaatatgcagtgttcaatacttcagttattttggtacataggcaaattggatacctctgaaattaacagaaacaagaatttgaaaaaccaaccaaaatttttacatggaggactctcaagttaaccaggcttgctaagatgagaacatcactgacaacagcaatactcacccaattgtcttcctcagacctggaaggaaattgttccaattatgaataaaatgtaacgttttagcaaataacaataaataattgtatgtgtatgtgtatctgtgtgtatacaatttaaataattcctccgttaatttaacccaattcttcattaataatattagcatgaattaagaacttctaggcttgagaaaaaccactttaaaagtctcatttaagcttcataataaccctatgagttacaaaccattatcattcttactttatagatgagaaaccaaatatatttatattactgaattaagatgagttatcagaatttcatttctaatatttaatgatcctggtaggatggaaaatacacaaaaatgatacatcagttactgtactttgataatgtatctttacttctataggaataaaatttccattttccctctagcacagaatttttctcttctataatgtaaataccttcacttcatgcaaatacctaattcaatccagccaagaactcccatccaaaatgttttccctataatttttgtatatatttataacagtggtccccaaatagggatagttttgcccccccaggggacattcagcagtgtctggagacagctgggaagggtttgctactggcgtctagtggatagagtccaggatgctgctaaatgtcctatgctgcccagggcagcctacacaacagtgaattatctagcgtaaaaagtcaactgtgccaagacggagaaaccctagtttatatgaaaagcaaatcccatatccatattattttattgattatctcttgacttatggactaacagggttcttcagggacaatgagaattatctggattcttatagacccccagatcaccaaatagggtaaggcaaatcgggtaaggcaaatcatacaaactgattaacaggaaccaagagatactgctgtccaagaccggggagaagacggcatgctgtgactaatggacatcagtcaataatttcataacctctttgggatacaggcactttttttttttttttttttgagacagagccttgctctgtcacccaggctggagtgcagtggtgcaatcttggctcactgcaacctctgctgcctgggttctgcctcagcctgtcacgtagctgggattacaggcacttgccaccacgcccagctaatttttgtatttttagtagagacagggttttaccatcttggccaggctggtcttgaactcctgacctcgtgatccacccatcagagcctcctaaagtgctgggattacagacgtgagccaccgtgcccagcccaggcaccttttaagtaaagcgagagacagttcagtcctcgtttccttccacctttaacacaagagcatcatggcagattagttcaaatcttggagcaaaaatatgaaggccaaacacttaaaaaatgaataaaaataaaattacaaaaacacaccaaatagaagaaagcaaaatttaaaacaaatgaagcaaagaggaagttgattggaaagacatgaggccaaaactgattcaagcggtgagtcctgtgaacatgggtatgggccacatatttgtctctgcggttttcagtaatgaaagagaagaggatgtgggatttctaaaggcagaatcctggaaaagcaataacttgcccattcctaaaactttcaaccaatgtaatgcacatgtacaaaatgacacactcctctctgaaaaatgaatattaaggaaaatgagcattatatgacgtatatttatacctaaatcctaaatactttttctagaaaataagaaaaaaacagtataatctcagaggttcacggaggcatcatgcactttctggcagttgtagctgaccagacggataaagggacccccaaacagccgcctcccgtgtcatcagattgctctaaaatacgtaattccatcttctcacatgtgcacctccccatcccacagcatcaatcctaaattcctagtggtaggcaaagtagagtcccactttctaatccttaaaacctgtgaccatgttatgcttcatggcaagggggaaagtttagattgctggcagaatgaaggctgttaatcgattgagccatgacaatcaggtagcttgtagaagctggaaaaggcaaggaacctgactctccatagaagagcctccaagagggaaccagacctgccaacaccctggcctaagcacagtaagaccaattttgaacttctggcatccaaaacggtaagataatcaatgtgcattgttttaagccactgagtataggataatttgttgcagcagtatcacaaaactgatacaactcgttttagtttccttttgctgtctaataaattgccataaacctagagccctgaagcaatacctatgaattatctctcagttctcatgagtcaggagtccattcgtggtttaaccagatcctctgtttagaagctcattgtcctgacactgagatgtctttttaggcttgtgagagtcttctaaactcattggttgctggaaaaattcagttctttgtgactgtaggactgagacctcttgatactagggaatgcccacccctgtctgccctgtggttctctccacaacatggaattttgcttcttcaaagacaacagaagggcacctgctgtggcccttttaaagacttgcctgttaggtcaaatccactcaggatgatctcccttttgactaacctatactcaactgattagggttcttaattccatctgtaaaatccccttactcttaccatataaggtaaattaattatggtcctgctcacattcaaggggaggggatgatatagggtaggtccaccagggggcagaatcctggggccatcttagaattccacctaccacactccttggctgggcaaagtagctactgtaccagtttgcctctgcccgttaatttttaaccaaatgccccaacacaggcaagttagtaaggtttgtccactgtcctggacatgttcagtattagatacatagaacatatgcaaatgctagcatgttcctctctctccagtgactgttcccaaacttcaccttattttcatgattgcaggacataacacagaacccgaggtacatggacttaatcactgtacatctccacgcatgtgatacatggtcttactaaaaaatagatagatagatagatagataacagataataggcagatgatagataacagatgataaataaatatcaaatgatagataacagatgatagatgatagataacaggtaatagatagatagatattagagagagagagagagagagagagagataagagatagatgctgtctgtgccaaatttttttcttgattgaatactctaattccaaattaggagattgcttgatcaatttccctgccaatcattcctccacaggtaggcaatcaagggttccaaatgaaagcatatcataatgaatatctaacacagtagcaatttgcagtagactataaaacagtagctaatacagaattctgagagaaactaatagtgacaaggagaaagcaaaagaccttcagtttcataatgtaaactcaaactcagatttgcttgcctgaaaagtatcaatgtaggcacatcctgaatgaattatgtagagaaggcaaccgtttgggagttaacaatgagccagcatataaggaaagatggcaacataattacttccattccttttctataatggattgggctgattcaaattcaacatatttcatcaattttttttttaacaatcacaagtgatggtatttttccctttatttgctaactcagtaattcttttggggggtaaaattttgaggaaatcacaaatgaaacaaaatccctgatcatgggctaatgcagacctaagatgtttttgtataaaattaagaacagccttcgtatttcttcttgcagtttttagctggaagaagcctaccagcacaaaaaggataagctttaataaatagctctccttgtgataatgtagcacacattgcttcaattatagttctattctagtactgggggagggaaggatccgtcctggcagccagaaccctgcccaagaaaatgtgatgataacacaggaagggggcacccccttagccagccagataaactctaccagtctgaggcagacttcccagcaagaaaattctcacatcctcctattctaataatagaaccaaactagaggaagggaggaagaaacatctgtagttgtgtgctaaattcctcaagcctcctacactttttgagtcccctccctttaattagaagcatttatgcgtcattccacagtctctttttccttccaactatcgtctagtatgtcttctactctacaaatgatttctaacatttcttgttacaaaatgttcctgtgtggaaaatgctaatatttcatgatgcaactgacccaactccacagtgcagtgtaggattctgcaaacaccatcttgttattctccgtaaatatccccctttccttcttctggagaaaatctcaagcttcaatcactgggccgtgaacccgccaagacagtggcctttgagtcagtttgaaagaacaaaaatgcctagagcccttcctccccaaagaaacatgggattgacaagaaactctttagtctctcaacatactaacatacaaattaaacacattgtttaacacaaactatacttgccccattaaaactatcagtcaaaagactcagaactagccaggcttggttcttctccaagccagacttaaacaccagctcacaagttcccacaacatctgtttctagatgcttgatctatctccctgccaatcattcctccacaggcaggcaaaggtgccttttgaagcttcaaggactgatctcaggagcataggatggagaacacactctcaaggagatgaaaagcccttttcaagccatgagggtgacctcctataatgaccttgacccaaatgttctggtgatggctgcttcatggggagcaaaaggaatactgtcttaataataatttattgtctatttcaaaatacgcagaaaaatagatttataatgtttctgacacaaagtaatgataaatggttgaggtgatgcataccccaattagccagatttgatcattatatattgtatatgcttgtatcaaaatactgcatgtgttccatacataggtacaactataatatatccataaaacttttttttaaaaggatgcttcctgaaaaactgaggcaaactgcactaagtgatatttatatctttgtataacgctgcagaatgctaggagttcgttccaccatattgactaaatatacttgctaagataaggtgtaacgattccatctttaacattataataaaaagaaacacccgggagacttcttatgagcctctatttgataatatgccatgtgtattatatatagttgggttacttttaactgattttaacaacataaaggcaaattttcaagtaattgcaatgttttaataagctaatttttaaaatttatattatatgaacttttttcctaccattgattttttcccccagactctgacacccctccgtactcttttttctatctcccggaccatattaataaggttcagcaatcattgtttgctgattgagtttgacttcccatgtaatgctttgggcaacggatatttgcatgcagagaaatgtggtcctctccttggctcaccacctcactgccaggaaactaccccttcaagagctgactgaccagggctggacagttaactcactcctccagtccaaataatatgttccttattcatatgtttttattcaatcattcattcatattttcataatctctctctcccttacacacacttatacacacatacacacacacacacacacgtgaatttttataattaagtatataaagactgaaaaatggcaaattcatcttggcaaatacccaaagtaaagcccatcagcagagaataagaaacactgagtgataagatagctgagagtcccctgagatcttggccttgggccgggctccttctgcaccttggaccagaactggctttggactcttcaatctttgaacacatttccttttttagttgcaggcaaaacaatcataagcaaatgctgtccgtcactgttttcctacatgtacccaatgcattgagggagataacatacactcctggggtggccaggaatgcagaggaccagaagcgaatgggtcaattagccactaaccctcccccgtccacctgcacttcctccagagacataggcaagtgtgcacttgagcacaagtacatgcacacatgtgtacgatggatacagacattcatctttatattaacccaggcagcagcatgatccgaaaaatgccatctatattaacatcatcagctagggttaattgaatatctgttaagtaactttggtgtcagcaaaagtatcaaattctatttttagacatcacataatacaatagatattattcagtttaagcagaatagacactacatcctttcatatatacataattcctaaagctgagtatttctttgtacattgcaattatttttagaggaacgtaactaaaacttttccctaaatatgatttaaataataatttaaatgtcaaaaatattttaatcttatccattgcaagaatttataatttataaacctttaaaaattatattcttctgaaataaattatatcaattttctaatgttatgttaccctagtacaggacttggcaaactatagtcagcaggccaaatcaggcctaccacctattattataaataaagttttattaaaactcagccatccatattcatatacttattgtctatagccggctttgtaccatcatggcagagttgatgagccataccagagatcacgtggcctgcaaagtctctgcatttactatctggccctgtacagaaaatgtttgcaaagtcttgctctagccaattatggcaaagtaacttaaaaattatttccctcaagccctaatttttaaaaaataaaatgtcatcatgttcaaccaaactcaatagattctgaatatccttccagatattctgaatattctgaataccagaatagtagattctgaatattgctgtcttcaaaaacacttatggattaagaggataagcaagcaaatgtataagataaatgtaaaagagacacatgacatatctaaaatagaattaaaagcacttcacaaaactgggaaaatattaaaatatgttttaggatactttatgaatcaagggttctataggaattacgtgacaccatcacataagataatttgaagaaggcttgacaagacaactatcaacaaagacacaggtgtggaagaggcaaacacaagagttcccagtggctactaaggggcccaaaggaatgctgggggataaagggtcataaagggagagccaggtgggtgtggctgctgcggtgtgaggccagggccacagccagtcccaggtaacccagtggcagccagtggtgggaatcgcagctcggacttccctcccctttctcccacaggccttccaaggaccttttccatggccctatccagctggccgcgagagggcacaggggcatgacagcagtcatagaagcttcccagtacagaggcagaaacagacgctgggaggggcaagagaaaatagccagcaggagttcactttctttcgaagatgataaaacaggagaaaataaatgtgaaactgttctctacagtgtttatatttctagccaagaacactctcatgaatgaaattcattttctaaaattagggcaatgctaagaataagtcttttctccaacattaaaataaaaataaatttaccaaaaaatggttgcataatgaagtggctggaaccaaaatgtagtcttggtaagattaagcccacagtagctaatgtacaagttgtaaactatatctcattcatatcatgttgatatttgaaagaagtagaaatgaggacacacaaaaaaaaggaaagcatttttacctcatccttcaaacaaaaacaaaagtattttttctcccaaaatgatttttaaattaaatgcttcttttgtcagaaagtgaatcctagcgtagtgacattgccattgatggtttaagcctattagagacctgtgttgctcacgaaacatgttgaataggactctaacagtattttcacaaatgtttttctcccacatcctcatcaatgagatctggcatttacttccaatcagtgtatatgtcttcatttatatattataaacacatacagctgtgcatgtatataagtatattttaaatacagtatacacatctgaaaataatgacatcaagataaaatgattgatattataaagtaaatattatgttatagtctgatttaacaaaactttttaaacttagtgcaataatttatgatagaatgaattaaaattctgttttctacattcaatttatattaatttttagtttaaaaacttctataactgaagtggacaactcaaacagatatataaatccaatttcttgggaggctgaggcagatcgcgaggtcaggagattgagaacatcctggctgacacggtgaaaccccgtctctacaaaaaatacaaaaaattagccaggcgtggtggcacgtgccggtagtcccagcaattcaggaggctgaggcaggagaatcacttgaacccaggaggtggaggttacagtgagacgagattgcgccactgcattccagcctgggtgacagagcaagactgtctcaaaaataaaaaaaaaaaaatccaattacatcattggctgtttttaataaattttgatatactactttttcaacttcatctgccaattagacaatgttttttgttgaaatttgccaagcacattttcatcttcactgatgtcaatatcttgtgctcaaaaatttatcagaaagattaaaaaatgagcttaaagtccactgaaacttcccttttgggagttttaaaaaagggttaaaagtacacataagacatttcaaaagtgaattttctaaatttatatatttaaaaatcaggtaagattgttattatagtgattgttgagcatcatcattaacaaccaattcacataaggacagaaatcttctgaggtatctgatttaaaaattacttttaatttttttatttcaataggttttttggaaacaggtggtgtttggttatatgaataagttttttcgtggtgatttctgagattttgggggcacctatcacccaagcaggctacactgtacccaatgtgtagtcttttatccctcaccccctcccaccctttcctcttagtcctcaaagtccattgtatcgttcttatgcctttgaataattatagttaagcactcccattatgagtgagaacatatgatgtttggttttccattcctgagttacttcacttagaataatggtttccaggtccatgcagcttgctgtaaatgccattatttcattcatttttatgatatacatatatatacactacattttctttatctacttgttgactgatgggcatttggattggttcaatatttttgcagttgagtattgtgctgctatattgcatgagtttcttttggaaagcaattacggtctcattaattgtgaaacaagacaatttcttttctacaggtacctactattcatcatactattaaaaataacaggaagttcagcaaatttagatcccttatatcttaaaaaaggagaaataggtacatagagatgatagcgctagatatacagaaacattgatatatgtgtatatacatacacatccattgacgttaagcttcacaatttttcaatatcttaaattaatgacagctctttaaatatgttgccactaggtatccagagaccctccctataaaacagaaaataatggttctttcccacctcatttcaaaacattataaatactctcccatgttaaataacataacacaaaaatgcactttactggaacttgtaagtcaaaacccttccaatatttccctgattccctcaggatgccttagaaactcactttggcatgtgtcagagcttgacatattgagcaagtgaggcaccagcatcaacttacattttaatattagtacattttacattgctgtggtataaacattctagaaacagaatttcccattttctttccatccgtctcttgagatcactgctattgactctagactacctgcttcagaatcacatttagatgtttgctaaaaatggtcgttcttggccactggagtcagaatcaatgagaagtggagtcacaaaacccagagtttaaacaagttctggatgcggcagattttgcacttcgcggatggtcccagcagcatgtcccccacaggctctcctgcatgcaacctgctggtcatccatccacaactggagtctatttctctaccaccttggattctggaaagcctaactcctttgaccaataaaatatgaccgaagagctcctttgccagttccaggcatggccttaactggcctggaagcttcatttccagtctcttgaaggcaggtgccatgtaagaagttcagccatccagagaccaccatgttaggagagaataaagagatgacatggtgggcaaaatgacaaatggagaagaaaggaggatgtagaagcaggaaagagagagagagagagaaagagagagagagagagaaaggagacagagacagataccaaggagcaatggcatgcagtccctgtgagtggatcaaccaccttgaatatggaacctccagtccaagcagcctcatctgatgccaacacaatcataaacaaacttctcagccaagttctttttttttttttttttgacttttggaattttggaattttggaattcctgatcaacaaaattgtgagcaaaataaaacggttgttttaaatcactatgttttgtggtgctgattaggtagcaattaataactgaaacaagaagtcattattttgctacaagtaaggatgtctagtcaagattctctccctgcccatcccaagtctccatacaggaagccccattcccctacctgggatttgcggtgaggctgcagccctagaaagatggctggctgtcacccctgcctcaggagtcctcgaggctacttttggtcaacactataactgaagcagaagcaacagtggcgtttagaagatgtcaaacatggaaataatgacttcttggacttatacaagtatttaaccctcctttccctttgttgaatgcctgacatcccacgtttgtaaatcaattctgtgaatcctccagcccatttatggtccataacttaaattgcatcaaataatttcaaacacggtagttaccagtatatacttgatttataaaattcacagttataacaatatgttaactcgtttactcaatctaaaaccttaaggaaaacattactattattcctgagagggaactgaaatacagtgagattaagtaacttgcccgaggacacacacccagtaagttgaggcagtggctactcagatcatatatccccaaaccctcttcattactgtcttcagttattaatacagaaattgtagttaggatgtcaggtaaataaatggtgaatttccataaaccaaagggaatttacagaaatattaactattctaaaattctttccaagtttaaacaatcaattttcatggtgatttattcaataaaagctgcaaaaaaaaccatgtttgtttgaaaatacacactcaagtccatacaaagaaaaaaatcaactgtttagattatatgagtaattcaaaaggtgaagcagtttctattgtgtagaccagggtttctcaaccaggtgcgattttgcaccccagggaacacgtggaagtgtctagagacagctttggttgtcattactagtatgtgtggggtgtgctactggcatctaggggtacaggccaaggatgctgttaaacatcctacactgcacaggacagaacccccatgaccaagaattatctggcccaaaacatcaatagtgtgcaggtgcagaaaccctgatgcgaaacgtgatcgaggcgtttcttctgccctgatcatcctttcttgtggtcatctcctctccctgctctgagccttggtagcactgtttcatatcccacactgaataccttgtgatggcactgccactaccactgttcatttttcaggtccataaatcttatcttgtcaactggaacgtgagctgctagagagctctcaggtctctctctctctctctcctggaagaatgtagtgcaaggaggtggcatctgatatctttttgtcaacacggtttataatttctaatttcttgaatacttgaaatgaaatactcaaagccatccaggtaactgcctccttctgagaaaatgtcttccttgagtgtcttttacttcttaagggtttaagaagccatctcctcacccagggccatatgaaaaataaacttccctttgttttaatttccaagaggaagttatcaccaagggacacaaacttgaacttttgaacatggaatggtcaacattccagcttttatactcactgtatggacaatcagtaattgctgctttttaacagtaggaataaatctaatacatgttattaaattctgcatattttgtcacagtttgtgtttgtgtaattttcctttcatgcctgttgcacttgtgttatttgatcatctaatttctcttttacttttctttctcctcctccaaaatggaggcttatttacatcaattattgatctgccatatgtctaatttagccctatgtccagtacttgaactagagaaactgttaaaccaaattagtaataatgtttaggctagaggtggaggggatattgggtaggtactttttgcaaaagtgaatacataattaaataaaaaatagtaatactgttggtggccacattagctgtaaactaacatagagaaaagaaataatgagcaattggttcctttctttgtaagatcccaattgcagtccatacagttattctccatgacttatcacagggtagtccctctgccaatagtggtataagtgaattgaaaacacattacattttaattaatcatttaattaaaggaaaaagagagacatgaaaatgaaacagggaacaaaagctcaggtcacatacagcaatgggtgatctccaaatcttgtctccctgtctttgaaataagaccagacagcatttggccttccggtacatcgtcacctcccctctcagctcggctgcagccactcaaggtttgggacttcaaagtgccatgactcctcataggcattaagcctacagtataagccccagcacccccaacctgcctcactctgtggacttgcacacaaccatgggccactttccatccacatcatcaaagctgtccaaaaatggggcaggggaccctggccttcgtttcaaaaattacagttctgccagatgccacgagatggatgctaaaaccctgttccttcctggattcccctgcctgctcctcacacaaatatggatgtcatgcctctttcatgtcaacacctattgtgctgaactctacacttggaatgtctcaatacctagtgctgtccttataccttgacgaaaactctccctagatttactgagcactctacttgcttaaccactcagaatccaaacacaacatatgtcatctgctttgtccagggaattggacttctaaacacttcccccatggagaagataatccactcttcctttacactgagaggtctcaatgaagaaatggcttccaaaccagccaataatccagccccattttcacatctacctgattcaacaattcattcattcattcattatgtctctcactcattcactttcacttggtctgttttcctccttcatccctcccctccttctcttccaccaccagaattctcaattagcctttcaaatacccacaagaaagtcccactgtaatcctcaccatcactcaaggtcactagcgccaaagcacaacttcctgtcttccatccctataactggcctacacatccagaccctcaaaacccactctccctgctactctccagtgcttctgggatcggatacactattttcatagcccctgtcagggtccattcccacaaagtatgactcacaacaggctccagagctctagtttcccagggttcatgttcaaagtagggattcccgctaccccaaattcttattcagtaagcataaaaaggatttggggatttccattattaaaagtccatttgggtgaatctgatgatcaacagattctagaactcctgtgctcaaaagacagtaagcctctcatcctaactgccttttgtaatgctgatgctattgacagaggcagtgcctaggattaaactcccctttgtgagttggaattctggtttgcaaactccatctacttttcaaaattaagtgaacaaagagaaagatgggaagccaaataattcacactgaatgtttgaatcttaggctgggcagaatttgatagttgtctaggtggtacatgggagtgactggggagaaggacgagtgatggggaaggaggaggaggaggaggattttctactcttcagagcttatggcagaaagttatcagcatgtgagctggagccaggtggtctgagagctaatctggaatgcaccaaggctgcagatacttgatgctgacctgatttcctcatgcaaaatcaggataaagatgatacctatcaaatataagcactgataagattaaatggaataatgcatgctgagctcttaccataaagctggatataaaataataactcaatattagctatgatcatcattatatgcataagatttaggaaaacttaacctctttattttgttatatatcttcagagaattacattgtacacatccagacgacctgagtggaaatcattgttctcatccaaatatcacccaatgctttctttaattctaggtagaataatcaaaaaagacactttgtctccatatgccaaataacagccccaatcagccagtggaacaaccagataattacttatcaactaaggggtattttaatgtgatgcatgataactaaggacttaaaatcacaaatacaatcatgccaatttttaaagggatgtgtaattggggcaagaaaatagagagttgaaccccacagaaggaaagaaatagaatctaaaaatatcagttattttaaaagttcaataaaggctattagtgtataaaatgtataattaatttactatctgtatatccgtttacaggcttatcatatctttgaggttgatctataaatcttcaaatatattaattatatttaaccagctgtggtaaactgcgatttgtcaaaaactggtaaaacactgttttctttttaaagcagctaaatgtaatatatttataatgagcccttcttgcatcagctataagtacatgatgtgacataatttataactataaatatacattttatatgtaaatagaaaagtctctgtattctatttgaaatactgtacttttcacaaatgcattgcttaacaattaatgtggtcaaatcttataatgccaaaatgttttttaattatgtatttcatacctttatgctcaagcttaatttggttacctgttattctctaattacaaaaaggaatcttcatttaagaaagtcttggaccaaatataaaacatcattcagaaagcaggccggtcaaaaagtaaaagcttatggtttctaaatttcaggatttctttatgaaaaaatgtcttctgtagtattttacaatttttaaatttcaggatttgtacaggcagtagtaacaggcaggaaaggagggtaaggggaaggagaaacagcatatttcctacaggtgagacattatgctccaaactgtgatctcaaaaaaaaaaaaaaaaaaagatataaaaacatttccttagggagctttaatggattactgagttactatgggcggaaacttcttgatctctttctgggagacaaccaaaaaggtgcagctaaagctcagagaagaaaatcagcatggctgagcttccattatgagaaaatacatgaaaacagtattggatggtggtcacccaagaaaatgcaataatagctgaatgttggaaagtgacaaattcaacctaaaaaaatacatatatatatacatatacatatgtatatacacatacatatgtatatacacatacatacacacatactttttcctaagttttttttctatcgactcaaatatttcacaaagggggaattacgcctgcaggagcacatagctgtggtgtgaatgactgtgtcctctgagaaattcatatgttgaaatcctaacctctcaaggcctgcaggtggtgattaggtcacgagggtgacaccttctgattgagattagtgccctgataaaaaaggaatcagagaactcagtcagtcgccacttccactatgtgtgtgccctcagcagacactgaaccttcaggtgccttgttcctggactttcaggccttcagaactgtgagcaataaatttctgttttttttgtttacttgtttttgagagagtatctcactccaattgcccaggctggagtgtagtggcatgatcttggctcactacagcctcaacctcccaggctcaaatgatcctcccacctcagtctcccgagtagctgggactacaggtacatgccaccatgtcaagctatttttttttttttgtatttttagtaaagacagggtttttccatgttgcccagactggtcttgaactcctgggctcaagccacctgcctaccttggccacccaaatcactggggttacaggtgtgaatcactgggattacaggtgtgaaccaccatgcctggccaatttctgttgtttacaagttacccagcctagggtatttgggaaaacagcctatataaactaaaacacacacaaatacacatagagttaaagaatatatagctataaagttaggtgaccaaaatgtcctctagtcatcaaaaattatactaatgtcattatgacttgaactgtgtcctccccaaaagatacggtgaagtcctaacccccagtacctaacaaataatctcatttggaaattaggtttttacagaggtaatcaagttaaaatgagatcattagggtgggccataatccatatgtgtcctatgaaaaagggaaatttggatgctgagccagacaagcatagaggaaagaggatgtgaagacatgcaggagaagatggccaaaaggcttgagtggtgatgtgtgtacaagctgagaatgccaaggattgctggcaaccacctgcagctaacgaggtgaggaagaagactcccctagagccttagggaagaatatggccctgccaacacttgattttagatttcaggcctccagaactgtgaggtcatccatttctgttgtgttaagccacctagcttttgtttctctgttatagcaggtctaagaaactaatacacatgcgtagaacagaagtatcacaacccagtcctttttttatcttctaagtttttttaaaagttctctcctaaataaacaaaaatacataagtaatctttaaaacttacataggttaagtttctagtgctgtactgattggttcaattgttaagaatattgactataaggtcagttctgtctttgacatagagttttgaataaggagtttgatggaaaatatctgtagattaaggttctttttcaagactgtgatggtagctgacatttttgcagctttaaatatatactgagtcacatccttagtaaagaaggaaggtaatcgtcaaacattttaaaataccccattgttataagattttgaaataccattatcacagcatttcagtaatgaactctcacagccttcagctctgcccactgttgaagagaagtaatcagtctagatgcatacttcccttatggagcttttaggggcataatatccatccagttagtcatttggacaggcttgataaactaagcccacagtcaacctgccattaaaagcagagtgagttagatttgtggcatcctcagtattaattaaacattgatggtgggcatcactgttcagaagaagggggcatctttacctaatgtgcgcgcaaatctcaacagtcttagagctgaaagggcccttagagatcatctattcatctggtctaatcctgttggaatggggaatctcatattagaactgcgggtaagagagtaggtgaagaaggagcctggcattagaggggagactattaaaataatacctggcaggaattgatgtggatggagagtatagacagaagatgttcagtgtcgagcaaaagaaatagcaagtggagatgggcctggaaggtttgaattcagttggaggaaatcaagcaaacacccaggagaaaggcaagttggggatgatgagttcacacctatctcctgcaggggactttctctgagctgaccttgtatttttaccagcttccaatcttgggtggggtgctgaccagtggagtgggagaggaagacttggcagaaaatcttcactagtgacccaagtcaaccttgccagcgttgggctcagatgtcaactttaagcatcccttgaggcataaacttaggcagaatttgatcatttacaaacacctgtcatttgaacaggttttgggaaggaggccataaatgttaacacctttctctgctctcccaactgaaactctaaaatgccaaagaatattttcaggaaaacatagtgtgcttactccaaatggcacagacaaaagccatacttcacgtctccttccctgatggggccaggcctcagatatccaaatgtagctgagatgtaacagaagagttttaaggcccctcagtggccctgctctaatgagagccagaagttcccaatgctgccacctcaagatattattacagtactgaaatgacatccaaaacacgaacaaaaagaaaactgaaattctgccctcttgtttctcctcacttttttggggggcggggggcaggtcttgctctgttagactggggtgcactggcactatcatggctcactgcagcatcgagctccccagtctccagtgatcctcctgccttggcctcccatgtagctggacctacaggcacaccccaccacacctgactaatttttgtaatttttgtagagacagggtttcgccatgttacccaggctggtctcaaactcctgggttcaagtgatccacccgtcttagcctccaaaagtgttgggactgcaggcgtgagccactgcgcccggccatttctcctcatttctaatgccatgtcctgggtgctgaacaggatagtcccctacaacacagaattatctgacctacatttccatagtgctgagatgaagaaactctgagaaggagaaaaagaggatagtaatttggaacaaatcttacagccataatacaggagtagccttatgtcaccatgggtaggtagaatctcttccaaacaaagaggcataaacccaggaatattttcttctgaagatctcctgaatactacctgaattgggttgaatggtggcctcccaaaacatatatctatttggaacctgtaatggtaaccttatttggagaaaggatcttagcaaatgtaattaagaatcccaagatgacatcatcctggataatcctggtgaatcctaaatccagttgcaagtatccttataaaagaaagttcagggctatattagacacatagacacacaaaggaagccatgtgaagatggaggcagagattggagtttgaaatcaaagaacacctggagccactagaactggaaaaggcgatgaagctttctcccctagagtcttcaaagggagtggagccctgctgatatctcagtttctgacttccaggctccagcactgtaaaaggatagattttagttgtttttaagccaccaaatttgtggtaatttgttattgcatccctagaaagctaatacactactaaacagataatatgttcagacaacttatattctctctaatggccagaactgactggtttaaatgtgacttcagaaaaactttgacaactatattaacaagctaagtgtttctcatgagttacatgagctaaatgacttccttcaccaaaggtaatgtttagtattttaaacagaagaaagtcacacttggtatttgtatcacagacaactttctaaagacagcctcttatctcagagttgataaattttaggcagcgaattcataagcatcaggtgtctcaaaatgtgcaacgtcattgaaatctgtttcgagaagttttaatgtgagcagcagacaggagtaaaatcgtattacgcaagcccttcaggctctctggcaagtgataaaaactcaatgccaactaggttacgccaaaaacaaaagcacagattcaagcataaactcagggagtcaaagtatgctgtaagaattccatggttcttactcctagttacaatggcctctgttgggccttcttcttggaaagactccatatggtgacaagatggctgcaagtagcctgcacttgacgtcactctttgagctcatgattgcaaagaagaaattggtcttgcagctctcaggcacagtgcaatgtcattaaaggccactgattaagggcacttgggtcatttacagcactcaggacccagaggatattattctcttgttgggcttcctgggagacctgcccacctgcaatatatgagaaagaggagccatgcatattagcttcctgtggctgctgtaacaaatggccagcaatttggtggcttaaatcaatatgactttattctctcacagttctggagagaagtcagaaatcagtatcaatgggccaaactcaaggtggtagcagagctatgctcccctaggagggcctaggggagaatccatcgccccttgcagctctgagtggctgccagctttccttagctgtagttgcatcactctaattttcaaagcccatctcttcaaatctctctcaaatccatcttcacatggcttgctcctctgtgtgtgtgtaatcttcttctgcatctctcttctaaaaacacatgtgattgtatctaagaggcacccagataatccagaaaaatcttcccatttcaagatccttaatataatcacatctttgccatgtaaggtcacatttagaagtttcaggaattagatatcttttggagggccatttttcagcctactgcatgatatcactgacaatactgctcaagtcacagggagtagagtcctggcaatcccagaaaaataaataaggcactgacagatgcaccttacaggctaacgcatggatcatctctcagctgtctgctaaatacaatgacgtcattacagaactgagccatcacataagccaaactcaatctcatacttgctttacatttatggtggggctaaacaacagatagtggtagaaacagcacatttcatttcatgctctcattcatgtgttcattatgctcatgaacctggataattcacagctgtttctcagtgcaaatatgcaatgttcatcaaggcatgatctcagagcacaagcacctaagatgctataatatcgatattgaacacatctagacaaagataaacctttagaaattgacatagaaccacctactgtcacatgctagcagagtagggaactctgctgacggtgagaaagaagatacatatccattagttcaatgtgttttccctgactcatcttaggctctaaacagcaggaagaaaaagaggccgcttgacaaatactaattataatgtagatagaaatttcaaagccagattttttaattttgcctgttttctttatgaatcaatctaaatttattagcctttgctagtgctataagtcatgcatatatatgacagacaatttgggaaattatggtaaagtataaaatgaaaaatccaaaccactcaccacatggaaacaaccacttgctaatttacttatttcaaatagtaaatttaacttaaatacacacacacacacacatacacacacatatatatatataatttttttttttttttgagacagagtctcgctctgttgcccaggctagagtgcagtggcgccatctcggcttactgcaatctccgcctcctaggttcatgccattctcctgcctcagcctccccagtagctgggaatacaggcgcccaccaccatgcccggctaattttttgtattttcagtagaggtggggtttcaccgtgttagccaggatggtctcaatctcctaacctcgtgatccacctgcctcggcctcccaaagtgctgggaacttgaatatattttaaaaagaacttgaggatagattcaaagaatgcctgaacttcatatttcttcaccataaatatcaactcctaaaaacttcccaaaagataccattaattttttttaagtttacacacatagatacatgtttctttgtagcatacatttatgtttctaggaggtataatatattataaaatagctggaagagagactttcgaatgttctcaccataaagaaatgataaatgaatgaggtgatgaataagctaaatacccaaatttgatgattatgccaaatatatatgtacagaagcatcaattttatcccatcaatatgtacaaatacaatgtgccaataaatatttttaaaggaatacattaaaaatcacttaatcagaatccaaagaaacaaaagacaatccttgaaaactataagtttaacaaatcctatataaaatattttaaaaataacatattttgaaatttgagcttgcttttagcattaccctcaaagacatacagaagggaaacaatgagcatttctccagcaaaatattcccttttgtaaaagatagatcacttgttgaagaaaaacaaaatagacatggaaaattgattttatcatgaactataataaagcctgagaaattacacacaagtagactgtggtgtttatgttccaccaaaatttgttgttttcatttcttagactcaactactcaaaataaccctatttgttttataattggagcagttttcttggatgcctgttttctcttgtatacctatttatctttgttgtctatataatttccaatagtatttccatttttcttagtgataaaaataatcttcatataattaacactttctctttgttaaacttgtgatttgtgtaaaaaaatctacttttctcataaagtcatttttatagaatcttctaatttgttccttaataattttcgatgaactatgtctatgaaagaacatatccttattttttgtgaattctttatcgatctgatttgtccttttcatgtcagtcttttcatactttatgaatataatatcatctttatattatttttaaagttaaacatacactcaattcataaagaaatctgcaagatctaaaataataaagaaagccctctatgtcatacagcctatatagtttgcttaaagcaaaaactttcaactctttaactggtttatttatgtatttttctccaaatttgtaactaataatattttactgctgtttcttgatattttcagttagaaatattattcactggctcctttttactttatccctcttcctccatcaacatagatgcatgctccctcccccactttctcagtattgatttatgatgattctgtaggaatatgcagtacctacataactatgcaaatactcttcacagatgggccatgaaataagattttactacatcttgtttctcaaaacaattatacgtttcttagagttaataattgtctcttgtttttctatgtagttattatctttttgtcccccacaccgaaatgtaagtctcctttttgtctaaatgcattcaaacacctcagatatcccattattgatatcctcctggaaagatgccttcggtaactgtatcatctactccaacctggactggtggctcccaaggcccgccgcacaacagttccacaattatctccctttgccctcatcccaggaatatttttctccctctcgcctgtattggagcctctatttcctgggcctagtgtgttaaccattcatatatttcccttgatttttcatctcttagtctttattcaactttctgggaaatttttatcaaatttatttactaattttccatggatatttttatttctatgatcatatattttcaaaataatctatgaagccttttgaaatacactgaatatttcttttctccttgtttcatggtagtaatatcttctctaatttcagaagacattcatcataatttcttgtctctctgtcttccaagtttcttatttaatttggttcactctgtgtttttcgtaactgggaactgcaagaacattagagctgggcacccacattgctttgtagaccagccatcattgcttaatctgggtgggatttttttgtattagagtgaccaccgatgtcactatccttaaggttctagttgtaagctgattagataccaacaaaagtgtacgccaaaacccatataaaatatatgcaaagagaaacaccaacaccggggagaagggctaggatctcaatatacagtatatatactgtgtgtgtgtgcgtatatatatatatatatatttacacgcacacacacacacacacacacatatatacacatacatacatatacatatatactgaattctccccttcttttttaagggaagttctcaggggaaatcttggtcccctggtccaatatatcagcagctttgtcatcttccagaattgcactactgtcttcttccagcatggcagaggaacaactgtgttgagacacaaagtgagcgagcaggaagatctgggttctaactgcttcttccattgtctcctgagtttgtggtttctcttgaaaaactggctatggatcttatttttactcctctgaaggttatgtctttttctgttacttgattatttttaagatttatcccttttccacgagttttcagaagtctgactataacgtgctggtgtggttatctattgtatttgaggtttgcagagcttcttagtctgtgagttgatacctttcatcactttggaaaagtttcagtgataattaccaggcacatagcttctgccttgtcctcttccttctccttttgagactcaagttgtatgtgagttagagttttcaaggtgtcatgtgtgtctaatactcttttatctaccctttccaattcctctctgtatttcagtttgaatattttccacagactggtcttccagttcactaatacaatattttttttctgctatgtctaatctgctgttaaaataattcatatagttccatatgtcagatattatttgtttttaaaaaattatagaaaatttatttgattcttttttattctaatgttctggtaaaattctccactctttaattaatctgtctaaattatcctctactttcttccttatattaatcataattatttaaagttaccttctgctaactttactaactgtatcatctgtcactttcatcagccaagagcaactctccagaggaaggggcagctatgaaccagtatcaaacaaccctcacaatagccagggatagggtgccctgttctataaggagagctgggtagggtgtctcttgtgttcatagagattttcctttgatgtacctttattgtcacttaaatgctttattttaaatcaatgaaagaacagtacataggttcccttcatcttgaatcagaaactaatggctatggtttaaaattgcatttgattttgatgctcctttattcaaatggtgcttggcaattcttaggcaatgaattgcatgaggtcttcggactccagatattaccaaaattacatgtatagtcatgcctaatttcgtataaagcagcctattcttagtagggaatttctgcatgggcaacttgcctctgcgatctaagatgcatgtaaataataactgagtattgccaaaaattgaaagtagaattgaatttcaaaaattaaactgagcaaccaacccatataaaatcattgaagggatcatgtagtatcacttgaaaaagtggcaatagcccccacaacagtaagaattgatacaagcagattaaacattgtgttctaatgaagaagtattatataaactcttaaaggttagctatgagagcacagcaaaaggattgtttgtcaaacatatgttaaacaagggtgttgtccattgcagccctatccacaatgactctacccatctctgtgacagttatcaataaattctggatgacaaatggcttacatgttaaagagtcaacaaattaagggttccaatccatccactccagagagtggtcagccaatgtgacttttttttttttcatttatgtttctcctttgctttttattttcactttgttcttaggtaattgggagacagcttacagaacacattatctcttactcaaacaagaaatcattactaaaatttggagcaatgagttttcctggtatgttggcttatttatttttgttagcattttggaagggacatacagataagggaaatgaacacagggcagagaattctgagcatgcccatcactcagcagtcatggcacttatgggggccatttttgacatagaaggagaaatgcattttagataaatgaaatgaactcctccatttatctagcagcttgtgattgtcagacagtgtttgctattggattacataaattgcctgacttcgtttcatgaaactaaatgatatacatgactaacaaatatattcatgcatcttcaatttagtttttgaggccacaagcaaagcaacaatttagaaatggataaagagagttattagaaattaagatatgcacaacacaaaagaatgaattcaataataaagtatgtacttttttgtcaaagacataaaaacacttcatttcagtggcagagactagtgtctgttcggtcagagtcaggaacatcaagaaaactctaagtaagatacctaaaagtattgagtattatcaatcatagtgggtgctatcggcaccccatccagctcttatgaaacaggacactgtatccctggctgctgtcactgttagctgatcctggttcatagcttcccaactctctggagaattgctcctggttaatgagagccacctcaccaggaagttatgtcaccaaacactccaaatgtggcagccgaagaacaagggagagttggttataaatcgccacagcccttgcctcaaatgggattaacagcggttctatatatgctctagagctgcatctgggatcgggttgaggctatactccagctgacaggaaatttttgcctacttcctttctttgctatgtcacacactccctaccttttgagagcatgccttaagtaaatcacatgcttgagaacccctatctcagactgtgtttccagggtaccaaacctaaaacccatatttgaatttcaattaaaaattaacggttatattcactgtaagccagatgtcaactataggtcgtatgctggccagtacaaatgagtacaataaagcagcaattgtcctctggagccctacacacccaggtccaaatcctagctctaccacctatcagatggctgatcttggctaaatcacataaacttgtagacctcaactcctctgctgttgaatattgaaaataatacccccactttagtgctgctggagaactcgatgagatgatgcttgcaaagtgccaagaacagagtaagggcaggatgagtgatgcctgctattatttttgttgctgtcatcatgatttcatgacaaattaggtcattaaagttacatcaaataagcataatgccaagtttcaaattagtagggaatgttttccttaaacaggagttcaggcattacttaagcaagacagaagaaagagtaagtggaaggatgatgcatattaaaaatttaatcctggcagagaattcagggataaatccagtgtactcttcttcctggctgtcctctccaaaatgtactatagagaaaattgaggtaaagagaggttaagtggcttgctcaaagtattcctgcttgttatttacagaaatgttagaatcatgaagaaatctgttggtacgtagcaaaaaaattagaatggtatggcggggtgggatgagggtagaacagggaacagttaagtgtatccccaggggccggtcttgttttccctagcacagactaggagaaaatgctaatatctgtcaatgtctgaatgcatacaaaccacatatcccaacctgccttgtgatttcttgaagttatgtgactgagttatggccagtggaatttgggcacaagggatgcacttcctggcatggcatgatcctttgcatgatcctccactcgaatttgtctttcttccctactgcctctggaggcatggattgaagacgggataccataagagaacactgtgggatcctgaacggcagcatggaaccaagccccacagactgcactggactcacttgcgagggaggaataagtcttctgcatgtgaatgttcagcttctaggagggcgcagttgttttaatggcagttaacttggttcatattctctgaaactagtaaaatcttagtcctcatctacataaaatatacataatcaactataaatcttccagaacgttatttaaaaagtagagtaaatatgtttgaataaatcggtatataaaacagcatctgacagaaaatcttcaccaagggaacagatataagagcctagaatctgaggaggaccgttggtaacgctgtctcaggttaccaacttctgggtcaagatcaactggggatcatgtaattattacacagcgagtccaaataaacacagcaatcaaacattgataaactaaaaaaaaatactgagtcatattgtgttcactcatcaattcaggaaatattcattgagaacttgccgagtactaggtaccataataggtgacaaactttttcttaaaggaagagagagtcacatagtttatattttaggcttggtaggccaggcagtctctgtggctactggtcaagttagctgaacagcagccatagatgttatgttaaaaaaaaatgaacaatatgtctggattccaaataaaacttcattaactattattataggccaacgacatgcaaatgaatggctatgttccaataatacctttactatgatcaacataccttagttgttaactcctgaaagattttaataaaaataatctttaaaatccacttctatgacaataagaacatatgacaaagataggcaaaaaaataaatgagctcagaatcatgatttttgagagctgtgggggagaccagtctctccttgcccaataaatataaaacataatttaaaaaattaatcattgtgaatatctcattggaatagttattctaaattattaattaatatatcatgctttaaattatacagaagaattccaacagagggtagttatattatagtgttatgacccattagagagggtattataaattgcctcaatttatttttaaatttaatttcatattaataaaaggaagtaatttaaacacaagaatcccagcagcttctttagaactggcaactaaagattcatagtttgcatatatacatatatatatatatgaacacacatatgtatatgtgtatatatatacacacaatatatatattgcatatataatatatatatacatgaacacacatatgaatctttagtgtttagatttcttcatatgtggagacatatatattcaacatatatacatagaaatctaaaccgaaaaattccctaagcacatcaaagatcttatatgttcaatcaagtaatcttaatatcacagattagaaaatggcttctttaaaacatgtggaaactgaggcaacaatcaaggaacatagggtttctcaacgttggcactgttagcattcagagtcaggtaaatttcgctcaacgggggggtcctgctctgtgcattgtagaaggtttggtaccacccctggtctctacacgctagatgccagtcaaagcttcccccaccagttgtgacaactaataatgtccccagatattgccaaatattcccagaaggtgaaattgtcggaagttgagaacttctagtctaaaaattgactcacgttgaaactcaatccccccaacccagatatacaggaaagaagttaataatgtggcacatatacaccatggaatactatgcagccataaaaatgatgagtttatgtcctttgtagggacatggatgaaattggaaatcatcattcccagtaaactatcgcaaggacaaaaaaacaaacaccacatgttctcactcataggtgggaattgaacaaggagaacacatggacacaggaaggggaacatcacactccggggactgttgtggggtcgggggaggggggagggataacattaggagatatacctaaagctaaatgatgagttaatgggtacagcacaccaacaaggcacatgtatacatatgtaacaaacctgcacattgtgcccatgtaccctaaaacttaaagtataatgataataaaataaaataaaataaaaagaagaaagaagttaatatccactttaactttggagagaattctctaccgatattgatcatgtagtcagagagatttaagttttcaatttagaaaccatagagaggcaggtggcaaattggaacacagatttcattttttctgcttatcccagcatttgtgagtgagaaacaagcagtgaatttatttccgttagaaacaaaacaatataaaaatggatttggagctatttcccaaaagaattttagtaagacagtgaggttaaatgagctccagcccctttgtgttttttgaactctgttcagtgagcatctacctccagccatctgcggtaggatcccagatgggcaaatgctgtgaattagtctgaggccagctccatttttatatttttcaaaaagctttgttcttataaaataatctccatgattaaggcaagaagaaaacttatactgaagatttgaatctgttattatgacatgaggtaaaagaaacaaattatggccaaccatcactatgcctgaaaatgactggttttcaataggggatggctaaacttcagcatgcagtgagttgcaaaaaaaaaaaaaaaaaaaattatcacagtctctgagcaaacaggtgccttataagtgaaaataagttaacatttgattctctagtcattgatgataaacaggttttattttcttaaattaaaagcaactcttggtctttaaatgttaagagacatcttctcttaatatgttaaggcatacctgtctgaaaatcataagaaatattccaaatatagccattttacttcatagtacatttgtatgtgaatattcatatggtcatgccaagagatttacctcatacagataacattcactcagggtaacagagtacttgtatcccaattcctgctcaaatcttcacggctttagcaattccaccagtgatgtttctagtttgtcaaaaagacaagattttttttggcaaaagggaagagacttccgatttgaagtactgttgactccatgtccaaaatattccttacaccagatttatcaggcaacctgtcttggaagtgagttttctcctttgggagccaccccacaaaagcctatttttctcatcactcaatttcagtatggttctacagagctgagccgccatgtgtgacagtgctttgatagatatcataaggtcacagaatggtgggagaggagtggagagggtgcactaaggtggtgtccccgtgctcctactgtagccaggaagtgtgctggctgctggatggaaaataccaccctggatttcagggcaattgacaagggacaatgcagtggggtctccagaattctatgaatgtcactaagtaggaaaaaagaagaatcattattcaacatccgctttctcatcattgttgctaaaccaatgtcaaagcaggagaaaaaatttgggagagaggaaaattgtaaaacagtattgagaagacaagtggttagtatgtaaggaatgaatatatcagtcaggagttgcctgtctcatccacgaattgtcccctggggtgacagtatgcacatgtgtgttttaggatgtctcttctgaaagcatttcttataactctagcttctgggttaacgttacttttcttttcttgaatttagggacaaaaatatgatgtttacctcccactccattaaagttatgtttaaaaaggttagggaagagtaagcatattaaatactaagggacagaaacttgtaagccatctgttttgactctaccaccttccaggtaacctaatctaataatatcatctaattctgaacatataaaaagaaagaaaacacttcttacaacacagagaatgaatttcaacatgaaacaataagtactagtcagaagtaaaggctatgaggctgtgaaatgcctcagagggtcaccagccaagcaggcacagaatgggttacaaagaggtgttgtctccagtgaaactcaaggatgggcagtctttttcttcaggaagaagataaatagggtgaaggtgattgagacaggacagcaagagcaaatgcttcaagttggaaaatagcctacagtttggaaaacaatatgcagcatgacatgaccagacaaggtagaaactgccctcaggtgatcaggagagtcacaggtaatgcaaactgccacctggaggtgaacctctgtcctgcataggggcaggacccaaggatgccttgtctagtgttaaataaaggttactggtgaactacattcatttctcattgtctccagttttcttgaaattggttgtcctccttgatctgtttcatcatttttctacatttaaacaataatttttaactttggagagagaaaaggagaaaaatattaacctgagatatacaaatcaacccccatgatttgtggtagaaaaccatctttctatgtaataattgaaagcacacaagtcaaacgttctgtcacttattatctaaaactgtgttttccaatggggcgcaccagcgatccagaacacttcaactctagctggtccaaatccaaatgtgatggaaatataaaacacacactggagtttgaagactgagttccagaaaaaaaaaaaaaaagtgcaacagatcattaatttcttacaatgattctatgctgaaattaaaatattttggatatattgaggtagtaaaatatactgttagtagtcatttcccttgcttctttgtacttttttcagtgtgcctagcagatcatcttaaattacctatttggctcacatggtgcttctatcagacggcactgttataagaccctttgtctaccagtgtgcttattcctttctgttatacttgggaactgtcatgtaaattaaaataaaatattcatagaaaccaacaaggcctctttgctggagacacgtgatataaaaaaaaaaagtgtgtcatgaattgccagccttctctctccagactaagtaaacagtaggctacagaactccgtacacagccacataatatgaaaaagcagaattgccctgctttgcaccaatggtacagcagtctgacctctatcattagagccgcatttttaaaaccacagttcaaaaagtcacgtcttcttgcttggtgctatgtcagtagactaagctctcaccacgtggtggtactgatgggcatcctatacttcagtaacagctcatcaatcccatcaataattgcaacctgatttccaccgaaggcagccaagaccaaggaggcaatgatgagaaaagtacaatcagtttccttgacctcacaaaaatatatacacatgagttaatggaaatacatctcctcacttttttgcatctatttatttggacatcatgtcagtaaaatttgcaaaaatatcacaatagactctcataagcccttcacctagattcccctgttaacactgtatcatatttgctttattatatttgcctctgcacatgtgtatagcttctatgtatgtatgtgtataacaattttaaaagctattttgatataagttacagaaatgatatccattatccctatatcttttagcatgcttttccaaaaaacaatgacattctcctatattacagttatcaaaatcaacaaattaatattaatacatttctactatcttatccagacatttgaatttctccagttgtccaaataatgtcctttatagtaagaaaaaatatatctgctgcaagattcaatttgggtcaagtattgcatttgatccccatgtctatttgttgagctttatgatggaagagctctttattatttcttcttttttcatacctttcatgacttcgtgatatctgaagggtagaggccagttttttgtaggatgtccctcagtgtatctgatggttcctcatgataaagttattagttataattttggttataatttttggctgaaatatcaaggacatcttgctgcgtcctctgtgcatcaaatcactgaactctgtcccattgctggtgaagttccccttgacctttgactatttggtcatgggctatttgccagatttctttactatcaagttataagttttcctgttgtaattaataagtatcatataggtaagtactttaagactaccatgaataaatatcctggctgtcatcaaactctgacccataaattagcatctattgatcacttttgcctaaatcgatttttagtataatggttgccaaatcataatctcctaatcaaattattccttcaatattcattagttggcatttgtttactcatttatttatgttttatgttagcatctactcatggattcttatgttattcaatgtgttataatctacctctggcattatctattttgacaatcaaattgccccagatttcttcagcgagcccacttcaagctggctcctagtttcttatgacacaccctcatcattctttaaatattttccttaatttctgaaacaacaagctcttccagtcttatctgagttctccttgcccaattctagattaagtcacttctcaaaaaaatccttcgtttgttttcatggagaattaagtttagaaacaaagtaacatgtatcaagtgtgttcactgctactaagaatacttctaaaccctctcagctgacggagctagcaaatttaaaaagaaatgaatgcgtatatgtaaatatatgtttgtgcacacacagacctacaaaacctcactttttaacacaagtgatatgccagagagtataccatgagaatcaaaatgagtataatatgtagtttctatctactaaacgatatatattttagaaaaggttatctaaaacaatctttaaaatggcattatgattaaattgttgatcattctttttttaattagcaaataaaaattatatatattgatagtgtacaacatgtcactttgatatacgtatacgttgtggaatggctaaatcaagctaattaatatgcaggtatctcacatactttatttatttatttatttattttggtgttgagaacacttgaaatctactctgttagcaattttcaagcacatagtacattgttagtagttatagtcaccatgtcatacaatggatctctttaacttattcctttgtctaactggaatttcttgttctgtggccaacatctccctaacaccttccctgaccttctgggcccctggaaaccaccagtccactctctgctcctaagagtttgtctttttagatttcacacataagtgagatcttgcagttttgtctttctgtgcctggattatttcactgaaggtaatgtcttcaaattgctgatcattctgattccttaataataaattcataattttaccactcaattagctcaatgaaagactccagttatgtactaaattgcagtggaaagacaatttattgtcaattgtgataaaactattataatggagatttattatttattatcatcactttaaaaaatcaagaataatagaaaattcttgataaattgcaatgttttatctcttttgaacgtcttacttatttttcgccatgctagtatggagttggcagtgatttgtgaccatttcacagatgaggaaccaataattcctagaagtcatggaactagatcacaaatcaggttgatgtgtcttcaaagcccttgctttttatcaatattagctttgatcaggggattggctgattttaacaccttgctaagtaaaagatagatttaatattaaaacctagctctgaagttccctaaatgttcacaagcagcagcattaaagagagaataaaataatataaaatcctctccaatcacctcttagagctctagcacatgagagtgagacgaaaattggttgaagaactttttccaaactctacacagcccgaagattctggcatagtctgtagggagttccagaatcttggtgaagaagatatttgtgtcttaactctcttattttctaggagacactttttaaagactagagggaaaagtgggcttttgtgactcagatctgctactaaaataaatacttcatttaagtacaagatctcaggtccattgttcaaaccgcaacaacagaagtaggtaaatttcattttgatctatttccctttattctttgttatagatagcttttaacccaagtattcatatttatgttaatataaattataaagaggaaacaaagctgttttacaagaaattgatgcccggatgcatcaaactaaataatcgatgattgctgtaactgtgggggaaggaatgtgtccaggctttgaagcaatgttccttgaatggtctgtcatctaaggaaggacaaatcaggatcacatccacggaacaaacagggccacctgacaggaggaaaaggctaatcaggaattaagggaggtaatgactcgtaacaagtagggccgccttagtcccgtggcctgacctgctgaggaaacgagcccctgctcaggctggattaacacctttacatgcatctgtcttcatcccctcaaacagtgagttaattgggatggaaaatgaaagcttgagaaaaataaattgcacctacctggataagagacagatcctcaagctgtaacctgaagaggtagtttctgcaaaatacaaaaacagagcagttttatttttaatagatcacagaaagttaagagtttataaaaatttcaagaacaaagaaaataataattttgacttcaaaagcatcttctttctaagaatatgttcagcactactttccttggatcttagagtacaaagaggaattcaagaggtcaacaaatacacattagagattggtgagaaagctaacgaataagtggggtgtgtctgtacatacttacggtaagtgtaagtcattaactggatctcttgatctatatggaataaataaaaggacatgggcattccattctgaaactcttttacttaagatgatgtacaactattcctcataggtcttcctttataattatcacctaaattcaccatgttttataattaagattttgaattcaagcaatgctctgaggttcacagtactctaccttgtaagatggattcagtacgtaataaacgtttagaaatatgaacttgggcccggcatggtggttcacacctgtaatcccagcactttgggaggctgaggcaggaggatattttgatcctgagaggcagaggttgccaggctcctgggaaccatggcaaaatctgtctctacaaaaaatacaaaagttatccaggcatattggcttatgcctatagtcccagctactcaggaggctgaggcaggaggatgctttggtcctgggaggtggaggttgcagtaagctgtgatcacaccactgcagttcagccagggtgacagggcgagaccctgtctcaaaaataaataaataaataataaatacataaatataacttgcattatataggatttggtttaaaaagaaaagaaaagaaacatgaacttggtggtctgcccaaaggaaactgatgacatcaagggcttcaaagagtcaagtttcactgcccaagtataaaataggaaattagagaaaagtaaaatatcaatttcaacaaagaaggggaagaatagtgaaacatgcagtggagatcagtagaggacacagaaaaaagatagattagttacactgggctttggactctagtgttgtaggttttagaaacaactcattaacctacctcagtattctttgcttcagcctctaactgaaatcctggcatcatgtaaatgggaagatggggcggggatgtgcaccagcagcaccccaaagaggaagggaggagaaagccagcctaagtgcaaataataatgtcaagaacatgctggcacataatggtaagcaaactctaagatgcaaatgagcacgaggtgggatctccaagaagccaaggatgctgttataatgggctggtccaaggtcacttcttattggttttacaacacctataagacataaatgttgactattttcactatcgtgggcggggggtgggggtaggtatataaactggacatatatcccagtagaagtgacaagtgacagccaaagaggcccaagggcatagccttgagatgaccaagaaacatccctatgagttatggacagagttagggaggacaaagcccccatggaagccggcactcagaagcacatgtacacacacagctgaaggatgaaagaggactaggctcacattcaggtagtctcatgagtccaggcattgcctcctgggcattcaggtttcacacagtttgcctcctcacatgggggtaccacctctctaaaccgagtgaaaacagcctcacccaaaccacagcaatagtctccttaccacactctttccacctttcaaatctcacctctgatataccccaagagaagctcccagaagcactgcttggcacatgccacctccatcacaaagccatttcaggaaacattcccctgtcctttattataatgctacagccctctatgtagaaccaggttaaggatacctctgaggggagggaatattacaggaaagtcttttgatttagtcagtgccatgagaagactaggactccaacagaaatgtcatctgcaggccaggcacattgccccgtaatcccagcactgtgggaggccaaggtgggccaatcacttgagtcctggagttctagacaggcctaggcaacatagggagaccctatctctacaaaaaaagaaaaaatacaaaaattagtcaggtggcatggtgcatgcttggagtcccagctactcaggaggctgaagtgggaggatccattgagcctgggaggtcaaggctccagtgagccacgatcctgtcactgcactccagcctgggtgacagagagagatcctgtctcaacaacaacaaaaagtccttttcagaggaacaaatgtgaacttggtgcacatacagaagagtatgttgaagcagccaaggtaggtggcactggagggtgactcgcatttcaacattagccaagctttcacccagtgtgaccttgaaaccagcacacctcctctaagggaagcaagaaatctacacacacacacagacaagtctttcagaagcggggcttaccagtgtgatatagtttggctgtgtccccacccaaatctcatcttgaattttaatccccataatccccatgtgtccagggaggggcctagtaggaggtgattggatcatgggggcgggttacttcatgttgttctcatgatactgagtgagtctcatgagatctgatggttttataagcatctggcatttcccctgcttgcatttctctctcctgccaccatgtgagaaggcccaagcttgcttccccttcaccttccaccatgattacaagttttctgagccctcccagccatgtataactgtgaatcaattaaacttatttcctttataaattacccagtctcagctatttctttatagtagtgtgagaacaaactagtacatagcggcaccagggaaattactagccattgtacacccgttgcctctatgagcagctcagctccccaccctcacatatttcccactgtctttctggtttcaggaggctgcccctctgctatgggagtcagcattacctagcaattaagaatattcatgcaaaaaccagagttctgcctctatacaatctcaggaagaaagcatttctttctatgccttagtcttttcatctgtaaaatggagctaataatcaaacccattccctagggttgttgtgaggtttaaatctaagaaaaacacttggaatgaagtctgacccattgtaagcatcaattaatggtgccaacttctatgttaattttgtcattggtcctggaatccagtcaccctactccttttcaacccactggcaattttaagaaggacttcttcagtaaatatttccaataaaagaaactcattcatttagtaaatgaattacctaagagctttggtgatatctcatggttcattctttcttgcttactcacacacatacacgtgcacatgtatgttcacactatggtatctgtctccagaaactttcttgaaaagaagctttcatacacaaaggaagagctggaagtgcatcagggccttgagaaaagacgatagcacagtctgcagtgctctgtagagctctgtgcagatcaagcagagagctctctgtctacttggagaggggagtggaggagacacagagatcgccatccacaacacctgcttccggttttcaggtgttttccatagaagaagataatggcttataataaaaaatacgccactttctcagtccacacctccataagcaaatataactcttctgatcattatttttctgcttctcaagttccaatgggctgtaaaggtacccctcctctccagaaacattgctagtggagtttaaccatctacctcttctccttccaaatacctgagagctatggtgcccttccaatcatctcatcagtaataacaaatcaatatggcagaggtattcaataggggaaaggaaggggcaaagaggagggaggggcatgcttactaggaaaaatagcacagttactatgaaataccatcaccagcaccagcaccatcaccatcaccacatccaataccccaggaaggaaagcaccagaggatttgaacttttctttttgtagtattttctgggttgcaagataaaaattggtgattattttaccccattccatatttttaatctaataatatagagtctaagaaatcaagaactaagagtcactaaagagtatatacccttcaatttatagatgagaaaacttctataaattaacagctgcagtgagatttgtccaatactgtaaggtttcagagaaagtcctgggattagaaacaagccccccgtgtcttggtgtcctttgtcccattatgcctcaaggccccacctattagttattcaatgtcaccttcctaatttcacctgcaccaaacatgcacacacacagaaacaaacacagtaacagctcttatgctactaccatttcataacttcactggtcatttacagcaacatttacaaatcattttaagaaaattcaagtcttagttctgctaataacaaacttttgatcctaggccatcaattttcacctctgggactgtgatctggctgtgatgtatgtctccccttgaggagaacagtttgagcctacgggtctggctgtttaaatggcacctcttttctctctttttattttgcctgaacaactccctgcccatacctaattctaagaatatccctatttcttaacttataaaatgaaagagataaactatacaattatctcaatgtatttaaataatacaaattcccaaaagactgtgaccatgtttagatatacacattgcctaactaagttctacgaataaatggccattcaacaaaagtatttttattatggcaaatttaaatcatttcctgagaagtgtttttcatgtgttatttttcacaactgagtaacttatttcaaaataatcttaaaagaaatctcaacatataaaatagatacaataattctttaatagtataaattgatgtaataagtacttatgtatttgttaataaaatcagttgatgaagctttcttaaaaaaattaaaactccacttatcagaactatttatcatcttacacagatcaacatctatttaatgtgtatattcatgccagttgattggttatatttttgttgattttttatttgtttgatttttaaggcacagagttggtaggtgcttttaaatgtttctttttttccttttttttttttttttttttctgagatggagtcttgcttcttcgcccaggctggagtgcaatggcatgatctcgactcactgcaacctccacttcctgggttcatgcaattctcctgcctcagcctccccagtagccaggattacactgacatgccaccacgcctgactaatttttatatttctggtagagacagggtttcaccatgttagccaggctggtcttgaactcctgacctcaagtgatcctcccaaagtgctgggattacaggtgtgagccaccacgcctggcctaaatattagtttaataaatgactatggtccatggaaaacccaagtagtcaaatacctcactacacaaacagtttagtattcaccttattacaattttcagctattttaaacaatattttattttattttttttttttgagatggagtctcgctcttccgcccaggccagagcgcagtggtgctatcttggctcactgcaagctctgcctcctgggttcacgccattctcctgcctcagcctcccgagtagctgggactacaggcgcccgccaccacacctggctaattttttgtatttttagtagagacggggtttcaccgtgttagccaggatggtctctatctcctgacctcatgatccacccacatcagcctcccaaagtgctgggattacaggcgtgagccaccgtgcctggcctaaacaatattttaaaaggtgaaccataagtaaaacatttgtggaattccctaatcacatcccaagaacctaagaatctgataaaacacagtgtggattctgctattctcaaatctctttccttgaactatttggccccacatacaactccaaatgcatttttgctgtaggaaaaattccaagccagctggcaacatgagggacttgaaatctctcaagacagcttgatccatcacagtttaggtcaatgacctacaaagttaaaggttacaaaaagagagaaaaccttctaaaggggataaaaaattgatattcccaggtgttgggccactcacaaactaaagtaagatctacagaaccctgcaagtggctgtcctccaaggtattacagaagaggcaaccactttatcttgcaattgtgtgagcacagaggagggaaaacaatatgcgtgaggttcatgagaaaggccaccagcctttccaacatgaaggaataatgcttctggcccctggccaactggaaatgctaaccaaatgttgcaagtagggtcagtctccctaacagggcaatgctttgagcaacccaaagcatttaagtgatctcattaatcttcataacacccctagatgtaaataggtagtaataaggaatattgccattcttcagggaaaaaggcagtggtgcaagaggttaagagattagattctttgaatgcattagttgtatagcttggaggaatgattctatacttctatttttctcctgtcattaccaaaatgaaaagcaagagtttgccaaagtgtaacagttcagtgttatggctatagcaaataaaaacatgagttttttctgcctgtggtatggatctacttttttttttttttctcaaatgccatggaataaaatttgacattgcacattcacgtgcaataaaccagattccttttaggagtaataacatatgaggagtacacagatccaatgggctgaataattcaaatcacaaagctattaagtttggcagatgcaaaatcacaatattgaagcccattcttcgtttccccactagacacctgagtgcgttttctacgtcttcaccaaagtttcttgcttactgactctaggattgaataactcattcctgggtcccatcacttcccccagtggcctattagaaacaaatcactaagcataacaatatattctcggagggagcagtggggaccttaatagatgaagttcatttgtatcttcatgtaaagtagtaaaatgcagccggcattaaagaaaaggttgagccatcatgagcatattaactaaatgactcatttcatctagagacactataaaacttaactttgacctccataaattatgaaagacacaggtgttttaaaaggacattctcttagaataactcaattggcctctgatgaatatgactataaaatcaaagaaaaaattacaagttcctattgaacgtatgagttagaggtttgcttacaactgagaaaagaagaattaaggaaggtagatttgtattttgtactagagcaaatgaaggcagaagccgataaaatgtataaagacattttaacaatgttgacagaaacgtttgttgctgattaataaaagtttagaccaaggctgatcacgaaacaatccaaagacaaaacagacactgcccatgagccagttggggaaggctgagagctgaccagtctctcctgtccctgcaccagcttcctgcacacaatactttcctcactgcaagtttccttccatcctcactgctgtcaacatctaactggcacagaacttttcaagtatagtgacatcctacatgatacgcacattttcaattgcactggtagacttttgaagataacaagttatgtttgagatggagtctcgctctgttgcccaggctggatgtgcagtggcagcatctcggctcactgcaacctccatcgcaggcattcagcaattcttgtgcctcagcctccagggtagctgagattacaggtgcgcgccaccatgcccagctaattttttgtgtgtttttagtagagatggggtttcgctgtgttggccaggctggtcttgaactcctgacctcaggtgatccccctgcctgggcctcccaaagtgctgggattacaggcatgagggaggccgaagcagacagatcacctgaggtcagtagttcgagactagcctggccaacatggcgggaacctacccctactaaatatacaaaaaaattagctgggcgtagtggtgcacaactgtaatcctatctacctgggaggctgaggcacgagaatccctgaatgtgcaaggtggaggttgcactgagcagagatcctgccactgcactccagcctgggctacagagcgagtctcaataaataaataaaataaggaaaaatagtaactatatcctttaaaacataaagtgttgtaaaattagtttgattatctaagtgtaaatatttaatatcgtgatcatatcagtaaatttaaatataatgatttaatttaatcatgtaaccaactcatataattcaccaattcaccagcatgtctataattgtgatttccaagacttttcattatgctggtcgactctaagtaaattctaggagactttttattttgtggttataactatcctaaaaaatgtctgcttcatgtatttttttcatgggtttctcagaagataattaaatttcaaaattacaaagcctttccaaatagtatcacattatatttaaatagttagatcacatttaaatcacagtttttaattcttttgtgagtttttttctaaaatattttaaaatatggtgacaaatttataatatggtcatgtgattagctatctcctcagtcagaattttctctaccctcctcaaaaatagtaaatatgtattcttcgggctatgcaaatttcaagataactgtaatttaatttttgttgctgttaatactgttacgtgtgtctggtacccattctcccagaatcatattaacttctttcattccctatcccagaaagagcattttgagctccttaaaagtcttggttattagaaataaatttcaaagaacacactaaaactgagatcaaaccattttaatagcattcttatatatttaaataccaagattaaaaggtgcaaaaatagatggatagtctcttattatttagcaagtagaatgaaataacaaagatacattttaatggcatgcagtaactaaacaatgccgccagcaaatcttagagatataaaatcaggaaaatattttcccacaaatatatttagggtaaaagttattaatcaatattgttaataattacactaatagtttacattttattatgctttaattattacttgcaaatctctaagtgctgtgaggattacagatgatgatttattgctctaaatttaactcgcgacttttgcctttgtgggtcctctgggtatctgatttgttcctttctgtttttcagttaacagagataatttttcatttgaaaaaaaatgccaactgaatatttctatggttcctttaacctgtgatttcctaggactattcatgctttaaattatctccatatacaattaattttctaggttatcttcagtattcatacaaatctgagatcttttttctcatgtatcttctaataatcaaagaattacagctcatcctcccatatgctctatcccagtcacactcccaaaactcactgaatggtttgatgcttcccaccagccaacccactctgttggccatcaattgctgtcaaaatcagaactgaaacgtgtctcaaatctggcttctcatctccattgccatcatcactgcctaagtctaagcaccctctactctcacctgatccacaacccgcaactgccatgcctcgctccaaattctgcaagttctagtgcctagtgcatcctgcacacaatatggtggacgtatcttcctaatgcaaatatgattatgtgaacatataaatgtagaaatctcctgggctcctcaatgcctttagcagaggttctcaaatttaccaagccagcagagcaatgggagcttgattaaatcaaagattctggccgggcacagtggctcatgcctgtaatcctagcactttgagaggccaaggtgggtggatcacttgaggtcaggagttcgagaccagcctggccaacatagtaaaaccctgtctccactaaaaatacaattagccggatatggtggtgggtgcctgcaatctcagctactcgggaggctgaggcaggagaattgcttgaaccaaggaatcagaggttgcagtgagccgagatcataccattgcaccactgcactccagcctgggcaacaagagtgatgctctctctcacaaaaaagattctggcattacttccggaaagtggaattcagaggacttgaggacaggcctggacatctacactcttgaaaggcctgtcaggtgaacctaagactggcccagttggagtcactggtctagaggactaagtctaaacttctttataatctggccccagctaatgctcagagcttcacctataattacttccccctctctgtcaccaacaggtgccacggagccaagcacttttcagcctcatcagaatctctgacttttcccatgtgactctctgtcttccctgccagattcctcaagcatctctcaggccccgttggaggaacaccttctctatgcagcctcttcagatcgatgcaccatcatatccctttactcttggtgttttcaggaccctttactcaggcttcccttggagaatctaattgcttgtgcccgtctcacccactaggccaagatcatcatactttttgttttggggccagagagcagatagtttgcttttgtggtctatgtgccaactactcgtctctgcagttttagctcaaaagcagccacagaagatgtgtgaatgagtgggtgtggctgtgtgccaataaaagcatatttacaaaaacaggaggcaactctggggccccagcttgccaacccttgcgctggactagaaagtcctcatcaggtagagaagatgcttcatctttgtttctctaatgcctaagaagcttcctggcataaagtaggttcaataaatatttgagtaacacagagtcttgaaagaagaactacatgaactaatacatttggatgaaccccatgtggacctggtaggagaaaagctctcaatactcagtctgtagcacatgtacatgcaaataagttattcaattattatcacagccctttgttggtttgctcatgggatctgggaaataggaagcctttgtacatttatttatttatttacggctgtcccttggtatccccagagcattggctccaagaccacctcgagtgccaaaatccatggatgctccagtccctgatatcaaatggattggtatttgcctataacctatgcacatcttcccatatactttaaatcatctctagattacttatatcgagcacattataaatgtaaatagtcgttatgccatattgtttttattggtatcatttttattgttgtattgtttgtttttaatttttccaaatattttaggcttgtggttaaatctgcagatgcagaacccagggaggaccaactgtatgtacttacttgcttataactaaatagataactgttgtactaggctgatattctcccaactcaagcagggaaaaaaaaaatacagatgggaggccgaggtgggcggatcgccaggtcaggagattgagaccatcctggctaacatggtgaaaccccgcctctactaaaaatacaaaaaattagccgggcgtggtagcgggcgcctgtagtcccagctactcgggaggctgaggcagaagaatggcgtgaacccgggaggcggagcttgcagtgagctgagatcacaccactgcactccagcctgggcgacagagcgagactctgtctcaaaaaaaaaaaaaaaagtacagattagttttttttgtttttgtttttgtttttgttttgttttgtttttttacaatagcagaaggaacagaatggttagaaatctttcccaggcatgtcagttggccaccagtttgttaaaagcacacaccctgagccagctaaatcagcagagctgggaggggcatcttaattttgaacaaatgtcctagctaatacttaagaacattaatgtttggcaaatgttggacaaaaggtaacaaagccagcagacaacaaggagactttttaacatatattgggtaaattaatcaaataagcgaattagaagaaaggggagaacaagtagaagaaagagagagataagcccagagaatcataaaggacatacctgtgcataggggccagccctgagaaggaaagggacagagaaggggaaacctttaaaccctaaagtggaggttcataaagatttgattggaagaggacaaaaaagactgcagtgaaaagcactgttccttttccatcaccagctgcttgtcttaagtcataattaatgtaaacacaacatgaaaatcagcattacctgggatctcttcccacaatggggttctactcctttttgcattcactgctaatctctgatttcataccgctcagcatgtattccctttaattgtgtcaacttgactaaaatatactctttggaaaagacgaataagtgtggctactggaagcagaatcgctgatctgataaacatcttcagttttcctgttaattatatattgcctccaaaagagtaattccaaggtaaaattttcaagtaaaaataagaattataatcaccgaaaaataatgatattggccagttgtttaaaataaattttatgtgaatttaaaattaatcccccttgtttagaaccagtgtgataaagtcattttgtaaagaagaaactcattaaatagaagcctaccgtttattttatgcgtctcataagaatatatgctatgttaaaataattgggaggccattagattgaggaggcttcactgtcttgggttcctatgtaaacaaaccaaaattcaactcaatgtaaatagtaaaaggaaacttaagcttaaccaatcagaaacaaaaccctaactaaagtctaacttcagacttaaccaattagaaaccaccaactaacctctaactagggagtttccactttaaccaactagaggcattttctttgtcttgtttctgggaagaatattataaaagtttcctcccttgccacccccacccacaagtggagagctgctggaagtctggtgatgcttgattcctaaatctctaaatgttcaaataaacttgttaaaattttaatgcacctaagtttatcgtttaagggttttgaatacttacagcaaattcagccagagcataaaaacagcaagttaatctttccttttttatctgtagttttgtaaattcaaaccattagccaaacaaatggttcaaaataataaacgaaaaggatcagaaatccatactatttgttgcacatacatttatacagacatatcttctgatatctagaaatactgtaatggtaagtcaaggggtttagtgcaaggtattcaggcagctatgggctgatactcacattgggtcaggtgtgcaaggcgtgcagttatgggctggtactcacatcgggtcagaagtacaaggtgtgtagttatagactggtactcacactgggtcaggtgtgcaaagtgtgcagtatggactggtgcttacatcatgtcagatgtgcaaggcatgcagctctgggctggtactcacattgcgtcaggtgtgtgaggtatgcagctatgggctggtacattgggtcaggtgtgcaaggtgtgcaactatgggctgctactcacattgggtcaggtgtgcaacgtgtgcagttgtgggctggtactcacatggggtcagatgtgcaatgcatgcagctatgggttggtactcacattaggtcaggtatgtgaggcttgcagctttaggctagtactcacattgggtcaggtgtgtgaggcatgcagctataggctggtactcacattgggccaggtgtacaaggcatgcagctatgggctggcactcacattgggtcaggtgtgcaaggcatgcagctatgggctgctactcacattgggtcaggtgtgcaacgtgtgaagttgtgggctgctactcacattgggtcaggtgtgcaatgtgtgcagctatgggctggtactcacattacatcaggtatgtgaggcatgcagctatgggctgctactcacattgggccaggtgtgcaagaagactcatgcatctctagtgccttttgttcccttggtgacttaatgttctcattttgtgatgttattttgtatagaattaaaatcaaacatttccaaggacataaatcattatatctgctatgaattatgatcattacctgatccaagtattgggtctgtgggcctcaatcccaccaccttacccatggcagatgtttaggccatgtggactcacaggtatttgtttgagagcttacagacgaactttcttactaaaataccacagtttgtaagactgtaccctttgatttatgtttatattacactcaagctttttgggaaaagtaagagaatcagaattgagtaattggatgaaaataacttaaagaccaagaaacacatttaaaaacctgaagaaaattcacattttagaaactgagatagatgttaaaaaatgttttcatttagaaaaatcacattttgaagaaaagcacctaaatagccagaaagagtgactccacatcttccccacagttcagtggcaaagactcatgctacagatgctttgataataaactctttttcattagcactgtaggtctttatgcattataaaaatatggccaatttgtaaatgtccaacagcattcaaacactgccttatgtgtcaaccaagttagttggcatttggaataatacttggattcagcacagaatacatatcagagtaattcgggatggaatcacttgccacccttagaatgaacctgaaacactaaagacgaactaattcatttgggaaataaaaatgtaatcaccctcccttgtatctgttgcaacaattcaatctgcagtgaaacttacacttgtatcaagtgtgtggagtgttatcactgccattccttttataatcttctatacaaaaaccagtcataatatattctttcattttgaattttttataccaagaaactgatcttagtaggatttgtgacaaagaagtatgcaatcattcaacaaatattatcccaagagtaggaacaaatagaaatcaaataatgcaaggaaataactgaaatgcttcactgtgattatctctgaaattgtttttttctttatgctttactgtatattctacattttgtaaatgaagatacctaagtttcattactgaaaacacaaatattattaacttttaaagagactgggggaaaacaagatatgactgttgatgcatttaacataatacgaaagttcatgtgcatcctggaaatgaaaatgtatgacttcttccagaaattccctgaattcagatccaagtaccttccgattctccataaccacaaatggctgaaagagaggcttttcttttgcagcctaacgaacttcctttatcaaagagtacaaagaatctttaactgtttcaatttcaggaacatacagtatcactagtataaagtgaaaccatccaataaatggttccacaatgcctagtgctatgagaaaaaaaaatcgactattattctattttttcacaactcatatttttaaaccattactgatttctgaaatatacacctgttatctaaacttactcttgctaaatcaagctttgccaaacaggaatctgagggctgggttatttttaaagttttatatcttactcatatgccctctcaaactttctgagcctaatcccatgaaatttcccaggtgaaattcctattctcttctttaggtagcgtctgcctgaaaggcatatgcacacgtatgcgaaacccatgaagaccctcagagcttccctagggctgcgcgctcaccagcctgcctgttaatgtgacagtaacttctcacgggttattttatttcatcttcgcaacagctgaaaggggtagaaattgttgcatcatctttacaggtgataaaatcaggctctgaaactggcttagagtcacttaggtaggggccagcctctttttttttctgttattatttatcaagtgtctataatgtaccacacactgctctagaataaaaaactacagcccatgctcccggggtcaccaaacctttggaacatacttatgataaacatataaaaggttgttatttggaattcaaatttaactgggcatcatggatttttatttgctaagtctggcaatcctatgtattcatgtccaccatgccatacagcatgctaggttgactcagcggcccatccgatccttcccagcagaccatgttgatatgcaatggatggagacctccaggaatgaggtctgggatgaggactccagggatattgaattgcagattccaggggccctgggatggaagccacaagacacattgggatggagactctagggacgctgggatggacactctagagacattgggatggagacgacagggatgctggggtggaagctccagggaaactagaagacacagagatagagacttccaggaatgctgagatggaaaccattggagatattggacagagacctctagggatactgagagagagagagacaccccactgacactggaatagagaactccagggactctgggatgaagacctcctgggacaggtaccccttgaaaacaattcccagctgccatccacagccagaacaggagcataagacatctcttcaaaataccctaatttgctctgtggcttctcacatcccttaggaaaatcttgagtcactgaccaaaagccaaccacttgcagagaatgaagcgctggtctgttcacacagcacccaggacctccagagacaacaagagaatctcatgagtcaaagtcatagaaaagcctttccaaagttctttagagatgaatgagggatgcaagactcaaaacactaattggggtcacatttgtacctgccccaccccggtaaggggtctgttcccttgactcagagtgaaagctcattttccctcagggtgagctttggtgtatacagcctgccactggctcatgcccttgccagatgtaggtgtctgagataaattgttataatcccaacccccttttccctaagtgttcacctggatgcagaggggaacatagacaaattcaactctggaaataaatgtgttgaatcaacaggtatctttgagcttctataagcaggaaaaatctgtgctatatgctggagaaataaagaaaagacaggcacttcccttgccttctggtaagtcaccatctgataagggtgacttgtcaagaaataatgcaatattgtacattaagtgcagttaaaaaaaaaaagtagatgtccagtatgttactagggccacacaggacagagaatgtggtggttcaggactgctggtggacccttgagccaggtccttactacaagtgggagtttaccaagcagataatttggagtgggggttggtggcagccagtattccagaaaatgagaaagaggtcagaagggaaaaagcccagaggcaagaaagagcatattccataagtgtaggcagaataaataattccacatgcctggaccatgtgagaatgaaaacaggcaagtctggaagggaagtgggaatgcagggcagaagggctggcgtaccacaccagggagacagcttatatccaatgggagctactgaaggtgggcatttttaaaagatgatgttggctgtggtatgcagaaggaggagaacatctggaggccaggagactgatttaacaccactgcaaaacacaggccgaactccaagtgatgaaatttgttggaagtgagcatcagaaatcccccagtattgctactggactaaggtaaggaagagaacaccaagtagccttgtccaatccatactcaccgcctcctcacaaacgtcaaaagaggtgaaggtaacttgctaggtgcaataaactatgccaacttcttcctactcatgtaaaattacaaccattcatcacttcaagtgttgagtggatgtacaaggacacctcaagatccaagagcaaaagcaacgatcctagaaactgttcaatgtttatctagagtgcccagactataagctagatttagctgcactcgtgtttatagagagactgcaaaacctctgtagctatggcaggcatgctttatactctggtacatttggacaaaaaatataatgaactctccactgcccaatgtgccatccttagatgccagaggaacccaattctacaaatggaccctttcttaaactttaatgtcaattttcctaaaagatggatatataatcccaaaataggtaatttaaatgcaaggattatgcaggttttctaaggaagtgatagtgaaaacaggggaaagaactcaaatttgtttggattgtgttccagtggcctcattgtcaaactgggatgcagatgttgacctagatacgggaacactcacacccttaagagataaagataaaaataacttcgttgaatctcaatttactggtatatggcctaatcaaggtaacaaagaaaggtggtggtgggccttggggtacacatcaagatctctggatctctagaatcctactgaagaatatagtgggaagtcaggaacatgttttcaggagtcaaactgactgggtttggaacccaggtccatcttttcttaggcatatgccccggacaacttatttatctacttccttcctcagtttccacatctctaaaacagcaatgttgatagtacctacctcttaggtttgaatggaggaacaaatgagttaattcatgttagaacagttactggcacagggtgagggcccgatcaatgcttactctaacgggcagccatcaacatcttattagcagtagtatattttatgacactcatactgtatttcattcttataagaaataatattattcagcattcttcagttttgtcagtgaaggtcacatgtaactgcacagatgtaaaatgaagtccaaaaatatctgtggtggcaaaatacaatatctctcaccttgctcctacaacaagttctttctgtcctgggtcaaatgttaactgcgagaaatccacagcattcttcgctctgaactcccgtaaccaggggccaatttctaaatagaaaaaataaataaataaaaagataaaaatgaattatttttcctctggggaccacagatagtgcacatcaggtagcagacgttacatttcagagaggattcggaggtccctctatgccatctttcagaggccactggaggtttccctcaggatgccccataagccatactaagaacttgtaaagcacagagggcagccacccaataaagagcaagcgaggcatcaatgcttggttgtgatttacaagccagatgtgcattttccttttggctttgggctgggcagaaaataacacagcattcacatgattcatcagaggaatactgaatgcaaacaagaccatttcctgtgcaacttgactcaaaagagctgcagatttttaaatattacaaaagcctccttaggagcaaggaccaagcacacaagcatcatttgccttctttcaaattagatgttccatttccctgtcctttgggtttctattttggccccatgattagacttgttaaacacattccgacctttctagatgagaaatccacagttacttctaggcttcatttgcatttttttttctaagggaaatcagaaaatagccactctatagagacaggcttttacaagcacggttaactcctattagacagcctccagcccagagtccgataattataaaatgacagtatttgaggagagataggatgctgcttcaatgagccatttttgcaactttcattagctcatttttaacactaaaaaatattcagtgagttgcccaccaaacgtgggataccttatcattatcattgacaattaaccataacatctgattgtcgttttttcttggatttagtattttgaataacaccaccctgactaaccaggcacataacaactgtcaaatcaatgaagatgttggtttgaggaaaaagtgtgtgatacaggaaagaatctcctccaacaaacgctgatgctaaacacatcagtgttatgtttttaatgggggcatatggaaatatgcccccattccgtctcatatcctaaagaaatcgctttgttgatgtgaatgagagggactattttttcaggaatggttctgtataataaacatgtcttttctctactaacagttacgagggggaagtgatatcaagtaaaatttatcttctgcttaaaggaaaccaggggtgagtcatatagagagggacttgtaatgtatatgatagcttgatttttttaaggattttcatataaatttctacattttataggcaaatcaattaaaatacgtagaacaaggtatgtacaaggcaatggaactatgaaaagttattaataatccttccaggactttataattcagttaaagaaacagcactagtatctttaaacagggtgtctatcaatgcaagtgtttataggggcttgtggggttacaggaattattcttatatgaaaagaagagatgattgagagctgcagtaaaacaagaggaaagatttgaccagagagtgacaggaaagatgtcctagaggggcaaagcaagacagcaacatgggaggccatggtgccccctgtggccataactggtatcactcatcttcactccatcaatgcctccattcctgggcaaaagagaacccaatggctcttgcgtctgcattgctccctgcagtgcatgcagcatacaaaacagcacattgaatgcgataggaaataataaatatgtgaaatgaagtaagaacaagtaagtgagttcaagagagaaataatcaaaaagaaaggaaataagaaaaagagaaaggagaaaagaaaaagtaatagcaacttaagaaactactaggaaaggaaactgaaaggtgtatttaaatacaaactgtagaaaaattcactttcaggttaaaaggtttggacttgatttcatatgtgacagcaaagctttgaaacgttttcaggaaaactcttgacccatttgagcagatgtctttggaatatcaatgagcccttgatagaaagaatggtctggaaagagtagagaatggaaggaaaagtagtatatttttaaaaacctaaaaacctacaatttaggtattggccttgaaaatgaataaagaagatgtgggatcactgattagagatgaagtcaaggtaaacaacttaaaaagaacaaaacagttaccaaattaaatgaagaagaaaacagtgatgactgagacaggcatcagagtttgaggtggctttagagaaagatagtaaattcaggtgcaagaatgggaatgtttcaggtgaaaaatttccaatggtaggttggcccacagccattgttaaacatcgctaagacctagaaatgtccataaagatgttctagttcaggaggttcatcattcagatgggaaacacatgaccagggagcactgccaggaccaggctccagagtgaatatcaggggctctgttcaccacaactcacagcccccagagctgggctcacatccaatcttcaaaccacatgagggaagaacagagggccaagggctgaccttcctgctaggggagtgaagagatgagcctctaagaggaaaaaagactacgaaagatagaagaaaatcaggttactcttttcccatgcattcatctttctttttatttagaagacttggaagaaagtggccaacaggaaccaggctaaagagacatacatcaggttttggtccctatactgaacaacgggaaggcagttttgctacttcctaaaataccctgaagtaataaaaggagtcatgtacagaggaaaaaatgagttaacagcatgtagttctgtcaatattgttcaagtttccttatttgaaattctaatgaactttcccaataaaactgtgtatttttatggttaacatagatcaaagttgagtaatctgcatattcccttctctttcctccagaaggttggccatctcaactttgcatattacattggcttctatctcactgataccaagagagccttgcaagaaagtctctgcaccaactcacctcttgaactaaaaagaagcctgcaccaatacctatcctcccaactttcccaacagatcagagaaaaggcactcaatcctcttttcaaagaccagttgctctcatctcttctttcccctttaatcgcttctcaattacctaggctttcctctaaaatctccaatgttacctagtccctttccctctgcctatatgtacatcctctcctatttcaaaaagcattacatatttttattacactcccttgttattatagcttcaaaaaccccaataaaatgcataataaacttccaagtacaatatagcaatatatcaaaaaaaaaatcacacacatacaaacacacacacacacatacacacacacacacacacacatacactatatttcatagggaatagggcttagcccagaaacgcaaggatggctcagcaagcttagtaacagaaaacctattactataattcatcatcacaataacagatttcagtagtagcaggaaaacgtcatcaatactgctttctaaggaatcagaaaatgaacagttttggaaatagaagatctaaaagagttcagggcaattggtcacaaactagatgccagaggaagttcggggagagtgagggagcaggagggggtccacagcaagtggtgaattgaggggatacaattttcaataacattaagatgctcattgcccccagtgagtttacctttttcctcctatccctattttctgatattgctgaaataaccatatgatgaaatggagcttaaatatggcagccaatatgactatatatatataatatatataatatatattatatatatataaaattggaagttaagttataacataaaatttgtaaattccaactgaacacttgatagataattcataatatttgaggttaactatcctagataatccaatttttacacatatatttacgtgattgttgaaatatggtctccagcaatgattttttattgcaaaattacattcattgattcttagttgccttctcttacagctacataagctcgcatgtgattggtgtataaaatattttatcaaaagtataattccattttttttaataatccagtcttacaacttcaagaaacgatttattttatgaacaagtcagtattaataatttggtccaaaatacttgacaaatataactagagataagctaaatagattcaagttaatgtcccttccaaaaaagaaagaaaaaaaaatcaaagaaaaaagaaatgcaaagaaaaagaaagggaaagaggggtaaaagctactcttttaaaaaaagcagacactctaaatatagccaaggtaatgatgtttgtaaaccaaaacaacaacagcaacaaacaaacaataaagggcagctcttgtggaagacatgacagtcattccaaaatctgactgagagccactccacatgctaacacctgcagcgccaactgtccagaaaccaatctgatttgttagcaaacactgaccagggaaacctcccaggcacactaagggctggctccggatacctgtttcattcctcacaccttcaaacttcagttaattaaggggctgagaaagcaggatttcaaaagctatatgggtgacttgaaacccacattggaaactaagattcaagccaaactaggtggggccaggggacggtgggtaaagattgttgaaaagcacggagagcaacttacataacacacataagtacagtatgtagaaatacaagtgcatatcacagcctacttctatttatcatgtagttatgtaaccgatttagtctgcatcatgacaaaataacgctaacaatatgattatcagcaagacagctcaaaaatagctaatgtttaaatagtaggttctatcttatccactttataactattaattcctgtatttctcacacctgccttatcataggtgaagaaactgaggcattgtaagagtgagtgttgccaagatcaatagctggtaagatacaaacccaaccagcatagtttttgtggttctagccactatgctatattattaaacttcagcaaatataaaatttagcttcctatacagcacatttggaaaattacaggaagaaagaaaaatcgacagcctctccactttgaaagttactctattcccattgatagactgttaagcaaaatcactacgcactcagttttcaactatggactagagaaaaatgaaatacaacagaaagctgggtctctcaaaaccagctactactttaacctgtgaataaaatattgattgtttttgcccatgttaataagggtgatgatctacacaaaaaccattcatcattttttattacccaagtgtctttatgtaagtatggaggaagaaaatgacaaccatgtactgatctgctttattggagtaaagaacattctgaaatcagaacgtaggaatgatacaagcactgtggaatgcttgagtttctaagcagtctaaaccactcaactccaatacaggagttggggggcagggacaaggtactgtcctgaaaatgaaagagctgtgtcttcacctcctcaagatgggaaccttctgtgagcagcacaggaaaagaagtacagggcatattctctgtggagaaattctggaagttcttttttctgacctcttcctgaagttgtgaaaagatccatcctacctcaaaggtagggacctattactccttaaagttggcatgcttctcccttctatggacttcatttttggtttcagtgcattacataaaccatcctatcaatgaaatctgagccaaaactatgatagaaaaacaagggagtggaatgtttaaaagctaacacaagtagaagaagagcacggcaggtctgtgctggtttactatgctgtgtcttgcctgctaccagtttccttccctttcctttgcagtttgcgttaccaggcctgttacttcaacaaccactcagaacaaggtaatctcactttggacaataaatcagcagcaaccccatgccacgtgtacccccaaaataagatacatcaggctttcaaccaacttggttccctcaaatcttttcagtgattatcatagctttcagtcccaaagcttcacacacttgtctggtgccagcgtgtgaatgcaaaacacgtcataagggaataaacatgcacattcatagatgtttaaaatatgctgctgaaaaacatacatatcagaataaccaacatttcttacttatacttctttatttactaactatattttcagtactgacttggtatcaggaattgtatgagatacttttacatattaactatttttatgtttataatcttgtgaagcgagagctatcatttttgttataaaatttttttaaaccctgaaattttgacaagttaaatatccaaacatgacataaggaataagtagctaaactggaatttacatccagaataaggctaaggcaatatttctataagacacagattaaaaatcaattttccaaggaatgcataaagagcatgaatccttactgcctagtaacatatacgcatggattaatttatcaaaaatggtagttgtacccagcaaaggagagaaaaattggaaagaagggaagctggtaatttccagataggagacaggaatgttccagcttggctgcccactgagcaggacataagtgaaggaggagtaccccagagaaaaacagaaagaaaccagggcacaccccaggcagcaagaagtccaggggaaagaagatctcaatattggagaatttatctccctcaaatgactttccaagacaagtcctatttacattagcaaactccaaaatgtacagatatgctaaaccttacttttgctttgtagaaaggttggaaaatatgaggccaattttttatctccaaatatatgagcctctactattttcagtataactcctattgagggcttagttgaatcaaagcaggttacagcagggcatgacattagctgcacttcagtccagcccttgactttatagttgagggcaggtgtgttacaccacctgcccaaggctatgcatgtgcagtgagctggaaaatcccaggtcctaaggttcctttgctggtctattttcttccccatcacagcactagtagaatatctaagtagaagtaccatggctgaacctcacctaacaccggcatttagatcctgagatttgacaagtatttatggtatggcctgaaaatcatgcaaacaattgaaaacatgaggtaaacccacccctgtttcagaaaggtagtggatttcaattggttacaagatgatcattgtttccaatggaattctgcttcctaacattcctcttaaaatatccaggaaaaatatcaaacatgtttctttagttgttctatattatccttcaacaatctaacttggagaaatgatgggcctggaaagtcacatgggagtcccttccagacatgaagcctgtccaccacctgccctggcagccttggtcaccagctgcctccccatgcaggcccctgctcctgccttcactggaatgcatgcattctttcctacaatttcacagattggtggttagtatttaatgctgatttacattatggatatatatttataacatggattccaggatgtaaaaaaaaaaaaaaaagtggtctgtaccaggctgaccacattatctgagcacatgaaaatttctaaatgatagtattttaaatgaccaaaattatatgtatctatagttatcaatatatctcagtcccaaggccatcccactcagcaagcatcctccttcaaactacccagtataagaacaagaaagctcttgcagactgcacttagtgaagtagattaagctttccaaatgtggattatagtcatattgtatctagatatattgtatataagtatatacacaatacatatactgtattatacacaacacaatacatattttgtgtatatgtatgcagtgtatatgtatacacatgtatttatttctatatatctgtatacatatagacacacatatacatgatagggagagaaggcagagagattctaggtggacatgggagggtccctggagaagaatcaccctcaagcttaaaagcctgacagactgcagcccaaagtgacaacttatattctgttttcctgcttgaatgttaccttttcctaaaccacccatgttcccaccccaccccatcctgtgcctataaagaccccagactcagctggcagagaggagaagctgctggacattgtggactatggctggatgttggagagaagttggcttgacttcagagggacagtttgatggtgtaactttgaagaagaatctggccagagatgtccggactccaggggaagataaccttcctgccccatcccctttccagctccccttccactgagacccactttcattggcatttatcaccatttacctccacatttaccacccttcagttcgctcatgtaacctcatttttcctggacaccagacaagagcttggaaaccatgggggcagacacaaaagggcctgctgagctgttaacatttaagctatctgcaggcagcagagctaaaagagcactgtaatatgccctctggggtttcaggggtcacaggttccccactagatgttggtgcggggcctacagggagttggctcctgccagcatccaaaattgctcaccctggctcctgcatctgctcacctgtatgctccctccagcatggggtggaacacggagggtctgagtcagtggaactcacccctgctagtgccaaagtggccagctggttccagcgtgtgtgcactccatttccggcctcgtttgcacactccctcccacaggagttgagagctgagggctgagtaaatgaggcatccctatcacaagtcctgggaaggggtcagggaaatatctggcttcatacacacatagatatataaatataggcatcaatgtggtcattgtgtatatatatatgtgtgtgtgtgtgtgtgtgtgtatatatatatatatgtatttgcctaagtgtattcaaatagatattatagacacttaatagactacagtagaaagaaaaaaattatctcaaaaaatgtctacaggaaatgagtctgtcccatttatagaacttttaaaaaacaaaaatatttaataataaccaattagagaaattaaaacatttcgtatcacgaaaaaagacccaaaatagcaggaagcataaagcatctttcatttgcattttcctttgtaaatatgacactgaaaacacagcattttaaaaatgcaagcagtgctttttcgaatcttttctggtttctattgcagtctgttgaaagtgagtcaagtgttctatcaagtcttcatatgattttgttgcattaacacatagtatacctaacccatttctcacatgttcattgtagaaaaatattcacaaactacaacttttgcaaaaggtctacactctggatttggattcttgtgaagttcactgtttcatcttgggcaggcttcctggtggatgtctcagaaaccaaaaagctgtgatagctcctttttactcgatgagttcctgattgggtcttccttcaaacaccatttgaaaactacaagcttgtgtcacacatttttttcttttcttttttttttacatcctggaatctatggcataaaatgtatccataatgtaaatcagcattaaatactaaccaccaacctgtgattgtaggaaaaaatgcgtgcactgtttcagtgagggcaggagcagggacctgcatggagaggcagctggtgatcaaggctgctggggcaggcggcagacaggcttcatgtccagaagggactcctgtgtgactttccagacctaccgtttctctaagctagatcgtcgtcacaagataatactgaacaactaaacatatttttccttggtattttgagagaaatcttaggaagcaaaatttcactggaaccaattaccatcttgtaaccaattgaaatgcactacctttctgaaacaggggtgggattaataaattccactgttaccccacgttttcaattctttgcatgattttcaggccataccacaaataacttgtcaaatctcaggatctaaatgccagtgttaggtgagggtctggctactccagcccaaggagttccgagtcattcaagggttgcctcagacccacctggcaagtgcaaagagacactagtgaaaagttgtctgtaatctgagttcaaaatctgcctcacaggctagagttgccttcccttttgtttataactttcaagatcttggtaaattcctatttcattaaaccatctgaagcaattaattaggataagaaacaagctgataagtgcctgggttttattgctagataactcctagaagaagcaatttctactcatccatcaggaaagacagattttttttaaatttataagattatgcaaattcatatattataacacaaactaagcatgaccctcaaattcctggactgtgattaactttgtccttcaggctatgaagttggtgcccagcctgcccctcccttcaactttacgtggcttcaaagtactttgagtcacccataggaaactttgcccagtgcagaagggttttcattttgactcctgacctgcagcatatgattttaggctataaaatctaattgcaaaatctccatgttgtgacaaagaacaacaaaaagtaatttcccttagatttataactttagaattacaaatgatgttaatatgactaaaattacaaaaatgaacaatttctattcaataggcacttagattattccagaagtggccaaagtgctggctgtgtaaacagtgatagccagaagactgacagcaaagaaagccattcgccaccagataacgacagagattgcagaggaacgtgccagagatttcttagagccttagggtgtgtggttttaaaatatccagaatagttctgctacatattcagaatttgccagacctcagctttaagacaataaatcatttgcttaaggaaaatctctttctgtcacattctcacaattcacacgtaagtttcctgtctgcctcctcactataggaaaatctttagcttctaatctaagccactacttcttcagaccttaggattcaagggaagaagaaagctgtggaactcaggagacaagacagggtcatgcaaggaaggcttcttgcttgaagagaggtctaataagtcccaaggtggcctctttgccgaagtacagattctatctacacatcggaactagaacatatttgccaagtcagaccaaggtttttccaggaactttagggttaagcattaggtggatgtgcaccaaaaatactggggcagcacaataattcatgtacgtagtcaagtaatatttatttattgagtacctgctacatagaagaaccaactgtaggtactgcctggaatacaaagttatataagacagacctctgccttcaagacatttataatttagctaagaagatgagatacacacaaaagagagttaaactgaagaagataaatactatctgatcccagggaaaagcataaagatgataaatgctctaaagcagcaccatccaatgaaaatgtaatgtaagctgcacatgtaattttgtatgtcccagtagccatgttaaaatgctgttaaagagggttgggcacggtggctcacgtctgtaatcccagcattttgggaggctgaggagggtggttcacttgaggtcaggagatcaagaccatcctggctaacacagtgaatccctgtccccactaaaaatacaaaaaaattagtcaggcatggtggcatgcacctgtaatcccagctactcgggaagctgaggcaggagaattgcttgaacccaggaggcagaggttgcagtgtgccgagattgcgccactgcactccagcccgggcaactgagcaagattccatctcaaaaaaacaaaacaaacaaacaaacaaaaaaaaaacatgctatcaaaataaaattcattgaggtatctttgtgtatgtgtattctaagtcttcgaaatccttacacttactgcactggacacctttcaagtactttgaagccatacctggagagtggctacacgattggacagcacatacccaagatattaagaacaggcttccttggtaacatggagcctttgttggatggaaaaacaaattaacttgtcttcttagaaccagctgccatagaggtcagcgcaacctaatcaggcactgattccaacaaaactaccctgcatttaccaaatatactgatgaaagtaacacagtccttggaatttggttgatttaggttggaatctcacaggcagaacttttttctcgggaaccgtattcataagtgagtagtttaataatgggttgactcagcaggtctgcggtattcaagccaagcatgttccaagagagtgtctggtctttgactggctgctgggaaataatatctaagcccttacaatattctgcctgataggagtgtctctctctcttgacctgagatctttgatccatgccagatagtctacactaacaatgcagtttacagtggggacctgtggccaggctgcatctggttgacttcaggaagggctggagtctgagtaactaaggtcagccatgcaagcattccatgcttttgtgatcaaccctcaataaatccctggacaccaaggctacattgcatttctttggttggcaatattccattcattttgccaaatgtcatttctgggagaatacagtgctgtccttatgactgcaccgggagagaacaatctttcccaagcttttctgagctcaggatttatacacagtctttcctaagctttgccccacatgccttttatgggtgctaactttaatctacatctaccccatcactgtaatcaaccctaactgcaagtataaatgcttttctgagttctgtgagtccttctagaaaatcattgaacctgacagtggtactggagaccaccaactcaaagcttctccctcttgtgatgataagcacagtaaacacaataataaaacctgtataaatatccctggacacagatgtgttagtttggaagagtcagaaatatatagaaatcactgtctcactttatcagggcattatggtacctgcttatctaggaagagatccagttccctccaatagcatcagaatctcttaggcagcaatctttagcttttacaaagggtaaattccttcctaggatcaagcttgaaacttctttacatgagttataataggcatgtggctagaaactagacaaatgccactcatgatccagttccctccaatagcatcaaatctcttaggcagccagcctgtaccttttccaaagggtaaattccttcctagaatcaagctttctatgagttgtaatagatatgtggctagaaactagacaaatgccacttatgatataattagtgcatttcattgttatctttcttcacatattttatagcccccaccgtttttttttcaaaattaacataagaagtttattgccttatgtattcttactttgtactgtctcacagaaaccagtacattaccaacaaattaagaaaaaataatagacattccattccatttttcattattttattgagcaattaacactgttattcaatgaagaaagccaaaatgcaatctggtttgcataaatatttcaacagagtgggacagaagaaaagtcagatcccacatcatgagtgtccccagttcattgtgaaatacacccacacagatgaagacatattcttcgtctatggtgtccccatggacttccagacatatggactagctaaaaacttttggaagccaatcaaatctcaagtctcaaagctgtactctacttgcattggctttctctgtctgcaagggtctagagaccaaggcactctacctttagccttcactctttctcagactccgctgcttttcacttctctctcatcgttcattcaaggagacccccttagccttgctataacactgattctcatttctccatgttgatatcaggattccatcctgtctgaattatcttcctatgtactccctgtttactcaaattctaatgaatgtaacaggtcgggggggttacttaagagtagggtataagtttactaatatctgtgttctcttatctagtgaaatagtcttcaatgcatgtgttaaaaggaacatgggtcatatcaaagcagcatgcagtcctacatgtcatctgtattcttccttaataacctcactaacctccctcctttccaggccaccagacactaccaatctgatatatctttttattttattttattttttaatttgtatctatctatccatctatctagctatctagctatctagctagctagctatcgtctatctatctagagatcagtttatggcgctggctaatttttgtatttttcgtaaaaacaggattttgctatgttgcccaggctgatcttgaattcccaggctcaagagatccactggcctctgcctcccaaagtgctggaattacaggcatgagccaccatacctggcccaatttgatataccttgactagtgattgtgttcgagaagcacttatgaactatattctatcattcttctaatcattttacatgggattgtttatatccaaataatattgtgaatttagtgaaagaggtcatctttaacatttatgaaatataagtattagtctctaggctctaaaagagggattggcaaactatggcctatgggcccaatctatcccatcacctgtttttgttaataaagttttatcagaacacagccatgcccattgtttacatatgttctatggctggatttgtgctacactggcagagttgagttcagactatttgacctgcaagggccaaaatatttactatcttaccttttacagaataaaactataccaacccctgctctagaaaatcatagagtaaaaggctcaacaaatatgtattacagataattaaacatgctaagcatagtgttttagaaatgaaagaaagaacaaaagaagaaggaaggaaaggaaaggaaggaaaggaaaggaaaggaaaggaaaggaaaggaaggaaggaaaggaaaggaaaggaaaggaaaggaaaggaaaggaaaggaaaggaaaggaaaggaaaggagggaaaggaagggaaaggaagggaagggaaaggaaaggaaaggaaaggaaaggaaaggaaaggaaaggaaaggaaggaaagggaagggaagggaagggaagcaaaggaaaggaaaggaaaggagggaaaggaagggaagggaagggaagggaaaggaaggaaaggaaaggaaatgaaaggaaaggaaagggaaggaaaggaaaggaaaggaaaggaaaggaaaggaaaggaagggaaagaaaggaaggaaaggaaggaaagaaagacaattttaaagtaagaaggaaccacctctgggcatatctactcatacctcttccctaagactccagaagagtagagggtcttgctgaaattcacccagctagatatcaatgtggattagcttagaaagagcccctaatcgttcaccagatatcatatatctggtttatcatatatcacatggcatcaataaggaggagcacttccacaatattgcatcccatagttttatatggcatttaatatcttccggtgaaaatgataaggacatgcaggaaatcattaccctcttcacaagttgagtattttctacactttcacacaaaatcgttttgaaactccagctaattactatacttccatttcctctgagggaaaaaataaaataaaaagcaaaccttctggaattcctagcacagcctattagttaatattatctacagtcccataaagtcactggcctcacccccaggcttgctttggtatcagcagccccaagtcaaacaccaaagatgttaaactttaaaaaaagaaaaagcacgtgttaaaaaaaaaaaaaaagaaacaaaagctgacatttatggtttcagggtttttatttccaacagaggtggatttctgccacggcccagcaacccccagagagctcagcatgccacacctccaaatcaccagcctctgcaaagacaggttcataaggcaatgaggaaaataaatgtccttccattggctttgccctttttggtgtattttggccaatctcttcatgctttcatttcaaggtactaacctgccaagacccataagccagggggtataatagtcactcttgtttcccagcgtgggacgaagccatcacatggacaaactagaaagctgtatttacagccccactgacttcctgggagagagttgtgaattcaatgtcacagtctcatttctaatcttgtttccaatttttcttgacatgtttatattctcatttcctgatgtgtgccaaacagcttcagagacccttcctgctctgggcccagttttcatggtgtttgtcatggtgaactttaattatttgcttgaccccattaatgtttcttcactagaccgtctgctcccaggcacgtgacagctgtttgttcattcaagccttcgggcagcaaacgtgtacctactctgtgcctggtcctgctgtagacactacagacgctgcaggaaaacaagtagagaaggctgttcctctcattgaatgcttatccgaatgagggaggcagaatcaatgaaataaggagtgccatgatgtaactaaaacagagtaactttgtagagtgtgacttagagcaacatggtagagtctgtgaggaaggccagtctgtgcaggtaacatttaagctgagactggaatgacaagaaaaagccacatagaggtctaggcaaagggcattccaagagagggagttgtctggggaaaggccctaagctgatgatgatccagggcaaattaagcaagagaagcaggacaggagtgtaacgagagacaggagaggagaggtgtgagggaggtagggccactgcatgcattatcttgcaagtagaggtaaaaagctttggattttattctatgggagaggttggcaaacttgttgcaaaggtctggatagtattttaggctttgtgggaatatagtctctgtcataactactcaactctgcctttgccaccacagacaagagtgggtgtggctgggttccactaagacaatattcacaacgacaagtgggaggctgattcagcttgcagctatagttttgccaacccttgtctatggcactaggaagccaaggtatgtatatggaacagtcaagggggaggcatgagctgcgtggcattttttaaaaactcttaggactgtagcatggggaatggtctgcagaggatggagaatgcaggaaatgggatagaccacagtggtctagagaagatggaggaaaggaggcagatatgggaagcattttgaactaattgattagggaaataaggaaacgtgagaaactgaggataacacccgagattttcactagaacagctcaatctatggggtgatttctgagacaggagagatggagaaaaagtaaatttggggaacaatccaatagttctttcctggatgtctacgcggaggtcttcactagaaattgcaatggagaggtgagtaaggtgggaacagagaagtcctggagctcagaggggctgggcagaagataaaggtttggtagccctcaacataaagatgtcatttaatacggtgctagaggtgacatcgaggtgaggaacgacagaaggagaagaaaatggccactcattactgagagttggaagaaagatgtgtggagtgttctgcattagaacaaatgaatgcatgcagaaatgaatgaataaagcccacatccctgcattaggagggtcatcttattcctctctatctacaacctctatagttcactgtagaatttcagagcgatggctatgacgattttgatcttagaatcaatttgattatttaacgccatccctgatacataacccatttatcttcatacaggcttttaaggacttcccaattggattctgtttctactgacatccatataaattggaacctgctccttcccttcaattctttccccagaagtgagagctgatagccccaggtaagtccccagcccccactgaagacgcatttcttctctgagggttaccttgagagacagaggctctgttggttatgattagatggtttactaacataattgtgaacataatttgttctgatctgcttctgccttccagtcaacccacgttccgtatattagaagaagaaagggttggtgtgtgtgcatgtgcgtgcacacacacaagtgaagagtgtttagttctgcctgtctgtgcctcagggaatggaatgtaacagatgttacagtaacacacattttttgctttaagaaaaggatgaaggaggtggagtgggccaacttgtagacactttggattccaaatcaaaccagaaaaaaaagaaaaggctgcacacagttagaagaaagtgcaagcggaaaagaacccccaccaagttcaaagggacttgtgtttaatcagacaaaaacaatttttatagcctcgggagcccgtgtggtgtgtgaggaagttgtgcagcaggatggcattaggcactcaagccagcatgcttttgtgttattttcttctttctttgtttgcaaccggggttcaaagaaattcactgtgcaaaacagatactgaagtagatcatacccacgaattaacattgtcatgacaagcagctctgtgttatgagcaaaattacaagtgacccatcaaataaagcagttattgtctaagtaagagctcctttcttccaggattccaccgtgttgctagctttgtctcttccactgaaacgctcatgcacctgatatgaactccaagcagcctcctgaacatattcagtgagcctgacttcaagagaaagccccgaacgatgaggaattaccagcttgcaagacatagagaacccattccttctgaaaaatcattttccttcctgagcccattcacacagggctttgactgtttcctacctgaaggtcacatgcatggccaaatctccatctcattaattacaactcttggcaagccattaaaaatctcatttcattttaccatccaacctccttttaactgacttttcataattataattctatttttgatatactggacctattaaatttaatgccatacagagattttagaactccttaaaaaaagactcaaattggactgtgtccaccaaaggatgtgtagtccttgcttaggaatatgaaaggggaaaactgcagtgcattctattttcatccacagaggaagaaaagtcaagctaattgcatatggtcagtataataatgctgtcattctagaagggctataattagcgagaattgttttcacaaacaaccgaccaagcccatgactccagcttgcattagttcttttttccccaccagttataaacatttctatttttgctcctccccaaacataaacattactccattaaaaatacccagggagaggagatcctgacagtataactgcaaactctgggaatagacataagcctttttgcaaatgttgagtctgttaaaaggattagagtgccaagagagggttggaggaactattatccaacaagctaaactttacctggtaacatcaaggcgggaagccccaggtgaggcacctctcctggacagagaggagtgagcactccaaagccccatgtgaagatgaggggccattgggatctttcacatctgaagatatataaggcaaaacttacttagctccacgtcatgtcgtacagtatggatgaataactatggacaaaattctctctcactttaaactacagttatttaacaaacattatttggacaggaattatgatcagtgcattttccagtgctgaaattcaactaagaaacagggattgttgaattttgtcacactagactgagacagtggatcatctggagtatctagcactgattctctccccaacatatgttcagagtcctgttgctccagcttctataacacactttcttctgtccccactgctttttgtttggaccctccatacctctcattccatcactggttgtccacctatgccaagtctgttccttggtgcctgggcgctccagtcagcatctctaacatgaaacctcaataagaccaaagccactaagaaccacactggctccattttaccttcaaacccattttcagtgctgtcccttgtgcaattttggttctaactgtagtgagtgcttttggtccagggaccacccagagctcccttgacttccctttccttacctggtggtctgacgcctgtcgttctgactccagctgggatgacagctgccacagaacctctctgtgcatctccttcaacaagaggaagggtcttccctgtgcacacagtgtccagaccttgcctctcaggtcctatgctgcagcgttcaatttgtctattgacacatccatctttccactaaatggcaggtgcgctgctatgtcctacactcccagtgcctaatgcaaaggctgccctgatgcaggcacttgataaagatgtgattcaatgaatgaatggatgtgggttcaaagagtggctgaatgaataaatgtcaaacacattgatgaatgaatgaacataagtcattcagtgcaccctctatgttgaaagaaacgaagctggaaaataagacaaagcttgggatgctaggagagagttctttgaactacatttggagcatacctgtcctctatgctatgacaaatatgcctggaatctagaaaaggaggctctaggttgaggcattgaggtacatgatgagataattttctctcaaaattttttgattcaaggagcaaagcactggttcagaccctcttgcaaagacagtaggatgtggggctatggaaaaactcaaagtgaaaaaggtgagcacatacatgttaattagggctcagtccatttcctctcctagacaggcccccagatcctcagcagcagcacccaaaccagacacatacacactcacggacacacacacaaagcaggaataccacagtagcagctcctccccccaccagctagaggctgcagaatatgagaacctggcctttgcagtgtaacaggccaggaatctagcctctgctctgttccataagcaccatgggttcatggactagttaattaaattccttagtttttttcctcagctacataaaaggggaaaaatagtcactttatacaattttataaagactgaatggcatactgtatgtaaggcactcagtaagcatttgttgttggattgctattgtgaggcattgttgaacttgacattgctatgctcagcttggcttggtgtttatccagtagattccctttataacataatggccagaataaaggaatggccagagaaggaatttcctagcataaccagactgaagctgagttgatgataggttagacatctatggaatctgaaatgagtcagtccttcctttcctgaaggtcatgatgtaacttttgcacctataataactattcccctacagctgattttgctggtttttaagtcaaaatttaaccaattccaattaattccgtctttatatttgccaccactccatgttggcttgttaggcaattaagtattcaaattagagtaactctcaaatatttccttgcagaggaaaaacaaagaaacaaaaaactatgaaaaaaattaccctttaaaggcaaaatgtccatccagttttgaagattaagaaccactggggcagaagagggagaatgacctagaattcagaactgcaatgataaaattattcctttgacaacactaggtggctgattctcctaaggttgtctaatagatttaaaaatttttgctatccttgttttatggaaatataatgagaaatatagacatggttttgtttagtttttaaattcaagataaacaagaatttcaactgtgacattatctctcagcaatagcctttgaatctcttgtgttgttcaatgaactactcactagatgaaccactggcctttgcaggtattaacctctgcagtaggtcatcctacttcatctgtactgttagtaaattaatcaaaagctagcatcaggtatgcacacacctgcagagataatgtgtacagtgttctccagagggatgggatttgattctgtaggtgacactgatggaatacagcagtcagggtcttaagaaattggatagattaaatatatcacaaaagagacattttaatagtctaaaaatcagtaaaggtgtttttcaaaatacatataattgagaaaatatacactaccctaaagagagagtagattatgagatagagatgcaggaaagaactatctcaattgtgtcccccaaagcaaataaatttttattaagtccagtaccttgctttttaaaacaacacgatagcttacaaaagaaatgaagctttagtacacactcttggaaataccttttcagatgatggtgaaaataataaaactgcaatgaaaataatgacacccataataggacacactgggtgcatacaatattctcggcactaggctgagcaacacagtgggtattttacatacacattcctgaatccttgaaaaatccatgaagccatgtattagtacttacattattcatgcaagaaaactagaactctaaggaaaagcaagaaacacaaacgattcttttcattttataattttctttatcagtctgtgatttatcttttgaatgcctgattttctatcttcttcatcctaggggagagagtattaagttctttaacagcaaaggattaaaaacatagtcattctctccaccaagatctataaagtattttttaggggcataacaataaataagacagaaatcttgccctttaaaaactcaagtctggccaggcgcagtggcacatgcctgatatcccagcactttgggaggccgaggcaggcagaccacctgaggtcaagagttcgagaccagcctggccaacatggtaaaacgctgtctctactaaaaatacgaaaattagccgggcaagttggtgggcgcctgtaatcccagctactcgggaggctgtggcacgagaatcacttgaacccaggaggcagaggttgcagtgaggcaagatcatgccactgcactccagcctgggcaacaaagcgagactctgtctcaaaaaaaaaaaaaaaattgcaaacaacaacaacaacaaaaactcaattctatgcagcatcacatactttcttccttaaaaataagacaaagacatggttctgttatacagaaaggagggaaagtgatgaaaattataccagcattaccgccattttttctgtgaggtaggactgagtcacatatatttttatatgttgtgagttctagataaatacttaataaatgtcttactctgggtttaaatgtgagttaatctgttcctccctatgcatcaccttctaagagatttcctcagcattttcatccacctcataatgctctttctcactacgtctatactctgtctcatccacatcatgatcttttgctctgaccatattgatgctactaggttggtgcaaaagtaattgctctttacctatgtatctctttaaacactttcaagtctgttgggagttggtctattttgcggatctagggtccaaattctgtcactgattgttctgctgatgcgcttagttccattcattgtttcattagtgggtaccctttgacttgagttcaccatcaccaagaagctgtgtttacaagagccccaaatccagaactgagaacactgccatgggcatgaacactagagggcgctctcaaactcgaagatttggtgttaaggcccctgctggcaaggaaggttcttatttgggtacctcgtgggaacctagaaagcaggcttgaggccccagtttcgtcttcatgagacaatgtccacccacagccatcttcctcttctcgtcttggggggtgaatctgcggttcttttgcgttttccttttgcaggtagaacagctcactgtagcttccggattcagtttctggcctccctgctcatcaggctcaagcctcacctgcttctcccatccctgagcatgtttataagccccagcccccagaggcatttcaacttgggttcctactgaggattccagacttgacctctcttttttatttctgtcccctggaactgtccctttcttgctttggggacgctattttttaaatgccattatatgagggtaagagatttcaaccatcaactcggcctactgttttgctggaaatcttacaaaagaactatcttctgtatgttttcacctcaattccagagtaactagaaatactaccctacgagggcagagacacttagtttgaatgcgattccaatgttttcatgctgataaatatgaacattttaaatcttaagggaagataggtagttttaagtccgtcctttcaattttacacctgcatttaaaaatataatttaaactactatttaaccattaattatatcccaaaaaaagaggatatgaaaacccgagtgaacacagttaatgtacttgcccccatggttttgaaacccagcccacacacttcccaaactctgtagtatgctctcatgtctagatgaatatcaaatgtaagatgatttctatggttaggagctgagttgaaagcagaaactctttagtcttcaactacaagtttcatttttttatgtgcaaaagtgtctatctgcaaatgcacaaatgagaaacaacagactggctgaaaccattcagcaccacacctggctcctagggagtgttcaggatttctcagcgactgcctcacctcagcataatatttgtaatgcgtcttactttttacttttgagtttatttctttgaatagggtcaggaaaatccattaattaaagattccaggactctaaagtacatttcaaaaaagcagaattgttcatgagatcttataaccatcctaggttcttcggatattactttgtgtggttatgtggccagaggagtttggtctcagactataaaaggcataagtctttctaatctgttcataaccaaatatagcacacaggaaatcactgcaaagcgctgatataatcttttctgttttactccatctgaagatggttcctgcctgaaccatgcacactaatcatttaatgttctacagaagaaaagaacaaacagagcagggaggcagatgtggccacatactggatctacacttaaaacagtgaatggctgctacccccacctcctgcagtaggtaagggggggtcataattacatggtggggtaggaatgggtcaaaagcaaattgcctgagtgagagaagttctagaaggtcacatggtgagactggctgaaaagtacctccagaactagcaaatgttttcacttggcttgaagtcacagaaagagcattgcagcataatagaattacacatcctttgggagatatccttctctcacttggagtgtgaaattcttggtgatatcaaccgaagctccacatagttatggaggtaaaggaaactggaggctttgagaattacaaaacataccacagatggaatattatccaactatatttcttgcctcccctaaacatcagttacacggttctgtcaagagactcagagctgccaagggtcagttgctcagttgtagcaaaaactattttcaattcatggaatggcatgactaaatcaaagaaaaataaaataaaaaggcatttcaagtggccagaaaacatggggcatatggaagtaggcaggcgatgaggcaggatgttcatgggagaagcacagtatttcattagctcctttaaaaaatgttgctgaagaaacctggggtgctcaaatttggctcagaaggaaggggaagtcttaaataagtatagtaatgataaacacatgcaaagttcactataatcttcccactctttctttccttgctaagttaatttttcttatagcaggcatctttaacaaccatgtaaatttattattttcatatgttctttctttattctctctaaattccaaagattgcccttaagagctttcaaaatctgaattaaatcagagaagacattgaacaattttgtgcagacacctttgagagtgaagaactatatcttataaatggtgtgaataatgcctttggcccttaatacaaacttattttatagccctgaatgtaattcctactacatatctatattagtcaggcttcacaggtctagatgaaattcttttcatctaatattttcactgaaggagcatagcttttattcacaaggaacatcctaataggattttaaagcttttcccaatgagagatggcttgcttttatcatgctccttgaggagaaaaaagcttaagaggtttcaaataaacagcttatcaatatcaaatattatttaatcagaccaaagacatagttagattaaaattataagaaggacaaattattgtgcaccagctttcataatttttaattataatttctacaattttataacgtgagttatttgaaaacatacttagctattcctaaagagagtcaaattcccattgttcatctcaaaagtcataaaaagcaccaacagatccttccattctcccaaacttgttgtgactcatatttttgaatttcgagtcattcaatgtcttctaaaatacaaaaaatatattaaaatgaggaattatttattttcttctttgtatctcagaattgattgggaataatttgcaagggttgagttttctgtttcttgtcaaaagagtttctgttcagctatttaataaaacatgtattgagtactcattgttcagaaagagcccttatgtaaagcacaaggtggagtatacattttatttactcaccagggttttatcacaggggagacagacatattccacaacacatatataaggatacccatttctgtgggcagatgcattagaaaatatacagaactgacaacacagctgaggagaaagctaaactaccgtagtacggatcttccttgctaacagaacctgattttgttaaacaaccagggctggagcaagggcaaggctagtaagtacctcatttggagtgtaaaatttcaggggatcaaaaaatttcagtaatcaagataaataatattttaatataatatttttcaaggtctagattaatgcaaaaatccaggaggagcaaaccatcaacattttgaataaagaccctggagccccaatggggctcggcaggagactgtactgatcctgtctttatttaaaatctagagtgctgttcatcattgcttgatttttttgcattcagatagctttttaaaatattgcattagtatattatttatcttgattactgagtgtttcagcaccatttaaatagtgtacccaagatgagttcctcactcacctaatcctggtcccaggcctgctggactcaggacataaatggtggtttttttccattctcccttgccagacacttccttttcaattacacctagaggcagccacacaaatagctctggccattcatatgcaaacaattctgcacatggcttcatgtaagatttggcttttgttgttgatttctgatactaagcagagagcaaagaagctggttgcccccaccctcccactactgcctgtctctgaacactgccagcagccatcctaacatgaaataaaaaccaagggcaagagccaaccccgtgaggattattgagcaaaatgacagcacttgggtccttgctgccactgttgagctctgaaccagccctgcactgcttactctttgcatctagttaggagacaatgaacatccttatgatataaaccacaattagactaactatctattacctgaagtcaaaatatttctaatggatattctagcttaatagccagtgagctttcggggtaagggtttctaaactttactgcactgatgacttaaaacatgtatgttaatatttcatctctgaatcatttgcttctaggtagtgaagcagtgcaaattctcaattggaatatggctgtaatctctttatatggcaattaattgtggaaatgtatgcaaattggaggtcaaaccatcattcaaataaaatatactgattttttcctactaaatatttgtgacaaaaatgccagtgtcaataatgtcaacagaaatctccatttttattttgctcctgcaataaagaattctttttttttttttttagatggagtctcgctctgtcgcccaggctgaagtgcagtggtgcgatctcggctcactgcaagctctgcctcccgggttcacgccattctcctgcgtcagcttcccaagtcgctgggactacaggtgcccaccaccacgcccagctaagtttttgtatttttagtaaagacggggtttcaccgtgttagctaggacggtctccatctcctgacctcatgatccgtccgccttagcctcccaaagtgctgggattacaggcgtgagccaccgctcccagccacaataaagaattctattgtgttgttgtttgaggatgaagaaaggagggaattttcctgaagagataaagaatgtcccaaatgtcccttatgttcccttatttccctagtttcaagagcaatagaatcaatgtggtaggaaccttagatatagtagccctatgggctcatttttcacttgaagaaattgagatgaaaatggaacacaatagattttctatacatcagagaagcagttaacagcagattcacaacaattgcacaggtttcctttcctagtctggtattctttaaacatgaaccatgatgctttccaaaaaattgactcagagaggaggccaaggcacatgagtctctgagcagaacagcctacatcgatcttcgttaagtgatgctggaaggcaaaggtctataattatgctatccaatatagtagacactggcaataaatgactacattttaatttaactaattaaaattaaatacaattaaaacgtattactttagaagtaacatttcaatcctcaacagctacacatggctaatggctaccatatttgtcaatacagaatatgagcatttctatcatcatagaaagttctattggccagcactgctttatagccatgagttctcttattgttctgtttctaattgtaggaacaggaagaaaggaaggatcacctatagaaaactcaccctgaaaaggtaaaagaagaattgcatgcattactacaaaagctactcaggctaaatatgtatctctcttatttcctctccatggttaatataatatctattattccaaaaagtatttttatcacttaaattcaaaagcaatctgaaaatcaacaattctcaaatgtgatggcacctctgaaagtggtatactcagaaattttcctccagactgcctttgggagttaaataaattaactttcttatgccaagttaacatgaacttagcccttaaaataactttgtgaggaaaactttactgataaaacagtctgatatagtctggttgtttcttctctccaaatctcatgttggcatgtggtccccaatgttgagggtggggcctagtgggctgtgcttggagaatgggggaagatccctcatgaatgatttggggccctctttgccgaaatgagttcatgtaacatctggttgttaaaaaagagtctgggacatctgccctgtctctcttgctcccgctcttggcatgtgatatgcccatacccccttctccttctgccatgagtaaaagctttctgaggcctcaccagaagtcaagtagatgttggtgccatgcttgtacagcctgcagaactgttagtcaaataaacctcttgtctttataaattacccactctcagatattcctttacagtaatgcaaaatgaactaagtcacagtctatggtgggttttcattaaagataatcttggatttcaagtaatttgctgaaacatgtacacacacatacacacacctaggtcttattaaatgttacataacacattattcagaattatctttcacattgtaaagttctcacataatgcttggacgtgatgcccaaaaatatgtggcattgtatcctaacaaactcaggctatttctaaagcaatatgattactggatttgacactctcgacaagtttatgcatcctcatttgagttgggactaacgtaatttcaaaaattggtttcatagaggtattatttaggtagaataatatttactcatttaaatgtaaaatttaatgacttttaacaaatgtataaaacctgtcaccacctcttcatcttgatatagaatatttgcagcaactcaaaaaatctctcgtacaccttgcagtcaatttcttccttgaccctatatccaggcagccattaataggtattctgctgctacaattctatcttccacagaatgtcacataatgagataatgaatacatattcttttgtatctagactctttcatttagcatgatactctgagatttcatctagcttgctatctgtatttgtagtttgtttcctttttattgcccagtagttctccattttacataattaatttattcatttccattgatgaacttttgggttgtttccagtttggagtttttaagaataaagcttctataaacccttggatacaaatctttctgtagacattattcaatattatgttactgttgggaaaatacctaggagtgaattttctgggacttattgtaagtatatgtttaacttttgaagaaatgtcacatttcccaagtggctgaatcattatgcatcatcatcctgcattattaacaacaaaacaagaggtccagttgtgccatatccttgccaacacttggtattgtcagcctttctaattttagtcagtctgcagtgtgtgtggaggtatctcactatgcagttatgtctaaattgctagtccatttttaaaaattagattgttttcttaagttgtaagactttatatatgctggacacaagaccacatatatatatggtaaatatgtgtatctctgtgtgtgtgtgtatgtatgtcaaatattttgcaaatattcccacacagtgtatggcttgcttatccattttcttaatggtgtcttcgaagagaaaatgcttttcatttgaatgtggtccaatttatcaaattttctggtatgtgcttttcatattctagctaaaaaatctttcctaattcaaagttttggaaatatttcttatatgttttcttccagaggtttttaaatttttgctcttaaccttaggtctgtcatccctatcaggtaattgttgtatattgtgtgaagcaatatttagagtttactttttgcagagagatataccatttttccagtaccacttgttgaagactactattttctcattgatttaccatagcctcttcactaaaagttaattgacaatatatatgtatatgtgggcctatttctgatctctgctttctgttcattgccttatagttttcctcatgcaattacatcattgttttgagttcttgtagtgtaggtcttccaacatttccctgcagaacaaaccaaaaaaaaaaaaatggcagtgcaggagcttagaggcatacctggttatcattatgaaagttccatcgctgatggaacatgtgtgattagatgaaccccttccttcacttaacccattccctgccttatatttttcctcaacccttatcactatgtaaccaattctactacatgtctatatcttattattgtctgactctcctaataaaatgtaaactcagtgtgggccaggatttatttctgttttacttcctggggtaaccctagtaactaaaacaatttctggcacataataagcactcaataaatattgactgaattattaatgaactgggcctctgctttcatctttaaacaagtaattctctgtgctgaagccagagaattgagtggcacaaaaaatcaaacatacaaatgagaatgacaaccgttaatcaccttctgagagctgccatgagcactctgctcagccgttcctggcgtcagggtcttgcttcattgattttagttagcagggtttgcagcctctctaaggcacacccagacatattttcaaggtaggatgggtcaaatagtgttaccccgactttttacactggggattagaggaatccattcattttggtgctttagcacacaacatcactgtggatgacagcatgagtctggcaggctcttaatcatgaataagaacactttctcactcatggaacatgtgtgattagacttgcccctgagtcatatgaaggaattgggagagcaaaagagaaattaaagaataaagctagagattacctcccagcctctctttagtcaataataaaaaagattcaagaaaatacaaatttaaagtgttgattaaattaaaaaccaaagtaaataagatttggaaaccttcatgcagtctttttctgttgttttgttggtaacagagagacatcaccactgctatccactggagatggcataagctttgtctcccaaatgtaaccaaggtggcttaccttgtgctgatataaagagaagaaaggaggacataatccaagaaagatactgcctaattaaaactttactcaccccacatttaatctccaactcttcctctgtacataaaataaggatttttatctaccttcagtatgacaaacagatgaattgcccatttaatgcttagaaagattataatatacttaaagatagataaaatacaataacgtaccatttgaggccaaatggaaacactattttaaatcagaattctaacagtaactttacaaatccttattcccagttttaactcaatcaaattgcacaactttacttacaagcaatccactcaaagacttaaaataataaaaactatctccctattgagataaatcaaccaaaaaacaattgaaattttacctgaagataaaatataaatattcaatcttataaattatttaattagtggccctagaacgcaaaagtaacatgaaagttattaataattttcaaaactcaataaaccattttcgtcagtctaattattgcttataaaaatgcacaacagggaccctctcaggtctcatcagccaaagatcaataacaacattaaagtccagtctaagtattagaaccaattctctttgttaataacttatagtggttacatgctgcattttctcctaacatctctgtgcactcatgaataattattacatacctagattatagaattgaaaagtggttttttaaaaatatttcatttctccagatagaaaactgacaatatattttaaaatcagaaatgtatcccaaaatgcattttgtaatgtaaaaagcaggcaatgtggttataccttagctggttcctttgcaaatagattaaaatattttgccaatgtgattttgacattacatcacataaaacatccagtcatatgcatgataatgaaaagacaaattattcatggaacaaaggatatttaaggatccataacagcacgtttcctccccaagtaaactcttaagaggataagtcatatcctattctgaaacaagtgaagatcacacttggtttatgtaaattttagtttacagagaaaatgttgagttcaagacagttttcaacagttagcagtgtcttcctatatgttaatcagattcatatgaaaatgttaaaactaagtattaaaattaatgtcatgctatctatttctaattaaaataaatgttcttaattcctccttggagaaagtaggacattatcatgcaatcacacacatttatgatttctaaaggtcacagtggtagatctgagactagatgaacagagagaaatactggaagcagttttacccaagatttatatattcagactcagaaacctctggaatctcacagggactcgaggaatcctctactgcagcctgtcctgtggcaatgaggttgctgtatcctaatgaagaggctaaactcagccagtaccatgactccacacaactgcttggtgcattagacaccagacagccaaatcccagagaagaaacagagcatcatgagacacgcatggagccatgggacacgcatggaactgtgggacacgcgtggagccatgcggcatgcaaggagatgtggacgtgcatggaaccatgggatatgtgtggaaccatgggacacacatggagccatgggacatacatacatggagttgtgaacatgcctagaactgtggacacacatggagggatgggatatgcatggatacatggacacacataaagacatggatatgcctggagctgtgggacacacatggaaccatagacaagcatggagccatgagacatgcatgtagctgtgggagacacatagtgccatggcacatgcatggagccatgagacacacatgcatggagccatgtcacacacgtgcagccatgggaggcacttagatggcacatagagggagacatggatatgcatagagccatgagacacacatgcacggagccatgtcacacacatggacctgtggacacacatggagcctagcacagaaacatctccttcactcatccagcatgccttcattttctgagaggttacagtttgttgtaccttgacactgtccgtgttacgccttctccagccgcaggaggagcaggtggcaggctgagcaatgccagtggcccacaagacagcacggggtcaagggaagagtgacaggaggccagaaaacaggcaagaagggcagttatgatgacaacatgtaatatgcacatggccacattagagaagggcagaaagagcttcttagactaggagaggggctgggggcacagtgagtgaatacgagaaagagccaactcagagttacaaaacatgtcagatattcttcctgtcaaaatttaacaaagcaatgcatgcaacacacacataaatataatgtaatataatgatatgttttgaaaggaaaatataggatccatgaaaaataatcattcatactgtgatatgggaataaaacccaagtttaaaatcctaattggtcactttcagtcactgttttttcaatcatctaagactacatatggggataaaggcagctgttaaaacccaagttccttagggaagcagcagaaaaccaagtgcaaccccctagcccagtcccggtgatggcccaagctggagcagtcatctcaattccctccatgcccttcccaagccactggagctaaatgttgcaaatcctctatcacgagtccatgcagctcttgcttaagtttcagaacaattctcaggccaatcaataaacccataagtaggaggacactctacaggaacattaaggagttaaagataaagatcgctgggacctgggaatggaaatcaatagggccctgcctgattctgcaggcaggagtaatcttaggcattaatgctaaatgctgccagctaacaccctgaagaaaggcctccaaatcagtcatatgaaggacccacgcaaagtacagcatgactcacatcactggtggtctttctttgtgaataatgtgaaattgcttcccacaaaccaattcctataacaggagcatgctctctaaatagccagcatactgagtaaactttaatcaataaacaaacaaaagcagaatatggcacattgccttaagtagacattaaacatttaaaactaatttcagagatggttttgagactcagtaagcatgctgagaaacatgctgtcttgaagggtcactatttttcccctctttattggaatagacatttaaacaaatgacaaggacatatgtgtgaacggtgcatctgtaatgggtcagggtgttttagcagccactgcacaatcagggctaaatattccagaacacagagtcaggcaagtaaccttgcaaacatagcaagctgttaaagcgtgttatgcaatgaactccactagacaggaggagcctgcagtggcaaatatttcacagaggctggaaaaaaaaaaagattctaccagcatcttctgcctagccaggtaaatcagatcaagactctgacagaacatgctaagttgcatgaagacgttccgttaccatccagtccttcatcagtagcatcctatgcagaatgcctccagtgcataatactatctgcatggaaatcaggattttaagtcaagattatccggttctccctttatttccccttagtcagtgtttcatcctactttctcaaagtttcttggaatggtgccttacaaaaaagcgttcacggggagtcgcagagaccacttgttcagctgtaacatgagccatttcaaggcctgactgggtgcataacatcacaagacatcgtgtgtgtgtgtgtgtgtgtgtgtgtgtgtgtgtgacagagagagagaaaaatagttttattccctcctcagagaagcacttcctttctaaggccctgtactcttggcctggggcctgcctacccctcttcagccaagacagagatcttcaggaactccttcctctcccgcacccacccccacccacaagctttcctgcatcctgggtgctttggcctcctgccctccaggctcactggaggtggagttggcttcctataactttactgggcacctgttcccagttgctgtgccctcctacagcaccggggtctctgcttaaacaatcatctcccctctcttctctctctttagcctcttccttcacctcattccttcccatcgccatttgaggatggttaagtcatgctctttgaaaagctgttccctgccccttatgtccttgcatgactgacatgaattctctccttttatatctatcatctagtccctaacctttgatatatccccacacatatcaccatctggtttcttcccccaaccctgcactgaaactgctccgataaatgctgccttttatgtgtcctcccaaaagatatactgaagtcctaaccacaggtacctctgaatgtgaccgtatttggaaacggcacctttgcagacaaattgtttaagatgaggtcgtactggattaaggttagccctaagttcaacatgacttatgtccttataaaaagagaagacaaaaaggcagggacacagagggaggataccatgagactacagactaagagactggagtgatgtgtccatgagcaaaggaatgccaaacattgctgacaatcatgagaagctaggaggaagcagagatcggttcttctctagagacttcagagagaacacagacctgcaaacaccgtaattttggacttctggcctccagaactgtaagaagagacaattaggttgttttaagccatctagtgtgcagtaatttgttacagcagccctaagcagctaatacagtactgctgacagaatttctcagaaagtgacgaattgtcctggctttcccagaacagaagcaaccaggaaagtcccaggaagaccaggacaagtgtgtcactcttccttctggcatacacctgccttgaacactctgcagtatctgacgctctgctggacatagccttcttgaaaatatccccattcttggttctcagaaaggcttgccctcaactagataattccatctggtggctcacaggaactcagccttttccatctaaaatcaccacacccctcttatctgctttctcttcttgattctatatggaatcaacagccaagaatgtggggattgcagtcagggcttccttctcattcctgctctacatctactgaatcctcaaccacactcctttccaatttccagaatctacttcttctctacatttctgcctcccttcccttaatgcagttcctcctccctttggtctcagtagcagcctcagaatgggctgtccctgccggcattttgtcatcctccagataaaggataaacttattcagatgacttccaatgccaggcacctccgaatccccacttgccatgtgagcctcatgccctccacctcctcctccatatcgtaaaataagatgtcctgacttcctgtgcgtgaggcttgccaggacccgcaatgctccctctctcacttcagggcttatcacttgctcttttcctctccctggaaacctctcctttcataagttttgtaaacaccttctaacaatcacttgggatgcagttctggcatggcttcatcctagaaacctttttcaaccaccgtcctacagcccaggatgtgggcttagagcccctctcctaggctctgcagcacccaacacaggcacctgttaggacccttcacagaatattacgcaatggcccttttggttcacattcctaaaaatagtctaaacccttttaacaggaactgagcatcttcttgatctcctcaatatctagtaaaaaccctgtacacaacaggcttctcttaaatgttcattgaaggttcactccgaattaaaaacatgcaaataaaaatacactgagatgccatttatgcactgagtttggtccaaatcccaaagcctgacggtgtactctgcaggaaaggcggcagagaaataggtattcatatccagggcaactagaatgcaaagtggtgcaacctctatgaaagagaattgggcaacatttacaaaacgacatatgcattcaccctttggcccagaaatcccaattcgaataatctctttcaacggtacacttgcaaaaatattacataatgtttacaggaggcattactcactgaaacactatccatggtcacaaatggcagaaaataacctaagcatctctcagtaaggtgtttttgattaggttagggctcatcacatagtggaagctatgtagctaccgaaaaaaaaaaaaaaaagaatgacatcaatctctacactcttctagagagtaggctccagcatatatcattaggttaaaataatgttacacagaaacaagtctatataattgccacctttcatctaaggaaagagaacataaatatatatttgtatgtgtgtgtgttgctttgcttctattacaaaagtagcctaacccataaaatataggtaaatagctaaatgcagaaagagctctggaataggatcaagaaaacaggaagcaaagctagattcctttgaacaccttttgcttcaataattaaacaaatgatagtaactgggtcttgggttggtgccataaccacgcagaaagaaattatttctactggttttaaagcagtaattttgctaatttcactaaaattttccagtgaaatatatacgcgaggacaaaaaaaaaagagagagaaaaaagtcattttaaagatttttcaataatccaaaacaactaggtttgcatgaagctgttattctaaaatgactgtgtactaaagaaaaaaggcaaagaaataattaggttggtcagcagagacttgagattttgtgcaaggaagaaatagacactaagatgggaaaggttaacaaagaccctagagtcctggagatgagttgggagtatcaggagaagtttatggtatgttttaaaaatgcttttgttagcactgtccactgagaagacctgtgggcacctttggtgctcaaagcatacagaaatgagtgattcccaggtctgtggaaggaaataagtaaaaggaataggaacatcttgtcaacccagagagtaaagaagctctcaaagatgacttggatggagtcagaagagtccagaagctgctctcaagaggctacactgggcttaaaatgctataatttcaccatgtacaaggatgtaaactacatggattaaaatacatcaaatatgttgaaattcatgtattaataataattataataatcaaaataagaaaaaggcaaacataacatcttattcatcccctttggatgacaaatgaatgacctgtgggatgttaaagaaccaacctacttgtgtatttaaaaaaaaataaaagtataaattgatggggggcggggaacatttattttgcctttcctgcataaggtgtaccttcaggatacgtaaagagttgatgaaggaaagatagtttatatagaagtattctaaccattaaatgagcaaaataataaaatgagaaaatcccagttttgtacccacagatgaatcagtagattgaggctgtgatcatcaatgactgatcatttcccagctggatatgctctgcctcctgaaggaaatacgctgcactacccatgacacggtcaagacaaaaagatccaaacctggatctcagcaggtgtcttgagattactaggaatttacagacatctttggaaagaggaatatttgaagcacacaatcagaatgcgatgagcaaactccagactgtgggaaactgtccaggacaaagaacttggtttctgtaatttgcaaagggtgtgaaataaaagtaaaatattaaaagagactcaagaaatataccaaccaatggcagtgcatggaatttacttaaatctcgatttgacttaactggccaaaagatgccgaagtatttatgaacccatgaaagatctctcaatgccctctgggtgcttgatgatgtcatgaaatcatttattatttgtttgtttgtttgctgtgataatggtactgaattccttatctttgagtattatcaactgaaatctgatggataaaattatttgatttttttttaatttcctccaaaataatttaatgggtatgagatgaagcatgagtggaaatttagatgaaaaaggatggggatgggccatgaattgataagtgtggggctgcatgctccttagactattctttctttttttgtgctccttagactattctttctatttccatagatatttgaaagtgtttgatacaaagttttaaaaacaacaaaatataaaaccacttgttgcatgaattactgaaatacaatgtctcattcatcatatttagcctgataatataattccttgaggacagagatagagtctattttcttttccactctgaatgcttgagtgccccgggtgtgaaggaccttaaataaatttcaatgaatgaaagaataaatgagtggatatacagattaattatttaatcctaccaatccatagagatacttgggacattaaatcaattctgctgccatgcaatgctagatagaaacaaagggctaggtttgtggcaagactaaggctttgcagggaaatgccatagtgaagaattttaggctttccttggttttgttgttatttttatggtcacatttttatcctttggttcaaacacttaggaggcccacagtacctgttaaataaaggtgaccagaaataatgagatttttttaccttggtaatccctgtcttagatccctcttgaggtggtaatcagtttctggatatgaaattctaatgatagaggcttttgtagttttacctttattttaaactgtgtctgaaacaagagccactggattatacagcattcgtgatgctctattatcttctatcactaaacacagaatgtgcatttagatgacggctttgcaatcagtgcgtgctggttccttacctttataggagatgactggatgctcggttctctggcactgagtcgtaccctgggcctctgggtgggcgagtctccacagccccaggcttgagaacagccatgctataacacaggttcccttcatggtgggcaaggggcctctgactctgggcacgtgtcttctaaacagaagctcttcttctcctcatgtgtggaaagtgcctaaaacacacaaaagagaagaatcagatgactgtgagttcgttttctggtgggtggtcttctggtaaaacttcctcactaactttaaggttacactttgtggagatagaggagagcttggagggcttagagcagcatatttttctagtcatatcccaggtcgtgtgtgtgtatgaatgcatgcgtgagtgcgtgtatctcaatacagacctctcattctcccaataattgcatgacatagcccatttgttttaaacgagaaatgctcaagcttaagctgtactgtcgtcacactcactcctaaggaatgcagattaatagttgggattggccggatttcccttggtcacctgtcctaaccccttgcgcaaacacaggtctatatgtggaaaccctacaaatacctgcccatccctttttaacatttaaaatatttagttttaagaaggccacagccattgtcttttactaataaattgatgaatattatgctgcccaactttaaaaaatcatcacgatttgctaaattctgtatttagtgatgcaggataaccttttaaaattgtagataatctgcctgcaaaatatctggctagagatcaagtgtgaatcaaataaaatctatatcgagcacctactgggtgaaataaaagtactatgcttggaaactttaaagattatgaacaatttaaatgattaacaagcattaaagtaatacaggcctgtaaaaataactataatccaagctgttagcaaacctcaaaaagaacaggagtgctgtgggagtcaagggagaatacgactgctacagagaaggatctatgacgggtccatgcaggggctcaaatctgagtgtaatgctggaggataaagaggatttcaacagatggaggtttctggaaggacgttccgtccccagggaggaggatgaaaaggcacattggaggggcaagaggaagaggtacgcaacatgttttaggaatggtgtgctgtactcgatctaggaagtttaaagggaagtattgggaagagcttacagagtaggttaagatatggaaggcaaactacactaaggtgtgaggtctttattttcaggcaacaagctaccatagtacattaatgttagaagatcttattaatattaataagaccattatcacaatagtgtacctaggaaactaggcagatgagaacatagaaatggagaagtcagtttgaagccattacaattgttaagaagagaaataaatgaagcagtgactttgagggtttcaatgtgaatcaaaaggcaaacatagtacacaataactgtgggtaatggaaactacggcaaattagagatggccacagattcgggcattcctcccattgagagctggatctatgttctccacctggaatctgggttggctcagtgactgctctgctcgctctgctcattttaatacaacagaagtcatgttgtgctagtttccaagcccaggacctaaaagcctggcagttgctacatcctgtagcttagaacacattctttaagacactgagacactaggtcagaagtccaactaccctgagatggccatgctagagagaacacatttaggtgctatagttgatgggtcacacatgagcccaactctccagccatgagtaaagctgaaacccattgagtaatttcagtagatactatgagagcaaaagaatctctcagttgaaccctgcccagattcctgaccccacaaatgcaaaatgtaataaaagagtggttgttataatctgctacatttggggaacacagagcaaagagacacagatggacttaagatagataatgtaagtgacttcaaggatagtgatgccattcattttaataggataaacagcagatggattttgtttagatgagattagaatcattttgtgtgtgtgtgtgtgtgtgtgtgtgtgtgtgtgtgtgtgcgcgcgcgcgcacatcaagtttcagacacgtggccaggcatggtggctcatgcctgtaatcctagcactttgggaggctgaggcgggtggatcacctgaggtcaggagttcgagaccaacctgggaaatataatgagatttcgtctctacaaaaaataaaactaaaaattagccaggcatagttgtgtgtgtctgtagtcttagctacttgggtggctgaagcaggaggattgcattagtccagaagctcaagtctgcagacagctaagaatgtgccactggattcctgcctaggcaacagagcaagactttgtctctaaataataataataaataaatgaatacataaaagagagaggaactggaagaaaatccagagaaaactgaggggaaaagctattagggtcccaggaaagaaagtgaaagaaaggaaagaggccttctttaaaaaggagtgcttaccacctgaacaaatggtgagatttcaagataaataaaacatagatttgagggtgtatcaaatttcactgtctgtattttttgagtcaaacaaatggggaggaaggaaaagacatgataattgaaattttgaaattgaagagtagaaaaattaagggttaatttcatggaagttggctcaatatgaataaacctgaccagaaacctgaaggtccagctgagtttagagtctctcacccactcaatatttactgagtgacaactgcatactcagctctatgcatgtatgaatttgcaaaggaaccaagaagcatgaggtaaggcctattgcatcgataagcagcaaccatggagttgatataaggaagccaagtacagagtcaccaggaccaagaacttcagagcaggcagaaggttgaggtccttaagaatggaaggaattctacaacattcccattgaccaaaacattcaggttgggcagagaaacaggtaatggcactgcaaatcaagacaagggaagagtatagcttctataggaataagagatgctgagcatgaaggtggggatgggctagggaggaaaacagagagccagaggctcatctgtccgccagcccacaatccctgcccaagcacagagcactgtaatggacaatggatgagaaaatgctcattgtccctggattataacattaaaactatgagtttcacttttgaaaaggagttacagtgtgcaaaactggtgtctgctttagaactccagtccaaaggtaacaagatgaagtagcctatcttttctgagcttcctgatctgagacttaagatatgaaatgttatcaaatgatgtatttcaaaataaaatagcacttgttagaggtgctttagatgtgatttcattctgttaaaagcaaggaggtttggggcacccatatcagttcgggtaaattatcacagtcccacatcaaaacagatcagcaatgataaagataaaatgggaaggatgatgaagtggcaatcaatccttaatacatgctagctctgcagtaagcatggtgccaagcactcacacccatgcctggcacccaacagccacccagagccatatcaatgataagtccactgtcacagagcagcaagccatcatggagatgggttggagcactgccctgtcattatctccaagaatgagtgcaaatcaactagggactaagagcacattcttttcttacacatagtttttcaacgtgcacatctaagccaacatagattccccttctgctaccgatgaagggcatcatccagacctgcttgtgaccgcaactgtcctttatttacaatatgccctccactctgatcttaacagacttgatgttagaagccctaacatctttgccacctgaatgaaaggaagagaaaaataacccaagtgtctgaaatgctctttccttgggatttggaaagcgacaattagagaagaggggaaatgacacatatagagaatgagcagctaaaatggaacacgtagttcaagggtgatgagctgaaatgacatgtttgtcatgttaggaaagaacatttaatgagaacaggtaattttttgaggtttataattttcagactacaacatagtaccttttttcttaaactaaaggtactgtaaactgtcattacagtaaggtgacaggaaagggcattcatagtcttcatgcagagacgtgggcttttttaagcaacttaccatggaaggctaactccttgaagaggcttttactctaaatagactcagctctaaatagcaggtccctccttcccggactcagcaggtccatattccactgaatcatggagctcttgcctctcagtggtgtaggaggaacacattcataccagggcttttagtgctcacgctcagcactattgatattttagtcatataatcccgtgttctgggctattctatgaaattagcagcatccccggcctgtacctactagagctagtaacaccccctcccaccaccaactttgcaccaaccaaaattgtctctagacaatgtcaaattgcccctggttgagaacctctgctatagatagatagatagatagatagatagatagatagatagatacatagatagatagatagatagatagatagatagatagatagatagatacatagatagatagatagatagatagatagatagatagatagatatagatagatagatatagatagatagatagatagatagatagatagatagatagacagacagacagacagacagacagacagatgcatacatacatctgcatatgcatacatacatagataacttccctctttggaagttaaacaagctgccatgacttgaaagattattcaaaatatgcttatataaaacaccaaactaaatttgtgttgagtcattcaggcaaaatttcaagatatatgaaattcctgttaattataactatgtgctacatttgggaaatacattatgaaggaattttcaaaggatcaaagttctatcatcattcaaccaactctagaaaaataaaaatatattacgtgagttaatatgaaacaaatgaatttgccaatatgaagatttattctagaaagccaatttgggagacaacatataagcatttttggtgcgtctacttcaaaacccctgaaacccctaaacttccttttattttccagatgtaggaggatatctctataagctcgatctaaataagtacaactctgtatagaagtgtttgtgcaataaataacatttctcattcactcccacgctacaactgaaactgaataggctttggggacagaaaataactgctccttttaggaaaaaaaattgctgtcagataaaaaagaaatcaaaggaataaaagcttccatgaggcattttgcttagggaacagtgtctaaccagttattagtaaaaacagatccaacataagcttaatgtacttttcagaggaggctgggtttcttctgagctataggcctatcataaagatggatatagcctaatctgttggtatagtccagagagtccacaaacccctcctgcgcccatcccctacttgatggcattagagacttgctttggcaaaaggacaaaggagtcaggtgagtgagctgacctagtgaggtggcctcagagatgtctcaggaagtcctgtcccatgcatgccacagcaggacaatccttagtaccaaaaggctgaagcgattgctgcatgtgtgtctcttaattaggaacagttacagattgtcataatgtaaaaaaacaaaacatccaggatttgcaggagaaggagttggaaagcgcttttttttttttttttttttgagacagagtccagtctagttctgttgcccaagctggagtgcaacggcatgatctcggctcactgcaacctctgcctcccgggttcaagcaattctcctgcctcagcctcttgagtagctgggattacaggcacacaccaccacacctggctaatttttgtttttttagtagagacagggtttcaccatgttggtcaggctagtcttgaactcatgacctcgtgatctgcccacctcagcctcccaaagtgctgggattacaggcatgagccatcacgcccagctggaacgtgcttttcaaatgtttgtttttgcatttgttctttccatttcttagccctgttttaagggatcagatgaactgctcacacagaaactagagtcgccttccagactgaatgcagaaatactaaagaatcattccagcaaacaaaccaaccccgaagccatgccctacacaccctgacagagccaaagatggggtccagtgcatgattgtcagctgctgcccagtaaatagttctgcgtattgaaaaactcagtattcagcttctgcctttcaaaaaaaaatcatgcttttagaggaatagctgagaatgagctccttcttaatctgtctccactactcacactgcaagaccttccctgtggtccctctcaccttgccagggtcctcagaggcagccttgcacactcagtagtcacatctgcacccttgctgatgtcatgagcccctcatctgtctagtcctcccactgctcctggtgcagactgtcttccgtggtcacaccatggtggctgacaccagccacagcggcagctcctttccagaaacccagatgggacattagagtgcctgccacaccactgcttccacgtgaaaggttgccttggagagacccagaccttttgtttctaagtcttgattaagttttgcttctctcttttattgtaaacaatctacacatagtcccaatgccaagtgtatgtgctccaacatgctgaattggctgcctgaatgaacctgagaaaacagagctagtgtcctatggaccatttataatccacccatcccctgccactgagtgagcccattgtgaggtggcttaggcccttggtacatctgagacaagaaatgagtcaaggactcccagaatttggaaggtgaacgaggaaagataaatcatctagtctctcttccctctttgtagctgagaaggctatgggctcagagagattaaacagtgcatgtgagatcaaaggtgcagtgacaggccacatcaggatgggtcctgctaccttctggctgcttatattctacagcccaagctctctgctcaggcttctaaaaccacatacttatggccacaaggtcacatgacctgaatcacccccagaccaggagcatagccttgtctctagtgaatataatcagggatgaacctaaggcatgaaaacgggcagtgtcttcggggtatccttaatctgtattaaaccagccataatgaaggatttcttcggtggacaaggtacagctttccaagataggagcgaggatgaagaggacactagccccactactcccagatcacagctcagagtagtcaaacaaagaaaaagctctttttatatttatgaaatcgaagtaggaatagaagcaaagtcgtcagaaacaaagaaggaagaaatcctcctgaatgggggaatatagagactgtcatctttaaagaggttcaagtagagcgttcaatgaaacaggaataaacaatccaggagaatcaaagcccacggtgtgttcaggcctagaaggaatgtattaaatgaatctatgctcttttcttgctgttgtatcagatattctaggtacagtgtaggaaatggaattaaatgaagaatcaataaaacaataaacttaagttaatgcaatgttcaagtaaacagattcttctaatctttttcaaaaacgataactgaacattttattatttgggaaatacagtgaaattaaaggtttcttcttattacattgagcccataaggggaatcaggatgttccacaaatatatcacatctcttcaatttttatagtgcacttttaaagaaacaagatcttttttatattattttaacccacgtgtctcgattgccaagtttcagctgaaagaagtttgtcataaatgaattagggaaacatctttaggaatgtcttactgaaacacagaccactcttaactccagaaacactactcactgccaccttcaggtaactgaagaagttggctttgttacccacagattttcatcatatctgaactcagaggagatggaattttatggctatataaaaggacctcatgatataaaatggaaaaaagcaaacattaaactattttatacatttcaataatggttcggctccagtgaccttcttttatatctcccttcaaagggaattgttattatacttttgtcttcttccccttgtttagctccagatcgcctggaggaacgataaaaataaatgaagtccattagataaaattattatttacacaaaggcaatattaattttatctgtcagcaggttttaaaactaagtgaaagttcattcaatctacttctgtgtcagctaaagcaacaaaagtcctttctaagaaaaaaaaaaaaaagaaaaagaaaaaagtacttaaataatgggctttcaaggcaatgtaactaccttggcaatttctaaagaatttacctagagatgtttcctcagggcagaaaattcatgtggacacactaaaatattccagttataggccgcgcgtggtggctcacgcctgtaatccctgcactttgggaggccgaggtgggcggatcatgaggtcagaagatcaagaccatcctggctaacacagtgaaaccccatctctactaaaaatacaaaaaattagccgggcatggtagcgggcacctgcagtcccagctaccctggaggctgaggcaggagaatggcatgaacctgggaggcggagcttgcagtgagctgagatctcgccactgcactccagcctgggtgacacagcgagactccgtctcaaaaaaaaaaagaaagaaagaaagaaaaaaaagaagggagcaccattttctctttcgtccactgcaagatgtggagtctatgccaacacagaaaagcaatgctaccacagtgggaagaaaagacgatacccttctactgtcatcagtctggtcaacatcactgattacttcctgcttgtgaaatccaggaagcttatgtaactagatatctccatggcctttgtgaccactgacctttccttgaatatctcctgacatcctgtcttccctggattctgtaactccccaatctctctgtatttatttcacatctggcattctcctcgaatgaaagtacactccaacctcttctgaatgttcattgttttctccatctacacgttctcagaggcccttttcttcaaacccatgtgatttcacatggtctctaaaaactggtgactctcaaatctagatcctctccccaacctctgtatataatctagactcatacatcaaaataggggtatttacatataaaagccagtgtaactgctctaaagcaggcctcattatctgtcttcatcagctgtctcccttgcgtctgcttcctctcatagctaactacaccatcactcagacagccaactcagagctcaagggatacccaccattccctcctcctccatcttaccaaaactcactcctcattttgtgagtgtcttgacaatccttcccttacccacatttagaacccatgccctcctctggaatccatgccctcctctctgtcctgaccaacctcctgtatttcttacctctgcaatttcagccatttttgttgttgttgttgagtttccttgctgctaatcccaacccttaagcatcacttctatggagccttctatgaattttttcccacttttctctcgtccctatctggccccactgtacgttgattcttattcctgttacagcctttatcatcctgaactacaattacctgtgtatctgcctccttctaaaacaaggctgttaaaaactcagtctccagatagtactggacatagtgcagaaaaacaatcaacacctgagaagtggattgatggagaaaaagaatgcaaatccacatgtgcctctctaccttacctctgtacctctttacaatattagcacttccattaaaatgccatccaagttcccttttcttctatgactctgccattcgttgtcacagatgttttatccctcttttaaaattctcttaacatctggtccaaatataaagattcccatggttttgaaaaatgtcctttctaaatgtcataattgtccaattaatggtcaaagggatgaagggattactatagccagacagacttaaaaaaaggggggtcccctgggcctggaaacatgaaagcagacggaagatatcaccaaatgtatgaaccctgagggggtcagataagttattccagcacagataattcactggaaccacttgaaatgtcaaaggacaaaaaaggaggatattataattcacaccagaaagaaacttactgaattaataattttaggttaagaaatacaaataccttaaaatattatcagataaatttacagtaaatagactgctaataaacttagataaactatttagcagaaaggcttctgatctgatgttttcagattttagtcaggaataacacggtgtatatctgatgaaaccttttaaatccaatggattagacatgtcaatgccgatacctttgagttaattagagtttgtcacaatctttgatctcaaaaaaaaaaagtcagacctctagagcactaatcaccatttttggtgagtatattaaaaataaaaataagaaatccatcctaaaagaaaaaattaccaagacatatcatataaaaatcaaagatttcactaactagacaataaaaaagatgcaaaaaatccaaagtaggttatgtacactactcaaacatcttttacaggtttcctgaaatagacctataagataagtgttctcattcctttgccattttgcagatgtggagacaggactcaaggaggtcccatttccaaatggaagaagtaaaattttaacaggtaagtccctggccctaaaacccagggtcatcttgctgtcctctcacttctacaaagattgtctattgactaaggattaggagtcatgctagacacacaggtcatccagctgaagaaataagctgatgatttattcctactaactaacttcttgtcgggcctgaaaatgtgttttcttagagaggaaaatttcactaagtaactagctgcagcatcattcactgaccctgggaccagagacctcactgaccaggatttaatccagcaaatgacgcaatggctttgtccgtgtcatgtgccctcctgtccttgaggcaggggcagaggggcaggatgggctcattcagtcccatgacttaaataacatttatcggctggtgaatataagtgtacatatcaccttcaacctgtgcctgaaactgcaacttcatctgcctcttcatctctacctgagacaaagaattgcctcccaactaaccaggatcaagcaaaccactggtggtcccccttccccagtctacttcctggctgagtcttcgccatcacagctggagtcattttggattgctctaattcccccacacaacactctaaaccataagcaaatcccgtcactacttcctcaaaaaatgtataccgcacccctgtccccttctctcccatctgctactgcaatcccacctcaagcaccttcctctctcacctggatttagcagaagctattctaatgtgccttggtgtttttcattcatgcccctcaaaagtccattttctgtgttgcatccagataaatctttgtaaagagctcatctgattaagtaatttttccctgttcaaaaatttccaatagatctctttgcaacctccctaaaatgcaagatcctgaccccaccaacaaaccctcctccatggccacctccctatttctacatgatctccagccttcctgttccctgtgctcccgccacacacatgcacacacacatatgcacatgcacgcgtgtgcatggaactgctttctggtcttgaaacccaccaagctcatcaccttgcagatggcgcttgctggcccttagatcctagatctttttctacattctcccaaggtcccttctcactattcaggttttactaaaatgtcacctctacaggaaagcctccctggccaggcaggctaaagtacctcccttttactccactattagattccattattattttatcttcttcacatcacttaaaactacttaaaattgcttgactgatacatttttgagtttgggaatttttttacatcctattatatgaaattgatttaaaggatctataattttcacagcttctccttttaatgtgctgtatgtatatcaaaataacatgttgtacatcttaggtatatacaagtaaatacataaataaataaaaatatttcataagatacaggtatattcagtaccttcaaagaaggtaaattgagggggggaagcttcagtaatgggacagaataaaatatattggcgagctcaatgacagcaaaatagtttccagaggcctttgtcctcagtcatttcagtgatattggatatgtatgcttgtgtgggaggaataacaggacttagattatgatagtcagttgatgtccttgtgtgagtcctgtttaacacactggaatacaagtaactggaggacagattttattttgttctcttgctatccccagggcctaggacacagtatgacccatataaatattatcaactgattgactaggcagtggaaaggccagaaaccaagatagtcattttccaagtgatggataaactcactatgaaggccaagataccttctactaaataaaggcaatgaatcatccactttattttagccattgagcagtgcttacggcaagtttcaggagcactgctatggaaaagtacaagttagttcacagtcagcctattaggtgaaacttaggaatacaaagtcagtacagaattagcttcccctaaagcatctaatgattagcacatatgcgatgctataaaatctcacatgctgtgaacatacggtatctcatccttcagttcattagcctgaaatgtggagaggtcatggaggacattacaataaaggtctccatggtggaaaagtaacccccaagtgtgttcacttctgtatttcaaaatattaaaacctatgtgatgggaaatatgttaatgaaaatacaaaaatgatcccatcctaaatataaagccagaaaagtgaatgacagattgcatccatttggtaagtagctcctaaatactgaaggggttaaatactgttgctggatgcctgactgtctcctttttcagtccaaaagagtgagaaccatctacggtgttcctcagcctacaaagtaccagtgatccaccctgcctccaatgctagtttaggagaggcagccttgcatagatactaggagcacagactctggatccagatcacctgggttcaaatcttcgctccaccattaaccttatgcttcagttcccatgccctgtaatatggagataaaaaccatagcttaaaattatatgagttaatttgaaagaacttagaccacttactggcaattacgaagcactaaaaaattttgacaattataaacaaataaaggctatttaataaaaagaaaaatgctttataaatcttgtaggaaagacacgtctaacaaacaaattagtgtcttcctaaaaaaagacaataaaaccagttcagtgtttaataagaacagtgagaatgtgctgccttagccttaggaaaattcaacatctgcccaagaaatctataaaagaatgctcatagcagcattgttcataatagcaaaaaattagaaataatacaggtgtccattgagagaatgcaaatattcatggtctcttatatcacagtgaaaatggatggacaacagctatatgcaaagtaaatattagaaataagaacgttgagagaaaaaagaataatatagtaaatcaatatttaccgccaataaaaaaacaagcacaattaaacaatattttgaattcgataaaagtaaatgtgcaaggaaaagtaaaaggaagcttcacagtagtgctactgtgaatatgaataagtgtggtatgaacaacagaggtattccccaggatcaagcccccagtggaatgaggtcacccacagtccttcttaggccccacactttcccacttccacccttctgcctggaacacactcccccatgtccattttagaaccttatccattctctgaggtccaaatcaaacaccagctcccccaagagtggtaaccatttaccatgtgagaagcaaggaagcctccaggaagcgtgctcaggacacaccattgcctccatggccctcagcacgccctgccgtggagtctggcttcctgtgatgtgggatacggtgtccctgctgtacactaaagccacaagaccagagcctggcctgcttgttactgtggccactcactgcccaccaaagtttcttgcacgtagaaagtacctaatatttatggaatgaacataacaaccaaccgagcaataacaagtcatggaaagaagccccaggttgatctgggaggaggtgggggagcaggcaggttttggaagtgtgggaatcatgtcaacgaagtggaaataaagagaccacacttttggcagagaaatgaaataaagtctcaagatagaatgtaccaagaatggaggtagcaaatgcatttttgtttgaaaagaccaaagttataagtagtatggcacatccatactattaaatattatacagcttattaagccaatgtagtaaaactctatatactgagtttataaattcaataatgatgtgagtggaaaaaaataaagtgcagacatttatttatctatagattaaaaatagagaagaaaaactccaatgtttgactaaaataaactaatttttttaatgtttgtaagtgccaagaaaattgtggttactcctaagtcgtaggaaaatttttaaaaatataattctatattaaattttcaacaatatgcatttattaatttggtaatttaaaatgagcaaaatatttacatttaaaggaaggaggtaagattagttttatgggttaaccagtgagacaggacttcaatgcacatatttagatccagttcagggttgacttgccaggtataagacagcagaaaaccatggagggaaccattgctgcagtacggaaaagaaaaaactggttcaaagaatgggaggtgtgaagatataaaccttcataaagcagaggtcttctttccataagtgttctccaaactgaacgtgaaatctttgttattctcatgtaaagttgggccaaaaaaaagttatgttcagaatgtgtggcgtacaggtgtagcctgtaagtcaatgatagccattcctaaaactggaacctgctacctcttacttgctagactcagtttacctggagggaaaaaagtcacttgtacctaaggaaatgaaattggttttatcagctgcatcagataaactatgttatccaaagctttctgcttataccaagaagaaatgctcaggcacatagtcattgacactttccactgtgacttggccatactgcattttggtcctcaaagtggcccccgtagctaggtaaatagaacacacctgttaattcgttataggcaaagtagcacacatgtttttctctgtatgcaatagattacatttctggttgagtgagtagatgaaagtgatgtgccttctctaacatcatatgtaggaggaaaaatgttctgcttaatcttactgttcaagaaaatccctgcagttctctttgattatgaccacagtaacataagagacagttcattaaccacagagatgaaactggaggagatggggctgtgctttaaggaataaacacttcattctggaaggtcagatgtttcccaagcacaaatctcacagtttaaggatacttccttgcaggggcacacagacagatctatttagtttagtaactaataccgtgtatcacaataaatgacaggttgtggaaggaagctacccacacgagaagtctggaaaaaagttagtttacaacttgtaggatcaggcagtactttaatgactgtgagttttaaaacacaaacatgaggcagttggttggtatggctgcttaacagaacggtctcttttgatttaatgcgcgtgcgtgcacacacacacacacacacacacacacacacaaatacatcctaagagcttaacattatttatctactttgcctagttggtttcacctctaggacattctccaaaggaattcatcagatattttgtgctgggtatattttcttgatttctgtattcttgatcctctggcatttggagccttgtttctagagagactggccctcctagggctagcatattcgtaaagacagcaaacaacaccccagaggatacctctgcatacctaccaaccagccaagccagagcccccactctcaaccatctcctttatcaaattctcacccaatgtgctaatgttccccctacctaaagcaccccagagccaactaccacagcagtagggaacaccacatagcccagcacccaccaaaaatactcaaactctcaaatcctaaacttagtgtactcaccctgccttgcccactccttacagagagaaccccagtcaagcctctgcaagcctcggttttcttctgcctcccaaccctccctggtccttccccacgtggccctgtgtagcattatgagcctcctgtttacagagtctgtgagcataaaccttttcttcatgaccatcatgtctgcctctgctgtctcaccatccttgattaacacaaatcccacagacatttttaacatagatgtcagcaaagatttacactgaaatatattcaacctagtctgattattatgtgttacaagcatcgtttggaagcttctactgaggaagagggaaatagttctatacaaatggaacaaggaagacaaaaaaaaaaaataggaccaaagaagacaaaataaaatcaggaagacaagacattgcttttaagataaatatgctcaagttataatattaagtgtattggcaagaaactcaactctatgtacagcacataaacaaacacacacatagttgcacacccacatatacacatccacacagctgcacacataaatgagtgctcatgtgaatgcacacacaaaaacactttcatattgaaatataaacatacatttctataatttataaaaccagctgcacctatcagtgccaggttgcaaattccagctcagccacttcctggttgtgtgttctgtgcttccatcttcaagtggggataatactagcacctttctcatatggtttgtaaggatttaataatttaatcaacgtaaaacacttagaacagtgccaggtccactgcaagtactcaataatggttagacatgacaatgcaggtctttaaggttataatgaacatctggagaaaaacacacccaatcattagaacattctgagatatatggctttgcacatttttaatgctttggggcaattgtttttgcaagattaatgtaaattagcatgtatgattattataataaaaagtcatgtatccttttgctaagaagatgctgcagacaagaatcaagatgaattgggagcttaagcgctgtctctaattcacaccaccagaggattgcagtagctttactaataagtccagtccccataaatttgttatacatggtcatgcttgaagatggcatcaagaatgtggaagacagtgtcaaagacagcccttaattatttttaaaatgactagaattctcataccaaattctcaaatcaccatccaaacagcctcatcctaactccacaacaccatgttgatcacgattccctggagcttggcatgtgagtggtgctcttctgataggaagagctgatccacgctatcatcttcagagaaaaataaaatagagtgcaatgatatgcccaacttctctacaggaaatccaacatggccaagtattttttttccacagtagaaaacttgaatttaaattagattttttacataagcagcacaatgaccaaagaccactgactgagatgaaaacagaaaaacacacgtcaaggaaaacactatgatatccagaagcctagaaaaaatatgacactggtgtggcatcaaattccagatcaaattaagtgcactggtggcaagcatccataacttcctaaatggaagtcggagctaaagtgttcaaaaacaccagagctggcatcttcatttatcttgagagtttcccccacatatcgtactgaagataaaatacaatgagatcataacccttcaaaagcgtagcttattgtgcaatatttttctccagtggttaatggtgattctcacagattggaacagaaaaggttatagcaagggccaggtctgcaaacacattgagaaaataatttcctaacagacaagagcctcagtagagtagaaaagacaccagcatggctgaggatactgaagaactgcaattcaggtagatcaggtaccaagcccttctgcccttcagatgaaaagtctcttccatttaccaaatttgcccacaaaaatatttcaattttctgtgtctaatgtcatgaaaaactttggaaaaaactatgagagtttgagaaacacaggcctaggtttaatctggaaaataaagtatgattcggcaaagtgaaccttctagcaccaggttatcagcaatctagaaagtggctgtgccaggacttgaattcacatgtgtctgaatcggaaaccactgtgcaagcctgtgctaccaatggtataaagactgactgttttgagtatcctgataatttgcaaaaatattgtaccatcatcatcaaagaaaacgccacattttttaactttgaaaaatgtgtgcttcatttcaaatgtaagatagtgctaagatagttacctctctataaaaaatgaatttcaataacccagcaatcccactcctatgtctatatctaagagaaagaaaatatctgttcacataaaacttgtacatgaacattcatagcagcactattgataatagtctaaaaagtagaaatgatctgaatgtccatcaactaatacatggagaacagatgaagaaaatgtggtagatgctacaatgaagtgttattcagccagtaaaaggaataaagtgctgacatatgctataatgtggatgctataacatgctataagccttgaaaacatgataagtgaaagaaatcaggcacaataggccacacattttacgattccatgtatataaaatatctagaatatgcaaatccgtagagacagaatatagattagtgattgccaggggttgatggaaggaagaatggagagtttctgctaatggatacgggtgttctttctggggtcatcagaatgttctaaatttagataacagtggtggttacacagctctgtgaatgtatgaaaaattatgaaaaatctcaaaagggtaaattttatgatatgtgatttatatcttatgtaaagctgttattaaaaaataatttccaactagcaaccaggctaccaggttcttgtgatgatggttccagcagaagctggtgatagagaaagaagattagggtgtggctgatgacggaaaggggccttgaggggaacttctcagtcttgggtaagaggggcttccacagtggtgtttggtgatagcggtgactatgggagtcacaaaagtaaaggagagagctctttatataggaagctttccatagtctaggttcccattagcttgacatagatggtgaagggggataagatactggtatacatacaaagtaaaagagccatatacaccgtggaatactatgcagccataaaaaaggatgacttcatatcctttgcaggaacatctatgaagctgtgaaccatcattctcagcaaactaacacaggaacagaaaaccaaacaccacatgttctcactcataagtgggagttgaacaatgagaacacatggacacagcgaggggaacatcacacaccagggcctgtcgcagggttggaggcgaagtgagggagagcattaagacaaatacctaatgcatgtagggcttaaaacctagatgatgggttgataggtgcagcaaaccaccacagcatatgtatacctatgtaacaagcctgcacgttctgcacatgtatcccagaacttaaagtaaaatttaaaaaataaaagaattaaactcagataacttaaaaaataaaaattaaaaataaattctttttatcattttcaattcagaataatttgatcaatttagacaaattaaacaatctgaagatctaaaaaaaaatgtaaaattgacattcttcttcaatagtttgaacacaatgtacatttttttttttttttttttttttgagacggagtctcgctctgtcgcccaggctggagtgcagtggcgggatctcggctcactgcaagctccgcctcccgggttcacgccattctcccgcctcagcctcccaagtagctgggactacaggcgcccgccactacgcccggctaattttttgtatttttagtagagacggggtttcaccattttagccgggatggtctcgatctcctgacctcgtgatccgcccgcctcggcctcccaaaacattttttactgaaatgcaccagctctccagatagctcattgccctgttaatattcatgaagaaatcaactctacaattactttaaatacgttacattatatacaattataatttattataatttacattacctagaattataaattacttcatgatttatatgacttatttccatgatttatttaatgcttgtgttggtggagaccagtgtctgacctcaggaactcactctcctctccaaaatgcatgcttttgtgtacccttagacaaccctgagagactaggtacacatttcttcactccaacttgtttattaaaaatttccattcttttcccagaattttttttccactgttcaagcaattaaggcaaatagctaaagaaaactttttcagtactggtcattcccaaagagaagagcaagctggaagacccagtgagcatgaaggtggatgagcagtatccataaaagtcgcgccacactgcctggacctatttcttccactatgtatcacaagtgcttgcatattttactgtacagtgtgttaagtttcagtgaagacaaagggtctagtgccatatgtcagccaaagacaatgtttcccatggtgtccacccttaattattaaacatgtccttctagaatctcagaactatcccaaaggccatatgtgccacctcgtaatgtgaggcctcaatcttatgacacctgtgcaattacaatgactcagcatccccgtgtggtcctcttctcagctcctaaaagaatcaccctcattccaccattgccaaagcacaggaatataatgtgggacgtgctgtcaaaacaggatttcagatcacaaaatagttatgttccccaaaatcacagttctataaatcgttagcaagcatctttccataaattaatgccttgaccactaggcaagactctcatcctatggggattttctgggcaatgtttttgtcctataggagttttccttaaaaaatttaaagatgagaatcagcctggggttgctagttaagctcaacacagtcctaataagcagctgcttctgctcccaactgtcaccattccctccatatcaatatctctgagaaggtcagcacactgtcttcagcatgctctaataaatcaaacacaagtttgtaccagtcgaataaggccccgtgtatgtgttgctacacacttgtctccactggtctacaacatagaaaattgtgtccttatttgctgtaaccacatgttcactacaattaactctatacatgtacacactacatgctggactcagatgtctaaaccatacttctttggcccatctatctctcttaatgtcaatctataaaggaggatccacagaacattcatgtaattactacaattaacaaggagatgcaagtcacggccagggactagtaagttctgctataaacacacaatcacagagcaataaaggattttggcagcttatctgctctttcatcacctctctggctcttgcaaaagtggagtgtctcaacctcaccaccaatttcacaagagatgctatgactttatctatgattcctccatgcaaatgtgactattctataggccctttgagctctttctggaatcacacagatgtgagtttgaaatatgccccactttccagctttgtgactttgaaagagttactaatcttcggtaattctcttttttcttcttctaagaagtaccatctacctgtcaaggttttggggttttgagtgttagtgaggtgaaatgatctactggtaccatctacctgtcaaggttttggggttttgaatgttagtgaggtgaaatgatctactggtaccatctactcatcaaggttttggggttttgaatgttagtgaggtgaaataatctactggtaccgtctacttgtcaagggtttgaagacccaataatctcatcctgcttttaatgttcccaatacaccatcagaactgtattaagggtccacaagatgttatctgttgaatgcccttctcaccttgccccagccagtatcctggttgaatcattcctggctctgttctcctttttctctcatgtatcctcaacatggcttaaacccatctatcaggaacttctggacttggtcttatgacagcccctgaacatggccagcaagatgcaacacaaactcactccaaattcctcttcctgcctcatggtcctctttgcaccaacaattcagcacccttgacaccagcattttcatgcctacatgccccttgctctttatgctccaaatgccatctccaaactacaattttctatcttctcccattttatgaagatccactacaaatgcatccacaaaagctgtgttaattaccctctgtcatggcccattcgaatgaattattccttccaatttgcattcaaactcattgtatataccccttattatttcacttacaaagtgatataactgtttatgaatttaactccccaatacaaaccagaccgtaagcaaagacactcttttagtacagtacacatttttatcacaatcgagcttaggtctgaaacattgcagagacacaggcaatgtttgtaagacaaatgaggaagcacaaggaaagattaggaagcccagctcctccactaggcacccgagtttaagtctctgtactgccccttgctggctgggtgactttgggcgagttatttcacctcactaacattcagctgctcgttacaacactagcatattaattgtactttccttgtgggttgctataaggattgtaatattgaataccctccatgcatcatctcacactgactagcatacaatgattaacacatacctgctgccacattataatgaaaattggaacccccaattttaagccatctcatgctctgctgaaaaatgagccaatcctctttgctgaatgctccttgacagtccacagaggcttaaggcttagaagcaaagaacttattaaaataggagggaacgagagaaaagggaaacagtaactgttcacagacagctctcctcttctgccactacagccagtcagaaacatggcaaaggtctggatatagagtgtttacatccaagttctaagcctcacccagcctcctactgtgaatcagtttgtttgtttgtttgtctgtttgtttgttttttgagatgaagtctcgctctgttgcccaggctggagtacagtggcatgatcttggctcactgcaaactctgcctccccagttcaagcaattctcccgcctcagtctccccagtagcggggattacagatgcatgccaccatgccaggctaattttgtatttttagtagagatgcggtttcaccatgttggctaggctggtcttgaactcctgacctcaggtgatctgcctacctcagcctctcaaagtgctgggattacaggcgtgagccaccatgcctggcctgtgaataggttttaaaagaattacatatgatttctctgttcattttcccacctatgaaatctacagctgtcatatttcccagaaccatggtgatacgcgttttcattagctgcctgccatgaagttagattaagaagacatcaatgattttttctaatcaaagtcataaagtcaagtggtttcaaataacaacctccactatatatatgttaaagagaaaaatagcacccatatcgcagcctgggtgcccataatcttctaataccagtaataaatctttctgcgaaggctaaatcatttataaacttgttaacacagctcaagtctctaatgctgtatcactaggtttcttacttaatcaaattgtttaaaaatgtgtatttgcaatactgagtgattaggaggtttatcttatgaaagaccattccagtgtcccgttgtacacaaataatttgaaggcaatttccccttgttaagggtaaaaactctgattagactaacttctgatagctagttattgagatcacagaaagaatgcagccactagtgaataaacaaatactaagaccttccaggtggactgtctcaggtgacctccaaaggttaattcatgtaaaaaggatactgccattacaaccagaaaccaacaagttatgccctccttttgaaaagtattagattccaggatggattatccagccaaccaaagaaagggcgaatataaggtaaccagctctccagagtatgttctctcacccagtttaatgggaagctatgtggtttggaagcaaattctagagttacagaatgttaagcaagatattcattattttaccccatcatgaaacaacaagcccaaacagctaactccaggaacgttttctgagaccgtgtgcacatcaagaaacaagaaacaaaataggttgttgaaaacacccacatgttacagcatttctgcccttcctgaggatgggaataacattagaaataacttcacagaaaaacagactccccagagattcaaaattccccaggaatctcaccatttggacagacatatgtactctggaaaaattgttcctatcatccagtagccatgaattctaacttagtctaaactttccattcaaaaggcagcacctttcttaattttaagcaatgtctaaagtccaaagccccaggacaacatttcttctgagcctgtgtcagcttcattcagtctcattgaactgaatgatgtataatcaaagccaatgggattctgaaggagagagaaagtgagaatactagactcaaacctgaacagagctgagtcaattacagaaaagtcttggcaaagtaacttcagccccatgaggtgctgtttctctgtgggtaaataaggatactcacagccccctgtctcttggggcatttgcaaggagtgaatgagctaatacgtacaaaaggtggccagaatgctgggtgcacagctaatggccaataatcatgaattaatctccatgcccttttaaatggagggacttcgaatatgctggattctcttccatatcacttattactccatcattgaattggccatatagaaggcatatgcaggtaaacgatgtctgtaacagaggtcaccaactcatccacggtgagcagatgcagacaggtgcatcatataaggtcacaagtggccagcaaagaaaaggactcacaggccagcagaaacaacaagatgatgaatatctgggacctgtctttacccaacaggaataaaagaaacttgggtttccaatttaccatgaatgatgatggtactacaggtcttctgccttacgtagtcagagaagtagacatggaggaagaatttgttagaagcaaaataaagcgaacatggttaaaatgacaacaacaaactagctctgtctcagaggactccgcatgcacaagagcagtatttgtccaaacacaaacattttcccagtggcaatgacttacttactgctaagtccagcagaggcagcgatactaatttataatgtgtgaaataaagaaaagataacacaggcttctaaaaggctggccagtgggaatagtcacataaagatcccagcctagatttattaaaaattacaataattagtcctagaaaagtagaaaactagaattattttctcaaacataaaacaaactgccctcatgtcagtactcaattccagtgagaattgaataaatttctgctttgggaaaaaaccagcaacactgattttatctttaataaaaggagttataaatatcaagaaaatattttgatttgtataaatgcatcaaatataaaatttaagccttaaatatttattggatatgtcaagtatggatggcactggacattttaaaaattattcaaagaaattttaacaggtattaagtaactcaaatccaaattagaaaagaagaaacatatataggttaatgtataataactgataaaatatcagatttaaaatcataaaacatctgtaagtttaacacaaatgtgaaatgtttacgtgaagagaatgtacggaaatgatattaaatgaaattagcccaatgcaagtaggtgtcctgtagtagatagatttcaaacaggtctttcagtaaaagttagacagttattaccatggaatttggaaaatggaaaattaagagattctagaatgaggaaggtactgtatcaaatttctcagagaataaacactattccagagttccttagcttcagcgtgactgtcattttggacaggatacatgtttattgtggatctgtcctgtgcattgaaggatgcttagcggtattgcctgctgcttttcatgagatgtctgtagcacaagaaacagtcttgacaatcttagtgatgtttctaaatattgacaaatgtccccttgcagaggaggagaaggcagaattgctctcccttccattgaggaccactgctgtatacaaagatacaatctacaaaaagagtatgtaacaagtagactaaacataaagagagaatatcgtgattttattttccatattttgattttcttctctacttactgtgctaatacgatcttacagaaagtgctacgcatagtaatcaaaactgtatcctgaattagtacaacacaatttcagcacaatgaaacatgggtttcaaaaatcagttatataatggataccagaaaaacaggcttctgttaccacagtaataaggacagcacagtttggtaaatgaagtgaacattgaaatttagccctcatttaacacatttctaaaacttaagcaggaaccacaaacctccaagggaagtgtattttggtcccataagctacctggctgcatttgctttgctttgctaatgacaacagaattaccagccaagtgttcacctgtggaagaggggctataccttcacagggatcagcaataaagaataaaatcttcctcagtccccagctaccctccccatctcttaccctcatgctgctaggtcaactaagccattccttatcagttgatgcagtggcctgccagattcctttaagctctggatggtgagtacctagcgcaaaagtcactttaggaaaaagaagagtctgtagtcctgccttaccaccatcaccatcaccatcatcaccatctctaccaccatcaccaccaataccactaccatgaccaccatcatcattgtcaacaccaccactatgacttttaccactattgccaccatcactactactgccatcatcaccatcactaccaacaccacaactaccaccatcattaccatcactatgaccatcaccactaccaccacaccacaccacaatcactaccacaatcatcaccaacactaccatcaccaccaccattttcaccaccatcttcaacatcattatcaccaccaccaccaccacaatcaccaacaccactgttaccaccaccaccatcaccaccaccaccactacagctagctagaagtctcactctccacagcacggaatactataaccctgcattgggctccagcacaatcaaacttctccttgaacataatccactaaggcactccagctcacacttcttaactccactagacttttctacttcctgcacttttacaattccagaactttctgaagtcattatcttgatctgggatgtcctctccacacaaattcttaggttaccaacttattaagtcaaacttgaagcacagtggatatgcagtaaatactgaattgctcacaaattacagaaattccctccatgatatgaaacaagctttccagtggattggcatctattgatttaactcctacatcgtgcttagtaggtgcaggcatggtactaagtattttatattatcagttgatttatcctcataacagcacaacacaacggttactattattatcctcatttttcatatgaagaaactgaggcaaagggacatcaagaaaggtgcacaagttcacagaactaaaatttgaatccaggcagcagtctcaccatgatctctgaaccactccaatgtgtagctactctacactgaaaacaatttcaaaacaaatttttagttattttttttttaaatgtcatagagtctaagagatagccagagatttttctaacaacagaatcctatttttaagagcctcaagcccagcctccctctcctctgagagcacgttgaagaaaatttgggcccattttaaacacagtttagacatcactgtttttacggcaaatatttgtttttcacagacatggaaactaagacctgagaaagggtagtcgtttacccaagtaacactgaattagttggcagcagagttgaaactaaaaccctggagtcccgatgccaactggatgattttcaattatcccttggccccctggctaatcattaaatagattttctacagaaaggtgcagtttcatatctaccaggtaagaaacatggttgatgacacatgaaaatgattcactagaaaagacaaaagataatcattcacccaaacacgcctcttgctaaatcttcagagtctaatatcgcacagtgcaatttgggattcaggctttacctctcatctaaggagtccaaagcccttctcaggcaaccctgggccactaagttactggccagttagcaacagagaaaccatgtaacaaaaattgtactcatctggtaggctgagttcatggccaagccagaaccaaaactccacctctctctgtacatccacctgtgatctggtgcatgcccccagccctgggctccccctcccgacccacacctgtgaggggacctttacctgcgtgtgctggaggctcctcagctgtttctccttctctgtaactgatttactggctgaccttcagaccatcttaagcctttccatgactaagtttctcctgtgcaaaattacacttctctctctgaggaggtgttgagaatgattaaatgaacctggccacagagcgagagctcgtcagacacgaggcattagatcggggggctgtgttgtccgcggggtgctttctggtgatcattcatgcagatacccaaatcaaagtctccaggtaaagaaaacgactttggaaaactctgtggttttaacaaacacataacaatgcccccacccccaccgttctctggtttcatattaagtaaatcttttactgagggttttttctatccaggcacaatggaaccctgataaaaaattttatgtatcttctatgaaaatacctataaaaataatttgatgggaaaaaatctcttttagcttctgttttaccatgagaatttctttttttagagacaattaaaagttaacacaaaagttttatttctcagtacctgtaatttgtttttattaaattaaagaaagagtatacataacagataagcattcacctatacctataataactgggaaaaaaatcatatgatcatgtaggtctattaagaaagtaaaaattaaatataacaatgcactccagaaatggatactaagatcttatttaaaatacagtatgtatgactaataaattgtcattctcattaccatgctccaaatagttatttcctttcttaattcaccttttgaaagcattttgttccattttcctggggctgttttactgcgtgacttccctgggcattcaacagtcaatctccgcaggattgggattttcatttcacgtgtctttaatctagcaaagcattcaggctactcttttcacagatataaataagtaaatacaacaatcttcaggtaaagaaaaaatacattcctcagggacaaggataaagctggaagccatcttcctcagcaaacaaacacaggaacagaaaaccaaacactgcatgttctcacttataagtggtagttgaacattgagaacacgtggacacagagaggcgagcatcacacacctgggccttttaggaggtgggggtgaggggaggaatcttagagagcgggtcaataggtgcagcaaaacaccatggcccacgtatatctgtgcaacaaacctgcacattctgaatatgtaccccactttttttagaagaaatgaaaaacaaaaaaaaattttaaagaataaaagcaggaaaaaaaaaaaagacattcaagccgcctacatttccataacagagcgttctctatctacttactatatttattcttgagttatagcaaatgacaatttccatctggacttttttttttttttaaataaaggcatttctcatttcatcttgtgataatttgaaaaactatgtatactgtgtaacctaaataaaatagattatagcaccactccaaaaattgctgtcaacttccacacatactaagctagtggacctaccccaggcaaaagaaacagggtcagatgctgcctaatagaaatcaagtgacacgtctttagcatgttctttgctatgccactggttatctgtagaggctccagagtttagtaagtcttcttaattggacatcatttagctcagccactgggctcaagtagacaaataggaagtgagttttccatgtgtactctgttccttatctgcacagtgggtgccctctgaactgagcctcatcagaggctatgtgtctcagcccacacgcaagcaacgtgcatgctgcctgaagtggaagcaaaagtgtgttgttagttgcgcacccatagaagcacacctgagcctccctatacagtgcccaactagaagaggctgagcacttccctcctgtcatttgtagactgatagtccagtcccatcattaccaggtctcacccactgccagaaggatggctcgtcctcagtcccatgaactcagctgtgctcatgagttaccaatgaggaagggatgaaaggagaaaataaaaattaatcttggccgggcgcggtggctcacgcctgtaatcccagcactttgggaggccgaggcgggtggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaattaatcttgtatccacaaaacataaaaactcacattaagtatcccatcatgattataaaatatcaccactcatcacctataggaggataaactaaggctagttaagggtaaatgatattgtgactgtcaggactagggcatttgtttagaatgacatagaaggtcttagctaaatccatgcaaagtgttccccgaaatgaacgttcagtctcctccaggaaggtgattccccgtctcagtaaaacataggtagaaaaatcagtcttatcatgggttacagaataccctttcctttctacctcccccttctgcttgtcctaattaagtcctcgaaaattaattgtataaaaacaaaatgtagtctaccacttattagattatcctatacccaatagactatgcatgaagatctttggaatgatttccttgattgacctacaatattctttaaactctcagatcaggactgtatataaagtaaattataaactgttttattgttattcctctactacttcattgctttttttttttttttttcacatggaacagtcccccttgttattacaggctaagaatctcttatctgaaatgcttggggccagaacggattcagattttgcattttttttttttttttttggattttgggatattggcatatacataacaagttatcgtggggatagaacccaagtctaatcttgaaatctctttatgtttaaatacaccttatacgcatagcctgaaggtgatttatacaatatgtttaataattttatgcatgaaacaatgttttgacagcattttgactacaatccatcaaatgagatcaggtgtagaattttccacctgtggtatcatcttggcactcgaaaatgttttagattttggatcactttggactttagttttttagattagagatgctcatcctgcattttcttgtataaagatacttcattaccatggcaaagcattcctgtaccatccattaacaatctctggtgtttcgttcataatgtgtaccattccatatttcccatccagtgaaatgtatgcataacaagtattggcaggagacaaaacaaaatccttactcctagctatgggtacaaagtcaggtggccaggcattgggctcctagcagtcaagagtgaaggagacattggggaaggtgggcaggtcctcaggaaaactggaaataaaattatccagtgacaggacagtggccaaaaacatttctcaaattgtcatgggaatggtttacaggagaatgggcgttacttaaacacaggccacttatgacagcaaacgtaaccatctacactagatatatatggcattaatcagaaataaagatgttagaaggagaagaatcagaaataacacacctggattctgagcctttggaaagattttgaaagtttaggcaaagagcatccaaggcttcaatggcatgtacagagtattgagcaagatggagctaggagtcacataaacgggctgttatacactggcatattgggcaaagccttctggtatattccagcaagacttcataacgaaagaccttacgccttaaaatagtattaattgaaaagaatgataaggcctgctgggggctaaaagggcgtagaagaagacagatttagaagagagggtaagaatgaatgcttgaaatcattgcataaattaataagtttctgtgtatgtttaccctgttgagtatccacagttacaggatagggaagacaagtggtagcagatattatgtgacaatgtttttgttatacatagacaacaaaagctccatatgctcaacaaaagtcagattacagagccataataatgtacatgtttctgaaacattcctgtattttgagtttccctcaaagcctagcatttataaagtttatcgctggtcctttcaatgaatttcactgaacacaagccaggcatgtatcaaaataggtatataaaatctctataaagtaaataaaactcatcagagaagctggaacagaacatttcctaactttttttcaatctgggaggatctgattcataattatcatctactgtctttcttgactaacaagtgagagccaaaaggatacccaacccttttgtcttggtgaaatgaaaatctattatgtaattattttacaaataacacatataacatgtataaacagacgttattataatcatcatatttcattttaatatttgaggctttaaaggataccattaaacaacattaatttcatttacaataaatgaagcataagacatggaaaactacttggctgcatttaagatctagcgattcaactataaggaaaaattactttcatcgaagatgacagttttcctctagctcttcctactgatgcctatgcaatacagtctcactaaatgagcataaaataaaaagatgtccatttgatctttggacaaagatcagatttgatgacacagatctacatccagtggtctgattatggatcctgcataaatagatggaaataggttcactttcaaacgtttaggcatcattggcaagactgacgcttctgctttctaccagtcataatatgaaaacattggcaatgacctttactagaaatcttcatgcaaatgcaacaagaaactcacccaaaacattagcagaacctaccagatctattcattagaagaaaatatcaaccataggtatcattcacaagtaagagaagaaaagcattagtcattttacctagtatcacaccatgggcttttgagttggcaaaaatgggaatgaatcccagcttcatgactctaccctgggaaagtgacatatttctgtgtctcagctttatctgttaaatgggaccaagagcccgttaccttgtagggttcacaagatgactgattgaaacaacatatgtaaaacacctaggacagtgcctgcatatagcatgtccgctataaatatcactccctttcataggcgactgctctaaaaatattatgtcatttcatagatgggtctcaattattttgtgattcattgcctcccaaagatcaatctacttgacacaaaggaaagatctagtcaccatgagacagaatggatattgaagcatacagacatttgactcaaattaatcaaaaagttgcatttttcagtaagtcagctattaccaagtgcttcttatgaatagttattttaagatgcagctttccagaaatactgctttcttaaacaaagtttcattccagaaaggaaaaagcctttggccaatttagaagaagctttgtaccattcctgggaactgctcagcatctggggttgctggattttaagatggagttctcctatctaataaagctgctatgatcattgaacacagacacatgtaagatgtgttggggccttggggacgtaaaatgatagcacgaggagggacaggaatctaaatgctttgtcgcacacaccagagcataaataattatcaaagaatgcttaggggaatttaatttaattctgcatgtaatgaaagatgaaaaattatcttttccattaacatcaattgcatcaaaatcagtatttttataattttctcaacctattttttttctttcaactggcgaagtatcaaaaggcaataaagagaaaaaaagtacttccagatggttggtctaagcaaattacatgcaattttcctttaaataaaatggaaaatatatgtaatagaagccctgctgaacacctatcaaatcaaaatgattactgtctgcaccgttgtaattcactcactggtttatggcctcactctatttcaaagagtttcccaaattcatataatgttctgcagtgctagagctggcatcagatctctgatgtagctgaaagatgcagactgtgaaatcttccattgttggacaactttcttatttgggacatagttgagaaagctgagcagccaaaaaataaaataaaataaattgtcctttcaaaggcagctttaaagtcgcactcactcagctcaataaactctgtgtttcaggggtaaccacaaaaagagaagactttctacttgttgttccaagtatacattttacactaaaccctatgctatttagagagatattggtaaaaaattatggcagtgggtcatcagatgaggaattccctctcaaaacccttctagataaactgactctcaattcccccaacctttactcaagaaattggattttatgtgctccatccttttaccctaaaactcattagtacataaatgaggagaaaaagttgagaattggagaggtgggaggtcagggaagatagagggtcactgggggagtggactgtccactctaacccgtttctgatcactggtatccacagaatgaaccccaaagccatcgcccatcaaagggcaggtcccacacttcccagcaattagatccaggtggaggtgagcctctggtggggtggtgcggaagggcagagccaggtaaccagggtagtcagggcatgcctacctcgcccctaccccagagcctctcacctgcaaactgggtacaagcagttggtgtaaggtcaggaatgttgtcaaaggcaacatgaaagttatagtgtatcaagttcaagacctggacttcacagatttatggctacataaatacacacaatgtctttatgaatttgcccctgcttttaatttagtaagagaccttcaaagcaggagttcaaaaccaggggcaattttacttcccctcctcaggaacatttggcaatacctggggacaattctggttaccacagtgaggggatactacgggtatctgtcaatagaggccagtgatgctgataaatttcctataatgtgctaccctcactgacaagaagggattatccggtgcaaattgtcaatagtgccaaggttgaaaaactctgctttacactgaaaaaaagagagatggaatttaggtagcattatgttctgtaagtagaaaagaaattggtaagaccagaatctcttaccactgaaatgtttctcagctgctaaaatagggagcctggtacactcattgaacagctttctaattttcttttatatcctacacagattttctctttattctgccatgcagaaaaataagagaggccatttatagcaaccatttgaattctctcctgtattattttaagatgctgctgcttttacattttgcccataagaagttttactagaataaataaaaccagttgtacacaattcacagacaattgttttccaaaggatttttttagtattataagctgtaacctctaattaaatatgtgatcccactggattttatacatagaatatagttaccatatttacgtgtgcacattatccactttactaacttttctaaaatttctcacataaatctgaatttttaagccttaagtgggatcccaatttgtacatttttctttcaactatccatatcttttgatagtgaatagaccagtcctcagttactccttagcacctcctatatttgcaatgcaggacccagtgattacttctattacttctggtagttctcaaagttacaaggaacaagaatgatcatgaaggttcaattcacctgattccataatcacattctttgctcttgagacattcgccccgttacttctgtgccttgtctttatcaccacaaatcctccgatcagcacatcccttgcctatcagcctctctacttaacaacttcatttttacatttattacatctttcctgccagagtcagtttggactactataataaattaccatacaccaagtggcttgaacaagagaaatgtatttccctctgtttagaaggctggaaagctcaagatcacagtgccagcagatgccatgtctgagggagctcctttcctggtttggaggtggtgtcaccttttgtatcctcacatggcagagcagagcacaggagcaagttctccagtgtctcttctttttttttttttttcgagatggagtctcgctctgtcgcccaggctggattgcagtggcgtgatctcggctcactgcaacctccgcctcccgggttcacgccattctcctgcctcagcctcccgagtagctgggactacaggtgcccgctaccatgcccggctaattttttgtatttttagtagagatggggtttcaccgtgttagccaagatggtctcgatctcctgacctcgtgatccacccgccttggcctcccaaagtgctgggattacaggcatgagccactgtgcctggcccagtgtctcttcttataaaagcactgatcccatcatgagtgctccactcttacaacctaatcacctctcaaaggtccaccttataatactatcaaactgggtgttaggatttcaacatatgcattttgaggggacacaaacattcagtccataacacttcctatatgcaaagcagagcaaaataaaggcaaatactacattttcaaagttatttgcctcagtagcatcagcatttggttccagctgtaatcctcagccccctcccatgatggtaatcaaaggcttgccatttgctggaaattcctgccctgcaataggagtgttcttcaccctctacatctgacaactgccctccacagttcacaaatactgacggcgcactaaaccataagctctttaggaacaggaactctgacatatatgtatttataccccggagagtaatcaaattgtactacatatactcctggtgctgatgaggaccagtaatgagacagatagaatgtatccagagacatctgttggtgctaagaagggctcaggcaggtaataggcatcctaaccatttaggacaaagtaaaggacaaataaatctccaattttagtcatttattttcttccgctagctttcaggttgatgtgttctttcctagttcctttaggtacaaagttagattgttaatttgaaacctttctaaacctttctaacttcttgatgaaagtgtcttggggctacatgctttcctcttaacactgctttggctgcatcccagagattttggtaagttgtgtcctcgtattcattgatttcaagcattttttttttatttctgccttaatttctgtgttcacctaggagttattcaggagtaagttgttcaatttccatgtgtttgtatagttttgagagatcttggcattaatttctatttttattgcactgtggtgtgagagtgtccttggtatgatttccaggtttttgaatttattgaggcttgctttgtgaccaagcatgtggtcgatcttagaagacagtctgtgtgcagatgagaaaaatgtatattctgcggttgttgggtggagtgttctgtagatgtctatagaaaatgttttggccagagtgtgtgcctcacttagaaaggaaggggaaagatagaggaagggcagtgcaaagtcatgttcaatggtcatggtcagtgaggcaaaactgcatctctgagctcaggatgaaagaggatgaggcaacgatggtcgaggatgctgattacatctcctaagtacaggttttaaacatgcacacatctggtcaacctcttctgattgtgtgcaaacctaaggagtcacaggtgggccctgataaggtcatgagataaaatagggggctttatgtttcctagggcatgcatgcacacacaagtacatggcagatttaacattttataaatgacacccaaataactcctgtttatcatctgggagcattccatttttttctcaagaatcattgtatgacaagatatggcaaagctcaaattaaatcaacacaacgaataaccaacaaaaacaagtgaagtttcagaagggcaaattaagaacaacttttgtttttctgtggtgtcacacagagaaaagttatgtctagagtagatactctttgatgtacatcccaaaagctctattagcacatctgcagccaaaccactggtttcaggatgtgtactgttgggcccctcggtggccatattggttccagatggagttcaaataacataagggcctttgttcccgggctgaactatttcatttctccactggtaacttgcacacatgatggagcgctccatcatgaacgatgtgcaatgcccaggggtgcttcaaaaaatgtaccacagagactgctaaaactcatggaagcccctgcttttaagtgatagcagcagcatttgccaacagagtggtgctagtgggctgtattacattccatctttgtttatgcaacacccctggaataaaaagttaggcatttaccattataatttaccttaattatagtatttgtcactacctgtaatgcacaaaagaattatggtagttgcactcatagaagaggaaaatgagacacagggagcctttttgacttgcacagggttactcctatgctggagagaaggggaaatattaaataccttacatcaaatacctaagggcagacttaaggatttctaatccactgctgctgactgctggtattttaagacgggaactttcaaagaagaatgaatgttgtcagaaacatgattcctaacataaggaagcaatgactgggggctgggagatggcctatatcccttgtaagagtattttgagccctttagacaataggaaggctctctgacagtcttacttgtcaccaggcctctgctatgtccagaacaacagggttagaattcatggccccgccaggcatggtggctcatgcctgcgaccccaacactttgggaggtggaatcaggtaggtcacaaggtcaggagttcgagactagcctggccaatatggtgaaaccccgtctctactaaaaatatataaaaaattagccaggcatggtggcgtgcacctgtagtcccagctacttgggaagctgaggcaggagaatcgcttgaaccccggaggggtaggttacagtgagtcgagatcgcgccactgcactccagcctgggtgacagagcgagactttgtctcaaaacaaacaaacaaaaaagaattcatggccacatttccaaaatcttcatacttttgcaagctcactgcctatttcagggccatttctttgaacttatttcttcccctacccacataatcagtgtgaacagtctagtgtactgccttctgtatcttcctccatgtttctgcaataacatacaaatacaggtattcagacatgggggatggaggtcattttactttataatttgagattttctcataatatcataaaatctctccaagttaaccaggtatgattaaaattaatctttaatcacatctgagacattcttacaacataactgacatataatctatacttgattggtacacattcaatatgtgagatcaatttttgggagagaggaaaggaagcagtaaaaaagcttctataaacattcactatacatgcccttatatatgtatgctggtatttttatttttacaatatatatgccctcatatattatatacgggtgtttttctttgtatagtacatattcccaggggttgtaatactgggtgaaatagtttgtatatttttaattaggattatcaaaccacttttccaaaatatgtaagtaattcatgtttccatcagtcatgggtgaaagtcccctttaatcagcatccttacctgtcatgggtgttatcttttttctctctctctttttggccagtcagaagaatgatatctcatttgaattatcctaagagcaatggatagaacattgtttcatctacttactggacatgaggatttgctcttatgtgaactacctattcatatatttttcaattttcttatgggctgcttgaatttttctcatcaatttgtaagagctctttgtatattagaaataccaaccttatgcctattgcaggaattgcaaatattatctctatctaatgttagactttttagatggtttatgtcatcttttagcacagtttagtttaacgataaccaaattacagtctatcccttaagttgccaaaaagaaggaatcagcagaaaattctcgttctgcaattactaagataaaacatccagtgaaagaggaacttggaaaagatccagtacaaataaaactgcatgttcaagaatgctttcttaacctttggcacagatgccaccttgccccctccttggcttataagaagctgtcatacaccatcattaacacagttggtctcacccttcaatgcagatgttatagggtgctgctcctgaataattcttcaacctgggcaacgcatttaaattgggaattttcagctataattgttactctctgctgtccataggatgaagtctttgacccgaacctaaatacagaccagaattctgagcccaaaaactatctccagcatccggagaagaagcatcatgaaaggggaggagagagctgtttatatataaaataagttgaatttgcaagaaagaaccgactgtctttttctttaaaaattgtaggtagtatcaaagtttttctcctctttacagataaaaacaaaaaggctaacggaatgcagtcgaccgagaactagtttcttacatttccattgagggtatctttctctagatctgtcatttttcagaattttccaagtaataaagtcacaggcttttttgttaggtggctggaaagagaaatgtatttgtcattctgtctgatcttccaaagcatttttcagtgttgtttttgttgctgttatcttgttgaattttttatcagactattattggtatcaccaataaagaggatgttgaattatgtttctcattccaaaaatagtgcaaaaaaattaatcttaaaaagtataatggaatccacttttctttcactgactccatctgcaagccaggatcaactgtaaaatcattttatgaagaagcaatattgcaggggatttattctctgggtctaacagactgcttgcaagccagcgttaaagaccttgaacagttgatgcaaattccacctttgtattttactgccctcagtgagctcaacatcattcattaaagggtgtattagctgatatcttaccaccgccatgcagcagagaaggagaatcacataattttaaaattcaggctgagggccactgtggacgcagaaggctgacttccgaccacctgcttccccactagacttgttccaaatggctttcttgagaggtgattcacaagtgctaaaaaatcacgaatttttaaagtgagatattttggattacttataaactactttccgtaatggcattttaccaatgaaatgatccactggatgaaaatgacttatccttagttatctgttttattcctgagctcatctattttgacaagttcttgatcattgtgcagtacaaactatgcgcagccttttcacaaaggcttccctatggattctaggagctcacaacccaccgcttctcaacagacagtcatatattctactttacagcagaatacttctgcctcagggaatcctaatggccagtgccaaatcttgttttcactaactgtgagaaatgtgagccttatgctttacattaataggccaaatgtatttctctttgatagaaaatcaaacttctaagccactgataaaactctggtgacatcctgagcttcacaggtttgatcctcttacaaaaggtgtgaacaatgcaagtgaggttaacaaaaatccttgcagggaatcacacactgagtggctctctggcctgcatcactaactgctgcattttattaacagcaggtcaaagagcctctcgcccaacacatcacaaatgttcacagagattcaatgagtcaacaagtatgcctactgcagctggaactgacactgaaaatgtgaactacattgacaaaaattctcagcaggcctctcaaacacaaacttttccctagcccaaggtctctggggaaaaattataacaattaaaagtgcagtgtggagtgagaacacagtgcagcaaatttttaatgtcagaaagtagcaatttgataactaagaaaactggaaaaatcattataacctatgccttactttgcccagcacctcccaagactcaactggaaagagcctggctttgagaagaatgaaagcctgaactgctgattgtgagaaaaaaaaaggcaaaataagtgctgaaaggaactcacatcaaatatttcattgtaagagtctgatcttatttcctatagccagaatggcatttgacgatacaacagtggagaattttgctactaagatgttgaatgaaatccctcaagaggagaattacctttgagattttctgtcacttttaagatcacttctgaagtatcaaagcactactatagcaaatgaaatattatgaggagctttgcaacagatgccaataccttcccaaacatgtctgaggcatctcctaggtcagaggccctggatttcaaacatactgccaatatgtcaatgacccccagatacacagctctattcccaatcattcctcgatagcccacacttgtgtatctgtctactctctagacccgatgagaaatgaaagccttcaactcaaagttaacattgccctagaagaactgttgcgtttccctccaacccctatacctccccagggcttctctgtctcagtaagttgtccaccatccactcacttactgaggtccaaaacttccaattcattcttaatttatcttcccctctctccaatgcccaatccatcagagcaccacagactctacctctaaatatgtcaagcccatccacttttctccttctacactaacaaccctgtagtctgtgccaccatcacgcctgaccccatcatctgtgagagcttcaagctggtcttcctgcttcccctctagctaccctggaatccattctctgacccagtggtgaccttgataatataaccgacaatttggaaacgtaaataactcatatcccaccactgcttctccaaagggttcccaatgcccctaatagacatagaagtttcatgtcccggcttacaaagccctacatatgctaacccttacccacctctgtggtctcaattcacaccactgtccctttccccactacacacaaaccaatccaaagttgtcccctgttcactctctgtcacatgaacccatctgaattctttgcatagcacttaaccactggacaatactttttttatttattgtgaacgcaattattgcttatggtctaactcttccaccaaaaatgtatgctcagagagccaggagcctatctgtcttgcttacgtgcatatcgccagtgcctaaaaccgaggctcacacactacatgtgttcacacacacacacacaaatacctggggaggagggagaatgcaagttatttctcatggtcactttgactgcaattttcaagaaaagcagtcagtgtgtgacagcaacagtagaagcacgatttccaatcagacattaattgagacgaccactagcccttggtgaccccatgtacaggaagagatgtttcagggacaccatttgtttatacagatgtctgtccttaagggatttttgtttgaaatcaaccaccaatcatgtattttctgcaaggaaattacacagtaagggtgggttccaaccctcaaaatatttgctagctcagtgaaataaaaccaagattccatttggagaaacctatagctgctttactttgcaataaattgtaaaataggtgggttttattgttttataattcttttctgtaatagtctaccaagaggaatcccttggggacctttagaaaataaaaggggtaaaacacatgctgcattaagaagttatatattatccactgggctcagccatgcaggaggcctcagcatgaccttggcaagtttcttaacctcaccacactgttcactcacctttaaatggggataatattagaacctgcatgcttgttgagaagatgaaatggcatgcataaagcagtatctgggacacaggaagtgctcagataatgtaagcattatgaattatcaccaagttattagcagtgcttcaaaaaatatttcagatttggaaatgttggaaaatccacattattaaatttgtattgtggccgggcgcagtggctcacacctgtaatcccagcactttgggaggccgaggcgggcagatcatgaggtcaggagatcaagaccacggtgaaaccccgtctctactaaaaatacaaaaaattagcctggcgcggtggcaggcgcctgtagtcccagctacccggcaggctgaggcaggagaatggcgtgatcctgggaggcggagcttgcagtgagccgagatcacgccactgcactccagccctggcaacagagcgagactccatctcaaaaaaataaataaaataaaataaaataaaataaaataaaataaaataaaataaatgtgtattgtcattgctacattacaaggaactgtttaatgacttgctctgagcatgttcaagtgctcctttggctgcaaacacagatgactaccgcaggcccgtggaggtgacccaggattagctacactctattctttctacacttggggaactggcatgtgcttaagaaaagacaagaaaagctacttcaaatcaataaagtcttcacaaatcatgcacacgtgattagaaatgttcgttctgggtgtatctgatcatttagtaattgctcaagaaaacaagaataactttgtacattatctgccataaagacaaaaaatgagcaagaaaatgagagtcaaagttagaaaacaaacaaaacacttaatattataatcagagaactgagtcacactgtcataattcacttttttattgttgctaatattatgatgtcccagaagacacttctaagacatttacatagaccttaacacctggtttataaaataatattaaaagaatatagtccagtacataaaagagaaagttattttaaaaaatgaaattggccaggtgcagtggctcatgcctgtaatcccagcactttgggaggctgaggcgggtgtatcatgaggtcaggaattcaagatctgcctggctaacatggtgaaaacccagctctactaaaaatgtaaacattagccaggcatggtggcaggcgcctgtaatctcagctactcagaagggtgaggcaggagaatctcttgaacctagaaggcagaggttgcagtgagccgagatcccgccactgctctccagcctgggtaacagagaagactctgtctcgggggggaaaaagatgaaatcaactcctagaaaatactgcagcagaatgataaagtaaacatacaactacatatcaagttgagtcgagaagaaaggaatttcaggaaaatacacaaaaatgatagtggcttgggagaaaagaatagacctgcctatcaaagcatgtgttggttctctgatgaggtttcagcctgagaactaacatgggaaatgtgctgtccttctcctgctttactaaccttctgccttcttggttggtgcatccctgtgccgggctgatgaatacatcacaactgctgctcacagctgggaacacaaccagtaataaggcacagttatagcttcagggatgtaaggaaggtgagtgactgtccatactgtgcgtgtgtgtatccacagtcacacatgtgtatgtagcaccaagttagtgaaaaggttttatttaaaaggtgctacctaggttgtgattttcctctagtaggtggatccttgagcagcctacccctaatttgccacaaattcataattaagttacatagctgggtgttagtatactgttttacatatagatttcagagattttaaccctgccttagtgcacctaatgcagtagggtttcatccaattataaggctttctctatctgtttctatatctatttatctatctctatataatttacatacatgcatttatataggtggatattctatctttctgtttattcaactctatctacatatattacatatatgtgtgtaaatatatatatgtgtgtgtatatatatatatatatatatatatatattcaactctatctatctatctatctatctatctatctatctatctatctatccatccatccatccatccaattgacccagaattgtggtcacagcaaggcagatactcttaaacattagtgctgtcctctggacatgtacatccagataactatgttacaggaaatacaatttcagtcttctgagcttggctcaccccacaacctgacagtcatgctgtgctgcgctatttttatgtttaatatgtactccttgaagatgatactatgaaattccactgtaacactgatagtgttcaaatgctcactttaagaaaggttagatgccaggaaggaagtgataccgaatcctacagtgcaggaaagcagctacattggtttcggtcttggtgctatttgaatacctcaccttccttttctgttctcttctacatctcatagataaccattaataagaaacggactttagaaggatctcacagtctttcctgtctttggtacactgtaagtgatgttcaattacactggaaaacagtgaagactatttgagaaagcagtaaaatgaatggccccagctggacaatatggggacagtctataatggctacagcaaatataattatttaattattgtaaaattatgcaataaacttcttaaactaaatatagcacaatcagaaggctagagcagtacatttaatcacactcttaaggaccattagagaagttatattttacaaaatttccatctgaatcacttcattaaataacatatacgtattcagtgcttattatgtgccagagtgttaagtattgggaagacggatgcaataatcaagccaaggacttcacagtgtgaaaaggaaggactatatgtatttacaaaatactacaatgaatcctactttaaattgccattgcagggatgtgcacaggagtgtggggacacagagggggtgtgacttaattcatccggccatggagaaggaagagaaaggttcatggaaaatgagacagattagctgagaactggtgaacaagcaaatatctacccactgaacaatgtgggggaaattataccaaatgcatgaatctctgattggggtgggggaggaagaatcccattcctcttctcttagccaagcccatagccttccagctctgtgtccaaattagaaatagggtattactcatgcgattcagaaagtcccagaaaaatccatccatcaacccatctacacaacaaataattattggcatcttattacatcttagtcccttacctcacctaggaatggagcagtgagtgaacaaaataagcaaaatccctggcagggtagagcttacatgagaaggcaggggcagaagttatgtaaaattgataaacaaaatatctcatgtatcagacagtgctaagttctttacaagaaaagcaataaagcagaaaaggaaaatagagaatagcagggagactttccattttagtcatttgatcaggaatatctcctgacaaggtaagagttgaataaacttgaagtaggccaaggagcaatcttcagggatcttcaggtaaagagtgctgcaggcacagaaaggagtcagaatgaaaagactgagcaaggaaagtggctactctgttccagggagaccaaggaggccagtgaaactgaagctggtgcttgggagagaaagatagatagagaagagagaggatgaggacaaagaagggacacgtggtgcctggcgcaccaagggaggaagctggctttccatcagaataaggcagcagctgctggaggattctcagcagagagcctgtctggtcactgtgtggagaaaagaccacggaggcccaagagcagaagcagcgagacggccggaagacctgagaactcacggggaccaagttgctgggagcttagctgaggcagggagcagtgaaggtgctgagaagtggtaagatattggatatatgttgaacaaaaaaacgaacaacaataagatttgttgacagctgggatgtggggtgacagagaaagagaataatcaagtattgttccaactgtttcagcctgagcaagtggaagactggacttcccattaataaaatgaggaactctacagaaggacatggctaggggttgtggggagaaaagagttcagtttggacatggttaatttgaagacataaattagacatccagttgtgaggttaaataggcagttgaatatataaacaattctggagcttagggataggttttggctgaagatagacatgtgggagtaattagtgtgcaaatgatactaaagccatgagactggaagagatttctaaatggtgagaatggtgggaaaagagacaaggtccagacactgaaccttatgggactccagtgcttggatggcagggagatgaccatttgaggctaagatgcaaagcccagagatatgaggtcaggccagagaaatggagcatcctaaagccaagtagagaaagtatgtcaaggaggtgggaggggtcgatggtataaaagctgctaactgttaagtatgatgatgactgagcctcgactgctggatttagcaacatggcggtgttgggtgatcttgactaggcagtgctgaaggaatgactaagggatcagactgggctcaaaataaaataaaaaggcagaaatggaggacaacaagtacaggcaaatactttaaaccaagttttttttgttttttgttttttttttagcaaagaggagataaatgtattataactaaagaggaaattagaggccacaggtcaaattttcttaggatgatagatgtttccattcctattggaaaaaaaaataaacagcatagagggaaaaataaaagctgattatgtaggaaagaaaggaaataactgcttaagtactgtaggagcaaaggaatgggatacagtttggccaaactagggttaagagtttccatcagaattaatcagtgtccactagctggaatattgtgattggcccacttgggtaggtacctcacctttaaaacatcactgtagtaaggaggtggcctgcaatgaagaaaagaggaacagttctcaaaaagtatgtggcccctgagctgtgataagggtaccccaatttatatgtactaaaaaaaatctgagctacagtaaacaacttagatcaacccacttaattcctcagcactggaaatgtaagtgcactattcttagatactgttacatgaaaatgtggtgatatttacttcccagaatctcccaaccaacttcccaacctttgctttttctgctttggtttaaccaatagtggttactgctcaggctttaaacaaaaacaaatgaagcaaaatgactctgatttctttgtggcctcggaggctcaaaaagacacaaacacacatgaaacccccactagctttcctagataaagcatgaactgattaggtttgcagccctgcagctatagaggcctctccaatactctgatctggaaaccacagggcaggaaaatccccaaagtcccatgaaatccaaagatccaaacgtggggtcgtttttatgccctcaggaaagttctgccaaaaaaagagatcttacacacagtgtaattgagagggcagtatccttacgtgcacatgtaaatccaaatccaagcaattaaccccacacacatctgcccctctaatgggtgtctgagaataaacagcacacgtcaatccctcccagcctcactcaatcacgaaactaagaaaagaaaatgaattctgaacttcaccacacagctgtgattcacaaatatttatagtagccataaagctggtgaccttcaggaagataacacacttggcagacattcacctaaacaaaagaggggaaaaggcccaaatctcaaacagcagagaacagagagagaggcaagatttcccaagttccataatggggaattccaatgcattctgatggagataatggaagctgacaattctcctgtcagtgagctttggtaagcggagtgaaatgcttgtgacaaaacagatcagctctgcacgggcctttctggatggcctcacagagattttccatcaggctgagtacacaatcggatgggactcaggagtggtgtctacagccctgtatttctgacattattaggaatgacaggctaaacctttatcccaaattacaaccactcagcatgtttaagcaagtgtgtaccttgtatcaacaatatacatagagatgccctgaaaatatcacaaaataaaattcctttcaggaacgtggcaccgaaagaaacaccgtcagcaactcagcaagcactttttttttcatatttggtctctttgtctagtttaaacccctcattacctattatcacacccaaacctatgtcttctcactttccttattttatagccaagaaatctaacaaaatcaagacaagtaaagactgagagctgactcttggtccgatctgtccacggtcaggtggttatgaatctcaaaaagcgagatctagattcaatcttttggaactcctgcccttaacattattgtacgcacatcacaacaaattactattttacatcagtgctcgagactgcacaaacgaggacatcttatttgtgatttgaccagccttaacttggtctttgatacccaccatgtaacatttaatgcaaacaccttaagttagctacaagaatgagccaagaagcaaagcactgtgatcaggatttaatcatggttaatataatgggttaagttctataaaattttttaaaaatgaaatatagttgttaaaatatagtcataggttatataaaatcttaaaatagaaagttcccttctccctaacgaagaatgaataaaagaatgagaaaatttaagttgtctggttctaaactaggtctctatttgtagaaaggagaagtgtgtttctgggattttctcccacttgtacaaatattgttattgtccgaacatccacaataaattaaaattggggattgatttttttcagtgaggacaaagaaaggcagaataaaacattgagaaggttttaaaaagcaaaactatattttaaatatctgttcctgaattaaacagttaaatatttttaatacaatcagaagaaagtaaagaatttttgttcatttttttactattcccattttatagatgaaaatgttttgttttattcctaagcactgattaaaatcattatcaagaaaaaatctgacatcactaaaataaacttatttaaatttaaaaggataaagcaaacaagcaaatgaaatagcggaaaaaacagtgacaataatgagttaatattcttaataattaagccttaaaatctgtaagaaaaatgttgagtctctatagctaaacagttataaaatctggacaaataattctcacacacgcttgtttgtctctgtctctctctttctctcccacccttccctccctccttcccttcctcctttctctctttctctcacctcttctcagagtaatggctaattattgcttgaaaaaaaattagcaaagaaacacaatgagtaaaaaataaaatatataaaaaaagaatattatcaaattgactaaaacaattaataatactactcaaagtttttgagtaatgatattcaaatttgttttagcaaaataaattctccagcatataaatgaagtataaatatctacaatacttttacaaagccaactggcagatttttaagactccctgggttttatgtagtaaatcaaccatagctcttctgagctaatgaattaaccctcaattaaaagaaagtattacaataacaattgctattgtttttgaagcatgtacttcatgcaccaaatacagtgacctgctcaaaatgagaaagcaggattggaactcaggtgtatgaagtctcccatcacccttttcatgttcatttcagcatggtctatgacttttgtgaactggaagcaacatatgttccacaaaagaagcaggaaatgacattacagtgcctttacacgatagagtattacatatacattaaaacaagggttttttcttcaatttgcaataatatgagaaagtatgtataagtgaaaaagcagtatgcagaattttatgtctagtattatctcaactctttaaactgcttatcaaaaatattccataaaagactacattaaatgtcgtctgtgattgtcttcaatagaggcattatagttgaattttcctcttcttttatatattttcagtaatgagcattcactacattaatgcactttaaaaatttttttaattgtaaaaataataatactcctgaaaatcttactgaccacatggatgataaagtgcaaacacctgtactccagagataatctctgtttagagtatggtatatattaatatatattctaggagactttataatacacatgaacttgtgcatagagattgtgtgtgtgagtctgtgtttatttttaagaggaatgggattatattaaatatattattctgcaatttgctttctcagttaataaggaatcaaggatagttttccattacttttatggtcagaatttcattttttatatcattgctattaaggtgaagcacactttgccatggcacatggaataagtacctaggggccagtgctccttgacaaaggcatgtctccaaaacttctgctatattatcaggctcttgagtttgctgcaattatagatttctaagaatgaacgaatgaatgagtacaatagttccttgcttaaattgcttaaagaaacacaaattaattggtctttcaattttctttgcccatctttgtaaatgatatagtagagagtcaaatatgcctttaagtatcagaagtatccgtttgtaataaaaaagaaaaatttaaaaaatcataccacaatttatttatgtggcaaagggtattgccatgttatttcatcatttaactatgtcaatcctgttcaaactccatctttgctcataataaaagagggatattcgagaccagaccagaacattcttgttcaacaaaattatcagaaggcccaagataattgcatgtttaccctaatatatataaaaggcagtatgtataagggtgcaaactaacagtgtcacattcagaaactatataaaaaccaaagtaggaaataccatctaaacttatttcataaatgagttatatataccagcttaacaaaatgtcaagaaaataatatttaccaggccctaatttgagcaaagctgtaatttaggtgggacttagactaacacatttggggcatataaaccatgtcaagcaatagaacatcaaatgtccttattctaaggggtaaggtttgcagttacaatagacttcaataaaatttgtttataattaaaatccaagcatccaagataaattgcactgtgggactaatacctactgtccccgaaacactctcattcactatactatgaggtcttcggcagtgcaaggatcgtgtcaatcatagctcagaaagctgcttagcctggaggccaaatccagcccaccacctgtctttgtaataaagttttattgtaacacagccatgcccattcacttacatacctatgactgctttcatactacaacggcagagtgatgcagcagagactctatggcctgtaagcgccaaaatgttttctcacactttttagaaaacgttcgccaattcttgatttagattactgtttgaaaaactgatttcttaatatttgttctgagtttctctctacaggtctgagtaactccagtaaggaataaaaactaaaatatgactgttcttattctagggaggcatggttagtgctaaaaggcagttttctgtaaaggttaagaagatagaatcaaatcccagctctgcctctgactcactgcaattctcttgcagattatttaagctctctgtgcctcaatttcctcatctttaaaacagtgacccaagaatacgaacctgaaagggttgttatgagaattttaaacatctcactcagcacagggcctgacacacaatgaggacttacattagctaataactcttcctatcatatatcatgataaccgctgaccatccaaagcaagccaacacaggctccatgtggtcattcttccagctctcaggtgctgtggttctccatgggggagggaacgggaggttccggttaagacactatgtgaacctgaatctacgtgggctggagaaagatacaaaatgcagacctccgtttcttcttctgcaaaacgtaaggacgacacaggagaacctctcgtctcagctgagcacatctacacatctatacagagggcccagctctaagacccatttagcctccttcctcatagacgaagccagggactggtaactcataatccaagagcaggaatggtcaccaattattcagaaaatctctggattatctaaaatcagcaaagtgttttgtgaatggggaaaaaatataagcctgtccacaatgagacggtaatttagttagggagaaaaataaataagttaataaacaatggtagtgtctttgcagtgactagtatatggaatgaaattgtcactttctctcactttacttgttcctcccctacacaactagtcctctatcccccttcaccccttcctctcttctagccttcccagaaggtagcaacacctaggtctaaagtgcttcagaaaggctcctgtgaagccagcatttctgagccagcctttggaagatccaaacaagcacgattcgtggtgggaacagatcattgtgaagtggggggtcagtccctacactgtcccagggccacaggaaggaggaaattgtgtggaggcctgaccaggaggatccctgagagtatcatgagaggtttagggcttacccagcaggtacaggggactgcagaaggtcccaggacaggaagtgagatgacagtggtatgcactgcaaataagtgggggcagcgcacagaggtaactgcaggagacaaaactgaaaccaggtaggcagtcacactggggcgcagaagatgctaagaagcatctaagccttttcacgtcttcgggttcctgagtgatgtagcggtggtatatgcccacaattgttttacttgaaagatttctctatctgaaagcttgctcattaactctcatttttttttcttttcttcttttcttcttttcttcttttttctctgagatgaagtcttgctctgttgcccaggctggagtgcagtggtgcaatctcagctcactgcaaactctgcctcctgggttcaagtgatcctcatgcctcagcctcccaagtagctgggattataggcacgcgccaccacgccaggctaatttttgtatttttagtagagatagaatttcaccatgttggccaggctggaactcctgacctcaggtgatcagcctgcctcagcctcccaaaatgctgggattacaggtgtgagccaccaagcccagcctactcttatttttaataacagaagtaaagctcacaagctgtcaaaaatatttcaatctgtaatttttttagtttcttcacttcccatttagatgtctcacttaccaaggagagagaggatggaggacgcgtttcctcaatcatgaatcacactgactccacagccacgtgggcactccagcccaagtctcacacaccaacacttcaaaaaagaaaatagagagatcctgtcaacccattttaaaagaggatgtggtcattggtcatgagttctatgaagttccattaaagtcctaaacaatcagagcaagctgctttggccacgtaggattaaagcagtgacgcaggccagcttggcatcacaatcatgctaccctagttcaggatcatgtgcactaatggattctttttcttcagaaaaggagaaataaaacatttaaatgctgttaacagatgaaataactctcataaaacatccagaagaaccattatttcaaaattatcttaaccagtctgaaattatctaaagcagtctgaaaattaaattaagattcattatatgaatttatccttttcatgactcattccactttttggaacacatggtaccttatacaattcaagaacaggagacaaaggcagtagcacaaactctgctagaaatttgagtttgtatttttatttacatactgatttattaggtgcacaattatgaggctttataggaaaaggaatgatgcatcgtgaaaaacaagccactttaccaaaaccaagtaaacctgtccaatctcgtcattcaatttcatatacaaaaattctgaaaccttgatgttgtcattggatggaaagatgaccacgaaacgccagcctccctagaaacatgtatgccagaggctgaaaatataggtgactttccatctatgatccatatgagaaatgtgttcatcaccagtgaaggatgcctgtgacttcaaatactgcatttcagggctcatgcttttttctgttctcttcattcatctggtttttctctacacttcccaggtggcagcttctggctgctataaatgtgaaacaccctgacattcttcctcgccaccctgaagaagggaaaatgggagaaagaacttcccagaacattctggctgtccctctaggcagtgattcccacacggtcagcttcagtcatgatccgaggccatctgcctgcagaaaatgaactgaacgacagcagctggaaatttataaaatgttatacctgctgaagtgccattttggaagccctagggttcagaggccagggaacaggtcaaggtggcactgcctctctatgagtctcccttcctccaggacgggcctttggtatgttcatgggaagcaagggggtgacccagggcaacacactgggacatgcctgcctgagacgccccagcagcccaggcaccctcatatcgtgcagcacggccaatcctccagtcccagcagagtcctcaaaagtccgtgacatcatcctttggacaggagaaggtgcagatgcaaatccttgaagccaaaagaggagccagggaagcacactcagtctcagaaatattcctcagagtggccaatttcttttacacaacatcactaatatcacctttgggcgtggcaacaaaatatgttagttgaaactcctttattaaatggcatgtttgaatacacaagcatcctctctccagtcctaaaatctattttacaacaattattactaaaatgtccttgtagttgtttagatctgagttgaaatgtaagtaataaagtttgacagatcctctggttaccgccatgaatagctggcaatttctgtaagttcccatgtctcagaactacattaaaaacagggctaataggtctcctgcctcccccagtgaggtcacaaatgagctgatgtgaaccctcagctggacagcaaaaccacacctgcagaatatgggtcagtctcttaaatgaaagagactggggccaaaaagatcattgcaagaattcacaatcagtaacacaaccagagagcaaatactgcaggaagaagacatccctgccgaatccagcatggacagcccacagcctggaccgccagacagtcctggtgcaaccaacagactccaaaacccagccccttccttgtggaaaagcaatacccacaggacagagctctcttggcttgggggaaaacacagcttcctacagagtttgatgtctaaacaggaaatcagtctcagcagcaggattcaagggtgtccacccgaaagggttgttactgtgcctgtgtttacataaatagtgaaaaagatattttaacagcctgggggcttgtcagccaagtgagccatgttgggactttctgctcctgagggtcagcccttgcctggggaagacagggtgctcaccaacacacccatgtgtgcctgggaacgtgcactcaggaacagaaatgatagtgacaaagcagaggccttgagttggagccaagctagaggaacagacaatgattcttgcaggtccagaagcagagcccccgtgtcctctcccagcaaggtcataaattagccaatgcattaatcataaatcactgacatattttctagaaaactgagaagaaagctgaaaggcaaagaaactacaaagccccagaggctcactccagactggaagttggaaaatttttaagcgacagttaactacccatttaataagaaactgcttattttttataaacatataaatttctctatttgactcaattccatattatccttattcttttctcttttagcttagctttaaccttggtgccaacaacctctgaaatcctctgagtcataattttcagagttctgcctcttaaaaaatgccaccatgaacatatatgtgcagaactatcttgacgacacttttgatttacaaacagtaactctttcccagaagttttgccctgtggccacctacactcttcaaattgtctctagatggaactacatgaagaagattgaataccaattataacttactaagtgctcatcagcacatgactttctgctaaaatatgcaaccttctccctgcccaacttactcagaatgaggtaagatgtagacttaagcattattttggagaccaaagttgagctgagtggtagcctttatcctgcagatacatggcagaaattaacatgccaggccagtcttatgagctgaatttagaaaccgtacaacagtaagattacactggaaataaaaatggacaagaccacctggcatcagaaagtttagtggagtgatgaaaagaaaccgtaaaagatacaggttcaagaaacctaagaactgctgggccagcatttcccaaaggcaagacttagaccagtgccatggcatttaattgacaggcctctcatcatcagtccctccgttaatcaccatgcacagcacagccccatggccacacatggtggatgcttagaagacaaaacaagaacctattacactctcaggagctgtctatatgatttttctgctatgtagttcagtatatactatgaattggaggaaagagaagttacttatgggcagaagagtcaaggaaaagatttctgaaaatgggaaatgtgatgtgggctctaagggatgaggaggagataaggaggatattaaaagacacagtgaagtatgttttagtgggtgcattgcaggtgaaacaaacagtagatgagggaggaacagctgaaagtcatcaggtataagagaagagccatttacgccagcaccatggtgagttaaagcatgagttcctggtaccatccctggagttgggtggaaaccccaccacggagcccaccaagataagagtttgcaggagtgcaaactgaatgagataggtgaaaaaaagcaattccacaaaggtaaaaatctggactgcaatgccataagaatcacagacagaaatctggcctcatgctcaagtccctggaggaagacaaggaagtaaacaggagggtggattccaggtggcaggccaaggagcagggagggtggcatcaggagtgtgtggaggcagccagcatcggctagcagcagcatgtgccacgatgactacctgcaagatcactcacatgcaagagcatggagagctcaaaagaggcactccagacagctaacagatgggaaaagtagatgacacacagattgtagggaatgttaacatgagaaagagatgagacttcatccaaaggaaggcagagtcactgaaggttcagtgggatgtcaggatgagcaaactttgggagggtgaatatggcagctctgcagaggatgcacaagacaagaaggggagaagctggggtaaaaagccgccaccagagaactccaggtatgaggagaattgcagtgaaggatgaacatggcccttgccaagcaaaggacttgcctttgccaagttcctgggaagtcacctctaagaccttagaatgtcctgcctgatgagagactttgttttgggggggctttaggccacacagatagtctaggctaaccatgtggttaatggctgagggcttgggcctctctggattagtctggccatgtctatgtggtcaattctcaataaaaactcaggacaccaaggctcaggtgaagtcgcctggttggcaacaccctatgcatgttgtcatacatccttgtgggggaagaagcactgtccacgtgtctccactggaaagagaccatcagaagctcgtgactagcctctcctggactccagctatgcaccttttccacagctggagtgtaaagggtactactgtaccctttgactgagatcaaccataatcactaatacaacaggttttacacattcttagagttcttcatgtaaatcattgatcctgagggtgcccatgagccacatggcaaacagggtcagggggccccacatgactaagtgtgcagcttcagccctaaacatcaacatttaaaacccaggagcaacaaatggcctatcgcattggaattattcacaaagaaaatatattccacattcccagaaatatattaactatctaaaatagattttaaaatatgctaaataaaaagtcaaaacatcacagtccatttttgcaaagaatcacttatatagaaacatcagtctaaaaactcagcatgtacttactgaggaatgaatgttcttgaatttagggcaataaactaaatgacgaaaatcagaattttctcagtaggaatgaaaatacaaaatgagtaaaggacactatttttggaattgccttcatccaatgccaactggtttgattgacaggaactatgtggaggacccagcactcagatgtgggctgtgggataatgaaacgccattcactctggttatacgcactgcaaccctttctgtcactgtccgtagcctgggtgtccaggcttccattaggtcacttctgacagcctctgtcacttgttccacaggtggtctccacaggaatgtgcttggataaatcgacagtggacatttaggataataatgtcccttgaaagaatggcaatctctgtggctgggggtccttggaaaccccagccactcaagaaaacaaagagtgggtgacaggaacagagaacaaggctttgaggcaaaagttatagggaagaaagcagagagaggggagaggggaggaagagcaaaagaaaaggaagagggggaagaaaaacaccctagaagcagctacagggataacaggatgtcctgaaatggtgcagccaactgaaaaatatgatataatctatcattataaaatggacttttattgtttccttcaacttttgttaaaataaattttatggaaaactgaggtttacaacatgatgtaatgggtgacatatagatagtaaaatggttactctagtgaagcaaattaacgtatttatcatctcacatagttacattttttgaggtaagagcagctaaaatctacttatttcacaaaagttctaaataccatatatggttctcacgcctgcattagtatctttgaaggatacaaataacagcaatgtcagcttcaggtacgagggaggagggccagttcctggccattcccttccactggcagaacgtctgctgccagctaccaccacattcctgggcaaatattccagcattcaaggaaacaatttgaaaaggaaaagcaaaatgcacaaaagcttgaggtgatgaagaaattataggatgaaggcagcagccagccccaaccactcttaccatggtccagggagcagccgcataccccaccccttctctcctctacaggccagcactggctggggtcagaggctgatccatggagcaagtccattgagactcccaaatatgagattgctggccactttacattcaagacagggtcaggactcaaatgaaaaatgatgtaatttttaaagatagatctctggatttgttcaatatcaccacttaaatttttttttagtttattttttttaattttttttttatttccaaaggttattggggaaaaggtggtgtttggttacatgagtaagtgtaaccaaacttttgtggtgacttgtaagatcttggtgcacccattacctgagcagtatacactgcaacctatttgtagtcttttatccctcacccgctttccaccctttcccctgagtccccaaaggccattgtgtaattcttatgccttttcatcctcataacttagctcccacttatgaataagaatatacaatgtttggttttccattcctgcattactccacttagaataatagactctaatctcatccaggtcgctgtgaatgccattaattcattcctttttatggctgagtagtattccattgtatagatataccacagtttctttattcacttgttcattggtgggcattttggttggttccacatttttgcaattgcgaactgtgatcctataaacatgcatgtgcaagtatctttttcatataatgacttatattcctttgggtagatacccagtagttgcaccacctaaattttgaacggtatttgacattgtgatgtctaaatgctgagagcggagttagaaagagatgggatatagtgggcccatctcttaacggtttttctttcttaaggatgttcctttgcctcttggtttgcccgcaccggcctgaatacagaatctgtgcaggaccccagccaagctgtgcacagacaaacaggttctgaatgaagtggtgtctctagcagggacagcactgatgcaaacacccatggcttacacattagagaccttacacaaaatgtgggacaaaataaatgcacagagaaagaaaacacacacacatatttacaatcagatcgttatagatatccaataatattgcattccaataagcaaataaatggccttactttccacatcagcttgaacctccaatcagagaatttttcctgcatcccagtttagcatgctggatgttgtgctgaatgacgtgcataacaccacaatgacatgggaggtctctgccctcaaggaattcagcctttggaatcgcttttccccaaatcagaaacaatctcattaggaaccagctaatatttgatctagaaataattccacatatttaccaagaacatttaataaagaatcccttcggtaaatatctctcgtgccattaaaaaaaaaaaaagtgggccgggcacggtggctcacgcctgtaatcccaggactttgggaggccgaggtgggcggatcacgaggtcaggagattgagaccatcctggctaacacagtgaaaccctgtctctactaaaaatacaaaaaattagccgggtgtggtggcgggtgcctgtagtcccagctactcgggaggctgaggcaggagaatggcgtcaacccgggagacggagcttgcaatgagccgagatggcaccactgcactccagtctgagtgacagagtgagactctgtctcaaaaaaaaaagtgtcagatgtgagattccccttcactgagtctctggctcccacagggccaaagtaagaacacctggagaccagtcccagaggtcaaggcctcatggacaataagtccccatgtgatgacacatgacctcacacctgggtcatttaatcatgcaaatatctggctctatgactggcaggggcaagttctactttcctgtacagaagagcaggcacttctacaagttgtatccaaagagtaagatggcatgaaagagaaatactcttcccacttggagccttcatgcccagatccagcctgagacccctctctccatcagacagtagtcactgtgaatggaatgatctagaaatattaaacatagctccgagctaaagaaaaataaacacagtaacaggggattttgtttctcaaagcattgactaatcctaacaacagtttggaaggaagaaatccaattgttttccattttgtcttcatgcagattatcctttggtgaatatttaaagctagtagaaatagctggcactcagtattgcctcagtaacggaaataaagctggagtaaacacttcctatttcattactctcacatgagacaatgatgtgttctgaactgcaaagaggcatggggctgagggaaagaaagagagggggcaaaaatgacttctttattaaagcaaacaggttgccaaaaactaagcaagtgctcaaaatgagcaatttctgttatgcgctctctaaggacaccagggcctcagaatagtgaatactttcttattttggccaccatgtgccagattttcaaaaggccacctcacttttcatgcaggcaattttgaagagcttgcacaaccagttaatttgcaaggacagccggcctctgggcttccactctgacagctaaattgatcaatcctttgtagaggaaaatctcagtccctagaaaaaaagggtgtctgagaccctttgaaaaatgtggtctctcaattcctacttattcagaactacacagccaacaagacttattctgtaagcagtagtttgcctacacaaaggagactcaagatttaactctagatctaaatttaagatttaattttaatattaagatttaactctttaaaaaattatttgactactcttgttacttaactatctctgttaaaacataaaaaaagggctgggttcttatatccgccctctggtcattacatagaagagcgaaatgccggccacagattaaaccacatctgacaccaaacctttctcagagaaaaagctgagctgaggcagacaagtctgttaagaaatatgaaaacagagaggggctcatttatcccataaaagttggctaactgtgaaattcacaatgaattattagtgaaatggcaattggttaaattgttcagaaaaatattttcctaaaaacagaacaggcagtagatttttagaattttctagctacacactcagaaaagagaaatgaaaggatgtgctccttcaactcagtaatggaaagaagattagtataaacccgtgcaagccaatccaatgtgcatattgggctctctgtgacttcacttattttagatacctaagccctagtgtcactgttttacatggtatacaatgatctgggccaagccaattgcgttttgccttggaagacaaactctgatgttctattctggcttaaacctagtgaatgttctggagtcattttagaatgttcgcttctttgaacacatgaaaaagaagacttttaaatcctcctgaatcagtcccaatgacctgtcaggtctttcatcgtccaagatgggcaccaaggcctaaagaagaaaatagcatctcattttcgcattacggcatgcaggcaacttgctcaggaatgtgaattccacctaaacgtttgtttcatgttttatagaggacttaacactatatgaatccctgagtgtgtcgcacaaccaaaaatctaattctgttctatttgtcatcccctcaatataaattagtgattaaaaatgagaaataagctacaacacaacaaaccagatggtgtcttaccttcctataaacactgttgtgtttagagagtttacacatgtgggggaatgtaatgacttatttttttcacatttggcaatgagtcatgtcatccattttagcacaaactgtcctgaaacttcctcccaaatgaagacatggaacagtttcactaatatgtaaaagcacccatgccagctgcctttgattagtcatgatgcctctctgcccactctacagccctcatctaggagacaacctgatccagtcggacacccaaacagaaccaaaaggtcggcatgtcctgaagtcaacctgctggggaagcagatgcacttttggaggggccaagatgcttcttccctttgcttcccaacacatacccttaaaaattcaacccaggaacttgatttaacagtgtcctcctctttacttttgacactctccccaacctttctgagctatcctatggacctaacatatagaagagaaaccatgaataatctcaggaaagttctaagttcaccaattattaaaggagccagagtctatcccaactgccaacattcaatggatgtccactctgtggaactaaatgggaaggaaacaagaccagcctgaaatgcaaaccatgtttgacaaaactgtgtttcattattttacactgacagtgcttagggctatgcctgacacatggtaaacccctagcagggagttagccccgccccttctgcctaccccaacagtggaattgggtttatgtttccccttcatcatctgtcaagacaactcctcccctccctttgtggaattaacagtattaaactgactgctggtgttagtctgctttttggttttggtttgctaagccattgagatagtaacacctctcctcgtggtacctgtgaagtttatttatgaaactaaatccagatctctgtaattcttgctctttagattttatcttattggcttgacttcatcactgaagccattcatcctaacatccctgcctgctggctctctgaaatccaggtggccctgacatccccgtgtgatgttgttgcctctcctctgtgaccgtgacatgtgatgctggcttttctgtttctcccatcaccctccattgtttacttctctgtctcctggtcaagggcaggcatctgtcttagtcagctgacttcacattcccaaggccaggcctaagtaaatgagcatattcaagaacaacagtttggttggtgggaacgtaaattaattcaaccatttggaagacaggtggcgattcctcaaagacctagaggcagaaataccatttgacccagaaatttcattactgagtatatacccaaaggaatataaatcattctgttataaagatacatgtacccgtatgttcactgcagtactactcacaatagcaaagacatggaataaacataaatgcccatcagtgatagactagataaagaaaatgtggtacatgcacatcatggaatactatgcagccattaaaagggacgagatcatgtcctctgcagggacatggatgaggttggaagccattatcctcagcgaactaatgcagaaacagaaaaccaaacaccacatgttctcacttacaagtggtagctgaacaatgagaatgcatggatatatgggggggaacaacataccttgggacctgttgggagcatgggggagggagagcatcaggaagcatagctaatggatgctgggcttaatacctaggcgatgagatgacctgtgcaacaaaccaccatgacacatgtttacctctttaataaacctgcacatcctgcacatgtaccctggaacttaaaataaaagttgaaggaaaaaaaaaaagaacaacagtttgatgaacatttctcatttttatctcagaatgtgtgtaaatattaacaggggcatatccctaaagttagctttaacatcagtcaaaatcacccaaaaatgcaggggaaattaacccgggtggtacctggagatgacctaagcctcacccagatctagaagataccacacacacagaaggtgcctgggtaacgtttggcagatagcagcatgcaggaacccctttcttacaagttgctagagaaaactgcagcttcctcctccagaggctctaggcctaccttgatcccatctttcctcacaataaaattctcttttcaatcctccttaggaggttttctagtctcagaagaagccttcaatgctgttcataggagattaggtccccctgttttagataacaatggctgtccatcctgttcatgctcataaaagctcaactttgcacagacttccctgtgcaaacataccgatgtctcccctcttcctgtccattaagctgagtcccctataccaggatccttctacagacccccttggggcggctgtctccactgcccttgagaaccactctcagcctcagagacatttccagaggagaagggctgctcatgaacacagtcaagtggggagaacgaggccaacccggtggccaatagggaccaagaaggaaaatagcttccccttagaaatataaacattatctttgtaaatgtcatgcttatatggataatccacttagtaagctcacttttcatagatatcaggccagttgctaagtatacattgttccagtatctgaaattaatgatattcagtttaataggagtgttcctctatatagcaattctgcagtcattgattaaaacagtcctcacttttgctgtctggactcccattctccctccataatcataggcttcaggctccttcacccatccaatgacctgaaagcatctcccttgctgctgcctgtcacacctacacccctctccactcacccagctgtcccctctccccagtcagccacagagaaaagtttgaaggagctttcttctcactgcccagttttctattttacagaaggctttagaaaacacatatgtgctctggctaaaataaaagtgaagttataatgtgatctaccacatcaaaaaaaaaaaaaagaaacggaaaatagttttagttaattcagcatcagaaaatcaatatgtccttagcagcattctgtgcttgacttcaaaatgtgtgttttaatcttgactttattacatgttgtacttggttagctcacacttagaattctcatcaactgctttttaggtctgtggatgggaaggtactccataagagaaatcagcctaataattgaatacagagctttaaaaagaaaggcttgtataactctgaaggggacaaaacaatgacgcagaaataaagtcagactacagcagttcaaagacctgtccttgtttgtgattttttttctaatatacagactcaagggttcaactaagaggctgttgtcggttacgcttctcatctatatcctctctcagatcagcagacatctagccactctgctgcatgctaatataaaatctgtctctgtctcctcacacatcccgtcagagaaaccatctaatcatgaaccatcctatcattacagcagccactgtaaatgcttgggaaattaaacaacaaacaagactcctcattcaaatggaaagctggcagcattgttggggagatgacaaaacccatcattagactgggaacaaactgccttgccctatgtgccctttactgcttctctttttcagggtacgctggaagaaggggcatagctatccattattcactgacaatctcataagtcatgccactttcctaactattgtaaaagagccatagtcagaaaagtggggtgaaatgttggtgacagctgcttatctcaaaggcttctaaggtaaaccaccaaaccataatttgatgcaataatatggtggttattgctattccttgaccaactactcccaatcccttcaggttagatttctcctatttttacattctggagtacacagagttctttcaccagtagctaagaagatgcaaattgatcacaacctccctgaaataaaatgaggagggtaagaaatggcccaggtttcttgattctctctgctgtgaacctggggccatgtcaccttccccgtcttctttcctgcacggctgaggatggcagacagtaactctccttagcagacaaggcaatctacccagcatggaggaaacaacaagtaaggactgaagttctacccgagccacctggtagaagaggaggaaaaaaagatgaaggaaatctgaataattgaaaggcgttagccctacacttaatctgcctgatgttacataataaactctgtcagtagaaacagactcttcctttcacccacttccttcaccttttccaccagatttcttccatttgtcacccctacagctcagaattggccctgccctgtctcctaatgctgaggacagaccattaaaggaaggaaggtcagagaaattacaatgacatggctttgttccccaagaacattcactctggaagctgtcactgctcaaaagacatcttcattctagctcatatggccagagggagcccccttctcctcaattccaatttgctttgacagacacatggctgtgaagcagtggtttgcttcccggagctgaagctgcactggaattccaaagctgccctagccctgtcaacagaagtcagcagcttgaagaagaactgctatccagtcacagccagcgttccctgacacctgataatacacactctctcaggcaagatgcatcccacctcagattattccagccctgcctctaattgctcccaccagggcaaacagggtggcattctgctttggaaggaattattaaggctatgttgaaatgaaagtcaaggtgagcccccgcaaatacagctgcattttttaatccagaccaaacaaaactttcttttagcttctagccacactctcccaaaacaaaattttaaaagaaaaactgagatgcaggtctaaattatataataagaggaaccccagtttccctacccagtttgttactgaagaagctatttattacaaaagctccagagtcactgttctcctccaggtccatgcagaagcaatgaagcccaacgacaataatgccatcaggagggcaggcaaaaagctcgttttaaggctcccaacggggtctaatacatcatccaggaagaaggactactctgagaggtgcctcagagggaaaagcctgtcaaatgactcaatgccaccagactctgatctgccaccagaaatgctgcaaccaccacagatactcactgacatagacagaaaatcctgcttcattatcctaagtctaaacacgtactttatacctgtgggattaaaagtgcaaaaggagtcagatcagtctagatgttatttattttacatagtaattgagattcataaaagaaaaatacagttggacctcattatccagagattacatatttgcaaattcacctgttagctaaagtgtatttgcaacctcagaatcaaaacttgaggcacttcccagccattcatggacatgagcagtgaaaatttgagtctcctgacaacaggcattcccagccgaggtctgacaaggcaatcctatcaccttcttgtttcagctctcatactgaaaataagtgccacatcctctatttcgtgccacattttttgcactcttgtactttttgttggtgatttgtctgtttaaaatggccccaagcatagggctgcagaactggctggtattcctaagtgcaggaaggctgtgatgtgccctatgaagaaaatgcatgtgttagataagccttgttcaggcatcaattatagtgctattgaccatgagttcaatgttaatgaaccaattgcatattaaataagttgtttttaacaaaaaatgcacttgaaacaaggttatttattgatcagttgacaaaaatatggtgaccagaggctcgcaggaaccaaaccctatatttcccctaggagcagtggttcaggatttgctaattcagtatttgcagtgacttcatagagcataattaccacatgctctcaatgataagaagaaaagacgtaaaatatcaaaggacatgagcaacagatataacaccctaacagtcttccccagcctgacacaggatcatcacaggccaacctgaaggactgtgtaagtagagttttttcagttcactcagaagagtaatcagctccacagagggagatccaatggaagctacctactcactcctgaaagcaaagtactagccttcttgcttcaggggagcacagaacttatcttgctaactgaaagctgggagccactggtgcctgactgtctagcactagccaccctgggcggagacctttctgaagtcatcctggagtgaaaaatagactcctcagaaacacaaatctgtaccattgacaggcatcagggacgacaggctggtggccaaggtcacgtgctgaatggaggtaggaggctctggctgtgactcatgggactctttactgctctcattacataatgtgaaccagatcctcatcttctcatcagataatgatctttgttctccagactaaaggggtgattacaatctgaagagctgattgtgtctcattacacttgtgataatatattcctgatgaccaaggctaaccaaggctattaacttgaaccttcaaataccaacagtcacaagttgtccctttgatatattcgcatctgttctgtgttgaattgaaaaaggttttcttgctacaaaatgtgtaaaggagaaaaagttaaaccagtacagaacagccagtgctgtttttttccaatccaggaaagcatcttaattcaattgaatgacttttagtacactgagatcttaacgtaaaaacaaaacaaaacaaaaaagcaaagtgattcataaatgtcacagcataaaaaggtccaaagccctcactttattgcttcctgatagtcttaagcgcttctcctctagcaatgttttcctctgtattataatcttaagaactataaccactaccttttggaatggaattggtttccttttaaaccactttcctctctttatgacgaaaaggaaatttgagtatctttctctacctccatttctacattgtcagttgtcaaaagaaagtgaacaaaaataaaagaactagatgacatgtgttctcagattcagagatgtactaataaagggatacacgtactattttgcaaatcctagaagactaatttctatcatgatcacaaaaaatctaagttggtagtctccaaaaatggattcatgaagaaaatcagaataatttatgagtgacaaatcaaactcaagagttacaaataggattcaggtaccagaattttcattccaccagcataagatggggctttacctgaccctgtccctgtccctgaagctgagtgaactgcagactaacggcacctctgtctgagtttcctgctcagatagcatattgcagtttaatttattttattttattttatttatttattttttttttttttttgagacagaatctcactctgtcacccagactggagtgcagtggcctgatctctgctcactgtaatctccgcctcccaggttcacgccattctcctgccccagcctcccgagtagctgggactgcagtcactcgccaccatgcccagctaatttttttgtatttttagtagagacggggtttcaccatgttagcaaggacagtctcaatctcctgactttgtgatccgcccgcctcggcctcccaaagtgctgggattacaggcatgagccaccgcgcccagccgcatattgcagtttatttctagagaaagcatcaggactaggaagcagtatgtcaacatgaatgggccagaacagagaagggttttaaactgcaatcaagcaatcttatagtaagaaattgtgagaattatttaaaaatgactattccatttgacttttcagccaaaccaggctctaaaattcccccaatctctcagaatattagaagctaaaacaaggacgtgtgtataaataaattaactgagagctttaaaaagatctggtgacaacatgaaaggaaggcttacgacccactaaaattttgaactgaaaagcagagaaatggttgttatttgactaaaacttacagaagacccttcttcttcggggaagcaggagtgagtcagcaggggacacattatggagaatctcaaatgcacaaagcactgagaggagaaagggatgaaaagaatttcaggacaatccagaggaggtgcttaaaaagaatcaagtctctgccaaagacagaaagagccagctctttgtttcagagaggcctgcagctacaggacttagattggggcataaattctaattaaagcaaatctttctagattccctgaagaatttccactcaccagcttcatctgtcagtgtggcttgagccacttgctacacagctcgacccagagctgctctgtccctggccatgccaaggaggaaactgtgtgtggtagccacactctccctacctgggaggtttatcctcttctgcaactggctgcttctgtaaagacaagcgtctgggtgcagatgagcaccaggatttgaccaaggaagaggaaggaggttaggaagcagagaacaaaacacaacaaaacaagaaaattaaaaactctaaccttcaagggatttcaaggagaaaacagaggaaaaaggacaagtagaaaaaaaggaaggcttctttgagcaggcagagcacaattaaggacacctgtgattttaggagctaacaaaaagcagatgtgtcatggcctcagactcccgtcccttcagcccagtcctcatgcagcctaactggaccccaaaccacaaaggggctggaggagaaaagggaggtctaagtcagcccagctgcaataacaaaggcagaaggctggaaccacaaaagcttttaaaaataaacattgtgattcaaggcaaggggggaaaaacagcactgagggaaacttcaagaagcactggctctcagcagacatcattttaaagaaccatttggaaattgccattcaatgaggtgtttaaatgacaacagagaggctgtcttacccaagtagaacaggatcaaacagagagatcagaagtaccctgccctgctcgcacttttctacagagcaactaaacttgcctttcatctctccaggaatactttctccatcatgaacgtaactaaagcctctaagacattgaaagatctggaattttcatactgttataccccctacacattctagatcgagcctagcaaattagcccaaatatgtatctatttcagagcttttaggaaaatagctagtctccctgtttgtactaaccacgtgctgcttctaaattcaatgtctgaatgtgcaaactatggcctagaacttcctaagatacttaaaagaaagaggaaacgtggtaaacctacaacacgcaaactctccttgaagaggacttctcaaaagctcctcagaggagtagaaatcgcaccatgatctaagttcaaaccctgtcaccaatttctacctgtgcagagtggatatgtatttctgttgttttttgttttgtaaaacttctctcagtttcttcttctgtaaaagagaggtaacagcaaccaggttgcaagtaaatgttgaggttccaacaatatgcataccaagttcctcactcaaaattgctcttaacccttcaatattattatcatcataacaaacaaatatttctgacaccaaagggctgatggttaagagtgttggaatggtctactctacgagcctgcatccatgactttacccatctgtgcctccttgcttaatataaaaaataaggtatgttagattaatttctttaaggcccatttgaggactaacaagtctagttgtctgggaatttgaattcttcctctgtattttacaactgtaaggattcatcctattgctattaggaaggtttttttcctccaaacaacttttcaaaaaaagaaaaattaaatacattaatttgatgccttttggggctacatgttttgaaagggtcacaggataagattttgatatgaggtacaaaaggaaagaaaaataattcttgaaaaaccagcatctctcctttttttttttttttttttttttttgagacagagtctcgctctgtcacccaggatggagtgcagtggcgccatctcggctcactgcaagctccgcctcccgggttcatgccattctcctgcctcagcctccccagtagctgggactacagccacccgccaacacgcccagctaattttttgtatttttagtagagacgggatctcaccgttttagccaggatggtctcgatctcctgacctcgtgatccgcccgcctcggcctcccaaagtgctgggattacaggcgtgagccaccgcgcctggcccagcatctctccttttatttaaggatgagacaaagccattatgtatcacaattgtgtaaaggcacaaagagctaatgacaaagggccttctttgttccctagtcatagcagttttgttctaaatcatcaagtctgctacctcctaaaaattgatctgatgaatctttcgctctttctcaagcttttgaaataatgtagaacccataaaccctaaactaagatgaacatttgccaatgacactccttcatcaaactttaagctgctcctcctcataagcacatcagcaacaaggcagttaaggtgattcagatagcaggcactcgcccatacgccacccagcacgccaaggcagcttttggtcagattgcccagcaagccacacaagatggtggcaaactgctctggggctgtgggagagagccaaacacagaagctccaagggtgagggagggaagactctacagaaaaccagggctccatgttcaaagctgagtttgctgtaaaatggagcacaggaaccctgaattgccatgaataacagtgccagctcctcggaacacgtatgagcatcaatttgggaggaacccaatgacaaacgacagatacaagtagttgagaggctcctaggcagggagtcccaacgatgtgcacattttacaatcagatttgtatcaaaggcatcctttaatgcccccagggacaactttcagcttcagttagaataaggtaagctgtgttgtaggaaaactgattcaagtagtcttggaagactcagccaataatttgatctattttcacaagaaaatatgaaccagaatgatttttatcaatgccagtggcaataaatagtgtacataatatgctatacgtagtatataaggttaatagctaatatcaaatctcaactttttaaaaaaagtcccataattacactattttctttaaaaattagaactgtttcctggaaagcctttgagggatcgtaatttaaacagattttaaggcagctaccctgatacctgcttcctcctgttcacactcctgcatgatcccttgagggtaggtgggacctgtgacttgtttctacaaatagaacacagcaaagataatatatatgcatgattaggtcgttatattatataaaattgcagcacccatcttggcagcttccctttctccctggctggcttttggattcaaacagcaatgctggagaaatccatacgacaaggaagtgcaggcagcctctagagctgaaaaagcctccagcaagaaaatgaggccctcagtcctacaaccacaaggaaacaaattctgcctacagcccaagtgaaccctgaagcagatccttccccagctgagcattcagatgagatccaagccccagtcaactgtccttgattgcagcctcggagaaaactgaacaaagccagatctagactcccaatccatagaaatgatgacataatataatgtatgttcttttaagtcactaagtttgttgtaatatttttatgagttaatattagtagataactgataaagatcattaaatctcaagttgttaaatacagagaaagataaataattttatttaaaataaatctatatgattgtttattcaatggaactggtctataataaaatataaatgtatattttaaatgcctgattttattaagcttctttttaattacagcacaaaatcaggcattgcagataactgattccttttccatttacaattctgcagtggttctaaagaaagcaaggtcataatcaaataagagaaataaaataacatcaaaatatcagcatttgatcattagttaccatggagagttcagcttttaaattgacctacaatgattagacagtgccacatcatctactgtcaagatttgttttcaaatttttggtagctcatataaaacacctctgagaatactcagtaggagatttttattctgattttatcaataatacaaatgaagaatctgattgttgaccaggcatcagtaaagtactgtattactaaattgtgtaatgataggagttcatgggttagaacaactgtcagtgagttcacagaaatacatttaatattgtcataaatatagactttaaaaatacgtagaacaaaacagttttaacaaaacagaaaatattcaagaaaagatgcaagtctatttcaacagattaagtatatacccaaaacatgaaacagcctatgcagatactaaagtatttttaaaatcatatttatgaattaatttaaacataattagtataagtatattatttcaatctgtctactattaaagattaaaaaagtaataaaatataatatgctagatgttcaagtagcaaaatctactcactcgaagcaaaacgattttgattacttctctactttttgggaaaacagagaaaaatgattttcagtcttgaaatgtttattaacttgaaactgaaagaaacattccaatttccatttttgaactcccagatattaagggattgctatcttctaaaattaattatccttttaatgatagtatatgacacaatcaaatgaaattatttgctatattaaagccatgtattcccttactaagaagcacctatgataacctatgtcattatgttttgaaatttttcagcttatttattaccttaagacttaaatgtagttaagcaagtatctattttgttatttttatgaagagtaagctgacaatttttccctcaatttgctatcttagatttccctaaaccttgcttagcaagtactctatcacttctcttggtcttaactccaaagatggatgagaaaacttgagtatagacaggctcactgtaatttacatcattcatggaaacgcctctttccttggtcgttggcttttctcaaacatacacttagcatagagatttcctagcatggaaatgatggttaaaagctcatgtgtgaagatcagctaggaaactattgtggcaaagcaggaatatggaaaagctgaataccaggtattatttcagatttggttttgttctcctcaaggtgtcttacagagaatgctcactgaatcttccagggtatcttaaaggcatggaagattataacttaggaaaaagcaaatataatgaccaagagctgacaccaaatggaaatgcttacagcaatagcagtcagctgcctgaaaacctcagcttgcccctgttattactaatggcccaggtaaggcaaagtccttagttagaaactgaaaaatcaattattggctgccaagtactggttgacctgacaatagaatggcatagagaatgatatttttccaagtagaggcccatcatcttctgattttttacagtagaatcaaatgtggggtcaggaacacctgctcagaaacaccaccgtgatatcactccagcacaccttgctacctctcttccctgaaggatgcatctgtaagaagcggtgtaattagagatacttcactgcacaatcatatgtggaggaaacagcaatagtatagtcctgcagagacaactaagtaagagacaggcaacgattcttttatttaaaaaactatgagtatagtctaaatagtttggtgtgtttgcacatatgtatgaacgtactccacagatgcttggcatttatcattctgttacctaggaggggacttccactctgtcctataatctccaagttagcctttctagccagaaaaaatcagggatcaaagagacactgaaactgtggcaacataaaaggcagaaacacaaatgtcttgatcattggcctacatccattgttaggatggtggcactgctatctacaaccttggcttaaagacttcaatcccaagactttctcatactcgagttctagaagtatctctatcccaaacctaaacaaaatgttcaccaagtcttccccaaaattgcctcttacatgagcacactttttaaaagaagacatacacgcagccaaaaagcacatgagaaagatctcaacatcactgatcgttgaagaaatgcaaaccaaaaccacaatgagataccacctcacaccactcagaatggctattattaaaaagtcaaaaaataacagatgctggcgtggttacagagaaaaccaatgcttagacactgttggtgggagtgtaaattagttcagccattgtggaaagcagtgtggtgattccccaaatagctaaaaacagaattaccattcaactcagcaatcccattaattgatacacatacccaaaggaatatatatcattctaccataaagacacacgtgtgtgtatgttcattgcagcactattcacaatagcaaagacatggaatcaacctaaatgcccagcaattttagactggataaagaaaatgtggtagatatatagcatggaatactatgcagccattaaaaaaatcaagatcatgtcctttgcaggaacatggatggagctggaggccattatccttagcaaaccaacacaggaatagaaaaccaaataccgcattttctcacttataagtgggagctaaatagtgagaacacatggacacaaagagaagaataacagatactggggcctatcagagggtgcagagggaaaggagacaggggatctgaaaaaataactaaggagtactaggcttaatacctgggcaatgaaataatctgtacaatgaacccccgtgacataagtttacctatataacaaacccgcacatgtatccctgaacttaaaataaaagttaaaaaaaaaaaaaaagaattttcaagaactccctgggacatgaacaataaaaatgccttttgtggatgcttaaaaaaagaaaaaagaaaagaacaataaggatgcaacttgcatccaagctctgataaaagactcatcttgtgggaaaccatcttaatttatgttgagcaagaaagtcttattggggaaccacctagtctgaagaaaaacagtgaaagcgttctcaagtgcgaagtatggattctgacaacgaattctaaataaaagatcattgaaacaactaaagggagagagggaggttttgtgataaactgcatttgacagagttcctttagatctagaaaaaacaaaaccctccatacacttatggtatctcctaaatattaaagtcttctcgagggaagggcaggaggtcaggacaatatcatgaacaattaagtattattttccaggcaagttagttttttttttatttttctaaactgtcagtggcaatcattctctaaagaaaaggggcctttattctgagcctgagtaaacatagtgaagttgctatagaaataaagaagccaaaatctaaaccataaaaaaactctggtgctaaaaatggatactctcattttgctgcaaaattataggttcagcaggtgctccaagccactgagacctctgctgccaacgtggggctttcctctgtccctaagcagctcactgtcttccaaggaatctaagtcatagaaatggcaaggtgtattgaatattctggtagtagatgctagaccaccaaagttgtttcaaatcaacagctgtaaccatcagacttagcctggaatgtgttctcatctggctctgttgaaaaagtactccacacccccctgaaggtgttttcactgtgtctgcgttgtggctttgggggaacattatctatgttgttactggttgataagctacactctaaaggcgaaatccaaaggagtcttttcaaatctgtgatgctgtattcagattttctaaacctcgacactgttgacatctggggccagataatcctctgtcatgggggagctggtctgtgcatggtgagatcctgagcagcgttcctggtctctacccacaagacaccagcagcagctctccccaccctgaatgacaacaccaaaaatatcattagacattgccaaatgtcccctaggaaacaaagttgcccctgattaaaagccactgtgttagatccatttaatagtataactttcaaatgaggccttgaaaagtatagggtaaatctatttgcttccctatttggaagataaatagttacaggaaaaaaacaggagccagaataatgtctaaactcccatgtcttactaagagtatgcatacatacacacgtttccatcggcttagaaaatttctggaaagaactgttaagaagatgttaatagtgcttgcctctggagagtgaactgtttacactttcctactgtttgaacagtttactcacgtaccccttttcaatcatgttttaaataattttaataacatatttttaagtcacattcaatatattttttagaaagcaataggtgttgattttcagtcaaattagagttaaaatggggttttccaatccatttgaaattccaaagcccccgttgagggagctgggccccaggcttggatgccatctgccggcagcagccccagccctggcatggaagcttgtagaccatcacagcctcctttgagtggaaaacagaataaaatggaagaaagtgccacaaaagcccacaaaggattgctcgctgtgtggtcatcgttctctggaataagatccttagtcctaaagcactcaggtctcttttggagcagatgccagtggcaagtctcacagcggtctgcaggcaccatgaagggaggtctgagttttctgtccagcacgatggtctgcaagcgtgtgcggacctgtggctcgtgtttcctagtaatccccaaaaatgcttccttgaaatgcttctttaaggagccccaactacagtcacctggaacgagctgtaaaactgtgtaacatgaggtcatttcattctggattctggatcctggatccccaacagaatcaataagaaaatgtcaaaatgctgggccccaggcccgctcctgacttgctgaatcaggacctctgggtatgggaacacagtctcattgttaacatgttaccagatgatccctgtgaaactttctgcttatctgtgggtcagtattcaagagtttccgtaattttcaagttgaaataagaatcttatgtaaaatatagtgactttcccaagggctgaaacttgcagattttcccaaaagagactccatgtctcaatcttgaaatggttgggagaaatttatgcatcaaaaaggagcattttaaagacttatcgtgtgccaagatatattaatacagtcagccctccatatccattggttccatatctgtggattcaacaatcagggatggaaagtaattgggataaagaaattccacaagtgctgtaaggcaaaacttgaatctactgtgtgccaaatactatgttgaatccaagcaaatgaaatgatgtataggcattacataggatactacaagtaatccagagatcatttaaagtatatgggaagatgctcacaggttatatggtaacactacaccattttctgtcagagacttgagcatccacagagtttggtatccacaggttcttggaaccaatcccccatggatacagaggatgactttattctccatctatattccactgggctgactgccatgtagttatttcattactttttactgttttgggtccttgggaaaaacaacatgtcatgcccagaatgataaggtgatatctgaacaggttccccaaacacaaagacgagcatgcatggcactgaagtgagagagtgagaagagaacttcagagagacgtccagtgttgctaaccacagaggacccagtggagaattcagagagaaattacaagttaaaccaatgctaattattgaccaagaaggccttaacatttctttctctcgagggtaatgtcaagccagcaaggtctgagagttgggggtgcaagtatctgagtagctgtgcacacagatacctgggtaccaatgtggagatcactgggaaacaggattaaatcagtaggaataagaaaagtccccaggcacaccggggactgttgtggggtgaggggaagggggagggatagcattaggagatatacctaatgctaaatgacgagttactgggtgcagcacaccaacatggcacatgtatacatatgtaacaaacctgcacgttgtgcacatgtaccctaaaactcaaagtataataataataaaatttaaaaaaaaaaaaaaaagaaaagtccccaggcagtgaaggaatcatgcctcacactatcaacatggttgaagaggatgggaaagaagggctattgaagggctactgagcagtgaagttatttatgagatagaattttgtggctattagagagggggtttgaaaaacaaaagggtaaaacttagaatgattctgagatttctagtttgggaaactagattcgtgtatttacagacaaagataaggaaatccaattaccaaaaagtcattaaatgaatacaatctgctcttacattactataaagttattattttccatgtttatcataaatatttcagagctaattatctgggcttggtttcacttgtgtacttggctgatttttctcattcctcctcttcccactcagcattaaataattgggatccactcccaatgagtgtttctgaaatactcttcaaagtcattgccaagggagagattgccttttcggattggtgtgtctcagatttatcacaagagtgggcagatgtgagggaaaaggagaatgagctttggcagtaacaatgcagagaagagttttgttattcttagtgagcatcaaaaggcagaaaggcatcctcataaatcattgtccaaaccaatagccttccccagaaacaaagttttggcccttctcatcttttgagctaaaagaatcagatgccaagaacagggagatgagatgcatgaattgttctttttttttttgagacggagtctcgctctgttgcccaggctggagtgcagtggtgtgatcttggctcactacaacctccacctcctgggttcaagcaattctcctgcctcagcctcctgaatagctgggattacaggcatcaaccactgtgcctggctaatttttgtatttttagtagggaacggggtttcaccatcttggccaggcttgtcttgaactgttgacctcatgatccacccgcctcagcctcccaaagtgctgggattacaaacgtgagccaccgcgcccggctgcatgaactgttctgaggcctgatgagcctttgcttattcccagattagaactccaggcaccttccacttccatgggtgagaacttcagggtatttactggaggactccaaacttctgtttgtccatgccatgttgaggaacacctcagctggccaagtgggtatacctggaaaaagctctttgtttcctggcacagactagaggactgtaagcatgggtggctttccaactggacagaatctggtaaacaagcaccaggagcctctaagccaggatcaagctgaggcaggtagcagcagctctgtgcctggaggtgggagccggggtgggtggaaggtctaggcaggcctaagcccgccctggcccagcgtgggtctggcgtcctgcctgcgggaggctggttccttgtgcagaattactaaatgctacaaataaggaaacactgcagatgaaagttttaaaggtttattagtaataacaccattcggggcactaaaacttcaaagtcctttgactagcagagtctaactaatctttacaacaccccagtgggctaggtaagcaaataaatattattatccctattatgtggagcacagagagctgtaagaggacttgctcagggctacaggaagatcagcgttactcacatcttggtaactaccaagtccagactcagaacagcaggctgccccttactccactgactcatgctgccacaaaaacggcagggagggcccgggaaagagactctcatgattcagaacagaacttgtgacagaagcaggcattgttggtttttttcttgttgcagctttaataacagtaaatgacagtaattttgcccaattagaaatgtctgacttgagatgttaggcagacgccttcattactggaacgtctactgtaggattttgacaaatcttacccagagtgggaccagcttccctagggctcctcctgaatggtgactcctacatactaaggctttccaggttaacctaaaaagtgtaggtttgcgaactaaacagtccttagtgggggttttaatccttcttttaataaattacaatatgtttctaaataaagaaattttagaaaatatgaaatggtaaaaagaaaatggtagtatgtgaactcttcctagtactataagtgatttctggtaacacttgggggtgtgtcctacatttaaactatataaaattcaggctgtctatatttcttcaaatccttgaataccatccaaaaatctgatttaaatggctacatagcaacccgtcaaatggtggcatccatttactcggccaatctccagctacatgatagtttggggtttcgaattactagtatcacaacaccagataaacatcccttttcatgaatatttctattaatttcaaaattttagaagaagagccactgagtaaatggattcatacatatttaaagcatttcatacctaccgtcacattgttctccataatattctatcactttccactttcgtatgttgtaagaggttcatttttctgagcctccaaaatttctatgttggtgaggcttaagagtagcaatggatttttttgttttgttttgttttgttttgtttttgagatgaagtctctctctgtcgcccagactggagagcagtggcacaatctcggctcactgcaacctccgcctcccagattcaagcgattctcctgcctcagcctcctgagtagctgggactacaggcgcccgccaccactcctggctaatctttgtatttttagtagagatggggtttcaccgtattgttcaggctggtcttgaactcctgaccttgtgatccacctgcctcggcctcccaaagtgctgggattacaggcatgagccaccacacccggccagcaatggattttaattaatagctagtgaatttagcataaggtcatgcttaaagcctagattttagttatgcggaatgtttaattggggtagtgagagagggctaccagaaaacagagaaaggtaatgtttacccatctccaaaatagccaccaccttctattaagcaaccataaaaacaactcatgtacaagatttttgcaagcaaggtgtccccatttcacatttgagaaaaatgaggctcaaaaagattcactcactcgctccaggtcattgatcctaggtttggagccaggataccggccctagggcatctgttccatcccactgggatatcaatggaaactaaaagtgctggagaccctgagcagggtagacaagagaatgtttttgttcatgattttttttaatcttcttcttccaaattataaatggcagaaatgtttttgatgctagcttcaaggcaaccttcagcatgcaagaacccccagcaggcttgcattaaaagcattttgtaagaaccttgggtatttggagtacttttacttaaatcttgaggaacacatgtttaagagggcaagctctgagccagacaaatgtggcttttattcctgagtctgcaatttaggatgtgtacaactttgagcaggccccaaatggaaaatccaatcttcatttgtgaaatgaaaaagagggggaattaaaagagacagtacatgcagaagggtaattccaacgtctggacatggtaagtcctcaagaaatggcagcttttaagatgagcatgttagggggggttccactatttcaaacaaggtcacaaagaggtagcataggtttttgacttacaaggagagagaaggtaatctcaactccacaggctggaaactctattcccttgatgttagggtgtgtccccaggttgcacaaagaagtttcagaagtgggaaattccttgttcctatagtgtgtgcttcaaacaaattatgcagcaatactgtacaatgactgagatttggctctggggaaataaacaaaattagattccacaaccaactctgtccaggaagtaccactgcctcttgagtccttaccttcagtaagctccatatgtaaaataaagatcattgaatttccagctcatgtgagaagtgactgagacaacatgacatatgcaaaggtaagggtaacaatgtctatcacataaaacaaaaaactcatacaggaattacagtatccatgagcgctgtccagtcttcctcccacttcttcacctcttcaaagttggccatagtcccaggatttctctggccaatgagatgtaaatagaaggaaaccatgcctcctctggatgaaagccttcccagggtcaatggaccatatgccatgttctcttatttccctaacagtgaccagcaactctcaagatgacagccaccccagaaatcagcctgcctcccaaagacagacctcttcaaagagcacctccagcaagcccagatgcacatggagcacaaatgagaaatgaacatttgttgtttgaagctgcagagatttaggggttgttggttacagcaacctggcccatagaaactgatgcagattttaatatgagtagcttattagtccattccatagagctggaaaaagcgatcctagttattttttatcaaaacattaataataattatgataaggagggctttctcaagtagagtaggtagctgaaaagaaaaacaatgtaatgttgaagacgaaaccctcattcaggaccctctgagaactgactctgctttctgccttggaaaaggtcagggctcactgacatagagtctaatttaggaaccaggagaacccaattcccttcacatccgtatatcacacacctaagtctacaagaacggtaatatgagtgtcctgaggatgaacgagtgatggggtctcaacatgttggggctgatgtctcagttcctacaggacccttcttgggagtgtccctgaaatactgcctaactgggtatctgaagaggaacgaggcaaaggaaagctgcccagagatagcctaaaattgccttccagaggtttctgtattctaattgtattctgtattctaattctctaattgagtgagttaattagagagagaatggtgtggcccttcctaccaatacataatccaccagaaagactggaagtttttcagtaccagcataagtaaggataggaatgcttgatttaagactagaaataacttacgacaattaaaaaaacatttttagcaaagtaacccgtccgattagaaactggtttgttagaaacagtagcaaagagagtttttaaatatccaaactatgcatcctaaataagtttataagtcaatgtttgttaagttgagtaactgttgctattaacaatctttgcaaccaataagtctgcatgtaccccttttaacaagattcattaaatacctagctaaacgatacagctaaacgatacaagcaaactcattgttcaaatttaaatgcaaactcattgctcaaaattaaatgctctgtggtatgcttttattcccaatttttcttgaaggaagaatgcagaaaagtagaaaaagtaacaacctgctcctcttagaaaaatgattgaatgctttatacagtgtaagatctataatgcaaattattaagaatctggctacatttttttattatactttaagttttagggtacatgtgcacaacgtgcaggtttgttacatatgtatacatgtgccatgttggtgtgctgcacccattaactcttcatttaacattagaaaaaagctattgactattgactcattgcttctatctctcaaatacacacaaccaatcatgttttctgacagcatgcatcctctgggaaatatttcctccacctcttctctaaaacttggcagtgtgaggttttgctttgcctttggtttttcttctatctgcctcatgacacttttgagcataagaaagacatcatctagtgccctggaagatgctttgttttgattcttgttcttttatggcaccctctgatagcattacctgactttggaaatcaattctgtgctgtgagaataaggtttgaaatgaaaacttcctgccttgtgttgaaaggacagagttagttttattgaggctagaaagtatttttccctgtattgttctatagacacagaaacaatccttagctcagtctggggcaaaagccaaagaaattgtctaaaatggcagatcctgaaggaggcttgggggttgggaggtgatgaggaagcagtcaagaaaactgtataataataattttgttcacttccagatagtctcctaatgttttcatagatctacttttcttcattgtgcaagctgcatatgtccactgtaaaagttttagaaaaatgtaataaaagaaagggaaaaaagcattcactatctgagtatctacagataatcatcactatcattttgatgcatttctttctaatctttattcaaaattattagaagtatatataaaaatatataaaatacatatacttatatagaattagtatttattgaataagttatgtataggatatatttctctgcatataaagtgaaatcctttaaaagcagaattttaacaactgcataatattcatgtcatgtacgtagcattattcatttcatcatttccttaccggtggccatttctttgccccatattttaagttgttcattcttttttctgtattttgtttatttacatatgtaccctaaaacttaaagtataataataacaaaataaaatatatatatatatatataatgcccacaaaataaaggaactaagtcataaatatgcatatgatttacataaaggagctaaaataagaaaaaaaaaaagaatgataaaagtcagcagggaaaagaactaccaaatcacctagtcaagtaaatgatttacaataacaaaaacaaacttaaaaactctacttgtaacaattttactggtgactaatacttctttaattaataaaacctattggctgcatatggcaatcagtggtaaaaaaaaaaaaaaaaaaaaagactaccaaccaaccaataagcccatgtagaccctggttctgtgaccctggttctgactctccaggaacagccaccggggatcaggctaccaagacgaaggcagagagcaggcagggtatgtagattttaccccaaaattcaggccaaacctagggctcaatatattcactggggagaggaataaggaaggagagagaggaggaaagaaggagggaaggagctgaagaggaggggctggggaggagtaaaggagaagagaaagaaacaggctcagggatatgggcttagggaacgtggtgtgcatggccatgggtggactggcagaagggcttctggaaaaactcagccctgtaaactggcagagaagggcacacatgcatcagcacgaggataccaggcatgaatatccaagtgctgcagaagccatgtgttctcatgagctggagggaggggagcagatgagcagcacagcagtccaaatgctgaaagagcagagctgtgaatcagtgatcaaaagacagggtgaccacatggagtccaaagatgctggtgagaagcaagatcatacaacagataggaatggaatgcccactccacaacatatggggcatgtaagatacatcatggacgtctacccacaaaaagcgatgtcaaatgagttttttttaaatattagaaagacggtgaagagtataataaaggaggggctaataaaaggcaaggatgctgacagaaagaagtcctctccaaggtgaagaattccgtccgtcagagctgatgatcagattgatcagtgagagaaaggatcttacgtggagtccgagcatcccaaagaaggccactcccgtacacccagctgaggccaggtgcaaatgtgatgtgtggggtgggggtgtgcctgaagccaaggctaacccaaaacatctgctggcttaaagggattctgggggagggctcagacacacatggggaaaccagctgtgagaggcatgaatcaaagaacagagccttcccaccaggaaacaggagtctggcttgaaaaagacgcaagagtaaataggcacatgtgagaagcatgcttaaaaaaaaaaaaatagggcattctggtatttcatctgaaagagtctacacatgttttaaagatttatccattcactaagaaattgcaagagaaacacccaccacgtgcaaggcacagcggcatgcatctttttctagctcaaagtgaattgaatgtgcccgtgattgcagaatcatttccattgtcagagtagaaatggctgcttccactctgtatggtggtaactcagtgaaacttactgccacctacatggccccatgtcatccagctctacccacctctcctgcctcaccccctcgcccgagacactctggccataccagcttacaccagccaaccctcaagggacattggtttctgaaacaggtgagccttttcctgcctctgggacttcacgtgttggaacccacctccattcttgtacttttggttccttcttattcttcatgtttgcttttatttacttatttatttagaaaccgagcctcactgtcacccaggctggagtgcagtggcacgatctcagctcactgcaacctccaccttccaggttcaagtgattgtcctgcctcagcctcccgactagctggggttatagacatgcaccacctactttcgtatttttaggagagactgagtttcgccatgttggccaggctggtctcgaactcctgacctcaggtgatctgcccgccttggcctcccaaagtgctgggattacaggtgtgagccaccacacctgctctacatctgcttttaaatgtcatggcctcacagaggcctttgtggtccaccgtgtcaaaatcttcaccatgcctattctcccatcaccctcatctcaagtttaattatgtaccacagtctttgttttcttatttgttgtctattgccttggttagattttccaaagaaaggaccgtgtccttcttagtcatgggtgtctgtcaagtagtggaggctctgtgaatacattctctaattttgagcaggtcaaagcaggacaaacacagaatgtttaatgaaaaggcagcctttaaagtaacatttattttccatttcataaaagttttcaaatgattttacaaatatgcaagaaaaattcatctgcataatacctagtggcattatctatattataacctaattgtcctgagcaacaaagtaactaaggaccccaaaatgaaaaataaagttgatttagccagttggtattgttaaaagtttgactggaagctactctatagcaggaaaaaagagtctcattcatatttgtattatcagtgccaagcaaagaacctggcaattaataagtgctccattaatgtgattttgattaaaagtgttcacgttttaaactaacatatggcagttatctttaaaactatagaatgacacaggtggaaagaaaatctcccttccattcccaaacttcaactcattttacagaggtagctaatgagaaaaagtcaatgtatattcttcgaaacatatccatgcattaatgatcaaaaatacctatgcaaggagatattaggctatacatgctgtttaacacctttcttcattcacccttcattcacatataatagatatttccatgtttgcaaaaatagatacatcattctatgtaaaggccgtacattactctgtgctttatttaaccaggtcacttctgtggacatttaaggttttttccacgattaaaaataaaaaaagcaatgaacatctacaattgtgtaattaggtggacataaatacaagataaatccccagaagtggaagcatcagatcaattaatgttgatagaaatttcctaaagcaccaaacagctattatagttacatcaacccttgcacatgttgggggtttactttttttttttaatctttaccaagctaataggtgaaaaatagttgatagtttacatttctttcattctgagtgaagctgaacagcttttcatactgttagctgcctttttggtttcttgataaaagctaaaggagactgatgcctccatgccaggtaccaggagggttatggcaagagcaacaaccctctgaagacaggctggatggagtcatgattcccatccacacagagctcaaaccaccctgggctctgaatctccagcccaattgcctaacgcatctctcaccttacccacacttctgcacactatgccttattattttttaaatgcctattcttcatttcaggtgacatacttttccatcatctttaccacaacatctactaaggcaaaataaaaatacccattgccattagaaaacagcagaactgtaccagatttggtggctcatatctgtcatcccagcagtttgggaggccaaggtaagaggacacatcacctgcggccaggaatttgagactagcctaggcaacatagcaagaccatgtctttacaaaactaaaaaaaaaaaaatagccatgcatggtaatatgatttggctctgtatccctgcccaaatctcatctcgaagtttaatccccatatatcaagggagggaggaacctggtaggagatgattggatcctgggaacagtttccccatgctgttctcatgatataatgatttaaaagtgtgattctttctccttctcattctctctctctctctctctcaccaccatgtaagacgtgcctcttttccccttcatcttctgctgtgactgtaagtttcatgaggcctcaccagccatgcagaactgtgagtaaattaaatctcttttctttataaattaccaaatgtcagatagttctttatagcagtgaaaacaggaatgtaatgtaatacaggaaatcagtaccagaagtgggacattgctataaatgtacctaaaaatgtggaagcaacctttgaactgcgtaatgggcagaggttggaatagtctggagggctcagaagacaggaagatgggggaaagtttggaacttcctagagacttgttgaatgattttgaccaaaatgctgatagtgatgttgataatcaagtccaggctgaggtgctctcagatggagatgaggaacttattaggaattggagcaaaggtcactcttgctatgctttagcaaagagactggtggcattgtgcccctgctctagggacctggggaactttgaactcgagagagatgatttagggtatctgtcagaagaaagttctaagcaacaaattactcaagatgtgacctgggtgctcctaacagcatatagtcatatgtgttcacaaagagatgatctaaaattggaacttatatttaaaagggaagcagaacataaaagattggaaaatttgcagtctgaccatgcagtagaaaagaaaaaaacatttcatagggagaaattcaagccagctgcagaaatttgcataagcaacaatggggaaaacgtctccaaggcatttcaaagatctacatggcaggccctcctatcacaggcctggaggcccatgagggaccttcctgggcccagggtccctgtgctctgtgcagccttgggacatgatgcgctgtatcccagccactccagctacagacatgactataggggccaaggtacagcttgggctattgcttcagaaggtagcttccttctgccaagaagacttggcagcttccacgtggtgttcagccttcaggtgcacagaaaacaagagttgagctttgagaacctccgcatgtatttcagaggatgtatggaaacacctggatgtcgaggcataagtcagctgcaggggcagagccctcatggagaacctctactcaggcaatgcagaggggcagtgtggggttggaggccccatacagaatccccgctgggcattgcctagtagagctgtgagaagagggccaccattctccagaccccagaatggtagatccaatgacagcttgcactgtgcacctggaaaagctgcaagaactcaatgtcagctggtgaatgcagctacaggggctgtaccctgcagaaccacagggtcaaggctgcccaagggcttgagagtccaccccttgcatcagtgtgccctggatgtgagacatggagtcaaaggagattattttggagctttaagatttaatggctttccttctcagttttggacttgcatgggccctgtagcccttggttttggccaagttctcccttttggaatgggagcatttactcgatgcctgtactcccattgtatcttggaagtaactaaattgcttttgattttacaggctcataggtggaagagacttcccttgtctcaaatgagactttggacttatacttttgagttaatactggaatgagttaagactttgaggagaggcataattgtgttttgaaaagtgagaaagacatgagatttaggaggggccagggtgggatgatatggcttggctctgtgtccccacccaaatctcatctcgaattgtaatccccacatgttgagggaggaacctggtgagagggattgaatcattggggtagtttcccccattgtattctcatgatagtgagttctcacaagatctgatggcataagtgtggcatttgtctctctttcctgccacctacatgtacgacgtgcctcacttccccttcaccttccaccatgattgtaaatttcctgagtccccctccagccattcagaactgtgagccaagtaaatctcttttatttatcaattacccagtctcagatagtttttttaatagcagtatgaaaacagactaatctacatggtgacacatggctgtattagtctagctactcaggaggctgaagcaggaggatcacttgagcctaggagtttgaggtcagtgagctatgattgtgctatggcacttcagcctgggtaacctagtgtgaccatgtctatgaaaaaaaaaaaaacttaataaagaaaaaagcagaacctttctacaataagcgatggcgggatagtgggcaaagcaaagccttggacgtgggctctgcagcttataagtgttccatctggagtgtcggagcgtcagcttcctcatctgtaacatctaccctgtaggaatgttgtgtgggtagaaagaatgtatgtacagtgccctggacttaatacaatccagaaacggaagtggttattattggcaacatgatgtgggtaagatttgtggtaaggaataaaatcttcttcgggtattaattctcccttcataccaggatttcagaacaagggaaatctttgctatttccccatcaagaatcatgtatacaacctgttcgctggagaggcaccttgggctggcaggtactccggagatggccactccctcactagcatcaccagagggtgatgataagagaaggctacagggagaggaggttgatgatcacacacatcacctctaaggtggtggaggtaattcatcagtataacaggcactcacaaaatacttcttgaaagaatgaatgaactgcccacctaagaaatcctctgataaatgttcttttttttctcctcgtttaaaccaagagtactccaccacagcattgctgacctttgggaccagattattctctgttgctgggggctgccctgtgcactgtaggacattcaccagcatccttggcctctgcacattcgacacgaatagcacacacacaagggcaagttgtgacaactaaaccatctctagacattgccagatgtcccctgagggcaaaatcacttccagtaaaaaccaatggttcagactataggaaagcaaaaaaatatatttttgaggctaaaaataacttaactttttactatgtccctgaatccaaagctgttttgaaggcttagcaaataatatagctataacttagcatagcaagtccttagagcaatttacaactgactggagaatattaaccgcctaaggcaaatcagtccttaactgctgctattctgggggtggggagggggacacagcattaataattcaataaaggaaaggctgcaggcaatgagaccctagagttatttatttagccaattagattcgtttttggtggcaaccctgcctttgtgagtatgaatacgccatgtctattcttcaattaaccaggaaaattgtacctcacaaatctgctcttactgcctttcagctggaggatgtgcagttcaagtggtcctggagccttcagaggagggaaacaggctgggaacattcatcacttacacgtgtgcctcacacagaacagatccatgcactgggggtgtgcaaattagaggtgtcagcatcagtcctcactgttcctgccctaactttccagccctaatccagagcaagacagggatgaattatatcaggtaaaatttagagccatggacacatagatatgctcagtttattactgttagtgataaacaatcctactttaaccactaagagactagaaaacatggttttttgtttttttggttttttggtttttttgagatagagtctcattctgttgcccaggttggagtgcagtggcatgatcttggctcactgcaacctctgccacccaagttcaagcgattctcctgcctcagcctcctgagtagcggggattacaggtgcataactaccacgcccagctaatttttgtatttttagtagagatggagtttcaccatgttggccaggctggtcttgaactcctgacctgaagtgatctgcccactttggcctccaaagtgctgggattataggcatgagccaccatgcccggcccaaaacatagtattaaatatacgtctggtgaagcaaatccaagagctttcctgttttaactttgctcacaatttaggctgcaggaactgctggaggtccctgaagtggacctattttggtggcttattttggtctagatcacaatgtggaaggtgtccctatcactctcttgtggtcaataggaggtcaactcaaagccctacagactacagtagctaatggggattatttttttaaaatcatcaggaagaagaatatataaaccaacatagtcctgttcactgggacaaaccattagaaattctagagatttctccataagctgttagagattttctttttccttgggtatttataaccttagcacttccatttctaccatatattttacttccttttccctttcttgctctcctttttcttttttggttccacttatttgtttagagcccagattctctaataattacaggtggcggcaagctgtgaggcttcacaaaaagtcagatacttagaccaggaaatcacagaaaggccactgacaagattccaatgtgaagatgcccctgaccattgacttgtcctcgatatctaaacaaagagcacatccctaacagggggaccaagatttcttatgcacacacacatctgtctgtcgcaggccttggagacctgggatcagtcagatccccaatgagagcacaaaatggaaatcacatctccaaaccacttttgtttcactaaaatcaaactgatgtttcagtcaacaaaacataaagagtttcagtgcctcatgaaatttcactgacccaaaaattacttttgtcaacccaaacatagctttcttttctcatttaatgtgatcgcagttgtgctcaccaagtccagttgagtacagagtgggatgcccgtgaatatgccaggagctgagagctgaacagtacctgacatttcacccatttaaattatagacttttcctactccagaagattcaggacatctatagcatgtgtccaaatgtggcacaaaggaaaaatatcttattaactcagcacaattatggggtctgagatcagaggaactggaggccttgtaatgtagagcagcagcttacaggaatggaactcagagcaaataaattttgattgagacaggaagaaaaaggaaaaacacaagacattacctagagtgagcatacctaaaggccaagattctgggtgagtggaaggtgggaggaaaaacagcccctctcaggcatacaataacaggtgatgtggataccactcactggaagggaactggggatgcccagtggtgtgccagccaatgtttaatgaccacccatcggaagaagcccttacctgtggtgtgtgccaatttccatggtgtaaacactcccaccatagcctacattaagctactatcacaatgtcactgaacacagagacagggagacacgcacacaattggctctcacaaggtaggaggaacagctccagcacagagcacccctggcacaggaagtggaactgaaaagaagctgggcaggggcctggtgcccacttcttttgacaggcgatttgtgtgtatggggcttctgtcttgacacagctggactttcctgatcatttagtctcagaaactgaatggagattgtttcctttgtcactcccaattctgctctgtgaaattcttaggaatttaaaaattcatgatgagcacatagtaacttaaattcaaacatcaaaggactgctcagttttttctcctgttgtgaccttattgtggtaaatattgcattaaattgccatgccaataattgagattcagaagcactttagttttgaagaaatttgctgttcatggcatttagtgacaaagattttcaccttctcattccctatctctcttcattctccttctaccactccctctctctcattttctctcccataatgttctgtctttggggctgtctccaaccctttcccatttatctttccaagtatctctatatatctctttctcaacttctttccccttaccccctctccctcactcttctctcaacttctcagtaagggaaagatttctcgtcctatctgcataatgtgtctgacaattccagtctctgtttgctaatcatgcttaaaagaatgacataccagaatgtagagacaacaggaagaggtaaactaagggaagcactgaaaaataccaggcataacaaaagcctgaacaagctctgcatgcataaagaggtactatgcattaggcatatggacttcacttgagattatgtaccataaacaagtacaacatgacaaaaaagaacatacagacgtggagtaaactactgaccacttaaagctggctgaaaatcccacaatacggatcctgagttttacttcccttttcttctctggttccccttaccctggtacctgccaaccgagcctttgatttaaacatttttatatatcaaaagatacagaagaaaaaagtaatttagatgtaaacattgaaacagcttatgttacaaaatgagtgcagttttaaaaaataaatacgcaaagccttggggggaggagaaaaaaacagctttgaagggaatagacaaataaaaagcccactaaagacacagatcattccagaggtgattccttctttctgcctgacacaggctgtgtggccaacatatgtatcaacagacaggaagtaacagaactccaaaccagacaggcgctgggagctcattctatattcacagaatcatattcgggaaggcagggtcccaggaagtactaaatcaaatcctgccacttcacaataacaaggaaaggataaaatgaattcttgatagccacagatttttcagaggaaaaaagaacagattttcaacttgaaaccattacattttagacaactttttaaaaagcttgaatttcaaggattagggcaaagtacgtgctctgtgttcctctgctaactgaaactgaaggctgtgttcccagttcttacagtcatttgacaaatacatcaacaagaattagccaccaacatgatttccttggcctcccacagtcagaataataaaaagaaattccttccatgatctctttattttaacacaccggttgttatttagtgtatcatcaggaggctgtaggcaaatcgctggctggctgtcacagtcaacatcaacccctttgaagtcaatgacactaaatggaaacactagaagtgccattaatgagcatgttttaataatgctactgaagtcttttacatttcaagaaaagtaccagaaataactctgtagagtttatggtagcacgattgaagtgttgctaatcattatatatcggtttattaatcattataaatgccatcacagttaaatgttatttggattgttcatatgcttaacattgaaggtgtaattaagaaatggcctgattgataccaggcgagtcggtctcagttgaactaggatttcattgaatgtagtcctcagggtggatggtattgaatggatccacagcactggggttctatggaggttcttgcatcaacatcccaaaagttcgggtccttctctcctcctccacaccctccattacacaagtgccccagagtcagcgtagtatctatccaacagacacccatgagtggggctgcatatataacaaataaagatactggatgtggacctgaatttgaatttcagagaaacatcgagtatttttgttagattaaatacaaatttaagataaacagaagatatataatttgttagtaaagctacagttcagacttagactaatgtaattattcattgtttatctgaagtttaaatttaactaagcgccctgtattttatctggcaactctacccaggggaaacatgtgtggagccttttatggtctagagatctgcctctaggtgggaccatgatggccatctgagcatatgtacctgtccttctcccacccccaggccctggaaattaaaaaaaaaaaatagatgtgtttaacgagaaatttcacaaaactgacagaagacaaggagaaggtgtcatgtgggtcagaaaccttgagaaattcctgaaagacagaaagaaacctggctcatcttaacagaggaaattgcagcctcagaaatgaactaaaaaggttgctggaaaatgttgtagtatgtctagggatgccccgagctcagagacaacaaatgcaatgagcaaacgaaacagaagctatagagattaattgggggagcatgttcagaagtgctgaacaaagagtgcctgctgctccaccctgtgtcaagcagcaggagcatagtctgtctagatagagccaccagggtgaccgcttgggctatagaggcagagaggtgccccgaatgactgttgataattgggtgcaccagaaaatgagaacctgctatacaccaacatcctcaatgatctccaattatatggaaagcaaaatggaatccacagataggagatcacagactctcaagatgaccaaaattattagaaaaaccaacatcaaaataaagaggcattgaagagcagacacatgcagaaacagggttaaagtagcaactattaggctttaaaagtagtgtaattaatatctttaaatatttaagatatcatctaatataaatgaaaaagaacaggctgcaatggggaaagcatattttagaaataaaaaataggattatttgtaatttcaaaaatataaaactccttggggaccaacccaaatgtccatcaatgcagactagataaagaaaatgtggtacatctacaccatggaatactatgcagccataaaaaggaatgagatcatgtcgtcttcagggacatggatgaaattgaaagccatcatcctcaacaaacaaacacaggaacagaaaacgcaacaccacatgttcttactcataagtgggaggtgaacaatgagaacacatggacacagggagggggaacaacacacacaggcacctgttgagtggggtggattgtgagggggagggagagtgtcaggagaaatagctaatgcatgtggagcttaaaacctagatgatgggttgataggtgcagcaaactgccatggcacatgtatacctatgtaacgaacctgcacgttctgcacatgcatcctggaacctaaagtaaaatcaaaaataaataaacaaataaatagataaatacaactccctgggttaaattgcaaagttaacacagctaaacatcaaatcaattaactggaagatggcattgagacaaggagacagtcaagagagatgtgtaagctccagaacccactgaatgaaagttctagaggggaagaacaaagatcatcgatgggaggaaatactcacataaaaaaaaagaagaaacagaaatagaaatgcatggaaaaaaatggactcctcagactataataagacagaatgcaagaagaaaccttacatataaagtgatgaaattctgtaacagatgatgagaaaatctgaaaagctgtctaaaaagggggccagaggtagaaaactttacctatgataatctgcttctcctcacagttctgaatggccacactgaatgctaaaagacaatagagtcatcttttcaaattttcaaaagaaaaattgttgtgattttgaaattagcaccctctactccacaaacttgtgttcagctgggagatttctagatatgcaaaaattcatagtttgccaaccatagattgtctctgaaaaaaaaaaactagtagaaaatgcatacaaacaaaacaaaacactatcacaagttatgggaagaaaagtaacatacactataaagtaagaaagatacactggtaagtacaagaaccaataaaactttcatttaagcctaagtaactgttaattggaaatcaaaaaattaataacaatctggaactaaaacccctggaaaataagaagttcacattaattatggtcttacgtggcagcaggcattattctaaactctttttgtgtgttagctcacttaatcttcacaataaccctaaaaagcatttactactattatcattttatagatttggaaactgaaggccagggagttaaaaccttggccaaaggtcacagaggtaggaagggatgggtttgagcaggacaccaaccatgggaatcggctccagagactccaggcaacccataagctcaggcgtcaaggctgaagggtggaggtttgggggaaagatggaaagcagtgaaatggggagaggaaggttcttgtttgattgttggttagaattccataataattccatatgtggaggaagaggatatagttcactctactttaaagagttaagtgaaagtgttaagtgtgatctctaacacagaaatagaacatacaatttccaaaatgataggacacccctccactcactccagtctttttttatattgcttagtagaattttatgtcttgtccatatggttgccacatattcttttaatttttaggtattctgtatttttcctgtcattgtgaatggatcacattatgttgttatatatgaatgagcaattgttagtaaatagaaaattaactttcgcacatttattgtgtaactcatacccctactgaactcttatttttctaatacttataattggtcatcttgtgtttggggggccaaaaatgtggactaattttatattttccacttcaacatgcaaaatttttctatccttttttatccagctgtattgcatagaacttccctaaagcattaaatcatacggggatagctgacctcatcatttcaccacctttaaggggaagaagctggttaccccatagggtagtttatgttctgtgtctataggtactgaaggagctgttgaacattctactaaacgcttgcctgtgaggctattcagtccccactttggcttctcgagtttcaggctgaattactggctctttcctccttccttggacatgtaaaattggtctagattggcatgtccacctacacatgaacccagatgaagtctcagaggaaccacactcctagatctcaccactggacattttacatcttgcgtgatgtttaagagacacttataagatgactccagatgcaaaatatgctgcctttcacatgtaagcttcttgtgaaagaactctggacattaattttgaactatcatattctaccatcattctgtcctattatcagcctgaaagcatgttattcattatggccctcaggtcaggaaaatcaatgactaatctcaactctgtatctattgaacattgatagctgcatgggtcatatgtctgacataagactttgtcctcaagttaatcaattcctacactgatgcggcctatgctctctcacgcagcccttgtgtgttcccagatgacacgtatttatttacaacatttacttgttatattctagaataaaattttcccatttggagtcttttctgaaaacaaaagggcattaggtctaggacaaatccaccataaggttcaaagattttggaaagaagaatgttagaaatctatgtatgaagttctttctgaatcgagcatattttaatatggactattttcctgtgttcttttgcattttaagtcaacaccatcttcttctcaaaagcatcttttgacatgttcaatggttggttggtttgattggtttcatttctggctatttactttgtggttacctccagagagaaatcacttaacattttcatgagtatcaggcctctgaataacgtgaaatcttgggcagggctcatgtaccattttctcaagggctttcccaatactcagtcaggcaggttgacacatacaaccattacatccaaaaagcatccttcagcagctttggcccaaataaaagaaacagaattgagctaacaatgagttcctttacttctaatgaaaattgctcaacaaagaaccaaatgttagcatatatatatatatatacctgctctcagaatgcttactaaatggcaggtgcggtgttaggcttggggtataagggtttccttccatctaattaaaattatgcaaaagggaacaaaatgtcagcctttccataaaacgcatacctttggaatctctcttaggaaacaggccctgtgtctggctagaaatgtaaggtgggaaggagggccagggcacccacagggatggcggtaaatgtattttgccacaagtaaatggattgtgccagatgttgtgggttacacggccaatatgtctgatctataatattcactttaagtataagaaattttgagaaaaccactcttcaaatagcatgatcaaaatgattcaaatagaatatttttaagtgaagtaggtatttaacacttaagaaacaaaagtgtttttgaaaaagggcttggaggctacgagtggctctaaatgggaatagctgatataaattgtcagtggatagattatttctaacatcatccattccaataacagtgcaaatttctatctagtaagttactcaagtgagtatctgctttaagtacactgacttcaagtaccactcaaaatttctaatctttggctatgtgatgtcaaactttctttgctactaaatgatctcacatgcctctagctccatgctgctgttgatgttttcttcttgctatgtgattttgcagaagacatggaagttggcaggctagctgaaatgaatactccagaaactcataattagagaagaaaatgattcttatctactccccaaacatactgaattccttggtgaggctatgcaggtaagataataaaaaatacataaaatgtctgagcaaatttcatcaaaataaaagcatttaacaaataagattgtcaactttcttctgctcatttgactaaaaatttaaaaaaatagcaatggatacaatttgagaatactaaaacaggcccaatatgaattcactaaaggcctaacacagcagaggagaaaaccaaaggcaaacataatatatcttatttaaactgacacaagctttgttttgacacaacctatggttacattgtagtttttggagactgtaaatcagatgtttaggactgagaaagaagaaaatagaagatcattttcttctttcataggatccattatttttctccgtatttgaaaaaaaaattttaataattattacactaaaattatgctttggctatcaatattttatttcatgagatatcaaaatcatccactaaagcagatgtataataaataaataaatgtattcctctttcagggcaatatccagttgctgtactcaagcaggctggtgtgaagggtcacgtgcagctcttaaaataaatggtctgcaaagctccaacactaatgcctaatcccatatcttgtcctgagtatgtggccctcttcccggggatgccccctgtgactccttggggcaaacctacttagagaggtctaaggaagcctgcccaggggaagagtgtcctggacaatgacctcacacttaggcaagacttaaatctggcttcttttattcaaattatctcagagctggtaagtggcaattggccaatgctcaggctgtccccactgtcacatgtggcctgcctttccactgtgtcttcttctagatatacaaagcagttacagcaggtactgcacctattgctttttgtcagcctcatggagtggctcttatgccacagagttgtccaaacccatgggcaaaaacagataaaatggaagccaggagtctccacccacagagacagggacaagttattctcctcagatgtctatagaatgtggccagcacattgttcgcgatgtcctcaagttcagttttggacagaaacggtcatacttatatgacacacacccatttgcctcagtttcccccactaggagacagtaaaaagattggtggttgccaggggctgaggggagggagggatgaacaggagagcacaggggattttcggggcacgagactggtctgcatgatgttctattggtggatgcatgtcattacacatttgtccaaatccatagaatatacaataccaagagtgaaccctaatgtaaactatgaactctgggtgataatgatgtgccaatgtaggttgatcgattgccccacccccaccagccacacaacccacatcagcactttgaagttattctatatttatatacttagattgcatacacaacctgaagacttgaatggatgcaaatgcaggcaaaacaataaggaggtaacagtttataacaggcaataaatattggcaaatttcctgattaaagtcaggtttagatttctatcatcaacttcagtgttgtctttcatcagatcacctttaaattaccactgccaaaataatattaaagtaaaaagaaaaacaacacaaaaataacaattctttaataataattaagaaaagatgttgtattaccactaacattttacccattcaaaaggggcatgatgccctaatgccttgaaggtaaacctggtagtcctacaatcatgagtggatattcttattcaatatatgcattgtaagaaggaaccacagataaaatcaactgacttgccagcagtggtcctcaacttacagacaaacacaacttgccactattctctctcttccttggcaaatctatgaccaatcttcctggattacagatagaagacacacaacagcttttataaagtctatcagttcatttggaaagttcattccttcacccaaaagctatttattaaatgcctgctgtgtatgacacattcttcttggaactgcggacccatcaacaaacaaatcagataagcaatggagctcgtatttggatgaggtaggaaagacaaccaacagcattcaaaagtaaatgttatgagttggaaagtggtaggttccataaaatactataatcacttgttgatgacttcttctgtgccagaaaaacacaaattaccaataaagtgttattgcacctttttccagaaaagaaaactaacgttcagaaagattaagaaccttgctgaaattcacacaaatgggaaagctaatgcagggattccatgtcacatcagagggagtttttctagtcatttcacaattagacccttaagcaatccaaaaatagaccccattagttatctgaatggaggaaaccaggctctatgcatgctgcactctgagcaagaagttaacacattgatcctggacaccagacaacccaacatccatttacctccctgagacccaagctcctcattatcatctccctaatgtttgcaacatgcaattctatttactttccatttttacataaatctttatttagaagaaaatagcataccatggaatattagcctgtgctaaaaagaaatgagctagcaagcaatgaaaagaaatagaggaacctttaatgcatattactacgtgaaagaagccaatctaaaaaggctacatactatgtgattccaaatatatgacattctagaaagggtcagaccatggagacagtaaaaagattggtggttgccaggggctgaggggagggagggatgaacaggagagcacaggggatttttagggcatgagactggtctgcatgacgttctgttggtggatgcatgtcattacacatttgtccaaatctgtagaatatacaacaccaagagtgaaccctaatgtaaactatgaactctgggtgatgatgatgtgccaatgtaggttgatcgattgcaacaaatagaccactctagtggggaatgtcaacaatggaggaggctgtgaatgtaagagggaggtgggataggagaacactctatacttgttgcccaattttgctgttaacctaaaactgctctaaaaataaagcctaacagttcataaatatataaatatatataatataggcctattagttcataaatatataaatatatatacctgtaaatatgtatgtagcagcatctatctatctatctatatatataaaacattatatatatataagcatactgtcatctcatattaatgtttattcaaaaggttgtacaatcctacacttatacatttttttgaaaatggcctctatctttcccacacttgcctagtttgatcactgtgagactcctcaagaatgatgcccggtaaaattaattattaattattaacttatttatttctatggggagaacatcagtacagtatttctgtttataaaacagaattgaaagccatggggcaatggaactaagaagagaaaaatctaattagggcctgacagcctttgataataggattaaagttattttcctcccaactactaatatgtgaagtcaatagtgttgtgttttctcttcttagaaatgtgtggtatgcccctgcaagcaacttttcccatgctataatgtttgtaactcacagaaaataaatatgatttctttgatgcactatcaggaagatgtcagcaaaacatgaagtgacacacaccagcagcctctcagaaccgagctttacagaaatggaaacttttgaaagaatattttctagcagcaagtaacaaagtatctgtttgaatttgtttcttaatatgctcaggttcaatgcaaagaatgtaaggttaccataactttaacaagcagcatctatttccagcatgtgctaaatattgtacctatttttggtaaattttaaaaaatatattttatataaattcttatctggacctgtacttcaaaatgttcttcataaaggctgagcataaaaattcctgtttaatcaaaccaaattaaatcagcaactatccacagagctcttctcccttgtgcaattggtattgtgggcataataataaataaaatttaagatgtaatttaagatcttggcctcaaggtgcctatctctgggggctataggagagacaaacaggacacatcaaagttaattatcttttagctctcaaactcaagacaatcatagaaatagaacatcaaggcagtacaatatccattcaaaaattgagtaggtatatggtgatggacatagatctccttttccttctgaatataatctctttgctttccagatgaatttccacaaatgagaccttaatcagaacagagtctattcaggacacatattgataattatcgaggtcagtggctccccaacgcggctgctcatcaggagggcagatgcttcctaattgacactgctcctagcccccaggccctgatcttctcacttagtaggtcatggatgagtcagcttctgccaaatcccccccttcaatgcccccctgaaccaaactaacatttgtacagcactttagaatttccacaatgtcccttatcctcctaattttttaattctgtgcaaaatcattgttgccatcttttagatgaaaaaacacagattgtataacgtgttcctgttttcagtcagtgaataataaataccatgggttaaatttagatattaggcaagagatgtttccaaaacaagtattttgtgctttagactagcatatatcagtggcatcaaatcacgtacaaaaaattatgctttccaaagtatctggttcaagtgttcaaggttcttcctaagaaataacaaatgcaacctttgacatatttcttttaaaaatttttaactgtccatatatattaaaatatttattctgaaattacaactagaaatttcagtaaaagaatatttgtacctatgtgcacaaaccaacttcaaaaccaaagtaattgtaggatattccaaagtgtttaaattctatttttctttcccctttgaggctgccattattttaggtaaaacaaaaatctgtgttccttctaagccataggacttcgatatcttcagggatacctggcgtccctgtgagtaattacccaggcagtgattaaaccaccaatactaggagtcagcaggcaggctgtgtccacaataggagtttctgaataacaacgtcacacaagagcaaattcaagagctaccgtgaagcccactcaagggaaagcaagcaagtaaatgagttgaaactggaggggagaagctgattgttacaggagttctcttgcccttagcttttacccacccaagcaagacagcttggttctctgtttgcacaaggaccatgtttagaaatagaatctgtgctccatcattaaatatatatttattgaatccctactagtgccaggccctgtagcaagccctcgaatatgaaggaacaagactgagccccactgtaagggagtttacatcattgaataaccagcccctcaacaagactatagtgagacaagcgtacactcagcaggatgcgtccacaggaggatgaagagaaaactggcggggcctccggctcccactagttcttgacagagcaaacccattttctttacatttgaaagtagacagtaatgggtaaataataaatcagactatttgtagtttatccttaattcttccagtttagcaatttgtccctcttatttacttaaactcttaattcagcctgcttaatttttcttcatagtatttgtttttacctgatcgactgaatactcattggtttactcattacccctctgctcccctctcccatccacacacactagaatggaaacttcatgaggacccagatttttgtcactgttgtatccccagcatgctgggtacatagtgggaactcaatatttcttttatttcattattattactattattttgagaggaatctcactgtctgtcacccaggatggagtgcagtggcatgatctcggctcactgtaacctctgcctcctgggttcaagcagttctcctgcctcagcctctcaagtgtctggaattacaagcgtgtgccaccgcacccggctaacttttgtgtttttagtagagatggggtttcaccatgttggccagactggtctcaaactcctgacctcagatgatctgtccacctcggcctcccaaagtgctgggattataggcaagagccaccatgcccagcctcaatatttcttaagtgaacattggaataatgtcaactaatgaagaatgtataattgtataatctgttaaaatgcatttcagatgaagcttaagtgtaatatactaatagaagtttattttataaggaagcactagaaacttccacctagacagtccacagaggccactgaactgtaatgaagcagctatcactaacattagaattacagtgaatatagccaaaagaaatattaccatgtttttttcagatcagaaaatatgtctaattcaacccagctgggatgtggcagggtcaaaatttgaaattcagagttgttggaacttaaggtataaactctgtctgctcggtcaccagcctgcctgccaagtagtcaagaaaaaaatgaccatcctggagtattcaattacctgaggaaggctgggtctccaaagggactgcctcgatttttcacttctacagaatttttagatatacatttccacaatttacagataagtctatgaggatctttttaaagcccataaaaccacacacacaacctgctaccagctaccaggagtgacaaagctccgagtggagcatttgagataatcaccattcatttgtgttttaatatgcatagagagaacaggccttgaaatagccttgcatatgaattcaatatttgtcttttaaactagttaatctggtacagtcttacaaatgcaatgccttattaaagagagtatcacatggtagcatttttctctcccctttagttgagcacattagatacttatagggacatggtatttctctcagaaacacttgggagctagtgaagccacaaagctaaggagataatcagctgatgatcaatgatgagctcccaagagtaaccagcctctatatagtcagcatcactggtttctcaggaaaagcatcaccattgttcatcttgctgcaaaatgtatgcacaagtatctttttatttttaaaaaagccctgacattttatgactgctgcttttctaagatattttcaaatatacagtccatacggttcagacacaatggactggggatagagacggctatagtgccgataatggagaaactagccagagcttcagatatttgttttccaggacatctcaataattgggtacacctcacaatatgtgagacttgacgtcgagtggcacggcatactctggcgcaggcacttgataaagactgtgtttgcaaatacttagcctgcacttcaagataccaggcatctaagcacgtcccagatggtgacagttaatcttcaaaaaaccctatgtggaagtattatcattgtcctcattttacagatgaggaaaaagagacacagggatgtcaatatcttcctcaaggtcacacagcaagtaagtgatggaacagtggctcagccatgaagctattgctgttaaccactaggttgatttgccttcattaatttcttcctaaaactgcacatttcccgttagtccctcttttggtctgtcgtttgactcttggctactgcttagaggaagattcattctattattttctaacttagtaaattatgtgcaactccttggggacatgacacaggcaaagctgtatacagagatgtatgccaagacaccatcccaagttaaccctaacagtctatctgatcctgtatgtaagtgggtatattgtaaatatttttaaattttctgtatactacgatgttttgatagtttaaaaaagccttctggctgggaagagactgcccctccctgggctagtcagttcttaaagatggccatgggcccaacctggagcttacctttgatatgaaaactaactgatgcagagccacacctcctctgtttgggccatatggccccaggaggcactactcctctgtcataaccatcctggggccaggcaccacatttatgataatatatttggaagtatatcattatcataatctgaggtgtctaaatacagcaatgtcaccacgaggggaaaaggactttcattcaccatccatcgaattctttggagataattacaaactttgtaatactttatttcggttcagaaatacaatttagaaattttaatacaaatttctggaagttctgacatttttaaaagataaatttaagcttgttatccttcagcttgctcagactactgtatggatgctacgtggaaggtggttgatcattgagggaccatcattatgaagatgcggggtccacagcgtacatttcccagccgagatatagcagcagggaataaaacagtgggaacagtagatcagcctcatattgcaaatcggcggcacacaccctggagtcgtttgtttcccatgagcacgttgtctaagtactacgataaccaactatgacccagtaaccttgtcatgcctggggccattatgactcaagactgcatacctggaatcaaacttaaactgtgaatatatatggcatgtttagcatgatttgggctgggttaggtgtggaattgttagcctgtgttttcgtctgtatttatttgacatgttctgtgtatatgattaacaattacagaattcactctatcaaacagatatattagttatggcaagctataaggaacgtaatgaaaatgtatgaatgctgcaattatgacaatgccgcaactatgtgtgtaaacgcaaagcagtggatgtaaacataggcagcgaaaggtcctcctcctaccttccatgagaaggaggcttgtgcttttgtggtgccacctggtggaacaagggagatgagagaagagagtcctgaaatggttaactggcccctagagacactcttcacaataatccaagtcctatgctcttaaaacttcacaaacctttatggagcacttgaaaaacaattttttaaggaaaaacatcaaagaatttagtgtcgtgtccttattttctttccacctcacctgactcaatttccccacatgaaaaaatgtcatcaaatgccaaataaagaaaaaagcagagaatggataagaacaaggggtgtatttgctaatgaatgcactccaaaaccacagaaattaacaaggttacaaagcagcctagcttccaatggaacacaaaggatgcctcattgacctagttatttgcatgtttgtcttcttcctccattaaactgcaagctatctgaagtcaaagtaacattatcagtcaataccttacatagagagtacactctataaataaactaatgtatgaacaggaagtttgacaggcagcatctttactcatggtccagaaatggacagttcagttctttagtattttacttctcttttatcgctcaagacaaaggatactacagcaatagcagataaataacaaaaccacaaccccatctatacacagatattgctgttaccttcaaagtgtcccagtctggttgtgtatcattaactttcatccactaataacaaaaaccaaacatcacatggagcacagagcacagaagtgcttccatcatagagtaatatagcaagaagaaaccgaaataagaaggcttggggaaaaaagtctgaagctggttctgccctgaaaaaaaaaaggttttattttacagcaataggttcataaataaatagaaaacaataagaaaatatatgagatctgaagctccattagccagtatccatctgttactcatattttaatatcttctatatcaccctacagcgcaacatatgcaattaagaagaaatggctatgcaactttttggagataagttattgtcaatgggccaaccacacagagccagatgtaaattactaagtcaatttagcaccagtttataaagttttgattaatcctcagctcattttatgttattataatgcattattaaatgcagcgcatggcttgaacttgctccttcataaattcactacatattgatcctgatggtggggcggatgtcatccccatggggcctctgaagtgatattctttccaaatgacaagagagcttctgctcataagacacatgttaagaaatatctggcaaaacagcaaaccttccaacggttttcatcatgttagcttttgacatgtgcatttgtaatgaaagtgcgtcttgtagtaccagcaagacactcattttctcctaactgatccagacatcatcccactccatcctcagggaacccactgagctgatccatgctgatgtcacacaatggcccacactgaggtttgctgaggatagggcactggataaaatacaggacacccagttcaatttgcatttaagataaattatgaataacatcttaatataactatatcacatgcagtatatagggtatacttatactgaaaaatttgctaattctggcaaccccacatgcagagtttcaggttgtggtctgtgcctggctgcggtccacattatatgtgttttaggagaggaatatgtttatgctacaattccaagcacacttgctccctcctgaggctttccctgccttcctggagcttgccaacacacctcttctaatctggcgttgactgtatgagaatctttcatcaatatcttcagaagttaaactgttaattaaatatcaagctaagttaatatcctagtggaagaattaaccatccctgcctttatgaaaaaaatctagatactaatataatggtccctgtgtgaggctagaatttcttacactgattttcttgatatttatgatgatttaatacaaagactatgggaagaatcaacaatattctgaataaaatggcttttatccaattaaaatatacttggataacaaaacaccacagcagtttcatgcaattgtgtcaaaatggttgctaacacaatttaatctctgacctctatttgaaatttcctataacacagaaaactaaagtctatgcttacttgcattcttaaaatgtagaaggctgagataagagaaactaaattgccaatgaattacctttactctaaagataagtgtcaacatatacatatgtgtctacgtgtgtgtgtatttgtgtgtgtgcatgaaatactgtattaagtatacatataaaaacatacacacacatccttctgagttttttcctatgtagagaatacagaaagagcattaagtgggcaaaggaaagcatccaaaagcaatgtcagcaatggaggagttcagaaacatgaagtagatgctgatgttagccatatcccttcccctactcaagagaaggaacgaccagctcccttccctcctcctgctggaatccgggctctgggctgcaggggcagcagctgtttacaccctttaagtactgacatgaagacaaaaactactcgccaaagatgactgagcaaaagagaaaaaagcctgggttccaatcgtcaccccaagagcacccaaggactcaggacacatagctgttacatgacaaaaacacaggtcttggttggctaatgtgccaccaattgggttttcccataggtgcagctactcattttcctgttacaaaatggaaaacccaaaactttccattcatccacccgtagaaaacataacttgctcagtttctagattgttctactgtaattactaagcataagatggaattgaggtatctatatttttttgtggcctagagactatattcaaactgatgaaggctaccacagaaacctaaatggacaaatatttaatcatgagcattctgaattggctcttactctttgtccctaaatatttttttaaataaaaaacaacaatattgaggaagtcactgaaagatccaggttaagaactgaggaaacacaacacattcctgtgttcagcatggttatttctccttgagggtagggtttatttctctgtagcagttaagacagaggatgggtgtaacacgcatagttggaatttaaataaaagcagaagcagccaactatttgcaacatgatgaagttccctatatatttaaggaattatccacagatatatatgaatatcagaggcaccatttggcccagggtgagaatgccaggctgagccaaccatactttaagcacatgtgatttgaagtagctgagacattcatgacaagactgacagtatcccagcaaaaacttaggccagagatagcagagagctggcctggagtcgctttcagctgtgggtatctctaaacatcctgtgtcttgagcttacagagttgcatgggcttcctcaagtgtcagccagcctagtcctgcccaaggaaacatgtgctgagcttgtcacttggtacttggcaggctcgcagagaaaccagagagcgcagtcatagtgggaggcctttagcactgcagtcctcaacttcaaggagaggagcaagcctttgaaatccaccagagacaagatgcctgagaaaacaggggccactctacaactaaataccctttcccaaagggttctaattgggggaaggacagagtgacggagaaggaagaaggaaaggaaagcaaagacaagaagaaaagtgtcaggggtcaacagattttgttccattctttgatttcctggatattttcccaaagggatggtagcacattaaacctggactcaaccagagctacaagttttatttcagtgaaggcattttcttgatcattttgcactgtgtccaaataatgatagcacagggaatacatgaataactgggataaagctgtcagtgaaaggaaacagagcctctggcttctccagtattgaaaatagcataaaagagagagagagagagagacagaatgaatgaattcaaaatacattgtgaaaccactcatccatttgcaggactaggtacgcataagaggggcacttcttcaccccccaggaggaagagacttgtctgactttcttccttaggaacacagaccatgacctaaggcagaactgtgaggttcagcagggaagaggaagctaaaagagccccgagggctccaggcacaggtaacatcttggatgctcatagcaggttgctggggaaagcctgtctgtatctaggaggtggtgtcctagagactatctatttccatgaaaagctcccagtgagttaatttcagagccaaacacaagagcctgggctcacaacatccatgttcactccattaccatgtgctactgagcagattcatccacacgctggagccaaccttgaatggtttcaacttcacatggaatcatctctgtgtattttatgtagcatcctaaagttgcatttaaaattttaaaaataaacacttcaaatgttggacaccttctcatggatgaagatctgcataacagcactgctcttacaatgccatctctctttaaggatagaggagttcattgcccgccacactgggaatattataaaacaacttcttaggatgaaacaaaaattaattttaagtcatagatttatttaaaacccaaagatttggcatcatttaagtcaataaatgtccagagtaatgcctggaacagacaaagtgctaaataaatggcatctggcattcaccattccctctaattataacgaaatacatttcacggctgggcgcggtggctcatgcctgtaatcccagcactttgggaggccgaggcgggcagatcacaaggtcagggatttgagactagcctggccaacatggtgaaaccctgtctctaataaaaatacaaaaattagccaggcatggtggctcatgcctgtaatcccagctactgggaaggctgaggcaggagaatcgcttaaacccaggaggcggaggctgcagtgagccaaggtcacgccactccactccagcctgggacagagcaagactccgtctcaaaaaaaaaaagaaaaaaaaaaaaaaacaaaagaaaagaaaagaaatacatttcactagcatcatattatacattgcaatcttcttgctaatattataaaaccaagaaaaaaagtttatttttacaaatacagtttccacaaaactcaaaaaacctcttttcattaatgtatttaggaaatattcagcttctgttgttttccagaaacttctgcaagctctagagatgcagaagtaagcagggcaaagtcccctttcttgcagaacgtggattcacatcaggagacaggtaataaaccaataagtaccggggtctcaaatgcaacagcaggtaagcacaagtgctgtgaagggcagagcatggtgaggcgcaaggggaatgcttcgtaggacttacacagagtggtcagtagagctgcccctgaagaggaggcatcagcacagaacccttcctaaagaaaagtgagtacatgaggctgaaggacaggtgcaagggaggaatcagtgaatgagggcaaagaaggagctgggagccaaatcatgggagctgggtcaccacaggtcccgagcagagataccacattgacagcaacactgccagcggattataccctgatgtccaatcaatggcaagggccaaagcatcgggttccttttatgttatatcctcatttttcaatctatcaccttctccaaaggcttccattttcctctctgttttcctcacccctgtgcttggtgtaatagatagtatccgatcatcatagcagccttgtaactcatttttaactgaaataaatacttgttacttagtacataatttctcctgatcaaaaattccaacaaagttcagaacactgaagaattgaaattctaatttagttttactatttatcctgcatttgagcagaaaagacaaattctaaaacaaaaaaaaaaaatctagaaatatttagtattcctacaatgataagctgatttcatatcaaggggaccaaggatgtgagtcccagttccctttccctgccctgaatctagcacttatttctagaaggcaaaaggcaaaagcatttcgctttcagtagagagctcatttgggcttggtttttcctgaggaaatccatttagtataattttttaaaaattaaacttcacatgcctatgactcaaactttcaaaccacccccacactccatcagttattttcaataattaacagtgggtgatctcagatacagcctggatgttttggaaaacaggaaatagtctgctagattgtagcctcatattccccttggaaggcttcttgattgaatgctacaagttgtcaaaccagactggttcatttgactcccctgaagcgcttgcaggagagttacttagtctctctcttccagaaaggagagcagccagaatgccagaacccaaacatagtcaccccaggactctggtgaaggagaaccttgcaggtggctcccaaaacacctctgctggcagcttttcccaagaggaaggccaaatggccgaagctaagtcaatgatttatttctaactgctgctaggaggtatcgtgcagggttatggataagtaccatgacttttctttgttgtctttgactttctggcttacaatttctgtgatcaataggaatagtctcaaagtgagcaatcagaaatttgtcctggtagattaactgtcatgcaagctgcaaaacagagccagatgaaaaatgcagaaactaaaaccataaagaatgagttgagatatcaagagaaatggcactggactactggtggtcctcaacctcatgtgaaactttcaagtataattaaagtaacacatccaccagaataatttacattattgataaaagaatagaaaggattagataatttaggcttctttttagaatcattagaagactgagcaatagacaaaggccaatttagttgcaaaagttttaattttattttagctataatggggacactcttttagcaggctatgtaaattgctttaaattcaagccattggtgaggagttgctaaagttgcccgatttcttagtttgtttatatctgcatttagctgctatgcaatgtattaatacatgaagatctaataagatattaaacagctctaatgttcagggtgactcccaaattatttttgaaaaattaatataatgggtcatattagaaacctttcattttgggctgcaagtaactatccagacagtcttacaaggttcagtgcttagagagactgccgacaagagatcccatttaaagcggaggccatgcttaatgaacaacgaaatatggccccatggggtagggttgaaagggaaggtcctaggtctcttgtatgctcaaaataaggtctaagatggcttatggggtccaaaatctcagtatggcttcaatgcatcccttacaaattgtgggcaaaaattgcaaatggacatgttaagaaggtgatgaaatttatcaaaacaaattatttgaaagccaaggccaatagggagcttccagagcagcacctccagtcatcaggtcacagaacacaatcaacaccaattcccatgggttcactttcatgctgaaatcatgcctccccctctatgtgctatccgaggatcactgtgtttcctacagggagctctttcctgtaacctcccagactcatgagcttgtgctgagataacttttaaaattgaatacttactgagtatttattgaaagctggtttcttttaagtttgctacaaccaatacaaaaatcaaatgggcatcaattccttgtagagcaatgtttactcttgttagaaaggaggtgccattagtaagataacataggtattattttactagaaataaaataattgtaataaatgacatgggtgtgtttcattgcaattaggtttaatcatgttttctcactgtaataaagaagcacctgagtcgacatggaaggcgtgattgagttttcaccattgccctaaaatagtgggtgtgtatctccattatcttcaagtcactttcaggttaaaaccatcccagagtatttggtgcagatttacatgttaactagttcctcagagagaggggatgtgagcagtcttaaagaatatgccatctggtgcagtacgacttcccggtaacagtttatctaaatgtcatcattttgtttttcccacacatgccttaatcaccttcttcaggaataaattgactctcttgtcatatatgcttttccatggtttctacacagtacagctctaaatgcttattgccctttacaggttgtactcctgaggtctttccttatttcttggcttccatatttgacgcaatctcctgtaaagtctttgagataaagtctcagtcagtgtaagagagaaggaaacaggcacctgcaagtgctgaatggtgacccaggcagaactcgtgctctaccctagaggcacccaccgtggaaggctgcttttctagcatgaggtaaaacttcagggacgggtgcggtgtctctcgcctgtaatcccagcactttgggaggccgaggcgggcggatcacgaggtcaggagatcgagaccatcctggctaacatggtgaaaccccgtctcttctaaaaatacaaaaaattagccgggcatggtggcgggcgcctgtagtcccagctactcgggaggctgaggcaggagaatgacatgaacccaggaggcatagcttgcagtaagccaagattgcgccactgcattccagcctgggcgagagagcaagactctgtctcaaaaaaaaaaaaaagaaaagaaaaaaagaaaaaacttcagaaagctggcttggggaagcatttccagaacgtgatcatagaatcctagcaactagggaaagatgagtcactgtgaggaggttgagtctgaagatacaaagcttcgaatttatcaccctgcattccacaaacaaccacagcatatgctttctccactgtttctcattttggtcactagagcacctgttctatggattgagcaagatgccagggagtgtcatctccctcttcctcatgaagcccccaccaccaccgcatccagtagtcaccgaatcgtgtacatcaagcctcctaaatatcttttaagtggacctatttccctcccactcccctatcaccactgtaaatgtcgccactgtagtggtctccttgcgtctgatcgctccttgctgcaatccattctccacgttgcagaagggatagtttgtaaaattcccatcaatgcataccagtgactgtggaatggacattagccagatccagcattttcagtcctttggctgctgcaaactttcttaaatcacactcctttcaacatgcagctccctctgcctggaatagccttcccctctgtctacctaggccttctcccttctgcgggtgtccagagaatggtcctcctttgtaaggtcttccttgaagtcccctgcttaccaccgtcctgctctgtgctccagatccttctctattttcccttccacagccctcctgccacttcactgtagtcatgttgcaactacccatcttctttggcacgaaggaagttctgacaggtttcacagccatgtctgtcttctccgtcactgtattctcagtacctattatagagtaaatgcttaaaaacataggatgaagaaaaagtggatctacaactagggacaaatttacaatgaggcaaccccaaggatgcttatcagaactctgcagattcaacagtgaaaatggcaggcatgataaatcaatgacttaaaaagagaagggagtttacataatctgcaagcactgagcaattctggccaagcagagggtatgggtgggtacaaggtggtgctttctactactcaccaggacagcatcactacaaggggaaggcaggtgtccacaggggtgaagaaaagagcaggatgagaggaggaatttggaaagttcacttttacatttcttctatggtccgctaagtacccattgcctgacacttagtaggcatccaacataaaattattattattattattattattattattttgagacagagttttgctcttgttgcccaggctggagtgcaatggcatgatctcggctcactgcaacctccacctaccgggttcaagtgattcgcctgtctcagcctcccgagtagctgggattacaggcgcacaccaccacgcccggctaatttttgtatttttagtagagacaggttttcatcatattggtcaggctggtctcgaacccctgacctcaggtgatccacccaccttggcctcccaaagtgctgggattacaggcatgagccaccatgcccggccccaacataaaattatttaatgagtggatataggttctacagcctcagagcccctgcaataccacagtattagactatccatatgtacccaaagtttatcattgtaatactctaaactctgtaagaagcctcagaatttcatcttaaagttgagtttctgagttagaccactggcaaatcagctgctctcactagatagtttttctccaaaccactcattcattaattcaagaaacatgtattgagaacctaccatatgccaccccctcttctaggaaatggggagacattactgaacaagacaaggtgcctccaatcatgaacgctattggagaagagagaaaacaaaaagtatataaactagaaagaatattatttcaagtaataggagggagaaaggaactaaacgcagaggaaaaagcaacagattttacatggggatagaatgtctagggaaggactctctggtgaggcaacctccaaggggccacgacggtggaaaaattaattccagggaatctggaaagaacattaaaagaaatagccttaagattgaaagccatgccattttaactcccgtggcatctggcacaacgcccagcccagaagtctcacctattcactcattcaatcttctgttcatttacgacctcattcattccttctacaaagggtcagtgaggattcacagcacaccaagcactgtgttagacagtaataatacaacaaacgtttattgctttattgggagaattagtgtgtatttgaacacattaaaacctccagtatttgacagattttgacatacaaatggcaacttcatgtaattcatagatgctatttatttctagattggtaagcacaaactattgggaagtaaataacgcattttggaaacttgatttttcaagttctttgtaagaactcttttacatagcattgtaaaagatattttacattgtacttttagttgcaaaggagttttataaacgggttatagcaaactttttaaggaactatataagttcctttaaggaactatttgtcaaccttattccatttacagctaatagttgaaacaaatgaaattgcattttcttaaaacatattatatttctaatccttctcccaagttaatgcaaatttagaaaattttgcatgtattggtatatatcacaattcccttcatttacctcccaattagaatttcagcctaaggctacctttgtaatttctcaatagagaaatgttttaaaatataatttcagataattcaaggaactgagttaaacaagtttggagcatatttttggtgacaactattggacatacgaattgtcaccaactgaaccatggtccattcggcctgccatgcccattccagaagatacccgagaagtcattgttgtcttaggccattcaaattttcgtttgcatctgtggccgtgagtatcacacactgtgtttcctgatatctagtgtaccagaaattttctgaattttccagtagtcattaatggctctttaattcatatactcattcaaaccctatggaattcatttacaatgaatcattataatatattctttaactcttggagtgatgaattttataggtatatttacaacagtgctacatagtccttctacagcttgtcaaatgcacatcacattcaagagattttgtgatgtcataatgtgatgttcctcttatctctgttactcattttgatatggaattggaatatatcctgttcccagttcacactcccttaagttaaagagatacattctttttacaacagagccttatgttttcatctggctaattcagaaggtaattccaacggtgaaaactatctcgagtggtaattatttgggcagtatcatttcatgctactcagaatccaaggaaaagtctctgatatcctggagacagcagtcttgattaaagagcctgagaccacttagctctttcagaagacctctgtaacctgaaatattgtagtgtaatttgtgccccaggtataatctaaaagcaaagttaacattctaccacatggtgactaaacaaacttattgtatattttaaaattaaattaagactaggttttaagtgatctcaccacaaaaaaaagaaagataagtaaataaggtaatacatatgttaattagctggatttaatcattccacaagatgtacatgtatcaaaacagcatgttgaacactataaatatatataacttttgtcaattaaaaataaattaaataataatgaagatgaattcctgttaacaactagaaaacaaacaatttgagggcaagttatgataaataatagtatgtaacactaaggcagacaacattatcctgacaaaatatgatttgtcttcttctttacacagatatcttgttctcttttgaccagagacaaaagaagaaaagtcttggaaacatccttcacagtttggggatgaatgaaggcagagaagtattcatcagtcttatgttcctggcaatgaaagtcaaaggaagtcaaaattgtggcttctagaaaagagaggagctgacatagccccagctccacctcccttgtctcaaagcataagagcataactgattattctcaacctcatccatacataaaaaagcgtgctaaacatttacttttgtatgactttagcaacaatcaaaataacttcataattttgcatttcctttttattatatataacatcatattttactatgtgtttccatatacctaacccttagatcctcctaagccctctgaatgggaagcaaaataggtatcgttacttttcaaatgaagaagccagagctcagtgcatagcagggacttgtctaaagtgatgtgggtaggaagtggtgaatccaaaagctgaagttctggtcttctaactcataatccggtgttattttcctttctatctttttttttctttttttaagatcagatgttcatagtaactgagcagtctctcagtgcacatggagtggttttaaaagtcaacattaatgttcaattctgctgcacggtgttgagtattctggaaagatctcaagaagagcctgatcccatgccagcagaggctctgttatgcatcctgcttttccttttaaggcattttaaattaaaggaagccttagacaccaccatttctttctgtcccactgacaaccaaatcctttcaacgaaagcaccaatttggtttagctacagattatttttatctgttcttgaaagtcacataaacgtgacctgaacaaatacgctcccctgcatgttcttcctgaatttcaaagtttttcagtaattaagcatttttcctagagtgttgcaaaccaaatagagttctgtgccaaagcaaggaacgcattaatgaaaacgaagaataaaaggaagccaaatccaagttgcaaaaaatgctctgccttattttgctgaaatgagatgcaaatatatatatataatatatatatatatatatgcaagctgaggactagagtaaatataatatgttgatgtgaattttcatactaaaatttttcaagaaaataaatatcccatctcaagatatgtttttttaaaaagaatcacacaatcacatgaattaaatgtgtgtcttggtaaatttagggatgttaataattcattccgataatagtattaaaccagaaaactttacagagtgaaaaagtaataatctagcaaagaatcctatcattggatttcacccaaaaaggcatcaaatcctctagattccatcaaatttctttaaaaggaaaaacactttttcttttcaggatgtcttagaagttttcattaaatcaaaaatgtgcacagcttatacagtggttctccagaaaacttcaaccacttggaacacatgtttgtgtttaggggaagacagagggaaaagagaggaaaggttgggaagaaagagatcataatggcttcaacaaaatttacaaccagtgattgtatgatattgtggcggcggcagctcctcacacaaaacagatggtacaatacagagctgtgtcttaaaatgccaagcaactaaagattcactgattccatctacttctgaagcctttcctaacaatctatgccccagagtcgacttcagaatatttttacgttttaattatccccttatttgaattactatagcaattatagcttcatacaggctcattatacatttaaacattaattttatgttttaaaactcaatactcttaggtcaaaagctcactagtgagatagtggagtggaacgttagtttcctatgtaacaaatgaccactgtaacaaattcccataaacttagtgccttaaaacaactcatatttattctcttgcatttctggaggtaagaaatctaaaacgagtttccttgggacaaaatcaagacctcagcgaggccctgctccctctggaggctatagaggagaatctgtttccttccttgccttttccagcttctagagctgcttgcctccctgggctagggcttcccttccatctacaagggaggagcagggcatctccaattctctctctgctccatcttcacatcgccttttcctctctatctgcagcaaatcttcctctgctccctcttataaggactctcacgattacatttaagacccacatggacaatgcagaataatctctcacctcaagacccgtaacttaatcacatctgcatcattccttttgccatgtcaggtaacattcacaacttccagggattaggacagggacgtctttggagtggactatcacaccctccacagcagcagaggttaacctcttaatgtcaatcatttagaactacagtcatccttcagtatacctgagggattggttccaagacccttccccataccaaaatccacagatgctcatgtccctgatatgtaatagtgtagcatttccatataacctatgcatatcctcccatgtactttaaattatctctagattacttacaatccctaatacaatataaatgctaagtaaatagttgttatactgtattgcttaggaaataacaagaaaaagtctgtacatgttcagtacagatagaaccacccttttattcccaaatatatttgatccacaggtggctgaatccatagacttggaacccatggatatggagagtcaactgttacttttaaatcaccttgcaaatgaaaatatgcttgctaaggttccttcaaaaagatcattcttaaaaagagttttggttagtgtagattccactcaaacttaatcctcagctccatgcatcattaaccttatggataaaaaattgtggggtgggatcctgcaattctctcgttctgtcaacagagaatactaaaaagtttaaagccatgttcctcaaaatgtttttctcctacacttaaatcgtattttcataacagcatttaatatactaaactacatcatagcctagcctagcctattctaagcatgctcaaaacattcccatgagcctacagttgcaaaaatcatttggcaactcagtccactgtagagtattggacatttacccttgtgatcaagtggctgacggagctgtgactgatggccactgcccagcatggtaagagagtgtccaccatatatcactaggctgagagaagatcaaaattcaaaatttaaagtacagctcctactgaatgtatatcatgttagcaccatcatgaagtcaaaaactgtaagtccaaccatctgaaggcagggaccatctctagttcgtcatgcaacggaaacttaaaaatgcctttaaaagttaacatagggcagcttaatttgacgttaagaaattttcattgagaaccttgaaataagtgtgaaaaatgcatgtgtaatatggttatggcaataggggagttggcaaagaacttgggagaacgtgcaatgttcccaattaattttagaccccataagaatgacacaaacagaagagcttgcagctgctaacaaatgacagatatgttctgtcacaccccggccagtccaaagggtaatgcagctaacctgatagtccccgggaatagcagctgtcaggaaggtgctgctacatgtcagatccagctccttaagagcaactgataagaaaaagatgaagaagaaaacagcttaatgtcagtgtaaaatctgaaattcacttaatcatgggattttaatttgttaaccttcccaaaaaatagtatgctaagaaccaaactgtgttccctagtcaaggtggagacccataggacatctcacttctccatcaactgccacccacgtagcacctcataaatgaaagtgggacagggacacttttctcttattaaatcattttctcatatctgaatatagttacgacatttgtgaaatcagtgcaaaaacaatctctttttattgaacgaaacatagcccaggtaccatgtgcttaattcaatttaactgaacaaatttactgaacacctacggtatataaagcactgtgcaaggcactgctgagtccaatgtgaaccctgcctttacagaggtgtgcagacatgcacacacacatacacagacacactcacatgacatacatacctctgcacacgtatacaccacacacagacacagatacgcaaacaccacgcaacacataaatacacacgtatacacacacaccacacacacacctgctgtccatgaagagcaggagttttgcccatcacatggagaacagggaacgtacacatggcaaggatttcatagcaccgttggaagcagcacttagaatctctagaaaaagagatttctcttatttaccatttctacactctctcacagtgaactacccgtatagtcagctgtgaaggttataacgcccactggacaaaattttaaaatgtagaaaactgtcttcactttagtatgaacaagagaatcctttgtcatcccaccccagggaaccagtgtgaagagacacgacagtttgtgtggagaaaggggttgaccatttacaaggagagagccatttcctaagacgttgcttcatcaaagcatcctggaaccccagaagagggaagagtatcaaaccgcatctgtgtgcaagaagcctggctcccctccccatgcaactggaagaccaatgagaatcagaaaagcagtgaccacgggccatcctggagccacatgggggcagcgtcttctgggacacaggggaagcactgagaggcatttaggaaccagggatccatggtcattcttacttaaagaacacacccattatttacatcctatcccaatggtggcaaaataataccactgagctgaaaaggatctctacattctaccaaatcctgttattctcacatgggcttcttcaaaagtatagaaggttgtcaatgtgaacacagtgcacttcatgactatcatatcaatccctgagtgtttactttcttctcagtgacattaacactggaacatccatgtcaaggaagtacgatctgttcttttcaaactaaaacatgtccagtccggagtgggtgggagcaagcccaccttgtggccactactgaactaccaaaactccaacagagaaaccaattctgtgaagcctatggggaatgccacattttttctaaagaaccataaattaagtttaaattcatgtggtctgttcactaaatgtctttgcagaaggaaaagggaattggctccaaggattgcagttgctctgaaagtgcatgtggcatcaatactcacttctctaagtggggtcccaggacctgtggcatcagtattatctggaaacagaaatgcagactctcaggttccacctcagaacccctggaccagcttctgcatctccacagaatccccaggtcctctgtgcctttaggttggagaatcagtggaataaacaccaggagtgcaaacaagatcaaagaagttacctgttgtagttcactttttcaaataattgactgaaattaatttttataattaatgaagctagtgatgatttggaatcccttgactaagagaagggttttaatgtaattaatctgcaaaatgatcagtttttgtgcatcactaaacctatgaagtttataaagattattttcctagctggttatgaagaaaataatgtcacaaaagcatctaagggctgtgccttaccaatgagccgaccctctccagtctgctttcctgtaatcatagtgactcaatttctagacttagaaagaaaaaacacagaaaactaacatagaggattgttctcccttctggtcacggtttatggtagcaacaggtgaaaaaggccaacagaagcaacgatttgcctcatcacattaaaagaaacatttgctttctcttccaaaagcgtaagtagtaactatggaaaccagacaaaaacgttgaaaatgacttgcaattcacaaagagcagaacaactctatttcacccaccaaaaaacaaaaaaattaacgatgaaaaaatccaccgaaaccttccccaagaagagctggatctgcagaagacataatgtgagtgctttgctcatgcaccatcataaattgtttgatttgctacagaattgttaaattatgtttttacaaatcggttatttagctgtgactccatttaaatctacaattttatgtgtcctgatgataaaatgggcccttagctgagccagctaattcctcaggtaaaaggcatattcttttggcagtaaattaactttggaaggtcagtaggtggcctatcaccaatgttagagatttaagaaatgcatattttgtctaaaacacttaatttacacctaaggaagctgaatgaatgatctcaaaatttccagctattatctgtttactaagttggtcctctggatatcctatttaaaggttgaaataaatgtacacatgatttatggagagaaaataaagcaggaaaacttcacccaattatgccaacctactcactgcccagaaatttccatccaattccactgccataagcaacttctctgtgtgttctcccatttatctgtttgatgttcctgtatccctcccccactttcagatcagatgttacttccttttcagacgagcttgtgcactgcttgatcttaatggaaccccataaggagaaaatgaccactttattttaaaaaacagaggagatgctgactcaaaacagaagagagtaaagaacttccttaaaaatatgaatctcagtgatacttttatagcccagaatgacatgtttatctttcacctattttttttttcactccaagcaagagcagaaaatttttttttaagcttgataagcaaagactcatttggggatacctgctacctgaattatcactatcagggttaaattaataactatggcatattataaagccataaatataattttgagctccactcttcccagcatatttatgtgagtttttgtctcattttgtgtgtttgtggtgagttttcttcctttctctgtaaaacatggagctgctaaggcatcagtctgttattgtatactgacggagtgtggaaataaatgccaatatcatttgcagagccatcctggttgtgacttttttttaggtgagtatcccactttcaactaaaacctagaaaaagaattctaaaacctttttcccaattaaatgttggcactcataacacattgttgatggattgaccaaattaaaaaacaaaaaatcttaagtttaatactgttttcttcagatggcatcaacagcgaagtatgtccctaaacttttcattgttcaatgctgggttgacaagcaagaaaaatctttttatcaccaaaatgcaaaaacaatctgaactagctgctgtgtccaatccagcttcgttttaatttggtgctaattctctaatttgctcatttattttctctaaccacataattaatgctgaagaaagtcttttacagcttgccactgagccctccatgtcttaatagaaggaaaaattccttagatatgtttcccatcaccatgcatgtgctgaagccaagaactagaaaaccgtaactgtgaagtattacgaaatccacacaattaagtgctgaaaccagcaagggccaaaaccactctgagacccagctcagaccaacccagcctgccctttcaagtctgtaaattggatcgcggtccagtgctttctcttacctcatcagccttcctttttccttttgctgtagtggtatgttttcaatgaactctgacatatttctctgattgaaaaccattttaatactcctagacaatgtgcttctgaaacattgtcacaacacatacaataaccaaaagtttagacctgtgtaaagcaaagtgaaaaatggagtgtcattgaatcccacaattctcgaaatacaagtttatgggaaaagccaaagagagccaagtgatatagtttccagccatggcacctcaggaaggcccctcacctggcctagcagcagccattcccacccccaaattgtaacctcagaggtacagaaccattctccaagtgctgtgacctttcctcctacaaatcattcatcagtccaacatttcctaagcacctactccaggccaggcactgttgtcaggactggacatacagtgaaggaagcaaaggctctgcctcgtgggacccacactccacgggaggaggtaaaccaccaaatacatgagtaaacctatggaggatgatggagaagagaacagaggaatggcgtgctgggaatagggcagggagggagtcgctgaaatggagtgaggggaacgtgagcctcttgaaggacagggcactggggcggagtcagaggggcttagaaggtgagggtgggtagggggaggacaggagctcagagcagggaggtgggagagcaggcactgctcaccagcatctgggcctattgaagatagggattggtctgggattggtctgttattccatattttatactctcccagccaggagatcaaagtcagtggcatcactggtaagtcctgtccatagcactcatccttgatatcatgatgatggcgctttatttctgtttccctccagaaaatcctagctccaggcaagtcatgagaaaaacctcagacacagccaaactgaggacatttgacaaactacctgatcagtcctcctgaaaaccatcaaggtcatccaaaacaaggaaagtctgagaaactgtcacagccaagagaagcctaaggagacaggcagctaactgcaatggagggtcctgcacaggatcctggcacagacaatggacatgagggaaaaagtgaggaagtcagaatagagcgtggccttcagtgagtaatgatgcatcagtgtcgcacattagctgtggccaatgtacacacaagtgcaaggcgttagcaataggggaacctgggcacagagtgcataggaactctccaaactgactttacaacttttctgggcatctaagactattctagaacattttttaggctaggcctggtggctcacacctgtaatcccagcactttgggaggctgaggcaggcagatcatttgaggtcaggagttcgagaccagcctggccaacatggcgaaaccccatctctactaaaatttaaaaaattagccgggcgtggtggcgcacgcctgcaaccccagctgctcgggaggctgaggtaggagaatcacttgaacccaggaggtggaggccgcagtgagcggagatcacgccactgcattccagcctgggcaacagagtgagatactgtcttaaaaaaataaaaataataaaaataaaatgaaatgtctttaaaagtttatcttgttaaaaaaagatgcaaatgctctctatctagaaataatgattccagaataaaaactgcaacaaacaaaaaaggtggatgtgaaacaactgtacaggtgaatgagtcaggatttaacaccgctcggtctattcctgctgagcggtttatgaaatctgctggagccctcacagctggccattccatttatttgaaactctgaatgattatgtttttccctattggtcccagctctttcttccagggccacacactacaaggaaaacctcctttcctgtcagcagtgcctcaagtcctcagagagagctttcctaataaagcacgcgctccctgcagccgtgttctgagcctcccttcaccccacaaatcatgcctggtctgactccaaggaggtgacctagacaccttacagggaggaggggcagagaggacagcacctgctcagttcaggctgcctgtcacacctgtcctcaggatcctccctccctctctttaggggtccagggtgccactgagaggctccacctgatttctgaggtccaagaccgtcctgggttccaaaacagggtctcagacagcctccccgtcgcatagccttcgcctgcatggattgaacttagcagccctttcttcttccctcctctgttacctccacagcctgacaccatggtgacacccacacatgactcaagaaaggatgttgacaacttccatgtagaaaggcaagatcgggctaatgtaataaataatctcataccttggaagcagtcagcctgcacgtacgagacagagaaaatgaggcagagacaaagggcgtaattgcaaataagaggagaagtaggaggggaacggtggctcacacctgtaatcccagcactttgggaggctaagatgggcagatcacctgaggtcaggagtccgagaacagcctggccaacatggtgaaaccctgtctctactaaaaatacaaacatttgctgggcatggtgctgcgtgcctctaatctcagctactcaggaggctgaggcaggagaatcgcttaggaggcagaggttgtggtgagccgagattgcgccattgcactccagcctgggcaacaagagcaaaactccatctcaaaaaaaataaataaataaaaaggaggggtaaagagtatgtctctttactctcctgtatgtgtttaactccacgccctccaaaatgaatgattttaacctggaaagttaaaccaaacatttgaggcccaccataactatggaactaacaatatttaaaggaatttgaaatttaccaaatttggtctccaatgacaagtatgattctgcatctcctgttgacatggaacatttcagttcatgagagaactggtcttcaactgaaattgaatgcacacagccttttatgcactgagatagacgtggcttcccttctcatagctcttcataatgttattaaacagtttctctagggccatttttacttctctaaatgatgacgcacatacatattttgagtttctgtggtctctttttttaacaagataaagcaagtagtaagtaataaaggtggtttcatgtacacagctaataagagtgtttaaaacctaatatcagctgaagaaatcttttccttatttatgtaaaatgggaattaactcatccagtcaagaggaaaatgaaatcaacaaatgaaacgtacacaagagaactgtaataattgccaaactcagctccgcagagaacaatgggattccagcagaacacagcacccgggcaatggcggaatgtgtgcatcgttgcctccttttccagagccttatcctatcacagccctgttagagatgtaagctcctggtctctctttgaagggtgtggtttcagtatctaaagtgattatcttacttaggttcatgaatcccataaaaatgcaggaattgtaaacatttaaagtgaaaatccttcctaggatgtctcatatcttagctataattgcaaccactccatattgtgtaaaattgtttacaaaaattcaaaaagccaaacaattaaacatattctaagtgtctctcaattgccatacaaatctataacgagggacaaagggaaggtgacatgactcagagtctcagcagtgagtcatcaatcatggcaaaataatcaccctcctgggtgaactctctttgtcaacagttggtctggaggaggaggcatacaggcatacaaaaatcagcaagttcttaaaagcatgcaaaaactgaattctctggacaaggtccagtgcaaataagttgggatgatcctcaggagcagaaaacaactctgtcaacaaggtgccacctccaggtcatcctctgtgctccgctcccttacagatggtgtacagggtcaattagtgtctgtcccctaaaagttcacgtccacttagaacctcagtgttatgttatcactatgttatagagcttttgcaaatagagttaaattaagatgaggtctaatatgctttaggttctgtgtccccacccaaatctcatgtcaaatcataatccccacatgttgaaggagaggcctggtgggaggtgattggatcatggggtggtttctaatggtttagcaccatccccctagtgcagtgttgtgatggagttctcacgaaatctggttgttgaaaagtatagttcttctccctttgagttgtctctcctgcctctatgtggaaaagagtgcttgcttctccttcaccttctgccatgactgtaagtttcctgaggcctccccagccatgcggaactatgagtcaactaaacatcttttcttcatgaattacccagtctcaggcagttatttaaagcaatgtgagaacggactaatacaagatcatactggattagagtgagccctaatgcaatgactggggtcttcataaaacggccacatgaaggcagagacacacagggagcactccacgtgactactgacatagacactccacactggaatgatgcttctacaagccaagaaatgccatgaactgccagcaattacaggaagctgaagatagacctggaatatactgtctctcggagccctttgaaccaatctgctaacaacttgatttcagacttctggcctccagaacttcaagagaataacttctcttgctttaagccaccgagtgtgtgctgatttgttatagtagccctaagaagcaaatacagatggtaacaatgaccacaaaaataatgatgaaagtccccttggtcacaatatcagtccttagctaattttcaaccattattaatgcaaaataaatatatacataaacactttttttgggtgacttgacaaatatttaatgaactattagttttcttcccatgaagggatttgagtgagggtcctgcctcacagtcatatactaaccatatatctattgaatgcccaaaatttgacactttggcttagataccatggcaggctaaaatcaagctaataaaaaagagagagaggaaaaaagagatttcagaggatactaatatttacaacaaagtttacaacctgttgtttgaatcatatgaaattgccaatagttgacctttcttgaactacaaaaatagctatttcatatggtttaggccaaaggttgaacactatggccataagccaaatctggcccactgcttctttatgtaaataaagtttcattggaacacagtcatgtcatatgtttgcatagtctcaatggttgttttcacgctacaacagcagaactgagtagtcatgacagagaccatataaccctagaagcccaacatacttattatttcaccttttacaagaaaactttgctgatccctgatttaacctaaaatgactggcagcaacagtaaaggcaccaggatttcagaagaagccaagatcaatgtaaaaggaatccttactagtgtgtccatctgagactccagacataaactgggacttgagaaagaagctgaattctaatgaagaaaaaaggctctcaatgcaacagttcaagctaaggacagaagggacaaggacccaggggatggcgaggatgataatggctgtactggcctttggccccaaataccaggagcacttgtctctcggagccttttcaaccaatctgctaacaccttgatttcagacttctggcctccagaacttcaatcactgggacacctcaaaatgcccccatttggttccaggtcctgtccctgctaaaatcctcacatgaagtagaactagaatgagaaaactttgataaggtttcagagatcaaaattctttgaacaccagactgagaaattgtatctttttttctttacgcatgaatcaatagaaggatatgtaaacagcatgatagaagagttatattaggaaaattaatttctgatagatgtgaaataattgagtctagagcaaaaactatattattcagaatatctattcctgtggccctttttagggttgtatgataaaggataattactccaatgattgcagtaattacactttaaagatttatagagagttctagagttgggaatccctttggggttattatcaaatagaaaagtaatcaaaaggagccttttctgcttcattaataggccacacattacagccaaaacataacctgctataaagcttgcattgtacatcgagctgcaaagtcttactaccaaatgcttcccagggatttataaatattgaaaggtagagaagaatttgcttgagtgaggaaagttctcctcttttccatttacttcaattatccaaaagcatattaaaaacatttaagtttaacattaaactagaaagccaagtgggatgtgttgtaagtaaattaatagctaaatagatatgtgcatgtttatcaacctgacattaaatgtatcttaaaccacatatataagagctgtcacagggtcatacagttcattgattttttcaaaactaattcacaggtacctttaattatgtaaaccagctgttcactgcctggtaaagacttcagcttgcaaagtaagaattatctacttagagagactgacctagaacacagttgctcccaattttttaaaggaaatggtgttacactgcagcaatttcttctcatgaacttgttagctatgagcccttgagccatcagcaactgaaggtccggagaagccccggagcagcttggcttcagctgtacattcacgtcccctagttcacattttgctggtggccagtgagacagggcctgcaggcaatgctcagagggtcaggatgctggaaattgccttagcactgtgggctttaggtgacaactcaagaactgggaaagctacccaccctactgggctgtcagtgacttcataagacaatgcatctacatagctcttgacatactcagtaaaagatgctggagtttttaacttctcaagctgttcccctttgcaatcacaaaaccaactgaaaattgatgttaatggtcattatcttggtgacagacatttcccagggtctcagaagggttgtatggcaaactccacctgggtatggtaaggggagtgtaagacggaaagtgtggatggaggccagggaaacacaagggatagtgcagcgacagggctagtcacagtgggctcagctatcaccttgaatcctgacagagtgggaggagtgagcacttaccaggtcccgagtgtgctgaggccttgggtggaaggatgcagccagacctaggagacccctcagagcacaagcccttctacctctcatcttctccatggcccccaagggaaaaagccaaccagaagcagagggctagcaagacttcaatgcagtccagagcctggaggaggctccagaggatctggaaggataagcagaagatgcccagcatacttctctttcttttttcctaccatcaagagatgtttgctcttatgcaaagtcaagcaacaattccaagccctggttttatttttagcaaattccaatttttcctctcatcttccttctcgctctctgtgtgggtgttcctgtgcaggtgaccaaacagaggtggcgattcaactgcattttgcaaagtgctttcaagtgaacaaagacattaaaccacacttcagcttgtaacaagaatttctatttcttgaatcatcacaaagtaatacttgctaacattatggagtgctcactatggaacaggcaatttacatgcattaacaatttctaatgttggcaaaacccctatgaggtaggaactattgctatcattttagaattggacaaagtggggcatggagagattgagcatgttcctcaggtcctcacagctaccaaggggcaggactgagcttcaaagcctgcaacctggatccaaaatctgctcatctaaccactacctttatactgcctcaaaattacagtgaaaaggcctagaagatcttgatatttaaagacatcctgcaactaatcttcttcatagaataaaaatatctatttttatgaaacaatcacctattttgtaatttgtaaatatgacatttgcacgtagcatttccttatgtgtccatgtgtcagtttccaaacattgtctttatagaaatgaaatagaatatgatcaacttaggtaagttcccactgcctaccaaagacttcagcttgcaaaatatgaatatctacttagtgagactgacctagaacacagttcatcccaattttctaaagaaaatggtgtcagccctcagttacactatagcaatttcttcccatggtctttttagcaacgaaccctcaagccatcagcaaccgaaggtccccaagaagtcctagggcagcctggcttcaggctacaagttcaggtccctgattacacatttatttttctgggttcctattcactaaacatgagaaatggggtgggagatggcattttccattatggcctcagcacagtctccccacccacaaattcttctgcagtgtgctttgccacttgcctgtccatgggcactctctccaaccccatgaatctgagccctaggactgctttgaccagtagaatacagtggaagtggtcctatgcctgtccttggcacagcctttaaagggcctagaaacgtccacttccagtatcgaagcccatgccttcccataaggacagagaggccatgtggcaggataccaggtgactgctactgcatgaggcccaaggagaaccactcagctgagcccagtccacccaaggaattgtgaaacataataacaaattgcaggtttaagtcactaaattatgggaaaattttctgtataccaatagatctccagaacaaatgagtttacctatttaatgcattttattttgggaagagggaaaaagataagagaactacattgtttgctcacattcccaggtagaacagtttcacctgggagccacgagtctctagatttcaggagaacctggctccagagaccaggcagggctttagggatagctggttcttaggtcatggtgattttatttgtaggactttgtacttacaagaaatccaaagagctaggcagaagagctgccttttctattctgaacccatggtagcactgtatccagatggttctggttatgaccacaagtcactccttccagttttgaaagcacaaccagctgtcagctccatcaaggtctgaggaactgccacccaactgtggccgtgtgctctagggatggtggccaagcctctggtgaaagggctacccacctgcacctgccagctttgcctctcaccatttccgccctgcatggctgaagcagaagtccccacagcctcctccccagctgccaggcttctcggcacctttcctagaggtcaggatcctacttggccagccctcgtgggcagcctgcccctgtgggaagccaagagcgtgacctgccctgcctggacacccaccagctgcacagctcctcccagtagcttccgggtatgggactgtggcctttatgtcatgctgagctacagagctgaaattactactaatatatttcaattaaaataaaataaaacatgtaatcttcatattccaggaatatttcagacattgacctataggcctctgccagccaacagtattaagacatctactaaactggggccagaattttttttccttcacattataaactagtaacatgctttcaaataccggactcctcctagtatttaaacccttataaaatccatgggtatatgaaagtaaatatgaacttagcttcctattgttcattcattctacgtgaagctcctcaagaagagggtgggggtaggaagtgtggaataaaaatcctttttggcaacctgagctattaccacattttctctccagtcttagaagactcagatcctcccttctttcatcttcccttgtatcattggacctgtagccctaggcatagttccctgaaacccaagtaccatcagatccgaaaggtgtcacgtggaaatagcctcaatacctggtgttcgacaaggctcagcagccagcacaggctctgaagagcaggcaaaggcaaggcagaggctgggaagccccagggaggtgtgcgggccgcgttaggatggacatttgtgcataactcttgccgctctgactctctgcctcctctggccatgttagatgcgaccatttccacagatacgttccacaagcaaagccagcaactgtttgctgtgttgagttataccatggagggacagatcatgtgttaaaaagaaaaaaaaatgtgcttacacatggttgcttgtgatgacagctgagttcagagatttccatcttgtatgatattcacatttttatatgtagtcttttgagattgcacagaatttgatggataattacagcataaatacatttatccaaattaaacatccaaaaagaaactacatgcaaatttataaactcttccagtctcaaccaacacactgaccaaataaataataaaatgttctttttttttattttaaagttatttgccaaaatgtatccccaaaccaggtgcttctctttcaggtttacataaaaggacaaaaggaagaaaacagaatagaagttaattattctggttcacaagcccttatgtaaggagaaatgattaattaattgcatttgcccacatcttgagaaatgcaaatagtctttggtattctgaccactcaactcagacctcagctgcactcaggatgcatctatagtgggcagtagaagcgaggagagatccttctccagagctcagaggctaatcaaggaatcttgacttgcacaatggaatcacctggaaaaggagctttccaggaaaccccaactcctatgctaaggagctacaaaatcggagggagagaggcgagaatgtgccgccagtcagcagggaagcctccttagaagtgagttataagcagcttcattacctgactgctctagctccaagtaccctcttcacatcttgaggcttttccattcccagaaaggtcagcctcctcttccttatcctgactgcaaagtgttttcaacactggaaaaggtcatcttgcaatgaagatgaataatgtgggttttgtccctaaaaaactccaggaagcatcttgcgtgggagtccttgtgagacctcgagcacatcagatatcaaggtctctgcatcaagcactctgaccagaaacagcccccagaacaaggtcctagagaggtgaccagctccaaacttctctatgatcctgaaaaggaagactgtaaatagttctatcttttctttggcactcttgagaccatttctggtcttcaggccacctacattcgtagggaactatatctgcagacaccatatcctggctttgtgtggtttgacagatgtggctgtgtaccctgagctggagggtcctctcagagccctgggcaagtaccaacagtgtatctgtgccagatgggcatgtacctttgaagcttccttcagccccagcaagtgaggaagctccctcagggcatgcagacacacaggactctttctgtcattcactgtcccacaccccactcttcctctctcctgctgtcactgcaattctgccctgaggttcctaggaaagcctcagggtttgattgaattgaacctgcaacattggttcaggtccttgaggcacgctggcaaaaaatggtatccatgccaggacaagggacacccaactggaaaacagataccgagagaggaaaaaccatctctagcctctacacactgtcttcccagggcagagcctagggtctgtcccagagaaagtttctagtaaatatcctgcttcatagaccaaatactaccatttaccctagtatctttgctggagcaagacacactaaaagcaaacaagtgatccaagttataatgggaccccatcataagcccctctctaagaagataatagatgaccatctctctatgaagtttagaaaaagacctacctgtggacaaagagataaattggaaaacctcagttgtgtcttccaggttctagaaatctatggaatgtttttatcaacctgaaggcagtcaatattcaatgaataaggcacaataattcaccaaatccatatccctttctttgactcaaatctatcctatctgccacatcagtttaggacaacagaaagtgtttgtcagaataaagatcttaaatatcccccccatcctcttatcaactacatattactttacaggtgaacaaaaaaccttggggaaaaacagtaatcaatgaacttttttttttttttgagacagagtctcgctctatcgcccaggctggagtacaatggtgtgatctcggctcactgcaacctccgcttcctgggttcaagcatttctcctgcctcagcctcccaagtagctgggattacaggtgcctgccaccatgcccagttaatttttttctttttttttttttttttttgtatttttagtagagacggggttttgccatgttggccagcctggtctcgaactcctgacctcaggtggtccacccacctcggcctcccaaagtgctgggattacaggcatgagccactgtgcccgacctgcatgtgtatttaataagaaggcatttctctagacatggggaaatgtaaatataattctttcaaagagaaatggtcatttgtctctccgatgattggggacgagtgttatcacagatcttttcacagagggcaactgtatcttccttttattttccacagataaaggttgccatgatagccaagccctttctccaccaggcttctcctttgacacttttttcatgtaaaccaaagagaagagtgaggggaaaaatctcagctgttctcctttatgctccctgccaatacaataaacatgtccttggtaggtattaatggtccttaccaccaaaagactgtcatcttctaatagcctgcaactgctcccaatttcatgcagtgttcactttgtcaagcacctaattccaaagcctccaacccccatgcttacaaatagaggttattcttttgttttctccaaagaatgaagcatcctttgaccaaagccatcaatcctagtgttagatttaggttgacaattgaaagatgttgaacacgccaattcgtctgagcccatgatactgtggtgtccaagataccatcactaattttggatcattggaaatattccaccacaggatacatttgaacttgttaaaaatagcccagctacccctctgaacatttcaacttactgtggcatcaacagagacatgctcctagttacaacattggcttgctcctctggaatgcaggaaaggagtcaaatttcatgatacggaattttcgagtttgtccataagatttttaaaatagacctttcactttagtgtaaaaggttacatacatagtaaaagattgtaaatatagaatttaatgtcttttctccaagtatgaacagaccatattgtatattttaggtataaaatattcatctaaaatattcagtatgaaacaattgatactattttcagaatactccctgtgcctccactctacttaaatatagagcatttaattaagtgaatccaattaatcatgtgaaagttaatgtgggaaaaggaaacagctaataaactcccaatggctcagagaagcaaagcatttcaaacatgcagactttacaagtttcctatgtgcctctaattatgtctttatacaaattcctttagctttctaccaattctgagaagtctaaggccaaattcttttctataaatatatctacaaaaactttttcttcccacacataggaaagacacaaaagatcgagtgagctggaacccgtggcccccttcctcatgggtttttaaaacatctgacataaactgcaacatatttgggccactgcaattatcaagcaaaaccgcaaaccagcagaagtcaaagtcaaccccaaaagctgtgttgaaaaagatacaccagcactcacctgaagaggaacaaagataaaagcgagtgaccctataaactttcaagaaagcagctttccctaacctgcttttgattagtgttcataggtttagccctgaaggcttaattaaacccagtagccaactctgtctcacttaaaagtgcaattaaagaatccacaaaggccactgggccctgagggcctcccacatgaggccccactatgagcaattcactaattgcgccctttgtcccccgactcttaatgatgacgctgccacacccccagtcaagatgcttattctccccacttagggccagctccaaaaacctcaaggcaggaagtgtgggcccaaaagcctgttctgcagagaacatacacttttaattaaacaacaacaaattaaaagctcattgaaaaacacttagcaacaaatccaaaactgcactaaagtccatgtgttaccaccactaattaaaaggactcttgattacagatcattgggtgtgatcttgtagccaggacttattaagggccatgatggagcccactctgaggggcaagccagccagtgttgcatccccatggaacatcatggtaccagaaagcggtcccgatccagaccccaagagagagttcttgcacctcgtgcaagaaagaattcaaggcgagtccataaagtgaaagcaagtttattaaaagcaaagaaataaaagaatggctactccacaggcacagcagtggcagtggcacgggcagcatggggcgggggttgtttagaattttatttggggtttacattgggcaagtcagtcttctcctctagccatagtccaagttcaaaacattgatttccttcagcctacctcaatagacaattcctcaatagatactctctttaaaaatgcctttcaggatttcaatggacagggcacataaccacagtgaagcctgactcttgtcctgacttgtgtaagacttcaggacctaaagtccaagcacctacattgactccttgaagttgtagagagcgacctgactgcaaagtcgggtcagggctgaatgaggtgtgagccccgggaaagcccttctgctcttcccacctcccagcttcatcctgaagatcctcgctgtgaatccttaagggctttcctatgcagcaagacaaacctcagggagctggaaactccgcaggtgggcctggaaaaactgttcaaagttaagtaacattcgcaggcgtaagctttcaagtgaatgaatctttgcgattcttacttgccagcttgcagtttcctgaatgatttcttttcgcaagctggtgatagaacctaggaattccatcactgctggcagacggaaagtaaatttggctccaggcctgactttcggagtcagcgtggaaagctgcaacagccaagatgggctgcctggacacgctgagatgctctctctatatggggcccctccttcccaactctcacctccactctcccaacccacccacgaccgctacacaattgacattcagtgtgacattcttaggtgaagaaagctttagaaaaaaatactagtttaaagtatgtgttgtttaaaaaaaaaatgcagggaggagtggatcggcagagtgggaatactttcaactcaaccacctgggttgggttcaggtcttcccacttgctcagcaccacctttgaggagtaaggaggcgaaggaagtgagagtgattcaaagatggaaaagaggggggcctttaagaagcatagcctggaaactccagatttttcccaccaggaaccaggaatgaagaagggagggaatctctactgccctgcggcaagccaggagagagttaccccacgggcagatgctggatcttcccaagctcaagagcaccgtccagtgtgatgcagacgtcgggatgtaactgaatagccatacgtgcctgtcatactcagaactgacttagatgtggtcctgtctataggcgccaacatgaaaccacccaggaacaagactaggagaaaaaggacacgtgctcctgctcctgtcatagcagcagcagcttgaatcccacagcaaagtggccagatgcttacagacacctgataatatcagacacagagcacaaaacttggtgcacccacttttacatgggtttgggggaggacggtttggctcaaaactttctggtgaacaaagagcataataattaaaattattttggtttagcagagaaattaaccagaggacgacaatcataaggagggggaaaaggaaaattcctctgatagatgggggaaaagtcactaaagggtatctgaagagcagccctatgcaaaaagacaggaggccaggcacagtggctgatgcctataatcccagcatttcgggaggccaaggtgggtggatcacttcagctcaggagttcgagaccagcctgaccaacatggtgaaaccctgtctctactaaaaatacaaaaattagctgggcatgatggtgcatgcttgtattcccagctacttgggaggctgaggcaggagaatcacttgaacccgggaggcagaggttacagtgagccgagatcgcaccactgcactccagcctggagaacagaacaagactccgtctcaaaaaagaaaaaaaaaaaaagacaggaaactgcagtctaggatttccctttccagtttagatcacccagacaccctgtcctgggcaaaggctcaataatatctggacaatggacccctgctctgtaaaacaccatttttcttttctatttacagcctggaaatattaaacttaaataaaatgtctatctttaactcctaggctcaagcttcaatgaagtttctcttcactgacactggcaaagatattctgattttaaacttcagaacagtgacaggaggacaggaggtgccgcagacacaaggcattggacatgggcaccctgccaggctgtgaagtgaacattcgaggcccttccctagcttctaacctgtcagaataaggttaaaatcccatacatcttagagtgtccaaaatcaatattagaggctaacatttggatgcttttcaaaaaagaaaatggttagaaaaagtagaaatcattaaaaaaaatggtctaatacattttatccacttaggacaatgccttcacataattctatacataacactatgagctgctttaattatgatcaactgaagctaccggaaccaatacaaatctatgattaaaggagattttaaaataagggaaaattaccttgctttcttaatccttctgtttcaaaactaaatacctgccctggtaacacagacatttttccaatcttgtaaccagccagtctgtttaactgaatggctaattagttatccttgaaatctagagaacattagcttgttgaaaatgaaagaaaaccaaaccacaaaaagtacctacctaaacagtattttattgactaactgaaaccatcaaaagtggtatgaaagataaaaatgtcacccaccccactgccatctaatcagcagaaggaaatattagtgtatcctcataaataactccttaccactcatgaagggtgataatttaggattggtaatagaaaaacatggtcgttctgtaaatgttactcttaatttgcttgtaagctaggcttcatgtttggaaagaggcaagttcaaagtgagctggtcagaaatgaccctggcaaaaggtcaataaagctattgcactaggacttaaaacgctgttgatctccatttttgtgaacaagtaactagaaatactgaagaaattaggcactatgaaaatgcttgcctgaagcatcacagggctggataaaaaaatactctattaccagtggagaaatgcatatgagtgctaaaggccagctagcctggaccacatccccaaagccatgctgagtgtatctggaccatggaccacctgtgccaaagtaaacactcccatggaaagccactatgtggaaaccaactggtgtgaggaaagcaaggtgcccacaagagagctgaggaagcctgtggcaggaggcagagaggattttaatacactaaacagatggaaggtgcagtaaacaaggtgggagagctaaagacactcacttctacccagagaaaacagtggaagagcaaggaaatgagaggcaattcgtatgtatctctacccaaaacctatattcagcattacattttaactgcaaaatgtgccaaagcagaatggaaagagctagaagcaattctttgattcttctctaagagcggggcggggggaggtgcgcggggtgggaaacactcccctttaaatactcaggctctgggcatttaaaactctgcattctgccactgggtctggctgttagaagttacctgccactccagctgaagcgaaggccttgctaagaaagtgtacaaggacacagaagcaggcatcatgaacttctcccccatcaaaggacagcaacctcatttgttgagcagaatgatgctaggagttccagactctgcagctctaatgagaccacaagattctgtgttgtcaaagatgttccccctgagctatgcccataaaacaataaaattggcagagaagcatactctaagcaatgactgggaattggggtgtacccaacattcagcggcgaggctggctgatgagtttaactgatttaatctggttatgttgtcgcatccggaaacaacctaagtttgcttgttttcataacagagatcacagctcagatagacttcccaggaagaaagtgtttcagtatcaaagaaatgtgctcatcctagcacccactggccctggcgctaagctttgtacaagtaatgtaaacacagaaaacatttcccagtagacgcagcaggactcgtatttaggccactggctgtttaatttactctaattttagagatgatgtccagaattttctttttaaaaaagttttattgaggtatatgttacatgccataaaatgtactctttgtaagtgtacaatttaatgatttttagtacatgtacagagttgtatgacaatctccacaattcagtttcttaccatttccatcacccccaaaaggcctaggctgcccatctgcagtcatgtccagttcccactgctagcccgaggcaaccactcacctgcctgccatctttatgggtttgccttttctgggcatctctataaatggaaatacatggtgtgtggtcttcagtgactggcttccttcacttggcacaaggttttgaggttcatacatattgcagcatatatcaagagttcatttgttttattgctgaatagtagcccattgtagggataggccacattttgtttacctattcttctgtttcaacttattaaatctataaatccaactacatgactaggcttattagtctgatcttggaaatataagaaaaagcctgccatatttttaaaatattctaggatgtctaaaatctctgtaatgtgtaaacatatgtaataaagacacaatatgttccctggaatttgtgtgcttggaggagagggtgctgttttaaatgagaacatccctgaatttcaatttttctgtgttttaatacagattaagtatcccttacccaaaatgcttgggaccagaagtatttcagatttgggattttctcagattttggaatatttgtattatatatattagcatttttagggtcatgtcggtgctcagaaagtttcagattttgaagcattgtggaattgggattttttgattaggaatattcaatctgtacacagaaattatatttatgctaatctccaagtcatgcaaggtcgtcaattcatttaacaagcactgacttactgtgcaaattgttgtgtattaggaactaggaaatatgcagtccctctcccaaccctccacctgccagtttacaaagacatttgtattttaagactgtgctaaaaaatcagtttggaggcatttggaacatttttctctaaataaagaatataagtagttttagagtccatggttagcccccaaaagtcttgcttaagccttagtcctttctctcagtatactctattgcagtctatactatatacatagtctctaagggcattttttgattcggtcacttacccaagatggcccgagagcctcctgcgtgccaggcactgttctaggcagcgtgggcaacacagctgcgaacaaaacagtctcattggtctcctaagctgacattctgtatcagtgaaagactttaagaaataaaggcagtgcgtggagttctgcaaaatgatatggagagaaggccgggcgcggtggctcacgcctgtaatcccagcactttgggaggccgaggcgggtggatcacgaggtcaggagatcgagaccatccaggctaacatggtgaaaccccgtctctactaaaaattcaaaaaaaaaaaaaaattagctgggcatgtggcggacacctgtagtcccagctgctcaggaggatgaggcataagaattgcttaaacctaggaggcagaggttgcagtgagccaagatcgcgccactgcaccccagccagggtgacagagcaagactctgtctcaaaaataagaaaaaaagaaaagaaaatcagtagttttacaacaaacctaaatctcagtcctgtaaaaggagtcacggaagccagttgtgattctaaaatccatttgtttacaggatgcccaaccataaatgtccctggcctccgaagcgttctctttccacagcaggtttgggggcactggcaggagtcagctgccttggtagctggctcagaacagctttgggggccctctgcaagacgtgtcacatctccggttttgttttgttttgtttttacagaaagaaaagctctttgtgtggaattttatttgaagtcactttgtgaggaatgccatctctgctgtgattcaggagaatagaagtttcggttttatgattttgcagacagatcacaggaaactgcttagcaaattttttcttagttgctttccttgactctgtttttctttccatgagtacatcatacatccttgccaaacattgggtggatttgaactgattgaaagaggctcgattttctgtgaacgatttgtccttgtgttatcctgattgtcactcgcctataacttacttaatttcacgtctcaacaaatatagtattatttcacccacagagttggcttctgatagaatcactctactggttatttatcatacatatctgtaattgaattacctattgcagtagtgtaatttactctcaattgtacataaaaatgtaacataaaataacatttttccagtgtatacttcctcattattctacatgaaccctagtttagccaattctacagaaatacagtgacaaataatgagtgaaagatgggaagataaaagattagtgggctcatgacctttcaataataaaagaatttcatcctctaaaaaaattattctcttttaaaatagttttttttccccaagtgttaatcaggaaaccaattctaggaaaccaataaggaaaaaaagagtttaaaaacagaatgattttcttttttccaaatgcagcaatactatgtcactacattttaaaatgtaggaaagggaaataaagtgtgcttgtctttgctcttgtcaaacaaccattaatcttggaccaaaaaagaagaaagaagatgacaacagcaattcctttgggaaatttttctgttttcttgatccactgttgtgtcactcctactttaaatttcatgcacaaggtgaaatatgacttgtctttgaagttgcctggcttcaaaatactctgtgaaatggacagcctggtttccttagctatacaaccttttagatggcaaagactgtcaatactagtatgttgaaataaattacctattatccaataccttctcttgggtcaagttttcatttgttttgttctattttgcttcaattttgaatcgaagcaagttttgagcaggttcatttatattgaaaagtttatgtatattctagcttactttaattttgctttttcttcttttctccctatcagaaattgattttgtatatctggataaccaattcttaaaaaattcatctgaaaaatatgctatatatttaccaagcgtacccatatctgtttctccaaagtgcttcccagcagccacatctcacctgctgaatttatccccaagttgctcccaatctatacaggaattggaaacaggagattgccccctatcatttctgcagggtagcagagtgataaaaacctaattttcaaccaaacttctgcatctcaattttaaaaggttgctgagaacatatgtgaaattatctatgttgtcaactgtactcaagacaactgaaagtacttatagacgctcattttatgattcaagaaaacagttaactttcttggtataaatttgcaagtagatgcaggtgagcagaaatgtacaatgcttcactttagacactttgtacttagttgtaactcaatttgttagacaccataatttacattttaaacattatttaacacataaaaacttgtcaccttggtataattataccccaagcaatttgtctgggtaactatagcaacaattgcagaaacatttttaaatacaaaattggtataattttagaatcaagaattatggaggatttattgcaggatgtacggctgctgtactcaaatagttgtacatatactactataaaaatggattccttgactgggatatgttataaactcatttgttctatcttgcacaccatctgctttgtagctcaaacctcttccttgggatgagtttttgatattagttaactctagggttcatgatcacttgtctacataatgcaatgcctttatactcttggctggacatttagtaaaggttttctgctcctcctccacatcttcctgtatcaaaagcaaaggctcaatttcaatgactttatgaccaaaaataaaatcacttgaaactcttaaaactaatcaccaagttaagtaaaactgtgtcacgattcagataggcagctctctctaacatcaggagcatctgacattgtccccaaagagctggcatctgttattttgggccactagcacacggtacagagaaaggcttgttggttgtaacatttgtccttcagcaagaggctaacatgactctggaactaaatttcttactgcaaatccatggacggggcttcagaaggcccatgactctaaaatttatgcagaagtttgtataaatgtgcttgtatttatttcggtctcgtggtcaataagttttaacagcctctgagctgtaagtttctacgtttcattctcccaagacacgtgatgaaatcattttaaagggaaacggcagtgaagaacgcaggtttatttttaccaaattctgaacgtctcaaaaatttcctctggacagagacaagctttaccacccaggaggccaaagctttactcgcagcagggatctcgcagctgtttgacattataacaaccaaatgagttagtgcaattcacaaaagacataaaatgattagcatcatctgtcttctccctgttaataaaagtacatattggctaaaagcacatagaaatagatgtcagtttgtcaaccccacacttcaatgagtatacagatgcttagtgtgactgcatggagcaacgtggatgagcaagcttctatctccaaagtttttacaagaaagaaactcaagggaaaaaacatctgtgtttcaagtgaaccaaacaattacacttagggctgtatttttcatgaaaaaaaaaaaaaaacatagaaaaagaaatcttttggaggggaaaaaaaaatccatgtttcttttggtgtaaatacaggcacagacaagaaaattatttcagttatacataacttaatggtattatctgcttgaactgaagttgtgtaaagtggtcatgataaacattacactctctaaaataatgaaactggcattaattagcaacaaattcagcaatcctaattaggtattgaaaaatctttcttattaaagcctggttttgtgtttctgtctccttatgaacagactacctctataattaataacatatctgctgattccaaactcagccattatgacagagctcttctcggtaagctagacgtaaaacttgtctttcttcaaaacaaaccagaacaatcatttgtgactcctgatgtgttaactaaagtacccctaaaaagcagaacggtattaaacaaagctcacgttatcttccctcaatttcgatttctttctgagtaaatgtaacagtcacaaggaaggcagatgcccagacaaggaagactttacagcgatctttttctctggaagagacctttctagttagagcatttatgtctggccaccacctttcctgtcccctctcctagcaaggctgacagctctctatagccaccagatcagctcccccaacccccggcccccaaaatgaaattattgcaagatctgcctggttctgctgtttgttgcctgggactcccgcccactcgcccaggacccagcaactgcctgtggcgcctcgtcctccgagcgctcgctcgcagcgccccctgccgggaatcccgaggacgccgcaggcgcaggaaagttaaatcccaactccggccgcggcatcctggtacaaagcaagcaaagggcgaggaggtgaacgcgcttcccgccaaagccaggggaacagggatgtgaccgctccaagccaggcaccggccgccgcggggagcgagccgggggaatcactcctccacgaccgttcccacgcacatcttgggagaaaccattccctctggagcccgatctgcccgaaaccctggggtctgaaaccctgagccgcggtgtgcaaaatccgtggagcagcggagggatgcctggtgaaaggggctcgcctagctgcagcgcacctggctggtggttccccaggcctctgcatcccccgccttagtgtctttcattaaccaaggcgcttggcggagttgagcccaagtcccattgcctcccggttcccctgtaaggaaagcaggaaaacctgcccaagccggtggggctgcgaggtggccgctcccgaaccgccaagtcccgacctccgtgtcccctgcccccggctcgcggcagtgcgagcctggaggcgcgccgggggcgggcacagaccagtgtgcgcacctttccgggtgttgggcaggggtcccgtctcgcccaccgcgacactccggctccttacctctccatgctcagacctcggcacaggcgggtacacaaacttccagcccgtgcactagctcaactgtgggcgcccccggactgacggtcgtcctaatcctgtacgcgcaacccccgcccaggtgcctgctgatggatcccacccgagatcggcaccacccaccagccgaccgctgcagtccccgggtcccggccagcggcgcggcgcggcgcggcgcggtcaggggctcctgccaaggccacgcaggaatcgggcgggggtcgctcaccaggtgcgaggagcgctggtgccagtcatccagcgcctgggggccagagcggctccgaggatcctcttcagcacctggctagggaagtggaggcagcagctgcagccgccccctgccacttccccagagccgccccctactcgctgagttccagaatgggggcaccggcttgggggccacgagcacggtccccgagcgcgcggccaaccggtgggtgggcaggttcgcgcccagcagagacgaccctcgaggtggcaaagttgggtgtccaagccagctccgcggggcagtcctgggtgggagaagggagcgtcccgggatgagcgacactggccgggccgcccctgcacggggaaggtggagggccggggctgcagcgggccaagggccgcggctggcctgaggctgcgaagcccacccgcggcgggaaagcagcgctcgggagcgggctcagggagagcagccgccaccggcgccgccttcccggcaagtagatcggcgcggggcgagcgggcgcggagagcgcggggcggagagc

SEQ ID NO: 790 - DNA, 86751 bp, Homo sapiens; identical to SEQ ID NO: 786

SEQ ID NO: 791 - DNA, 30463 bp, Homo sapiens
gtctctttcctttttttaatggggctataagaaaatttaaaattacatacatggggaaaaaagctaaagttgccattttttccctttaccttcatttatctgtttgtctaatagtcactgaagaacatatctttttaaagaagtacgtgtgtgacttacattatacttctatctgcagtgctggttcagaacaccatgacatttgaccaaaggactcagcagagggaaggctgcccaggccccaagctcaccatgaaggatacagccacacccttggttcattctcgcacgaatttcagacctcccacctatgttgaagactctggctactggccacatgctcaccgacaccgttccacggcaaaagcccagcacatctcaggggtttcctgggaggccggatgaatgtgtgaggcctcctgggagcagccctcagcaggcaagggctttggcctgttggggtccacaactaagtgtccacagtagaccagccctgctcaggcttggattctctcaacattaggcaaagggtctccccatacccatttgacagatgcaaaaactgaggctcaggaagctcaagtttgggaattctttgaattttatgtttcctgagcatctatttgaatgtaagttggactttctcatactagaagcagggattagtaacacagtttccagttatacaacttctcactgttccccaaggtggtcgatccagacatctgccttacaaaaccgcctcctgggaccaccttcccatggacagctggataccacctgcttgacttgtcccactgacccccacacccacatggaccatgccgatatcctacccacaccgacccctctcagtcacagcgtgagtccccggggctcatgcctgcttgctctaaaccccccagttagaacctccaggggaaacctgcatagatgacaccctgggccccagtgaaggctttggctcatagctccctctctctctcgttctccaccttctggttgagcccatgtgtcctgaatggctccccctttttgctggccctgtgaagcgtgctgccctctgttctctggatctgtaagcaataaactgcttctgtcatttcttgggttctgatgagttgcctcctctaccccatcctaacttctttcccggtcagggctctccgggagagtggctgtctcagtaggaataaactggacacaggtcagatgagagccacaaggtcatgtgccaggataaacaagcttcctgcgagagggacacctggccacaggttggacactcaggaatcaggccgtctgtgaggtcaaagaaggatcccatgaaaggcacatgggaaacacccacgaccacatccccaggatccccgtcagggcagggctagagtttacagccactctctcctgagaaggacgtcaagacaaaattaggaaaaaaactacaacatcaagtcacttgcccaaagtcacatgtacgcaccccgtaggtgcaggtgcagagtttctcaccggctctcccctttacgccaccaccagaaacacaggagatatttctgaggtagcctcaggccctgggacccaaaaatgccagtgcttggaaatccactgcttaggagacaacagctgggtgacaactctagcccaccgttctctgctatctttttaaaaaagctgcaaattcaaaaattcaaaaaattagtttattagcttaatataattaggtcaatggaatcctgttttgatctcaatacttcccatattgcaatatataaatgtgacaaattcagctgttttgtggcatagataagtgtctaagctgggcagttagtctacccgtttatagttcatgttcttcatggctttgcagcatttgtcactttctatgatgtgttcaaagaccagaaaaggccacacttgacctgtcagctggtccttgaacagctgtaggtttttttttttttttgagacagagtctccctctgttgtccaggctggagtgcagtagcgcaacctcgactcactgcaacctctgcctccaggttcaagtgattctcctcctcagactcctgagtagctgggattacaggcacatgccaccatgcccggctgatttttatatttttagtagagatggggtttcaccatgttggccaggctggtcttgaactcctgacctcaagtgatccacccacctcggcctcccaaagtgctgggattacaggcgtgagccaccgcacccggcctgtaggttttaactaataattagggtattactctatcattctctatcattcaaattctccaggtactgacctggtttttattttatttatttatttatttacttatttatttttgagacagggtctcactctgctgcccaggctagagtacagtagtggcacaatcttggctcactgcagtctccacctcctgggttctattgattcttgtgcctcagcctcccaagtagctgggactacaggcgtgcaccaccacaccaggctaatttttgtattttttgtagagatggggtctcaccatgttggccaggctggtctcaaactcctgacctcaggtgatccacccactttggcctcccaaagtgctggaattacaggcatgaggcactacacctggtcagaccttgtttttaaattatgattcgatgtacatgtcaaaaattaaattatttcatgcattacgtcctactgaatttgtgtttcaaatgaaataatcaattttaggattcctacacttattttataaaagtgaaaattaaatcaaatgatctaactatttccaagcaaattttgggatgaaagctattctaggaaggcttgcccttgattcttgctacatgtacttgttcagccactcaattaaattccttctggcctcgtcaatgtagggcttgtctgcaggtgagcaatcttctctcttccgatgcacgaacccatgagtctgcccagaaaatgttttaatttgatattcaactttgcagtgttctttcaacttctgagtcagcaaagatacctggtgtgcaaaagatttcatgattttaaccctttagtgatactttccattctccaaatctttagtgagcgttcataacagaaatttaacatcaatgctttaaatcagaaacaagttccacagttacactgaattctttcccactaatttttttctttttagacagggtctcactctgttgcccaggttggagttcagtggcgccatctcagctcactgcaacctctgcctcccacattcaagtgattctcctgcctcagcctccggagaagccgggatgacaggcacccgccaccatgcccagctaatttttgtatttttagtagagacagggtttcaccatgttgaccaggctagtctcaaactcctgacctcaagtgatctgcctgcctctgcctcccaatgtgttgggattacaggcgtgagccacggcgcccggcctctactgctaattttataactaacacagtccttatgtctggcaaaggagagatttcagggaaatggaaaaatgatacatctattatttgaaatcacttgcattaatatattagttactaatattataacaataatttctaaatgactgcttttttttcttaagagtcagggtctcactctgtcacccaggctggagtgcggtggcacaatcgtggctcactgcagcctccaactcctgtgctcaggcaatcttcctgcctcaggctcccaaatagctgggactacagatgtgtgccaccatcccagctaatttttttatatttttgtggagaagggatctagctagactgcctagcctggtcttaaactctcagcctcaatcaatcctcccacctcagccttctgagtttctggaattacaggcatgagccaccacgcccagctaaatgactgcttttgaaccatacttttcttctgctttttccttatcaactgactttgtttaataaatccttgtctttaaggtcacagactttattgtaatttgtgggttagcatggaggtggggcaagaggtcccgtttctccaccaggtaaccaggccatgctgagaatacttccctcagacatttccttaagcatgttttgggaaggttatacttccacactggaattatataagtggaattgaataaaacccatctttaaaatgttaatgttggaaatatttggagcaacaaatgcatccttcaagacttcccactccccgcagaatgtcaaaccgtgctattaaatatataaatgaggccaggcgtggtggctcacacccataatcccatcactttgggaggccaaggcaggcagatcacctgaagtcaggagttcaagaccagcctggtcaacatggtgaaaccccgtctctactaaaaatacaaaaattacccaggtgcggtggtgggcgcctgtagtcccagctactcgggaggctgaggcacaagaatggcttgaacctgggaggtggaggttgcagtgagccgagatcgcgccactgcattccagcctgggcgacagagcgagactccatctcaaataaataaatacgaagagaaaagatgccaacttacgtccttgagtggaatcacaacatcattttcagcaaaaatgaacaaagtggggttctttaaattgtaaatgtcttcagaatccttgacaatgcctgaaaaacaagcacagaggcatgatgtctgatccccacactcatgccacatgatccccacacccatgccgcatgatccccacactcatgccacagaaaactgcaacatttgggtttgatttttcaaagtaaaatctctgctttgcggactttattttcttttttagccattccacagaagtggccccacttgtaagattagcgtaaaagaaggccgggcgcggtggctcacgcctgtaatcccagcacttcgagaggctgaggcaggtggatggcttgggctcaggagtttgagagcagcctgggtaacatcgcaaaaccctgtctctacaaaaaatacaaacataagccgggtgtggtggtgcatgcctgtagtctcagctacttgcggggactaaggtgggcggattgcttgagcctggaaagttgaggctgcagtgagccgtttgtgccactgcactccagcttgggcaacaaagtgagaccccgtcaaaacaaaacaaacaaacaaaaaacccaaagcctgggcgcagtgactcaagcctgtaatcccagcactttgggaggtcgaggagggcggatcatgaggtcaggagtccgagactagcctggccaacatggtgaaaccctgtctctactaaaaatacaaaaattagctaggtgtggtggcacgcgcctgcaatctcagctactcgggaggctgaggcaggagaatggcttgaacccgggaggtggaggttgcagtgagccaagatcatgccattgcactccagctctgggcaacagagcaagactccgtctcagaaaaaaaaaaaaaaagaggattataagagtacaagagaaatttatttagtcagatcctcctactgtctacctccccactttatggactgggaatcaggccattaaataattgaatgatacctcgtccgctgcttagtatggaaagatgcggagcagcctgaggaatgtcccgctgggatgtaccttcgtttacaaagaggatcaatgtcaaaccttcgcttgagaagtttctcaggtctacacaagtcccacgggttctggcttgaatgcactgagtagttttgttggtaagaggagctgtcttttgagtgggtatttagactcgcaccagaccacgagtgtggaagtgtggaagtgtgaaactgcctgggcctagcaggtcagtctataaaaatcagtttttggccgggcgaggtggctcacacctgtaatcccagcactttgggaggccaaggcggggtggatcacttgaggtcaggagttcgagaccagcctggccacccacgcaaaaccttgtctctactaaaaatacaaaattagctgggtgttgtagccccagctactcaggaggctgagacaggagaattgcttggacccaggaggtggaggttcagtgagccaagatcgtgccactgcactccagcctgggtgacagaacaagatgctgtctcaaaaaataataacaatagttttcatctttcatctcagcattcattcgagattaattctgaaattagaagcatgctctgcctgacccaggttgtctgaaaacaacctgtgggtgtgtccacttctatgcgaaaataagtaagtaaaagatttgcagcaagttaaccattttaagataagaagacgtaaataacataacttttttccacttcctgctggcagcagaagagctaagtaacagagagagcctccttcacctgtaactcctcttcaggaggcagggagccacgggaaaggtgaccacgctcccttccccactctagcaaagctacttcatgtggatgggcctcttttgatatccctgggcctgagcccggccacgctctgcagctcacgcactacacaacagcggccagaaggtggcgccggggaggcatccactcccgaccgccttttgctaaatcgcgcaaaagcatggtctggacaaagcatctctcagctccattgttcccagaggcagctggccactgccttttgagtttatgtccttttgtgttgtcctaagtcaatatttaaaggcgtttttaactctaaaagtagttgaaaataccacaatgaggaaccattaacccaagaaggaatcattagtataactttatgatccacttcagatggtcccaggcctaacgatggttccactttcattttttgactttacaatggtgcacaagcgacactcattcagtagaaactgttccccaagtacccagacaaccattctgtttttcactttcagtacagaattcaataaactgcatgagacattcaagactttattataaaataggccttgcgttagatgattttgcccaactgtagcctgatgcaggtgtttcgggtcggccaggtgaggctatgatgcttggtaggtgaggtggattaaatgcattttcgacttgagatattttccatttatgatgggtttatcaagacttagccccattgtaagtagaggagcatctgcattatttttaaaggctatatttcctatgtgtcttttttgttttcgtttatctattggtctgaatgcttctatatcatgaatttagcaagcagtttctatatacagatataatgttatttcattgctgtagtaactttggtttgttttggccaaaaatgtataaattgctatttcgattttagagtgtgttttccttggctttctttccttttttttttttattttttattttaagagacaaggtctcactccctgtcatccaggttggagtgcagtggtgcattcacagctcactgcagcctcaaacttctgggctcaagtgattctcctgcctcagcctcctgagaggctgggaccacaggcatgtgccagtacacccaagtaatttttttctttttcttttgacagagtctcactctgttgcctgggttggagtgcagtggcacaatcttggttcacagcaacctccacctcccgggttcaagcgattctcctgcctcagcctcctgaatatctgggactacaggcgcccaccaccacgcccagctaatttttgtatttttagtagagacggggtttcaccatattggccaggctggtctcgaactattgacctcatgagccacccacctcggcctcccaaagtgctgggattataggcgtgagccaccacgcccagccttaaaattttttatagagacaaggtctctctatgttgcttaggctggtctcgaactcctgggctcaagccatctgcccatcttggactcccaaagtgctaggattacaggcgtgagtcatcgcatctggctgcctttgctttctttcttagtgtgtgtgcatgtttgtgtacagttagagcaatttgtatcttggaaaaatcagtctttctttctttctttctctttctttttctttttttttttttttgagacagggtcttgctctgtcacccaggctggagtgcagcggcatgatcatggctcactgcagccttgaccttcttgggctcaagcgattttcccacctcagcctccggagtagctaggactacaggtgcacgtgaccacgcccagctaatttttgtattttttgtagagacagggttttgccatgttgtccaggctggtctcgaactcctgagctcaagtgatctgcctgcctaagcctcccaaagtgttgggattacaggcattagccaccaccagaaaaatattttcatagatgttgctcataaaaatcttgtgtgatattgatcatcattacattaaaaaaacaaaaaaagctatccccttcatcctaggtgaagaaatggagaatttagattaggtggctttcccaaagtcacaccactgggacccagacctcttgactcccggtgacatcctctggttaactgcatgacaaacctccacctctattttcagattcttaaaacccatttccataagatgggcagtcttcacattattgggggttgtgttacactggatggggaggcttgtgattgttgtcactcttccacccctcccttctgcatggagtaaaaatgcacaaggcagatttaccatagacggacacccctgccctgaattctgagtatttcatcatcaaatgatggacagcagttccaccccagcagaatcccacgatgccaattttctgggcatgacactgttgtttcagatacttcaagatagcactgatctctctagaacagaaagaaaaaatattcaagaatcaggcttattttgtgaacccctcaaagagctgtgctgatgataacagggctgtatcagcaactgtttttgaagttgccaaggtttcttcttttgggagctccacccttactacctctggcccaactgatgcatcatcccagcacatcttcctgccaagcccagccctcctccaactgcctgacagctgcaggcaagctgggctcttcccaaaacataggtccaactgcctcactcccagctgagagctgagcagtcttccacagcctggggatgaaggccacagcccacagcacggttcgtaagacccgagtccatgatctgctccctgcagagtgccccagtcttctctgtcccctgagtctcccaggagaagagtctcctctctcctctctcccatgagcagccataactatgggcagacgcccagacactctctgacttcacacgttcactctctccccaaaactccccactctgcattgctcgtctcctccccctgccgcccagtgaagccaaatttggaacgccatcaggactatttcagccatgaggggaccaagaatagtggcccttgtctggcaaatgattcatgtgcaaactgattgtttggaactcagaatacattttcaactagaagcaatgtaccaaagtggaggtgggctgcacacgtatgtttattgtagcacgattgcaaagatatgcaaccgaagcgcccattgaccaatgagtggataaagaaaatgtggcctatatacaccatagactatactcagccataagaaagaacaaaataatatcttttgcagcaacttggatggagctggaggtcatttctctaagggaagtaactcaggaatggaaaaccaaatactgtatgttctcacttataagtggaagctaagctatgagtagattcacagaggcacatagagtgatataatggactatggagactcagaagggggagggtgggagggtgtgagggccaaaaaactatatattaggtaaactgtacactactcggtgacagatgcactaaaatctctattttcatagatggtgctcataaaaatattgtttgatattgatcatcatcacataaagaatgctatccccgctgggtgcagtggctcacgcctatagtgagaccccatctctattttattttaaaatttttaattaattaatttcttttttttttgagatggagtctcgctctgtcccccaggctggagtgcagtggtgccatcttggctcactgcaatctccgtctcccaggttcaagcaattctcatgcctcagcctcccaagtagctgggactacaggcgtgcgtcatgacacccagctaagtttttggtttgtttgtttgttttttgtatttttagtagaggcaggtttcaccatgttggccaggctggtctcaaactcctgatctcaagtgatcagccagcctcagcctgccaaagtgctgggattacgggtgtgagccaccatgcccggcctaaaaattttaattacaaaaaaaatcccagcacttgagaccagcctggccaacatggtgaaaccccgtctctactaaaaatacaaaaattagccgggctggtggcaggcgcctgtaatcccagctactcgggaggctgaggcaggagaattgcttgaacctgggaagcacaggttgcagtgagccgagatcatgccactgctctccagcctgggctccaacagagcaaaaacaaaaaaaaattttttctcctttgtgccaggggaaggattccattggccatggagaagtcctaccccaaggtaaggagtagtgtctgaaaggtgaagcccacccagctctcacctccctgggccacaacgtgcacatggccacgtctgcggataactcacctatcgatcttctgggcatttcttgttttcagccactcagggaagatagaccagtcgccagaggggtcccaaggctcttgccctacaaagaagtctggaacaatggttctgcaaaatatggacatgaattgatcttagtttcagagttgcttgactcagtattttgcttgcatttatttaaaaacttgctacgttggcgattctggctcagagaaaaggaaaagtagtgggtgtgaaggccaattttgatcgcagcaaagcagccacctggcaccgggccaagccctcttaggtttcacaaccgcaggtgcacagcgtctggcagcctgctggtaacccagccctggcaatgaggctatccacagggcacactcccatgggataggctggcatgggatgtggaggcacctgggggagtgggcctgacgtgggtggctttgagggcccctcctgcccctctcagccagcctggggagactcctggcctttcacatgagcctcaggccagagggcacacctggctaacttgtccagtcactatgaccaggcaatgttcccagcctccaccaagacggcgacgaagcacagtttcctatccagagggtatgttctaagacgggcagcagagcacaaacaagcctggccccagtccaggtcgctcttccatgcaagtcaacccagagggatagagccagccgctggggttgagtcctgtttcccaaaatagaattgccacctggttggaggaacagggctcctcctataggggtagaagaacactgaaactggagtgagaaaatccaagttcgaggctcggtacaccccatgctgctgtgtggccttggccttcacaagtcatgtcaccgcttctagcctcattttctcatctgacaaacttgcactgcctaaccccagaggatcctctcgagggcaaaaaaagttgtatacctgtgaaagggctttgtaaaacaggggtctttccttatcttttatgtcctgacccctgctaaaggaccctccgtgaaacaacagaaacagcaatgccatttgatcggctgcttgggccagtgatctggggcagccgcaaagcgctctctttatggcctggtttcctaatctgcaaaatgagagcaataacagctcctccctcaaggggctgccaggaggactaagggcaatgagcccagtcatgccctcagcactgcgtctggctgagcaactgaaactagctatttatttacttatttatttttactgggcttgcccctagaaagttaagtcccctcacatggggacgtgaaaaaggaaaacttcaaggaaggtcttttcattcagcaccgactctgcatcccaccagggtgggcatgattcctttaagccagtttctcttcctagaaaaacaaggtaggctcatcctcgggtttccagcttctccttctgtgaaaacaaaggaaatccagccgtgcaccatcctcagggctcactgggttgatgctttccgacgctggagaggaaggaaggttctggccctcctctgcgctttacaccggggcaaataagaagcaatcgggtatcagccttggccaaaggtggccatggccacttggccagacaaagaggtaaacttggggaggggagcaaggtctcactgtgccacttctgaaccccagtctaattcagagggggccacgaccgtacgtgtatggaccaggaggagccttggacaccctgccgtccaaatgggccgtgaaatctgacacgaggctgagctgttgaaggaccgagtcacgggtccatttgacagcaggtgaggctggcctcagatgtccagtgcctgcgtctggctgaggccccacacgggaaaagaattctcaatgtccagcaagtctaaaggccaggtactcccaggaggacaggaaacccaggaatggggttaggagcaccaggtgggtgtttaatttcccaagacatttcccatctatcttcacggcagtgagatagggaagtttctaatgtacagtagatactgtatagtcagaccgctgtggttttattttttaaagggaacaaaataaaccactgaaatttgtatgaatttaaacaaagaaacacaactttatacatacgtgtatccatttcctgagatcatgtcagctatatatctggtattgggcaactgccagccaaatatatcttgaatgacaatcacagctttgcctgcatcaacgggggatttggtgacataagccttgatgtgctcgacttgaacttcacggcctagccctccatactcaagtctgtggccaatgtcacacggacaaggataagcttcgttagccattgcagagatttaagtcgggctatggagagagaaacatgcgttatattctgaatgctgcaaatctaaaggctataaatggtaagtaaacctcaaatcaagattatagaaaaaaattcattttagctacatctatggtattatgtgagaaaccaatggtaacttctggttctggcaacactgcagagtaaggctatagacactagaaatgccggattgaataacaacaaaacaacaaaaaatagcgatgaaagaactcacagggaaaagggactcttcagggggcaggatcggagaggaaacagaaagccagagtgagggtgacacccacagatgctgacggggcccagtgatgctgggggacaggacccgactcaggagcacaccctaacagtcgggtgcttaggattttgtgtcgacgtgtagaaagagccatcgaagcacatgagacgggaatttgtaagagacccacgcctgcaatgtcgagccccaaaggttcatgtctcacggaagggggccaaagcaaaaggagaagagctccatccgccaggctcaggtgtgtgcgaagaaacccatctccgtctagattctgagtggaagggaaaaaagaaagcaatcctcggccgggcgcggtggctcacgcctgtaatcccagcactttgggaggccgaggcgggcggatcacgaggtcaggagatcgagaccatcctggctaacacggtgaaaccccgtctctactaaaaaacaaaaaattagccgggcgtggtggtgggcgcctgtagtcccagctactcgggaggctgaggcaggagaatggcgtgaacccgggaggcggagcttgcagtgagccgagatcgcgccactgcactccagcctgggggacagagcgagacgccgtctcaaaaacaaaaaaaaaaagaaaagaaaagaaaaagaaagcaatcctcaaatgtataccatgcttgcaaagtaggaatacctggctgagaaattaacacaattgactctgggccagtgaactgcctggaacaccaggcagaggcaaatgcaaatccactttaccacaagacttccacaatccaggccaaaaatacgacccgctgaagagcagctcatcaggaaaacctatacacaaggaggcgatccaaataaacaagaatcagcagacacaacaccctggaggaatttacagtgggaatggggtttgaaattcacctagaaacacttggtgaatcaaactggaaaacaggaaggaattaggaaattaaaaacctgttcattaaaaagcaggaaatgaggcggcgaaagtgggagtagtagaacaaggaatttgatttgtaaatgactgtgaacaatcaactgagataactcaccgccatcaggcctgcctaaatttaaataaatggaaacagattaaactcactagctgagacagattctcaacttggatttttttttgttttgttttttgagacaggatcttgccccggctggagtgcagtgtcacaaacggctcactgcagcctcgacctcctccctgggctcaactaatcctcccaccttagcctcccaagtagctgggactatggcacacaccaccacaatcagctcctttttttagaataaaaattttatacagacaaggtctcattatattgtccaggttggtctcaaactcctaggctcaagcaatcatcccacctcacactcccaaagtgctaggattacaggtgtgacccatcatgcctggttcaaattagactttttaaaaattaaggttccggaccaggcatggtggctcacgcctgtaatcccagcactttgggaggccaaggcaggtggatcacaagttcaggagctcaagaccagcctggccaatatggtgaaacccccgtctctactaaaaatacaaaagttagccgggtgtggtggcaggcgcctgtagtcccagctacttgggaggctaaggcaggagaatcgctcgaactcgggaggtggaggttgcagtgagccgagattgcgccattgcactccagcctgggcaacaagagcgaggctctgtctcacaaaaaaaaaaaaaaaaaaattaaggttccatcaaaaaagaggaactaggaacactaaacccaaagacatatgtaattcccttcatgaacaactggagaacacagtctttacaagcagatgtgaactgcctgcatattaacccacaatcaaagtttcagtaaagattttatataacaaatgctatacaaatacaacgaagaaattataataaaactcaaaagatttagaactggattaccatgttaccatgaaaacactacatagcaaaacttgatacaatcaatacagcagtaattagagacatctttacagcctagactacatatacttgaacaagaggaaagaataaaagtaagctaaatatcaagaagttagaagaaaaaaatagaatgaagccttagtccattcaggctgttataacaaaatacagtaaactgggtagctcataaatgcagaggtttatttcttacagtcctggaggctgggaagtcgcagttcaagggactggcagatgcaatgttaggtgagggtccactttctggttcatatgtggtgccctctccttgtgtcctcacggggtagaaggaactagctggctctctggggtctccattataaggacattccctatagtaagaggtctgccctcagacctaatcattttccaaagacccgacctcctgataccatcaccttgagggttaggatttcaacatatgttaaaactaaaaaaaagaggtaagaaacaagaatagccacaataactgaaagaaaatgaagaaggagaaattaatttaccaaacaacaaaacctattaaaacagtatggtattgctggatagatgaatacatcaatagaacagaccaaagactctagaaccagactcatgtgtattcatccagtcatccacagaatgtttactgaggcaccactctgtgacaaacactgtcgaaggttctggggaaacagcagagcatgaaacaaataaaaatccctgacctcaggaagcacattctagtgggatgaaatatacaaaaacaatatgcttttcagatggtaatcaatgctaagaagaaaaacagagcagagaaggaaagaagacaatgttggttgagggtgtgagttgcaatttacaatggtgtattggggaacagcttgttggaaaggcaccatttgggcaaaggaggcgaggggtggtgccctgcagatatctggaggaagagcggttgagacagaacaaacagcaagtgcaaaggccctgaggtagaagcatgtctgacatgtctgaggaacagcaagaccagtgtggctgcaacagaaagagcaaggggagagaacagcagagaatagtgtgagttcccagagttttactggaagaatttagtttttcctcagtgtgagatagaagccactggagaattttggggaaatgagtggctttatttgacttgatttacagtatcattggcctgacacagtggctcatgcctgtaatctcaatactttgggaggctgaggtgggaggattgtttgagaccagcctggacaacacagcaagaccccatatctgcaaaaaaaaattcaaaacttaactgggcatggtggcacatgcctgtattcccagctactcaggaggctgaggtagggggatcccttgagcctgggaggtcgaggctgcagtgagtcatgactatgccatggcactccagcctggatgacacagagagatcctgtctcaaaaaaaaaaaaaggatcattgaagatgctgttttaagaagaaatcatcaagtagcaaaggaagaaaagaaagtccagttggatggctccagcaacaatccagccaagagatgaagcagctcacaccaggacggtgatggtgagagggcgggaatggtcaagtgtggacagattttacggcagagccactcagttctgctgacagattgtatctgtggggacatcagacaaaaggaggagtccgtgatgactacaagggttcctgcctaagaaactggaggatggagtgtgtttaaatgagaagggatgtgggaagagctggtttgaggagataaggacttcagtttggggcatattaaggctgaggtatctattacacatcccagagaaaagctgggtaacacgatagaagttcaagggccaggggcccaagctaaaacgaaaactttgagagtgatgtgagtatacagctgaccctcattgtttgcagatcctgtattgatgaattcatctacttgctgatttttttttttttttgagacagagactcgctctggttgcccaggctggagcgtagtggcatgatcttggctcactgcaacctccaccttctgggttcaagcgattctcctgcctcagcctccctaatagctaggattacaggtgcccgccaccatgcctggttaatttttgtatttttaatagagacggggtttcaccatgttggccaggctggtctcaaactcctgacctcgggtgatcccgcccaccttggcctcccaaagtgctgggattacagatgtgagccactgtgcctggccatacctgctgaatgtattttgtaacctcaccgtcattcatggacattcgaaaaatgtgaactgtcaatgtccacattcccagctgaggacacacagggtgcaatagactgaatgtgtccccaaaaagtcagatgttgaaaccctaattccagtggaatgatatttggaggtagggtctttggaaggcaagtagttcacaagtgcagagccctcaagaatgggatgagtgccttatataaggggcccagagagctggcttcccttctttctgctgggtgagaacacagccagaagatgaccatctgcaaaccagaaacaggccctcagcagacattggatctgccagcgcctcgatcttggactttccagcctccagaactgtgagaaatgtttgttgttgaagccacgtttgttagagcagcccaactgcccacaacactctgcttctcatttgagctctcacagtgtaaacaagtgtcctttgcatggtcttagtgcacatttttgtgctttttgaggggttgattttgctgtttaaaagggccccgcacttagtgctcacatgctatctagcattgctaagcacgggaaggctgtgatgtgccttatggagaaaatgcgagtattggagaagctttgttcaggcacgagttacagtcctgttggccatgagcttcctgttaatgagtcaacaatatatattagaatggtatcttccacaaaaacacacataaaaccagggttatgtatgggtcaactgaggaaaccgctgtgaccaggccacaggtttacaggaagctaaccttgtattttccccaggaggaatggtttaggatttgctaactcagtgtttgtagggactttactactacaaataccaagaatgactgtatgtgggtttggtttgtttgtttgagacacagtctcactctgtcccctaggctggagtgcagtggcacaatctcggctcactacaacctccacctaccagtttcaagcaattctcctgcctcagcctcccaagtagctggtactacaggcgagcaccaccatacctggctaatttttgtatttttggtagagatgggttttcaccatgttggccaggctggtctcaaactcctgacctcaggtgatccactgtgccgggcctgtaggtgatatttaaactttaagaatgaatgacatccttcagggaataatggtggatgaagaaaagagaaatctagaagactgagccctggggtccttcaacactaacacttcagggagatgggaaggaatcagcgagtgaggaatgagcctgagaaggaacagccagtgacgggggaggaagaccccaagtgtggtgtcctggacccaagtgaagaatgggtgttgaggggagaacaatgaatgctgagtgttgccctccgcgtttggcaaagtgaaggtcattggtgacctccacaaggacaggcttggacgagggcatgggtgacagcataatcatagtgggcttaaaagaaactgagaggagactgggcgcggtggctcacgcctgtaatcccagcactttaagaggccaaagtgggtgggttgcttgaggcctggagttcaaaaccagcctggccaacatggtaaaaacccgtctctactaaaaatacaaaaattagccaggcgtggtggcacatgcctataatcccagctacttgggacgctgaggcaggagaactgcttgaacctgggaagcggaggttgcagtgaaccgagatcacgccattgcactgcagcctaggcaatagagtgagactccatctcaaaaaaaaaaaagagagagagagagagaatgagagaggagagaactaaagagagtgaacacagaaaactcttagaagacttttgacagaaaaaggagcaaagaggccgggcgtggtggctcacacctgtaatcccagcactttgggagacggaggcaggtggatcacttgaggtcaggagttcgacaccagcctgaccaacatggggaaaccccgtctctactaaaaatacaaaaattagccaggcagggtggtggatgcctattatcccagatacttgggaggctgaggcaggagaatcgcttgaaccgggaagcagaggttagagtgagctgagatcgcaccatttcactccagcccggacaagaagatcgaaactctatctcaaaaaaaaaaaaaaaaaagagcaaagagactgtgcaaaagatggagggaagacacagggatgagccttttttttttaaagtggaagaaatctcagcctatttgtacgtggatgagaatgataccatagaaaggaaaacaaacaaaacacaatcaatgaccccgggagagagggaactggagagtgtgacaggagggtctggcgcatagcagaggagctgccttctttggcagcgtggacagtcctcacgcacccaagggaggctgaggacgtggacacagacacaggtggtggtgggtgtggggcgggagagtgtggatgctccctgttggcatctgtttgctcacagaactgagaagcagagtcagcagctcagggtgagaggcgggacgagggctggggagaggataagcaggaaaacaggggaccagcgagaagtacgtatggctgtttcctccagccaggtccagcagtgggaacaggcgaagagcaggcgcagagcaggcagagagagggggtcagatacaatgggctctgtagtcatgagagggggcaggagggacctgtggggggaggagggactggccatcaatggggcacggctgcagcactgagctacccaggtaagaaaacaaatcaccatggatccccacataccccagtgcgtggctagaaatctaagtaggaaaggcgaaatttcaacaatcagaaggaaatactgaatacttttttcttgtactttggaataaggcagaatttcttaaatttgacccaaaaaacataaaccataaagaaaaggattataaatcccatttcatggtaaccaatttaaaaaaaaaggaaagacaactgcagaaaactgaatactaagtggatatttgatgaaattgcaaattattgtgaattttggcaggggaagatgatggcattgcagccatgtgtttttgagtccttgtctttcatagatgcatcatgatatcatgatgtacccacagatgacatgaccagaggtctgggatttacttcagaatagccccatttgggctgagtgcggtggctcacacctgtaatcccagcactctgggaggccaaggctggtggatcacctgaggtcaggagttcgagagcagcctggccaacatggcaaaaccccgtttctactaaaaatacaaaaattagccaggcatggtggtgagcgcctgtaatcccagctactccggaggctgaggcatgagaatcactggaatccaggaggcaaaggctgcagtcagacgagatcgcgccactgcactccagcctgggcgacagagcaagactccatctcaaaaaacaaacaaacaaaaacccaaaatagctccatgtggggtagggtggacaaggtgtccacgtgctgatggtggtgcagctggagtgtcctgtgtactaatctctctacttttatatatgcttgagattttccatgacaaaaagctcttaaaattgcattaataagatagtaactaagatgaaagattaataagataatgattaacattaatatcaagataaaagtctccataaacaaagtgagaaaacaagatagactaggagaaggtattattttaggaacagaggacttagtgtctagataaaatatataaagaattcttataagtcaccaagaaaaagacaacccaatagaaaaattcatatgaatgggcaatttacaaaaaagtacacctgaatggcccataaacatatgaacagatattcaacctcactgttcttaaggaaactataataaaaacaagaatgaaatactattttccatcttgcagattggcaaaagtctgttaacacagagatgatggtacacttgtagggaaatgggagggcatgtgaaatgatacaaaccctggaaggagtctagcaaagttaaagaagcagatgccccgcaccctagatatcccaccactagatgtttccctagagaaattcatgtcacatgtggtgggacatggtggctcatgcctgtaatcccagcactttgggaggccaaggccggggggatcatttgagcccaggagttcgagaccatcctgggcaacatggtaaaaccccatctctccaaaaaaaaaaaaaagcagaaaaattagccaggcatggtggtgtgtgcacctgtggtcccagctactcaggaggctgaggtggaaggattgcttgagcccaggaggtcaagactgcaccactgcactccaggcttggtgttaagagtgagaccctatctaaaaaaaagagagagagagagagaaatttgcacatgcccacacaggcacatgcagtgattatggaaaaatgttcttggcaccactaatatgatgacaacacctggaaccaatctaattgaccatcaacaggagaatgaataaactgtaatttattgattgatgtaggttgaattgtattcccccaaaatacatgtttaagtcctatcccccactccccgtgcatgtgaccttaactagacacagggtccttgcagatgtcctgtagttaagatgaggtcatactggagtacagtagaccataaatccaatgactggtgtccttctaaggaggggaaaacgtggacaaagacacaacagacgcacagaagagaaggccgtgtgaagatggaggtggagatgggaaggatgcacctgcaagccaaggattgctggccccccaccagacgctggaataggcaaggaagggctctcctttacaggtttcagaaagagcagagccctgctgacactttcaatttggactcctggcctccagaactatgaggcactgtgttgctttaagtcacccagtatctggtaatgttatggcagccctagaaaacaaatacattcataaaaagaatattacacaacagttcgatgaacaggctgcacctgtaatttatcaatataataaatctccagacccgcatggtggctcaggcctgtaatcccagcactttgagaggtcgaggcatggtcatagcttgaggccaggagtatgagaccagcatgagcaacatagggagaccccgtctctacaaaaaaatttttttaattagccgggcatggtggcatgcacctgtagtcccagctactcagaagactgaaaggaggatcacttgaacccaagaattcaaggctgcagtaagctatgatcatgccactacactccagtctgggcaacaaagagagacatttttatttttatttttatttatttattttttatatatttatttatatatatttatattttttatatatttatttttatttaaaaatagaaatacaaaacttgaaaaatctcaaagacataatgctatgtaaaaagacatagcattttgattctaaataacaaccaaaaaacatacattttgatgctaaataaataacaaccaaaaatatacattttattcataaatatactgtaggaaaagtatcacgcatgagaatgaattatcaccattaggacaattggttaccgggaagagaggggagaaaaaatggagatcgtgggctttattatgttttatttccctaaaaagttttgatttgaagtatatagggcaaaagggtattatctttcaaatatgggtgatgtgaaagggtggctgttatataattcccttcacattactgaatattcttagtgtttcataattagaaataaagtaattagattttgagaagaaagaaattaataactagttatccaatcaaggacaactggactgtagttttcttggtttggttttcataagctacattatagaactataattagtaagactcaataattcaacattgtcatttgacaccatttcagaaaaactctcaagccatgtttccctctgctctcacaatacagcgatcatcaacaccatgaccaaaggtaaggggtgggggcgcgtggggcagtgagggctcagttccaagactgccccacccctcagacacaagcagcaagttcaggcctgtagagctttctttttttctttttcttttcgggtttttttttttttggagacggagtctcgctctctcacccaggctggattgcagtgcacgatctccgctcactgcaaactccgcctcccaggttcaagcgattctcctgcctcagcctcccaagtagctgggactacaggtgcccgccactatgcccggctaatttttatatttttagtagagacggggtttcaccatgttcgccaggctggtctgggctgacttcttatctgggctgacttcttatctgggctgtttgttggctatgaggacctagggatcacagaaaatcctggccattccaggaagcctctaatctgaatgtttttactttattttcagttgacatccattttgcaaaaggaatgcttacagccaggcgagcagccctctaggctgatcctgcaaggttattctcctacaggagacgcccgtgtgtgtcgaaggctggactcctgcccagaccctccacgtgggcacagcagccaggccacgccttgtgccaggggccaagtccacaatgggcagggcgaacagtttctaccctggcaagtctcagggaacatacccttgactctcaactaactgtactatattttctgtatatacctttcaggattttagcttcctcctgcaaatgcactgtaaaccaaaaataaaattccaagcatcccaactaactgaatggacctctcctcttggccaaggcgattccaaagaaacctgtaaaactaattcaggccatgacaggaaggaggggctaggctcagtggctcatgcctataattcagcacattggaaggccaaggctggtggatcacttgaggcaaggatccaagaccagcctggccaacatggcaaaaccttgtctctactaaaaaaaaaaaaaaaaaattagccaggcatggtggtgcatacctgtaatcccagctacttgggcggctgaggcaggagaatcgcttgaacccaggaggttgcagcgagactctgtctcaaaaaaaaaaaaaagacaggaaggaggagtccaacatacctcattattccctcctccattgaagttcaggcacaaatgaccagcattaacattcaaacagaggtctcaagactgacgaaacagactttttgtagaaataaggtatgaaattccaacctgactcaaatacagcatccaaggatatagacagcaggccctgaaacaaatcaagtattttaccccaaaatatttttgacatattttgaaagggccctgcaaagctatctcttgtaggggaaacttacattctgtagagaatccccttccctttccaggtctctttctgatcctgaaaagattacctgagagtctggcagcttttaaaggtctgaacagaaaacatttgctatctattgcctctaagggtagccatctatgagacttcacctacataataagaactttggtctcccaaacctcttatcttaacccagaccctcctttctattgattccaggtctttcattattaatttaactctttcaaccaagcaccaatcagaaaacctttgaatccccctgtgacctgtaagctaccaccctgaccctgccatccccgatctttgagttgtcccacctttccagactgaaccaatgtatacctcacatgtattgatcgagttcctatgtctccctaaatgtataaaaccaagctgtaactcagccaccttgggcacatgttctcaggccctctgggggctgtgtcatgggtcatggtcctcacatttggctcagaataaacctcttcaaacattttacagagtttgacttccttctgtcaacaacacatgtatttattaaaagataattttcagaaagaagtaaaaccatcactcttcaacagatataaaaacaaacaacattgaggattgtactctacttgaacgacaggaaaaaactaacagatgttctaacaggcttgaaggaaaatcaaaagagcacaaatgcagcactggaaagtgtaaactaaaaactctaagcccccaaccaactgactggatcatctcttcaccaaggagaccccagaataaccttaaaaactgagttattggccatacaactcagttatatagttatgggttgggggatcacacacctctcattatccgctcctgactcactaatcaccatgaggctttcttttctaaaggctaaacagaaactagcctcttcaaacaaccccacactgatatcacccagccgcatgacactgccctcctttttgcctgataacaaaacaccaaccatgacatggttctggcctgtctacagagggtgcacagtaaggatttttgtgtcctctgcttcagcttttaacaacagagggccaaaaataccacccttggatcatgctaacgcagtcattttttgaacatggctcccatgaagaggcaaaaagctcaattgcccacgtacacggttctccttcaaaaatattcatggctgagaacagtggctcatgcctatactcccaacactttgggaggccaagacaggaggatcacttgagtccaggagttcaagacctgcctgggcaacacagggagaccccatctctacaaaaaaaaaaaaaattagaaaattagccaggcttggtggcacacacctgtggtcccagccttttaggaggctgagctaggaggagcacttgggcccaggaggtcaagactgcagtgagccaatgatcatgccactgcactccagcctgggggagtgaatgaaaccctgtctcaaaagtattagctaatccattattttaaaaattcataacccctcctatagcttattgaatctgtgtgtttggccacactgttcagcacagatccctgtactattcttcccacactggaagggtctgtttccagcttctggccagagactacacttcccagcctgtcagaatggccgctttgcgggctgcaacactttatgagaaataaagctctctttttccaaatttatgaaactcatcattctttagttgacaaaagaaatgttgagatgaattgcaaatgaagacaaaatatctttttggccaaacgcagtggctcacacctgtaatcccagcactttgggaagctgaggcaagaggattgcttgaggctgggagttagagaccagcctagacaacatgttttttttttaacttttttccacaggaggggaaagagtccattaattctgcatggaaacgggatagaatttacagatctatcagatctgccacttactcctaaaaatggctcaagtacaatgaatggagctggaatcagacagcccacagggcgtgctatagacatgggtacttttccactgaggcactttttacaaatgatgaggtcctttattgtgagtaagaaggtttccttttcctcctgtgctggggcaggactgtgtgtctgagatgcatgacagagtcctcgttacacatgctgtcaataaaggcttttctgtatcatggcagatgtgtttggggccaccttctggtcatccccaggtcagttctgtggtctccactggtgacgtctctggaaatcaggacgcttttcctagctctgtggagtgccctgcaggacaccctggtggccatgttcgtcggcaatgcccacactggccaccaccagcacaaatgcatgattccccatagacattgctgcaaggtgctgcatatgtgtgaatgacttctatgtgatggtatgcacaggagaggagcatatggaattggaatttgcagatcaaatactcaacagtgatccccatgggttttgatgtgtaattttccagagagatttgcttgtgtgaggcagagctggaggggccacaggagtcactctgtaggggtgaaggagcctcactctgcctaacacaagcatgtccctctggaaaattacacatcaaaacccatggggatcactgttgagtgttttttgttttttgttttttgttttttttgagacggagtctcactctgttgcccaggctggagtgcaatggtgcaatctccgctcactgcaacctctgccccactggttcaaacgatattcctgccacagcctcctgagtagctgggattataggcacatgccaccacgcctggctaatttttgtattttagtagagactgggtttcaccatgttggccaggctggtctcaaactcctgacttcaggatacatccacctcggcctcccaaagtgctaggattacaggcatgagccactgtgcccaatcttacagttgagtgtttgatctgcaaattccaagggtatgctcctctcctgcgtgtaccttcacaaggcactcctttactccgtatacatttgcacttcttgacttcttttttgaaccagttacaacatctgcctatttctctctttaatgaataaaataaaatatttatcacttttatatctgtataaaagtcacgatttcacctttggctgaaaattatcttttaacaatgtaatcaaacattccctttctaacactggcagtcagacaggtaagagaggtgataaagtatggtgagggtgtggttttcctgatttcacgccctaaggattcaaataactcacaagtcagacttccaggcacaacgcagttctccaacagaaatagagaaaacagattttgacaagcaaaagggactggtgcagttgggattataacaagcagggaagtctaggaatacatctccagcctcctgggagagcctgagcccggagggggcagagaggaggaggagggaggtctgggggaagagaggtctgcaaagtaggggaagggaaggccaggagggagggaggcgcagcggggaggagaggagagaagggaggaatacatttctggaagctttagaaatttagaaatagaaaccacgtggaagtgcatccagggctcagggttacagaggaccccaagacaacacaggaaagtggggtctaatgggaaaggcaggaggtttctcctttactgcttaaacattgtaggaacttgcatggcaagtgattttcaatcttgcagcagggaaggcagggccagtacttatccttagatgattctacaaacatcaaacttctccaaatatttatttttcagcagccatgcttgtattttccaagtgtctatggtcgagatagcatgaattaggaagctacctggatgagcccacaatggccctcttagacatgccaacgacgcccctgcagaatctgctttttctctggctgttcctaggcctggatagggttcccaggcctggacaggattccccggataccggcgaggctcattactaaccactttattttaaatgggctttgaaaacaacaggtggcatcttccatcagcaagtggacataaatctcagtgcccagtgtttccaaggcctgcccgacccacatggctgtggggtgtaaactgtccagtcgttcctggcacacctacccagcatttaggatgtcccactcttagatccatagacccagcacctctcttcttaatacccaccctaaagaaaagctgtcgaatgtggatgctgatttagttgcaaatatgctcagttttttaatagttttatattagtaaaaacgctacaaccagaatgtctcactgcaggaagagagttacaaggagtatttaacggcatggtggaaaggctcctccgtgctaaatggccaaaacgaacgcaagtttgcatacggtgtgatttccactatgtctttaaaatgcatggcgaaacacctacaggaaaataccaaaatgtaaacagcggctgcttcggacgcatgggatcgtggaggctgctgttctgcaaggacaacgtatcacttttatgaaagtcagcttctgaaaacggactatgggaagttccttacccgtgcacgcggcaaagaccttctttgccatagtcagaacacacgcgggagttcagaggagcggggcccgggcttgtgtgggcttgtgtgccccggggacgcgcacgtaccttgtcccgcggcctgagactgcgctgcaccgcgcggaggccgaacccagaggaggcggcgtggcgccgggcggggacgcgagagggacgtggacgcggcgaccgaggacgcggggatcctgcgggaccagtggctccagtcgtagcctcctgggagagccaagcccggagggggcggagaggtggaggagggaggcctgggggaagagaaatctgcaaagtcggggaagggaaggaaggccaggagggagggaggcgcagtggggaggagacgagagaagggagggagggaagtgtgaggggaggggaagaagtggggtggtcggagggtggggtagggaggaagagggagggagagatgggagaggctccaagataaagaaaggtgcagggagagggggtgggagggagggaaccgcagagaggaaggga

SEQ ID NO: 792 - DNA, 262511 bp, Homo sapiens
atagagaactttattttgtgtagaataggtcttttgatatgggaatcccatggagtgaaaagtaaaaattcataaggcttgtgctacatttttttcattacataatttctgtcactgtctcttccatgggcacacacagagtctgccaaagattcaccgttcctcactctcttgagactcactcttcttaccctggaggatggaaaaataagagacgtctgtctgtaggtgtgcagcattcatgtgactgctaaactaatgtccccttttgcttcctgaatgagcctcctttcagtgctggggtgaagacccccaaggacatgttctccagccttcctctgaatctactgcatcaatcaagccacagatgttggtcatgctcttgcactaagcaagagtgaactaaatattttaacactcaacacaacaaatacaatttttaaaacaatggcactgagtataaaatccttttaggtctttaaacagtttgttttagtgagaagggcacatcagagaatttctggctctcagatgaaaaacgtatatgtctggcctcacctgtcagtcagtggcttggaacgttgacagttttacatggacaaatagcttggaacagatgggacaagacctgatgtggagaaattcacatgattattaccctgtattaccctgattaaatccattcacttgcactcatcttaatgagcaatcattaaaggagacagcactaaatattcttgaggtaactgacaggcggaaagagttgcttatttatattcaaatcatttagctcctcaaaagaaagtgcgatttttttcacatgcagttagattgacgttggaaagcttttcatcaggtagaaggctgtaatgttcatctttctgctttccggcggcacttggacatttgctttggtattagaggcatcatgaaagtgagtggtggttttaatacctttcccaagtgggccctcacacttcattatcaagggaacaattcctgctttaagaaacatgtgcatgtattaacattgttgtatatttaataagatcattcaaataaggaagaaatagactctgagcaaaccaacccagacatcctttctgaatcttcccgatagcagagctcggcccttgtaaagcctatttggaatttatttcatttaaaattcacaacgtcttggttaaaaagcaccagattctttcaggctaatcattcttcagatccattcatttgcttctctccacttgaatttgcagttgatcttttagactaaaatttttgtctttaatattcaggtcactttcatatacttgtcccttcccttgctcaatttattctagtaatatatttctgtgctttttcttactccactcaatattctgagatgtatttgcaatgcagcaaatagaataatggagcaatgcaatacattgaatttaagtcttccacataaagaactcaaagtgctttacaaacaagaatcccttgttagttacaatgaggaaacagaagccacagatgctgcagttgaatcatgggaatagtctctagtcctcacgattttgtcttcagctctaaactgagttcctccgtggaatttcaaatccttccttgcttcttccctccctccttctctctttctttcccttctttcctttttccttctttcctccctccttctttcctttctttcctttttccttcttccctcccttcctctttatccttcctctcttcctccttccctcccataccccagcacacacttattgtttgtattatgaactaggcactgttctaagcacacagcatttacagccatgcactgcttaatcacagggataggggatacactgtaagaaagtaatcgatagacaattccatcactgtgcaaacatcatagagtgcacttacacaaacctagatggtatagcctactacacacttaggctgtatggtatagtccattattttgctcctaggctacaaatctgtacaacatgttactgtcctgaatgctgtaggcagttataacacagtggtaattatttattatttgtgtagctaaacatagaaaaagtacagtaaaaatagggtacaaaagttgaaaaatgtcatatgtgtgtagggcaattaccatgaatggagcttgcaggaccggaagttgctctgggtaagtcagtgagtgagaggtgagtgaatgtgaaggcgtaggacattaccctactatacactttataaacattatacacttaggctactctaaattcataaaaaataaagtaattgtgctaggacaatacaatggctttgatgtcactagctgataggaatttttcaactccattaaaatctcatggaaccaccattgtatatgcagtccactgttgatgtaaatgttgttatatggtgcacgactgtagtaatgaacaagacaaagcttctgtcatcttggaaatcacactgtagtggggaagaggagagttaaacaagtgaagaaataaataattccaggtaaagtagaaagaggtgctattttagaaagtgtggtcaggaaagcctgacctccccagagaggaggtgataaaagacctggatggaagatctgggaatgaacacttcaggcagagagaggaggaaatagtatcctcactccccatcccatcaataaaagagcttgcagcattccaggaataaacaatgcccagcaaccctgcaatgtgtggggcagtatgaataaggcagagcagagaggaagttagaggggaaggcatggagactgcatctcaccctcaactgaatgggaacccattgaagtgtttgggtgagggggaagctttgttataatcacatttatatcctacaacatttactctgactgctgttatttaaagaaaggcatttactctggagaacatatgtggaggttgggagaaggcaagtgtggaagtagaaataacaactaaaggctgttgcagtagaccaggcaaggcatgttgttagcttaaattaggttggtggtcaagatgggaagaagtggctggacgaggaatagattttgatggcaacaccaacaggaaattcagttggctttgatggggagtgagggaaagagaggaatcaagaaatactcttgggtcattggcattatcccctggtgagcaatggagccatttttcaagaaggagaaggttgaaggaaggttaaaatcaagagctctgtgtggacatgctcctgagacggctactgcaggtagagatgatattatgtcatggatggtaagtttggagtttgtgggaactatcaagtttggaaatatgcatttggaatttgctagcatatagaggatattgaaagccatgaggttggttaagattatgtagggatgagattgccagctggagtatctgagcactgtaaataagaaaccacattttgtgcattcgtgtcacttcgattgtcctgtctgatgccatctctttgtggaaggatgccctgacgagagcagagtaggtgagtcagagcttgcattactgaaagcaattgtggaactagtactagtcatggtttcctaatctctttatgtatggctgattttatttgctgtttcatttagaatttttcctccttctaaggaagattggtctgcagatttttattggtgctatatttaataaatttgattatctatgttatgctggatttatcaaaagattgttaagcttttcttatttctatgcaccagaacaaattaaataacatgggaattatctgtttatttgttggatggaaagaattcacagtgagaaattctggtgccagaggcatttgggaagaggcagaatacttaccaatcatttagtgcttacaacgctaaacaattgaaaggcataacatcaatttgtcctcttgacaattttatgaaatcagtattctttccactttagagattattaagttgaggtgcactgaggtctggaaattgccctcagtcatgcagctaaaaagcagcatttccaagttgtggaccacaatctgatttcaaatgctatgcgtgcatttagccattaagcatcaccgcgtcctatgttaatacccacagtgagagtgaagattcctttcagtggttcaggcataaaatttggacagctgccatttactgcccatctggcatttgtccccttgcctttaccctgactttctttccaggaaccactctcctccacccttgtttatgggccttacttggggctgactccatcactgaatccaggagtagtcacagaaacccaggtgtggcagtcaacatatccattcacctgagcaaaagagatatatccagggataaacatgagacccaaattcatcaagtcagaactaatcccaaaacttctcactgggcaggctctctgcagacaggatggttgcctggcatatccatcttgccaccatgagagaaggacttcagcctgcccaagaatggattccatccagaggacaaaagtgcccagaaaagagaaagcaagaccatgttctcctcagaatatgtcagcctcagaaccagccctcacttactgctggccttgacatttaaatgaacccacaaattctcagttgttactgaagtgggcttgagacggttttttgtcacattgggtgtgctgaaatagttgtggactattatagaaaggtaatgatgtattttctatttctcatagttagtaactggaaccagacaaattatctgcctaaagccagtcatttagtgaagtaactagggcccatacctgtgacttgtatattagagttttgagtattctattcactagatcatacagttttctcaaacatatctgtggaagttacttagaaaaaataaaatacaaatttcttttctggattctttccctatacatttagttattcattttccatcacttagttactctgacggctcagattttattgtgctatagaagagttctcaaagcataaggttaccatatgggcatcagaagttttattcattccaaaccgaacagaatgtctttggcattgactggctatactttgttcaaaagatgcatggtcaaatatattttcatatgaatttgcatatatgtggctgcacaaccattggattggacacatggaagatgataatgtgtgctcttgaaacaagcagtgccatttctgccctggtccaaactcaaatggttctcttttgtcgtaggagtcaaatttatttttcctgcccttcaaagatacaatacttccttacaaattacctcgcaaggatagaactgggtatttcagattttcatatatagaagctgccctgggtcttgctgctgcctctccccttcaaagcagctgtctccagatacaggattgccagcttccagaagaccaaaattgttgtgccttgctttgattttccagaatgtgggaccagcctttgtggttacttagttcatgtgttttggggaaactgaagctatctcttgcacccaggaatagacataaatgtgtgggtaaagatagggatgctctagaaacagctgctgaactaacaatgaaaacaaatgaatacaatttctcatctttaggaagtcattgctagccaaactattactatgcaaactatgtaatatttgtcatagcgtataaaatattattccatctacccatatttgtggacatttgtagcaaataagtggggtaaaggatagggactgtgacaatgatatggcatgaatctcactgactcagaggaaatgaaaaaccatgaactcggctttttaaattcaatacagtaaacttaatacagaaccacatcaaatcagatctgtaaaggatattaatgattatttgtgccaactccttaccatatgtgaaaagagaaaatagaatcccaacaaagatgcataagaccctgtaccttgacccaaggactattcagatgtcttgcattctagaaaaaagaatattgtggatttatttgctttagttttgaccagcacagcctccacagaagcatagtccaactcagtgggtggatgttatccacagtggcagctgttatcaccccaaggcaaggctagtgaccatgcttttgaggagagctgtgcaaaccccacatacatacatttgaatctcaccacagttgactgaaaaacctagatataggagtctgcacctcctcctcaaaatgtgagaaaagtaaaaaacatttagcaatggtactcaaggtcctccagccacgtgaatagagcaaaattggtccaatatattttaaattacaatagtagtatattagaaagggaaatataagggaaacttttagttataattttctgtagacattaatatttattcttgtatacatcagactttctacagatagacgccatgataatatagaagattcattttatgaaatattctttctcaattattcacaaatctgaatgttgtcttgttatcgttaagtacataatatgaatttattatctattctccctgcctggcatgaaacatcatttagataatcatagattctactgaagaggaagaaatttgaataatgttaacaagcaattcatggtggggcttttagtcaactttatttttctagttcgacttaacatagtgattcacaaagcttacttcctcctaagaattcacataaccatgaaaaaagtacttttggccataaaacaggatgagatcaaatgtatctcaaaagcaactattgtcagctatattcaaaatgcatcattctttgatctaaaatggagaaagtaagtgtggccatggctacacagcagtatggattggggagagaatacttcaacatgcaagagaaaaatgtgatcttaattatagggacttgtaattaatgcatttcaggcctcaacatttaagttgcattttggtaacttttaagtaaataaaaattttaaatgaataaataaagcttttaaatagtttttaaataaataacttaaaactaagaaatctgtttttatgccttttttccaatctatcaaattgacaatataacagatctgcattgttcctgcatcatttcaggtggcctgaaatttgacaagaagaggacatatgaatgtcttctgtaaggttagatgaagatcccaatgcactgagtcaaggtctctgaatcgtggggaacatgaggtagttaccccaagcagaagcagaggccacatccctcagctcggtgtccagtggccccacattcattcatactgggagatagcagcaaggaatgatactttctttgcaatacatggtactgtcgaaatgaaaaactcaataatcccttacaggatctccatcatttttttcgggggtggggggtagctagggacgtatagactctatactaacaatcttggcccttaactagaaatatcatggccgaccagtgaccttttggatacatatggacctcaagccaaatacagccacagcaaggccacaggctcatgaagaggaagaaggcagggtcggtgcccaggcatccttcgagaagctctgtctccaacttttctcatctggaaagcccctcttccttttgctcattgcaaaatctgacttaacactcttttatctggcagtgcttaaagtgagtttgacctgaggtccacaattgctaattgttgaaagagaactagaaacacttgcttaattccgagggtcaacatcaaaaacaaacctgaccaaagttgcagaggaggtattttacaactaacaacaaccttaacctgacttcgtttatcaaatgtcctcagaattatgatacacccagatctttggcattgtatttttttgtccaccgaacaaaaccgggaagctaccaaaagtcatgcatggaattcatgtgtaccactagcagtgtgtgagatcagcagaatgtttctgaaagctaagagctgtattcaaagaactgatcacaattgcatttgaaataagttatctgccactatttcttttggccataatgtggcaaatgttatatagacaagaaaatatttagtaaaagttggaagtatttgcaaaatatttgtgcagaagtttgcatctttaattgtatgacctcattgtagttgcacagggagactccagctacatcttatcttttcaaaatactcctgagcaatggctttcctacaacctctttggaatgtagcattatcagcttctatttccccaatttcctataattcaataaaaagtcagcaataacatgtccaagggcatgttatctcaaatgtggattttaatgaaacacaaatatgcccatgcatgttttagcaaattgttctggaccatgcaaaaatgcattaaaagtggaggcatatttacatttgttttgcatttgttatttaagaggtcagactatgcaaagtgcatccacttttgtcaatagcttcaaggagaagaaaattttattaaagttagattcatgacaaacagatgagttaatatctgtcatttgggggaaaaggttttgagaggctacatttttaaaataataggcatttattacttttccaaaactgagaatacttaacaaatgtgcctgtctattttaaaccaggtatactggtctgcaggtaaatttccaattaaaaagccaacttaattataagcagtttacagcacaaagggagattgttatatagtctggaattggccctggaaattttaatataaaaaataaaattagtagtagaagaataaaagacatttagtgatttccaaaaacttttagagacaattcttgctcaagatttacaaataaagaatacaatagaaaaatttgtattctaagatgatagaaaacaatatattctaacgttgcttaagagatataatcttacgtacttgctggatttgtttgtggttgcctttgccaaaggaaacttttttcaaaattaaagaattttttttttcctaaaccagcctctgcatttgcccctgaatgctggggaaaaaagggtgtgcaggaggggtgggcacaataaaaactgtgtgtgtgtgtggtgcattttctatacactcccggctatgtaggacggacagacccatttctacagtgttacctggattctctatgtagctacagacctactacattggggattacacaactctatgcctctaatattatgttgggctttgttggacacagcacaccaaggccagggtggacctggtggtgtgcacatatgctgtccgtgaagtctgaagtctaacatacttagaacattccttcttccagaatcacatggattcatgacctctcctaattcatctctatttaaatttcacttcatcacaaaagacttggtccgattatcacaccccacatcaccagcattctcctcatccctttccactgctctgttctccttatttggttagtacttactactatccaacatattttctgtccctcttcctagaatataaagttccattagaacataaactatttttcttcgctgctatatacccagtaactagatggtgcttggcacatggtgggtgctcacaaatttttatggaatgaatgtataattaaatgtttaaaataaaaatacaactgctgatcaatgacactgcagaaaggtccaccagagaatgcaacctgaagattggcagggaagtaattcatgaaatggctattgttctgaacacttagaaagtattaagatttcttctacctgcttctgacagactcagagtataaaaagtttcaaaagactgtgctgtggtgtggagaaattccaaatggaaaaattgaacatattctgtcatcagctcctttcagacagatgctctcaaggtgatcgatttggcagtcctggggagggatgatattacgtttcacatatacatcactggattaatcctcattgtggtattaaatctaattaacataaatctgtgcagtgacttatgttttaaatgatggggtaattatttaaatactttctactatgaagggagttgcgggcttgggttggagagacatagccaaaccagaaataggcaacaaaagactttccagaagaaaaatgtgacatagtccaataatatgagtgttacttaagaacacctaatacgctaaatactgatctgacaaagaagataaattgagaaatgatgattcatattcccaaagatttttttcatgttaatataagcatatttaatggagaaatccataacagattttaaagctttcattttctaaaagagtacgactcaaatttttataaacatatgtatgatatcaatagaggtaaatccatctcatttgagtgagtgcagctccagctttgtgtagatcttgagcatccttggtgagggtatgagaatgaagaacactccggagaccagaagcaacttatgactcaccaaagctctgactgccactcagtagcgttctaagccctccattcattcccattccacttcagtgccaagcatctgagatgggaaagtcatcttcagcccaccaacaagccctgagcggctgggcgtccatctccccatctgtaccagtggcacacatcactgttccattcatcatgtctatgaacttgatctgatttttgtcatgactgtcactataaaagtcactctgcatgagtgtcagaaggaaatttagaggtctgttgctgaggtaatatattttcagatcaaaatgtgggttattgaaatcattatatgtatattcacatgactacatattatcatgttaggagatgggactgatcatggagacatagtatctctctgcatcccatgagacatatctttcttacacaattcccactgctaggaagatcactgaactttccagaaagacgttcaccaaatacgctcttagtgggacccaactacacatcgtctgtggcagagacctacagttctcatgagtatctgagcagctctttttcctggaaacacagctgaacacttcccaggatcccttggattatgtgtgtctctgtgacaaagtccagccaatggaacatgcctagaatcaatgtgggctactccggggctgggcccataaacactacccagttactatcgtcatcctcttcctcttcactggctgagtagagaggattccaaggagctatagggagggggagccacaagacggaaggatgtggcttcctgaataatgggatggagatttaccatggctgcctgcccccaccacacacacaatggacagaaataagagagaaaagtaagcttttattgtattaatccattcaaattcagggcttgtttgttttatgattaacataccctgacaaataaaatgaactttaatggtttttcagaatctgttgcatttcattttctaaaagattacaatgcaaatttttataaacatatgtatggtatcaacagaggtaatccttatctcatttgagtgagtgcaaatgagatatgcatttttcttctgttgcatttacttttctaaaaaatattattttaattgtggtaaaatacacatatcataaaaattgccattttaatcacattaagtgaacaattcagtggcattgggtacattcacattttagtgtgtgttaccatcagccacctccaggatgtttttcactttggaatctgaagctctatacccatcaaacaataactcaccatttcctactccccaccccaactgctagcatccacctttctgcttcctgtctctatgatttgactactctatatacgttttccgagtggaattatatagtattttgccttctgtgactagcttatttcacttggcatgttgtccttcagaatcacccaagttgtaacatacgtcagaatgtccttcctttttatcacccacgttgtaacatacgtcagaatgtccttcctttttatcacccacgttgtagcatacgtcagaattcccttcctttttatcaccaatgttgtagcatatgtcagaatttccttcctttttaaggctcaataatgttccattttatgtatagaccacattttgcttatccattcatttgttgatggatgcttggtttacttctaccttttggttgttgtgaataaagctgctataaacatgggtgtacaaataactgtttgtgaccctattgtcaggctttttgagtgcaaatccagaagtaggattgctggattatgtggtaattccatttttaattttttgaggaatcatcactatacggtttttcacagcagcgacaccattttacattcccatccatagtgcacagccattccaatgtctctatatacttgctcactcttactttctgtttggatttcctaggatcttaacctccagaaaacataaacaaaagaagtgcatgatactgtatcacttactgtcatagattttaatgaatatatctgaaaattcgtttcaaactaagagctattcccaaatattcaacatctactgttctttgcttgataggagccacaaccactctctcctaaaaccaagctttttggttacaagtgatttctgtgtctgcaggtaaggttacagctggctttgtggttagtaaataatctcttggtaacagacttgcttcatctgtaggtgactgtatgaagtcaggccgagggctgagtcagacagctcagctgagctgctctggtggcgtgccatgagagtgtcacagccatatctggagcagattaacaagaaatgtaaattcccttccaaaaatagattccaagaagtagagaacttttaaaattactttctataggaatttccatgatgcctgaagctctaattaaaaagacttataaactctagctaggtaaagaatttttgaaaaactcttcctgcattctctatgtaagaataatacctagtgcttttttaaaataataataataagaagaagaataagaatattttgtgctgttattttcttgggcaaaaatttttagaaggctggaacaatcttgtaattttattctctagccttccaccattcctttacttataaaaaatagcattttaattaaaataatcctgaattccatgcaagattaaacacatgagaatagtcagcaatcttttggaacaaaaaaaaagaataaagagtgactttcactgtcagacacctaagtgtattatgaagcaacaatgatgaaaactaagtgataatcagcccatgggaataagtgcatagtccagaaaggaaaaaatgtccataaaatcattttggtatttaaagcaatggagcaattatgacctatttgatgaagacagtattatatgaacaagtggttaagccactagagaaagataaagttaggttcccattgtctcagaatttacatggaaattaattaaaatatgaaacaagtcttagtaaagatacagaacaataaaaacttccattccttactggtgagactgaaaataatacagctattctggaaaacagtatgccaacttattacgaagttaaacatacattgtgtctgtggtccagcaattctactcctgttatttgtccaagaaatatgaaagcatgttcccacaaaaagactgttataaaaatgctcacagtagctttatttataatagcccaaaatatgtaacaacatgggtgaaacaaaaaaacactgcattaggaagaaggccagacacaacaaagaatgcactatatgactacattcataggaagttttagaataggccaagttaacctatggtgatagaaatcagaagaggaatgtcctgaggcctgcagggtttatgggaagaatgaactagaacaggacatgagggccctttctcagggaagagaaatgttctacattttgattgtaatcatggttacatgaggcatgtattttccaaaacttgtcagtacaaactttataagtctcttatgtatctcaataaaaattaattgggaaaggtttaacatttaaaggaaaagactgacaaatataactacttcaaaatttaaatttctgtaggatcaaaaagactataaataaaagatgagtaataatgagaaaaaaatcattgactatgagacttagtttagtttaattaaatttaattaatttagagagaaatctcaaaattgaaaaaacatgaaaaactgatgaacatctgaaaggaaaaatgaacaaaagttataaataggcaatttgtgaaagaaatatataagccccaaacaaaatttaaacaaaattttaaatgtgtgatgggccaagggctaatatatctctaatgtaaaagggtttatagaaataggtagaaaatactgtatatttggatttttaaaaagcaggcaaaatataggaataaacaattcacaagaaaaaacacacactcaataagtgtcttaaagtgtctagactctctagaaatcaaggaaatacaaattaaaacaactacataccatgtctgaccctgcttctgctttttcctgcctctgtggttttctctttttttttttttttaatttgtttgtttttccttttcagaaccactgattctcaactcaatgcctgggaaacttttattaatgttcaagttatcaacttggacaccacttctcaggtagcttcccctgactctcaatgctaataggagccctgctttgcaatgctataccactcagtacgtcccctagcagagcacttatcacactgcacttactatccagttttcctacaatccccacaaaatcagttctgtaagggcaatgctacagtccaagtgcctaccaagcacagtacctggcacatataggtgcttaataaatattccttgaatgttttattgagtaatatagcattttcaaattgggaaaagctaaagaaaattatcgagtatcagcaagatttaagttgtggcactttcactcactactggtagaagcataaacagttataatgttttctgaagatgtagtagatggagttctccagagcaactgaaccaatcgcatatgtagagagaaataatttaccaaaaagaattggcacacatgattacgtccaagatctgcagctggccagctggagaccagggcagccgatgggataagttctactctgagtctgagtctaactcctaaagcaggagaagatcaatgtccttcctcaaagacaagcagggaaaaataattctttcttgctcagcctttgatactattaagggcttcagaaaattgcatgaggcccagccacgttggagagggcaatctgattgactccaacctgtgattctaatgttaatctcatccagaaactccctcacagacacatccagaaataatgtgtaaccaaatatccgggcaccctgtggcccagtcaagttgacatataaaatcaaccactgcagaaggtaatttgccaacatttaatagaactcataaaaatgcttaacttttttgacctggcagttcagtcttgaacaatgttttctaagaaaattatcagaaatatgtctctgaatacctgttaatggcatctctttgttcattggttgtaagataaaacaaccttaagagtgattgaataaattataaattacaataaaatataattcaaaacttaacgatgatatataatatagacttgcaattattgatataaaaacatattcacaatatgttaaatttaaaagtctatcaataaagacaattgtaatatgatctaattttaattttaaatatacaatatatacaatacaaaatatacaataaaacttccagaaacttaaaatgtagtgtgtcttctttgggtctgaaattatgcatgagtttttttaatttttcttttcattttatgatcctgatatttcctagttttaatttcaatttaattaattcaattaatcatgtaatttcaaacaaccaaaaaactaaccatgtgctttgaaagcttgacttacataggctacatctcaaaagtctgttccactcaggattaaaattaaagcaattagcttagttagatccttttcccttaagcgtttcatttgctgtctactaaaaataccgagctctgattgctttgctcaccagcctaaactattcctcctgatagagcctcagcaggacaagagacaagatgatgtttaggtagaggattgaaagtgatctgaaaaactgacaggtgtggtgtggtatatccatacaatgaaatattcagcctcaaaaaggagaaaatttttgacccatgctacaacatggaggacattaagctgagtgaaacaacccagactcatgaagacagacgctgtattatttcaggaacatgaagttcctagagtagttaaattcttagagaaagtagaatggtggtcagcaggggctggcggggagtggggaatggggagttacttaatgagtgcagggtttctgttttgcaaaataaaaagagttctggagatctgtcacacaacaatgtgaatgcacttagtgttactgaactgtacactgaaaaaagattaaaatggtaaattttatgttatgtatattttactgtaacttaaacaacaaagctgacatatctgactgggggaaaaatcagagtcacacagacttgacttgttgaaggatttagaactgatgagggctgacacagtggctcagtcttcctgccaaatccagggctcctccccttcatcccgccacctttcagaagctgagctctaggcacatcagagcaattaagacagatacttctatattctcaatctatcacccctggaatgaaagcaataatagtagctaacacatacagggtgctgactatttgccaggtagtattcagaaaacactttacatgcattgaccagataattctcacaactctgtgagggaagaattattatgaaatctcattttacagatgaggagcctgtgtctcagagaggttaagtaattttcccaagggcacgcagcctgcagtgggatagctacaatgcaaacgcacgcattatagccctagaatccatgtatataactgttgtaaccatgattcttatactttaaggaatcacctgaaagatttctcaaagctgtttcctggactccatcccaagagagtagttggtgttagggcccgtgaatgtgcctctttgacaagctcaccggtgctgccagtgctgctcggctgagagctgcatgctgagtggaacaaggattgcagcacactgtaagtgttgcaataaagcaccccagttatgttctggaattaaatctagtaaataatcaataatggatgagttacccgtggatcaaattaatttaccccaaatgacttgctattgatatgctcgtatttggtagcaatgtgagttgataatccaatttaaaagctgttacttattcaactctattgcagcaagtatgaggcaatgtgttctcatgacaagacggctgggaatctagagaaatgcaaaaccaaggaatatcatttagtgtaaaaccaccataacagcacaacacggtcttttaatcactacagcatcattttcagatgttacagaagttacagtatgactatagcattccacaaaatcctcacactccccttgctctcagtctatactctgcctttccagaagaggttgccttggatacaagtattgtcatgcctgtaaattttatcccctgtggcaagttagcaaattggcatccaggtttaataaatctgtctgttattaatgaataaatctagtctttctagcaagactcatacccacaatgcttgataacctctgagaaaatgggtaaaaccagttggtggactctcaaagtggacaattgcaccctacacccgtgtgacccaggggagcacagggaccccatgaactactcccccatgggaatgagtagtatccctctctcttgagactctgggactgcagttagtgaggttgggttctgaaaagatgctttcacatccccaattatgactaccactctagacttagaccagctgccctagggagaagaatgacagccccacatttaataatagatctcaggtttcaccttcctcactaggaacaatccgctcagcttagaagctctggagctgttttcccacaccgcaaggtcttctatcggtttgagagcccctggagatggcccacgctggtggcaacgaggcatagagagtcacacgagatcacttagctccccagtcaggtctactgcagtatgagaaacaggggagggaaatgttagctatttaaagatactagaaagaaaaacacatggcgtgaacatttttattaggtcataaggggtcaggcctaatagaagattatcactttattactggattccattttatattaccctgcctgaacaagactctcacgatagcaccaacagatttggctttaatgacttctccctcataatttctaatcacctacacttaaggaccattccccaccacaggaaagtgatggtggggaaatacttcactgcagtgaagacccttaaactcccaagattcagactcacctccctgagccccgagctcaccagtgagtccctcaagactgggtaatgaataacaccaagcattcatctatgaaggagttcctaaataggatgaagtagttaaaaatattttttaagaataattaaaaggcattatggaaaatcctgaaatatttcttttttttttttttttttttgagacagcgtctggctctgttgcccaggctggagtgcagtggcgcgatctcggctcactgcaagctctgcctcctgggttcatgccattctcctgcctcagcctctcaagtagctgggactacaggagcccgccaccgctcccggctaattttttttttttttttttttttttgtatttttagtagagacggggtttcactgtgttagccaggatggtctcaatctcctgacctcatgatccacccgcctcggcctcccaaagtgctgggattacaggcgtgagccaccacgcccggcctgaaatatttctaaacagataaaaaatagggtcaaatatgaactcattcttccttatatagaacatgtcctactagtcactaaggtgcccaggtttcttaattggtttgttctttgagctaatacctaaaagatgactaacatgggaaatgaaacccaatggccgcaacgtccttaaaacccatgcatccaaacatcctgtgcctctgggtagtctatggcaggctgaatgacagtcccccttggatatccctgtcttaatccctaggacttgtgactatgtcaccatacatggcaaaagggactttgcagatatgattaaggctacatatcttgagatgggaaaaaaatgacccttgattatctgagtggatccagtctaattgcatgagttcttaaaataggaaggggaatcaagggaagtgtatcacagagacagcagcatgaggattcagtgcaaatggctggttctgtgaggtaggaaccacatgcaaggatctgagaaaagttataggagctcagggcagccttcacttgacagccagcaagcaaatagggacctcagtcctacacccgtaggaactaaattttgccaacacctgaatgaacaaggtgatctttttctcctagaatctcaagaaaggaacacagcactgccaacatcttcatttcaggttagggaaatctgtactggatttaaagaattagaaaataataattttttgttgttttaacctactacatttttggtcatttgttatggcagcaacataaaactaatgcacagttttcatccaagttatacttctaattaaaaccttaccactttaacaaatcctgttctttctagccacagcctcttagcatgaactccagtttctttttgtaaagtaatcctctataaccttttatactaaactttctatactaaaagcatcagtagatttccttgctgtatttcagcccaaattagctgggcttgactaatcacagcagggtcatttaggagtgacataatcctaaacacaatcctgaaggtgaatgcatgctctcttttctgacattaaaggtggtttcaatcacgtctggcaccgactgaaaaaatgtattctggaatgcctcaggatgaaggaaagaaaaacatagatactgatcttccaacatcgcaatctggttctaatatcagttgtctacaggaagaattcactgttagagaatgatttcctcaagtctatttttaagatccctttaatgtagccatctgctaaattatcttgatacaaatgaggagaatttcagtgaacatctgaatttccttgtttataaaacgaaaactagatcacattccttatctagcctggtgataagaactaatttgatgtatacatatatcagtgtgtgtacgtaaatcatatacacagatttatactacatatacacacatgtgcaccaatcaggataagctagtttatgctgcatcattatctctgcctcaaacaaaccacccaaacttagtgcctgaaacagctcaggtttactccctcccagttctgtgtatcagctgtttggagtggatttggctagaggttcttctgttggtttcaccaggggtcactcatgtagccgcaccatggggtagcatggtccaagacaaatccattcacatgcctgcttgtgggtgctggcagtcagcagaagttgtgaagcctcagaaggcttttactcagaacagcctccatgccatttctcagtcccctttgatgtaagcaagtcacaaatccagcctaattccaaacgggtagagaaagaaaatctactccttgatgagaagagcaataagtcacattgcaaaaaggcacacacggtggtgggaagaatctgttgctatttcaataatccatcattacccccaaatatcaaagatttatttttattcccactgcatggccatcgtggttcactgggggctctgctgcccattactgctcattccaaaatgcaaagtgatggatgattctgccacgcagagcatgctgtgctggttatcagaaccaaggggaaaatgtcagagaagtggcctgcaggaaatgaaatacttccatccaggagtgacagttgtcactcccagccaactctaagtaagtcatatggccacatctaactccagcggagttggaggtgatttcttacaggtgcctgaaagaggagagctcaagtgagaataagtagatcaaacaggtagcacaacatacatgcatgctctcacacacacccatacgtgacatcaatctaatagtttgtcacaggcagctcaaacatttggaactacccaaaactctatccgtgttctggaaatgatagtctctgactataactcagttaagaaagaacaagaagattgatagtgtttttgtcatttccgtaagaaattttgttaagaatactctttcttatttgttccagagataatgatataaatagaattcacttgtcaatacccaattacttttgatcagacatggagggattctatctacaaactgaatcaaaaaatcaattgtcattttgaagtcagtacattatcatttctttgtaattcaaagctgtggtagttagggctgttctcaaatggtctttttctccttctggttgtactttcatccacttaaatgtgatcatgtgactttctttagtcaatacaattctacgttatatttgcatgctattctatactataaagcattattatatataaaaactcataaagttatcaggataataattggaaattagcttaatctcatgcaaactgcaaaaaaagatgattctacaaacaatatatgtgctaaaagaaaaaatgacaagataaataatactgaatcactacaatctccaactaaaattgtctgactcaactaaggcaataaatttttaaaaactgaaatcaaagtagaaatatattttaattgtattatatttcttaatgttttcttatatttaatgttagaatatttgcaagtctacaatggaggaggagagatttataaattccagctgcctataatagctcaactttttcagagacgtaaatttttttcttctaagaagaagtttttcacttcatgtagaagattatactaatatttacctgaacccaaattagggaaggtttatgtcgttgttgtttaacttaatatgctacccacgttaattagctatactgagcttgctttcttattttctcttagtatcccacatttataaagctatgtgctattctcaaaaagttttaggtagcagtccttgtaaggagttgaatgtgacactcagaaaaatctctagaactggtgaatgcaactttatttggatagaaagttttgcaaatgtaattaggttaaaaattttgagatgagattatcctgggttacccaggtaagccctacatccaacaaccagtgtcctgataagagacacagagaagaggggaaggctgtgcacagacagaggcagagactgaagcaatgcatctataagccaaggaatgccaacaattgcccacggctcccagaagctaggcagaggcatggaaaagatttccctcagagcctccaaaaggcaccaacactatcgacaccttgattttggacttctcatctccaggactgtgagataatacatttctgttattttaagtcatggaagtttgtggtggtttgttgtggcactcctaggaaactcagcagcccctatcgaaccatgcctccctcatcgccccaggctggctttcccttccacctcttctatattggcactccccaacaagcgagcagggccatcatctctgaattaacactatctagaattcatttcaccgtctagcctcctttgagttctgcagaaaagcagaggttgttatatcaaatacatcagatgtcaattgcaaatgtaaatttttaatcgtgtttcctttaggtgctgtgatgcatttgatgcagaaacagttgagctctactctaaatgcagagtacaagggacaggggagaaagaaaaatgagccatgcacagtccctccccttccaggcagctatatgaacatgtaagctataaaccacggtatatattccataacgatttccattttctttgctcctgttctgttttccaggactgaaagttgcctctagaagatgccacagtctgctgtcagttattttcttccacccattaaaatgcaaattggtatttctatgtaacatgtgacaggtttggataaaccgtgggattctctcctctcaattctttactgattgaattttaatctggattgcctatcaaaactcagcctattccttgaagttcagataaagtgtcacatccacaattaaaggtctcactgttacccccttacaatgcactttttatacctgagaaatgtgattacatttatttaacttactatgtttcgggcaccatgatttcatttaatcttcagggaacacacctaccattagatactctttacaaatgaggaaacaaacttggcagtgttcaggaacttgtctaaagtaattgtattagtgagctagagatgcataacaaagtcccataaacttaacagctgaaaacaccaatttattttctcatagttctgccagtcaggagtccaacacagaacagatggattctcttctcagcctcttacaaggtgtcagctgggccacattcttttctggaagatccacttccaggctcctccttgttgttggcagaattcaacagtggtagaactgaggtcccattctttgacacatgacctccatctgtgagcaagccatgacatatcaagccctgctcatgccttggttctctctggcttcctctctctgcttttaagggctcctgctcctgcgataacatcgaggccatctgaacaatccaggataatctcctcatctcgaaatcaactgattagtagccctaattacatctacaaagtctcttttccatgtacagtaacatttccctgggtttggcatcctatcatctcagttcccagtgattggggtgtggaatgttcttgggccacgattctgcttaccatagtcactcacaatcagtaagggacagaccagggatttaaacccaaatttgttttagtctttgtaccatgtcctgcttcctctctaggacacaccttaaactaaagctgcagatgttggtgagaagagagagtgtgatgtctaagaccacagcctctgggcagccctgcctgaaggcaaatcctcagccctctcatcagtagaatgagtataaaataatgtctgcctctagggttgttatgagaattcagcggcttaatactcgaaaagggcttgtttattactttgtctggcatatagttagcattgtagaagagatgttaaataaataaaagtaaaggaacataaggcaggagagtaaaagaacagcagtgtagaaggcattttgcccattttattataccatgataattcacaacgttttaaaaggtgaaatatttgtaattgtaacattaccctacttttgagctaatagtttaagatgtagccttgctaggtttcaacctatttttggacaaggagtatgacttatatgcattagatacttactaatcaatcagggagttgaactggattcaggaaagttatataacaagaacttcatgattctttttttttaatattgcctatttccaggcagattattagtggaaaaataattataaggagagatttttcaaaatatgtttaaaagcttttgtttttaaaatgaatttggagagagttctatttattgaagcagatgctctgactggaagcaaaatcaaaatctaattaagaaagagttacaacaatctccatgactgagagacccttgatgggcctagggcactagagctgacataacaatagatgctgggtctgatgtgtgatagggagggctctatgaagctcacatctgcccctaaaatgccacatcccctggccaaccacagctatgctcttaatgtctacaaaatatcttcattgatgttcattatatctgggaggaacaaggggcttcatcaatgaaagagcatccaggaatttatcagatggttgagaggaatgaaagcctgatttcttccttgatgatgatacttacagaaaacagattcaaatttgctagtaaaatcatagcagtgagtaagagtaggaaaaaaataggtggtgcatcttcctattgctgggtggggtgggggcaaaggaaacaaaaactagatctgcagataatagggaaatgaaagaaaagaaagaagaaaacagaaagcaagaaacaagaaggcaaaactaacaggtaacatcagttacaacaacaaatgtgagctgaattcaattacaaaacaaaagattcacagcatcataaaggaaattctattatatactatcccaagtgtatcccacctaaaataaaatgatatgtggtttaaaaataaagtgatgggtaaaatatattaggtacacgaaatcaaacacagaaaagtagagatagcgatattaactaaaaaatcaagctcaaggcaaattttttttaaaaaaagataaaaaaggtccttatatgagtataacaggcatgttccaaaataaaactacatgagacatgaaatattttttattgacttcttgagtccgtttttttctacaaattttaatacatgcataccatgtgcctggcattctgttgaaaactagaaacacatttaaactagacataattacagtcaggactttaaaagtttagatttcaacactcccacttctgcctcaacttgcagcttcctgttgtccaggaaaacaccctgatggcagggtgggcaactctacctacccccacctctcgtagccaggaaagctttacctgttagagcttccagcctagaggctctacctctgcctgaatttgccaaagggtacagcctcctgttgccctggaaatacctggattgcaggacgggcaactctatccaccttacttcttgtagccagatgggccacacctgctagagcttcctgcccagtggcctcacttttgtctgaattctgcaggcaggcataaccgtatgttccccttatccccacttggacagtagatttgggttgacctggaaaggatatagcctgtctgccagctttggcccctgcccgagggagacacatggagcagaacacccaacaaaagaaatgtgggcatgaagacagtaatcaaagagggctcctccaagacccaggagtgaactaaaattgaagccagtcaactgaacccactttatatcacaaagaaacccccaagagcatcaaagaaaataaaaacaaagaaactcacccaaaggataacaaattcaaatactgaaggaacatcagcccacacagatgagaaagaaccaatgcaagaattatggcagctcaaaaagtcagagtgttttcttacctccaaacaaccgcactagttccccagcaatggttcttaaccaggctgaaatgtcagaaatagaatttagaatatggataagaacaaagatcattgacatcccggagaaagttaaaacccaatgcaaggaatctaaggaatgcagtaacatgatgcaggagataaaaaacaaaatggccatattaagaaagaaccaaactgatctgatagagttgaaaaaatcacttcaagaatttcgtaatataacacaaatatcaacagcagaatctgccaagctgaggaaagaatctcagagctccaagagcagttgtctgaaataactcagataaaaataaataaaacaataaggaagaatgacaaaaactttgagaaatatgggactatgtagagaccaaacctaattctcactggcatccctgaaagaaagggagagaaagcaagcaattagaaaacatgtttgaaaatatccttaattaaaattttcccaaccttctagaaaagccaatattcaatcaagaaaatgcagagaacccctgcaagataccttacaagatggcaattcccaggacactaatcatcagatcctccaagatcaaaatgaaagaaaaaaatgttaaagacagccagagagaaggggcaggtcacctacaaagggaactccatcaggctcacagcagacctttcagcagaagccttacaagccagaagagattagaggcctacattcagcattcttaaaggagaataatttcaaccaagaattttatatctggccaaattaagattcataagaaaaggagaaataagatccttttcagatatggaaatgttatgggaatttgttaccactagacctgccttactagaggtccttaagcaagtgctaaatatggaaagcaaagaccattactagctagcacaaaagcacacttaagtacaaagaccatcagcactattaaaaaaaaaaccacacaatcaagtctgcataataaccagctaacaacatgatgacaggatcaaacttgcacatatcaatattaaccttgaatttaaatgggctaaacacctcaattaaaaggcagagtgacaagttgtataaagaagcaagacccaactatatgctgtctataagagacctgtctaacatataatgacactcataggctcaaaataaagggatagagaaacactggcaaagcaaatggaaaacagagaaaaagcaggagttgctattctaatttcagacaaagcagagtttaaatcagcaataatcaaaaaagacaaagaggggaatgacagaatggtaaagggttcaatccaaaagaagacctaactatcctataaatgtgcagccaacacaggagcacccagattcattaacgaagttcttagacaccgacaaagagactttgataaccatacgataatagtgggaaaattcaacatgccactgacagtattagacagatcatcaaggcagaaaactaacaaacgttttcaggacttgatctcaacatttgaccaaatggacctaagaaacatctacagaactctgtaccccaaaacaacagaatatatagtcttctcatctgcacattgcacatacctctaaaatcaaccacacaatggccataaactgtcctcagcaaattttaaacaaccaaaattataccaaacacactctcagaccacagcacaataaaaatagaaatcaatactaagaaaatcactgaaacccatacaattacatggaaattaaacaacctgcttctgaatgacttttgggtgaacaatgaaattaaagtagaaatcaagaaattctttgaaactaatgaaaacaaagatacagcacactagaatctctgggacacagctaaaacagtgttaagagggaagtttacagctgcaaaggcccacatcaaaaagttagaaagatctcagattaacaactaacatcacagctagagggaccagagaaacaagactgaaccacccccaaacctggttttgaaataaccaaaagcaaaactgaactgaaggaaattgagacacaaaaaaacatataaaagatcaaagaatctacaaattgattttttgaaagaataagtaagattgttagaccactagctagaataattttaaaagagagaagataaaaataaacacaatgagaaataaaaaggggctactactaccaaccccacagaaatacaaaaaaaccctcagagactactatgaacacctctatgcacacaaattagaaaaactagaggaaatagataaactcctgcaaacatataacctcccaaaattgaaccaggaagaaattaaatccctgaacagatcaataatgagttgtattaaatcaagtttagcctaaagatgcctccttacattttttaagtttggcctaaagggttctctgttcatagtgaatataacctaaatggaggtgtaaacagactgtaatttactcttgtgccaatcactgagttttgaccaatcaaagagggcaaatgttgaaactgtatttaaataagacaaatgctgagctgtttctgtatcttactactgttttctgtatatcattttccttgttctgtctataaatcttcttccaccatgtggctgcactggcatctctctgagcctactctggctcaggaggctgcccacttcatgaatcattctttgcttaaataaactctgttaaatttaatttggctaaggtttcttttttaacagttccaaaactgaagcagtaataaaaagcctgccaaccagaaaaagcttagaaccagatggattcacagccaaattctaccagatgtataacgaagagctggtatcatttctactgaaactattccaaaaaattaagaaggaaggactcctccctaactcattgtatgaagccagcatcatcctgaaaccaaaacctggcaaagatacaacaaaaaaagaaaactttaggtcaatagctttgataaacataggtgcaaaactcctcaacaaaatactagaaaaccaaatccagcagcacatcaaaaagctaatccaccatgatcaagtagactttattcctggggtgcaaggttggttcaacttatgtaaatcaataaatgtgattcaccacataaacagaactacaaacaaaaagcacatgattatctcaatagatgtagaaaaggcttttgataaaattcagcatcacttcatgttaaaatctctcaacaaagtaggcattgaaggaacatacttcaaaataataagagccatttatgacaaacccacagccaacattgtactgaatgggcaaaagctgggagcattccctttgaaaaccagaacaagacaaggatttcaactctcaccgctcctattcaacacagtactgaaaattctagccagaaaaatcaggcaagagaaataaagaaaagccatccaaataggaagagaggaagtcaaactatctctgttgacagacaatatgatttacacctagaaaatcccatagtccctgaccgaagcttctagatatgataaacaacttcagcaaagtttcaggatacaaaatcaatgtaaaaaatcagcagcatttccatacatcaacaatgtccaagctgagagccaaatcaagaatgtaatcccattcatgatagccacaaaaagaataaaatacctaagaatatagctaaccaggtatatgaaagatctctacaatgagaattacaaaacactgcttaaagaactcagagataaaaaaaacaaatggaaaaatatcccatgttcatggacaggaactatcaatatcactaaaatggccatattgcccgaagcaatttacagattcaatgctattcctatcaaactaccagcatcattcttcacaaaactagaaaaaaaactattttaaaattcatatggaaccaaaaaagagctccaatagccaaggcaatcctaagcaaaaaaaataataataaagctggaggcatcacattactcaacttcaaactatactaaaacacaacagtaaacaaaccagcatggtaccagtacaaaaacaggcacatagatcaatgggacagagcccagaaataatacctcacacctaccaccaagtgatctttgatgaagtcaacaaaaacaagcaataggggaaggactccctattcaataaatgatggtgggataactgattagccatatgtagaagattgatgccggaccccttccttacatcatatacaaaatttaactgatgataaatccaagagttaaatataaaacctaaaactgtaaaaacccttgaagataacctaggacatgccattctgaacataggccctgacaaaggtttcatgatgaagatgccaaaagcaattgcaacaaaaacaagaattgacaaatgggatctaattaagagcttccgcatacaaaacacacaatcaacagagtaaaagacaacctacagaacaggagaaaatatttgcaacctatgcatctgacaaagttctaatgtccagaatctatacggaactcaaacaaatttacaaccaaaaaacaaacgaccccatcaaaaagtgggcaaggacataaacagacattttcaagagaagacatacacacaatcaacaatcatctgaaaaaatgctcaatatcactaataattagacaaatgcaaatcaataccacaatgagatactgtctcacaccagtaaaaatggctactaataaaaagtaaaaaataacagatgctgccaatgttgcagagaaaagggaatgtttatatactgctggttgaaatgtaaattagttcagtcattgtgaaaagcagtgtggtgatttttcaaagaacttatctttgaaaagttcaaaagaagtatcatttgacctggcaatcccattattgggtatatacccaaaggaatagaaatcattctcccgtaaagacacatgcacatgtaagttcattgcagcactagtcacaatagcaaagatatggaatcaacccaaatgcccaccaatggcagactggataaagaaaaggtagtacatatacaccatggaatactacatagcatattaagaataagatcatgtcctttgcagcaacatggaggaagctagaggcattaccctaagcaaactaatgcaggaaaagaaaaccacatattgcatgttctcatttataagtgggagctaaacattcattacacatgaacacaaagaagggaacaatagacactgcggcctacttaagggtggatggtgggaggagggagaggatcaaaaaactacctagtgggtactactattcttattacctgggtgatgaaataatctgtacaccaagcccatgtgacatgcaatttaccttataacaaactgcacatttacccctgaagctaaaataaaagctaataaataaataaaatgtttaggcttaagggtacattaatatgatcataatttaaatatatgtgcagaagaaagccagtggaaggagatacaacaaagcctgtgtaggcattatggtttctttttcttatttatgcttttacttattttataattttctacactaataaatgttataaaatcatcacatatttgtatctaagtggcttctttaaaccctactcactattttttatttataaatactgaaattcaaacaaagtataaaaatcaaaataagtattttaagagatttttaaaattatatattttattttatttcttagccaataagagaagctgaaaaaaaaaacagaatttatccagaaaaaggggaatgaaaaagtttagcgttaccagaggtttgcttttccagttcagatccctctcttggggatcagcaatgaaggcaatagggcaaggaatttcacctgtgcacaaacgaaattcttcttgctgtcccttgtggcacttctccataccctgtctaatggaatggctctgaaacaactgaggctgctccccaggcccagcaaagctcatcccctaaatgagagcaggaagaaatagctgcagcccaatccctgcacccacccattggctcccacccaatgctccagcctctgcctaagccaggagatgctggaggctctgctgaaattttttcatgcgcttctgagaagaggtgatccttcacaaatcatgacatcagcaatatggtcctctcaaagtgtctggcatttggatgcctatcttctctagtttccaatgctgatacagagattgaacatagacatatatgtaacaaaactatggaatagacccaataactgtattttatatgccagctatgtcaggacctactggagagtcaggtcccctatgttcacttgccatttagtcttcaataaagcagtatatgatgatagtatattatgaaatatttcaaatacttaaaaagatatgcaggatattatgataaacaatagtatatcaaccacatggcttaagaaacaaataagtacatcccacatggtcctacacaccatataatccaaatacaatttatcttcccctggcataatgtttatataaaaattatatatggttagaacctggggccagatggtataggcttaagtgtaatctctaccacacaattaagtaatcttaaataagttaccttacctttccatgcttctgttcatcatccatattatgagctgataatagtgtatacctcacaaagatgtatgaatattatgtgggtttaatatatgtaattgtatttaattacatatacatgcattcagttacatatattaactagaattctacagtcctgaagatcatttcttaattatactactttcttaattagactactatctttctaacttctattccatttttcacataacccagaaattcactatttaaaaattaaattatgggaacaagggaagaacatctctctcctcacttctattcaagatcatactgggagttctagctggtgcaataatacaagaaaagaaaattaagggtatatgggctggaaaaggaaaaataaaactgtagctgacattcttgtgtatgtaaaaaattttaaagaatcagcaattaaaaaatcataatgctaataagtcgttatagcaagattgaggatacaaggttaatttacaaaaatttatatacatatgaacaattgaaatttgatattaaaaataaaagcccacttataataacaccccaaaatgaaatcatatatatatatatatatctaatatatatatgtaatttatgtacagaaaactctgatgaaataaatcaaagaagatcaaaataagtggagagatagtctatgttcacagattggaagaatcaatgttaatatgctaatatattccaacttgatccatagagtcatcctaatcccaatcaaaatcccagcaggctattttgtagatatcaacaaacttattctacaatatatatgtatagaaacacaattcattcttgtatgtttattagtaccctgcaactttactgaatccattaattatttttttctttttcttttttttttttttttgagatggagtcttgctttgttgccagactggagtgcagtggcgtaatcttggctcactgcaacctccacctcctgggttcaagtgattctcctgcctcagcctcctgagtagctgggaccacaggtgtgcaccaccacacccagctaatttttgtatttttagcagagatgaggtttcaccatgttggccaggatggtctcaatctcttgacctcgtgatccacccacctagatctcccaaagtgctgggattacaggcatgagccaccatgccctgccccatttattatttctaacaggtttttcttgtgtgtgtgtgtacagactctgagattttccacatataagatcacgccatctgcaaacagaaatcattttacttcttccttctagaggtgtatgacttttattacattttcttgtctaattgctctggctaggaattccagtgttatgttgaattaagtggtacgagtgggaatccttgtcttgcttatgatcttagaagaaaagcttctagtttttcaccattgaatatgatattagctatgggattttaaatatagcctttactatgttgagataaattccttttattcctagcttgttgagagatttaattctaaaagggtgttaaaattttgtcaattttttgcatctatgaagattttcatgtgatttttaccttttattttattaatgtgccatatcacattaattgatttgcatacattgaaccatctttaaattccaaggataaatcccacttggtcatgagtatgatacttttgatgagctgttgaattcagtttgctggtattttgttgaggaaaagaaaactatatatggaaatgccaaagacagaatatccaatacaatgctgaagaagaacaaagctggagaactgactgacttcaaaacttactaaaaaactgcagcaatcaagatagagtgggatgagtgaaagaacacacacagatgaattgaatataacagaaggcccagaaatagacctacacaaaatattcaattgagtttaactatggagcaaatttaattcaacgaagaaaggattgtcttttcaacaaatagtgctggaaaaattgggtatacatacatacatacacaaaaatatagacatagaccttataacttttactaaaactcatgcaaaatagattataaatccaaatataaaatgcaatactacaaaacttctagaagaaaacataggagaaaaatctatgaaaccttggatttggaaataagattttagatacaataccaaaatgtaatccataagagaaaaatttgataaattagactttattaaaatttaaaatattggcttatgaaaaaaacagttttggtgggagtataaattagttcagccattatggaagacagtgtggctattcctcaaagactaaaacaagaaataccattcaacccagcaatcacattactgggtttttacccaaagaaatataaattattctaccataaagacacatgcacatgtatgttcaatgcagcactattcataatagcaatcacatggaatcaacctaaatgcctatcagtgatagactggataaagaaaatgtagtagatacacacaatggaatactatgcagccataaaaaagaatgagatcatgtactttgtgggaacacggatggagctggaaaccattatcgttagcaaactaactcagggacagaaaaccaaatactgcatgttctcatttgtatgtgggagctaaatgatgagaacacatggacacatagaccggaacaacacacaataacacctattggagggtgaagggtgggaggagggagaggatcaggaaaaacaactaaggggtactggcttaatacctgggtgatgaaataatctgtacaacaaatccccatgacacaagttcacctatgtaacaacaaacctgtacttgtacccttgaacttaaaataaagttacaaaaaagagaaccaaaagacaagacagaattaaaaaaaaaaaatttgcaggcctcatatcttaaaaagcatctgtatttcaaatgtacaaaaaactgaaccgatacctcaccaaagaagattagacaaaccaaaggcaaacaagcatgtgaaaagataatcagcatcatacatgattatgaaaatccaaattaaaacattatgttactactacacacctattagagtggcaagaatccaaaacattgacaacactaaatgctggcaagaatgcaaagtgaaaggaactctcattgatagctagtaggaatagaaaatggtacagccactttagaagacagttcgacagttcctcacaaagctaaatgtagtctcatcatatgatccagtgatgctcgcaggtattcacccaattgattagaaaacttatgtccatacaagagcacacatgtgaatgtttcatagcaaccttattcataatcactaaaaaatggaaacaactagttaggcatggtggctcatgcctataatcccaactaaatgggcagctgaggtgggaagattgcttgagcccaggagttcaaagctgcagtgcaaaatttttggaatctatccatctgacaaaagtctaatatacagaatttacaaggaacttaaacatatttacaaaaagacaaacaaccccattaaaaaaatgggcaaaggacatgaacagacatttctcaaaagaagacattaatgcagctaacaaacatatgaaaaaaacctcaacatcactgatcattagagaatgcaaatcaaaaccacagtgagatactatctcatgccaatcagaatggtggtgattaaaaagtcaagaaacaacagatgctggtgagtttgcagagaaaagggaatccttttatactgttggtgggaatgtaaattagttcaacagttgtagaagacagtgtggtgattcctcaaagacctagaaggagaaataccatttgacccagcaatcctattactgggtatatacccaaaggaatatagatcattctatcataaatatacatgcatgcatatgttcattgcagcactattcacagtagcaaagacatggaatcaacccaaatgcccatcaatgacagactggataaagaaaatgtggtacatacacaccatggaatattatgcaatcataaaaagcaatgagattatgtcctttgcagggacacagatggacctggaagctgttatcctcagcaaactaacacaggaacagaaaatcaaacaccgcatgttctcacttacaaacgggagctgaccgatgagaacatatggacacatggtggggaacaacacacactggagcctgttggggggtttgggggagggagaggatcaggaataatagccaatggatgctgggcttaataccaaggtgatgggttgatgtgtgcagcgaatcaccatggcacatgtttacctatgtaacaaacttgtatatcctgcacatgtaccctggaacttaaaataaaagttgatggaaaaaaatggtgtcttttaataggtgagtggataaaataaactgcactgcacccagaaaatcaaatcttattcagcaataaaaataaatgaactatcaagccacacaaacatggagtgaccttaaatgcctattactaagtgaaatgagccaaactgcaaatgctacatcgtgtatgattccaaatacacgacattctataaaagacaaaagtataaggatggtaaaattatcagtgattgtcaggggacagggggaaaggaaggataatgggcgaagcacaggggatttttaggacagtaaaactattctaaataataccgtgatggcaaatacatgacattacgcatttctaaagcccgtagaattttatagcgcaaagaacgaaccttagtgaatatgaatttaaaagatcattttgaggttgggggatcccaggaagaaatttaaaccatgaccagagaatctaactgtactatgaatgtattaaccacatgggtaaaagtgagaagaaaagtttccgacttaagtgactttggaaatgagtaaagtctatgaaacaaaaggcaacaggaactgcccataaacactgtactctagttgataaagttatatcccaaaaataagggctaccaatgctgatactacttacatgtacactggaattgaacaattaaatgaatgtcagatggtggaatccaggtttctcactgtggaagtgagaatttatagacaaacaaggaggaggctagaatgatatatgtggaaaggaattagagttagagacatcagtgtgaactcatgtttagcttaatatggaaataaatggtaacatacataaatatttatagatacatgtatatatgaaggttagcatatgtccctatattcccttgctgtgtcagctgtgcaggtctaatgaaacaacatcccagtagcaatgaggacatgtagcacccagatcttaggttctaatatcattctccagtggaagaagccagggctccctggagaaatggctaattctagtactggggcaggaaatatacatgataagcctagagtatcttatagagtcagatagtaaggaagtgtttaaaggaaaaccccatattaatgggagtgtgtcaaaggcacccaggagccactgaaaaaagttcccaatgaccaaaagttgttaaagattgtgtacaccaaaagagttcttaatgaccaatttgaaaaacaaaataataaaatattactggactataacccaaagcatataataaatattcatgaggccgaagaggtgtaaataagtgattagtaattacatacatttataaatggggagaagagacagtcttacgggtggaagagttcctaataatttatgtagatattctttcctcaagaagggggagcataagttctactcccgaaagtgtgagttgtgcatagcaactatcttccaaaaactgcagtgtcgaaaggaagaaaaaaagaataactgtatagaggagaaacctgaaaaacactacctcaaacaggtgatcaagttcaacatcaacagccacaaatcatgttgataatatgtgcctttgataaaatgagattaaaaaatggcactttacttctgtggtcactcttcaaataatccatagccctactctcatcatgaaaaaaatcatcaaaaaattcccaataaaggggtatcctaaaaaacacctgaccagtattctccaaaactgccaaggtcatcagagacaacaaaaggatcagaaactgccacagtcaagagtaaactgagacatgccaattaaatctaacgtggtatcatggctgggcatggtggctcacgcctgtaatcttagcactttgggaggccaaggtgggcggatcacttgaggtcagaagttcaaaaccatcctggccaacatggaaaaaccctgtctctactaaaaataaaaaaaaataaaaaaattagccaggtatggtggcaggggcctgtaatcccaactgctcggaggcagaggcaggagaatcactagaacccaggaggcgggggctgcaatgagctgagatcgtgccactgcactccagcctgggtgacagagagagactccatctcaatcaatcaatcaatattttaaaaataaataataaaataataaaaataaatctaacatggtatcctgaatggactcttggaccagaaaaaggacactaggtataaatgaagcaaatctgagtaaagtatgcatttcaatataatagtgcattggattggttcattaattgtaacaaatgtactctattaatgtaagatgataaaaatagggaaaaatgggtgtggggcatatggggaccctctgtaatatcgtctaaatgattctttaaatctaaaaacatcctaaaaaattaaggtctattaaaaatttaagttagataatgaaaatttcctttaagccctttaatgtttcctattacttgccaggtaaaattgaaacttcatccttagtactgagtaccatctcttatctttctcccctttccaactcacacctgttcaacatttcaggggacttctcatgtttctgcaaaaaaaaaaaaaaaaaaagatgccctcccacaattacctgctttagagatatttcttctgcatgacattccattatcctagatctctctcagaaaatggcttatctttgaagattcagcttacttgctccctccttagacaagtcttctgtcaccctactataatggattgattgggaacctcttctctgtgcaatttggcaactagagattacaatttagtcctgcttctcagtgtggtccaggagccaacagcaataggcattaccagggagcttgttagaaatgccgaatctcaactcatcccaaaccaaaagaaacaaaagtggcattttaacaagatctccagattatttatagccatattacagtttaaaatgctttgagtatctagaatttagctctccttaagcccttagcacatggttctctggttgttttaattgcctgtgtccttgccaagttatgaaatcacctgaggacaagggttatgtctcattttttttctttatcttcaatatgatcacagtatctggaacattcaggataaccaaaatgaattaatgactagctgaaggacacattaaatgagagtatgtattacaaagctttacagtttttataggttaatacctaacactatttttccttgccaaaatttgtgaacaactgagagacagtcaagggtcagaaagatgatgtacaaaacatcaaatttattgccaacaaagcaggtttggcagaacatggctttgttgtgtagctaagcagctttttaatactttgcccagaattaggcagacaaaaagcttacctggggtttccctttgggggtggggatctgctcttggaaaacctaaggcatggaggagcagccctgccttgtgctttctgcaggcagaatccaaagaaagtagaaagagaagtgcctttcaccctgctcagcttcatctgccaaactcacagtcagcccgtcacccttccttctgtgtgaccctgatgaagaaataaatactccctgcacccagtgggaaattcagaggaaaaaaggagtgaggaggaacaaaaggataaaagagaaatacaacacaagaactatgatcatgatgattttaacatttcacagggcagatcatgcacctgacactgagaaagaatactgaaaggtgcttgatttttagcatgaggccctccaacctgccacactgtcaatcaaactagaactgcacatgtggattctgagggtttaaaatgcctcattcagcctacaaccccaatgaggacacccaaactaaagggtgtggttacaatcacagtgttttatttaccgctgccagtggcctcattgttttccaacaacttcttcctctattgactagaaaattacataatatgaaatgtaatgacatccttaacctgttcagtaagtatcaactctaagcaaccaacagtgatcagctaaattctgagggagccagggacgtaaaaagatcctttaatgtagtctaatacaaaatacaagggctcagagtattgttatttaaagtattatttattctttgccttttatataccattgaatactacaaaacttgtttttttcctgcaaacctttgggtaatttacattatagtataatatgtatcctaataatttaatattaatattatgtattataattgcttaataatctcatatgtattataatcttcaatcaggcagaatgccatattctataagttcccaagtctttttgaaatgccatttaacaaatgtgatttaaggtccatgtgtgtattaccctaagtgattaagatgatgatactcactagtcatacacatttcaaaaatacacacagtcaagtttatcaactaccataattttgaaagttttgattgctgatagtattgtcaaggaggaacagagtcctcgaggccagtggctttacccgtaagcctgcaacacatcctaatgctcaagcagacatgcaaggcttgtttcccctggtcctttggaaaaagatctatgttagcaacagaggatgggaaacacttagcatgcatggccatacacctctagctagtgcccttggcaggcattactaattgatcacagcagacttctcccttgacctggatgttgctttctcgagtcagagctcagggcagccactattaattgattggagtttgcatgtgaaataaaaactatctgatatcccatgggcttctatgagctggaaactttctctttctccttcccccaaccccaacccaaaacatagctgtgtgtagatgcctcagcctctgatttggttgtgtgtgatctttttccaatgtcagctcaaggttttgattctttactgtcaggttgccagcatctacggaagtgtgtggcatatatttgttacaagaatgaaggaagaggtaaaggtaggtgatgaaaattaatgcagggattataggagaagaccaggtctgggcaaagtggaggtttgagcaatcccactactggcattcatttccaaaggccatgaaatctgtatatctaaagggtatctgcactctcatgtttattgcagcactattcacaatagccaaaatatggaatcaacctaagtgctcatcaatggatgaatggataaagaacatgtggcatatgtatacaatggaatactattcagccataaaagaaaataaaatgttgtcatttacagcaacatgaatgagcctagaggatattgtgttaagtgagtaagtcaagcacagaaagagaaatacctcacgttcttgctcatatgtgggagctgaaaagttgaactcatagaagtagagtagaattgtggttattagaggctggaaatggtagcagggagaaaaggcgaggtagatgttggttaacagatacaaaattacagctacataggaggaatgaattcagtagttttgctgcactgaagggtggatacacaatagcttactgtatattttctcctttttgagatgggtcttactctgttgctaaggccgaagtgcaacagctattcacaagtgtgatcatagctcactatagctgcaaactcccgggcttaagtgttcctcctgtctcagcctcctgggtagctgggactcagcacgccaccacacccagctagtatatttcaaaaagttagaagacaggattttgaatatttcccacataaatgataaatatttgaaatgatagatataattaccctaatttgatcattacacatagtatacatgtatcaaaatctcactctgttgcataaatatgtacaatgattatgtatcaactaaaagttaaaggaaaaaaaagacaagctttgaaatcaaataatacaacaataacaaagttcaggtttggactgactgagcctaaagtatctgtgaggcatcttcctcccctgacaccctctgctaccacacagaccccgggagcacaggaggtatgcatggttcagaacagggcctggaagctcacacaggtccagtcagtatttgttgatggaggctgaattcataagcccatggactgtatgtatctggagagcagaagggtctggattagcagcagagatctgagaggcattcaagggaaagtcaaagggagagctctgggtgaatagaaaataaccagataggattcatcctttattgatgaaagtgctggatgacagttttatcatttcaacaacccaagctgagactttaagaaaaatatgaacttttgctctttgaaatggattaattggccatacaatataaccttgcaaaaacacagaaaataccccatcgagactaaaacatgtcaaggaaaaagacttttggagagctatagatgtaataatataattacaaatacttataataacaattatatactacatatttattacatttgttataatatcacatattatgttatattgtaaatatatttatagaaataaaactgggcaaaatgtctttggaaaatcaagtgcactagaaccacagcccaccatgagtactcaaaaatttaaaaactgtgtctaagtttaggcaggctgaggaggttgttaaggattcacaacagatctcaaaactttggatggcttctgtgcaaacacccatccaggtctgatggctgctgatacaatgacatgctccagtgtatggcacactatatagtgtccagggaagactgcaaagtatttctatacctatttttttaagtacagtgcattgtactacatacagaattaaatattgttaaattatgcaggaaaatcctttaggtacataatgccatttgattgtatcttttcgtttgtttgtttttgtttttgagatggagcttcgctcttgtcacccaagctgaagtgcaatggtgcaatcttggcccactgcaacctccacctcctgggttcaggcaattttcctgcctcagcctcccaagtggctgggactacaggcatgcaccattatgcccaggtaattttatatttttagtagagacagggtttcgccatgttgaccaggctgatctcgaactcctgacctcaggagatctgcctgcctcagcctcccaaaatgctgggattacaggcgtgtgccaccgcgcctgaccttgattgcatcttttaagctgcgatcggatgaccctgttacacaagatcttcatttattattaatcttacatctatttcctagcacctatataacataactgtcctgaatgccagcatgtcaccaacaagacaaagctcttgccattgggaaaatacaacctaaacaaaattattatcactgaggaagaaagaaaatattggtctagcaataagaatgttatccctcggcatttctcagggagttagtcaccagatgggaaatccagcccatggcgaactccttcttagtggtcattcaccccaagaatttccctgggactttgctctgtcatgtaattaatcacacactaggcctgcaatctgatgttcactttagctttatttacaagagtaagatcaaaggaaaaacaacaaaaaaagagagagacaaagatggggggaagggaggagaggaagtgggcagaaagaaggaaacagaaagaaagaaaacagaaagaaaagatgtcactataaagggccaacatctggggaaatgggcagacaaactatattacgttcacatgacagaaactatatggctgccaaaattttcttttcaaaaaacttaatatagggaaatccttctactaaatgttaaatttttaaaagcaaaatttaaagccatatctatcagataattgcaattttatttgaaaatatttatcatacagaaaatgactatagaagtgaaaatagtaattataacttggtaactgtacttgtggattattttattttcttctatgtgtcttcctgtatttatttattcatttttttgagatggagttttgcttttgttgcccaggctggagtgcaatggcacaatctcggctcactgcaacctccgcctcctgggttcaagcgattctcctgcctcagcctcccaagtagctgggactacaggcatgcgccaccatgcctggctaattttgtattttttagtacaaaattagacagagtttctccatgttggtcagcatagtctcgaactcccgacctcaggtgattgctcgcctcagcctcccaaagtgctgggattacaggcgtgagctaccgcgcccagctgtcttcctgtatttattatcctgtagtgctctccaaacaagcatgctttattttaaaaagtaaaataacaaatgctacatttaaaaaatacatctgattatcttttgtggtttttaaatacatgtaaagtactcaaccaagattaaaaagtgtgaggtgttggggctcagaaaccaatacaccaaaatatggggttttgacacatgctgaactgaagcaggcccctctgaccattcgccccacccccactgtctctcccaaattgtaggataaagttgttctctgaagtttccctttctgcctgtagtccagatcccccgaagaagaaaacaatgtcctccggttggtcccttccctgagttttcactaaccgtactcccgtcagaggaaagaagattaaagtctgtcaacaaacctggacagacttttgtcacaaaccattttctgctccgcgggcccaagaggctttgttcaaagccactgtatgttctgtgagcctgtggaatcctcccttgtcatcactgattacccctcagctgaaatcttcatttccctttcccataacctgttttgccaggatccaagcctccattctttctgtaacctcaagacattgtataagcttctgcaccccatgagggggtgagtcttcattctgaaggctctgtgtatacacattaaataaatgtgcctgccttttctccaattaacctgcttttgcaagttgatatttcagcaaacttacagaggaccaaggggaatccttggactttacaggtatttccttgatggacagcaaaaagataacttgagttattaatatataattcaaacatatgtcctaacgcatatgacatattctaattaggaatcactaacatatactttgtaaataggaaccatagaacccatgcgatttgacatagtgtgtctatttagagtctagtatatttcatcatctcagaatcgagcatgttaagacagaataacagtaatatcaccaaaaatgagttttagaaatataaatatcctcagcgctccccccctcaatattttattggtggtcttgttatttatagtgaactactatcatgtaacaaaagccaccaatgaaaaaggaatacatggatgttgttatcttctcaggaaaggttttcaggtaaggctggtgtctacactgcagttttatttcatgacctcctcatccctgtctgggtgagacagccccataggagctggtagacttgatggattatcgaggctgaatagaagggccggataatgcagctctgtgtgcttggtcaaagactccaggatcacagcttagaccctctttttctgctctctttttgtcatcctatctcccgtggcctccaaagtgtccccagcacctctagcttattccccagggacctccacgggccatgcacagaacagggcagaaatgctggtctgatgatggtgtgtttcccagtgccattccagagctgccagctttatctcgcaccctctctaaagcttcccccaatcccagaagcccacacacatgctttgtaaaagcgactgtctgcagctaggcacaccagggcgggaatggagcagtgggaacccctcctgtgttcacagctttctgcttggggactggctgctttggtattggccagaaattgcctagtcagagccaggccctgggaagaagtgctaggcagagacggccccgaccatcacggcatcagcaccattttcatctgctaatacaaggcatttaaaggctccagagaactcacctgcttcaagaagcttttccaggatcactctcaatggaggacctcgattcttgcccatttactgacttttatcaactctatggctctactctgacctggctagctcactcactccatctatcttcctagctacctacctatcatctatctacctatcatttatccaccctgtgacctttaacatttctgcttatgtttccaaatttatcactattgtaaaactatccagtggactcccaaaactatgaggcagtccttctcgaagggtggtccccggaccagcagtgtcagaattacctgggaacatgtcagaaatgcaaatgtccaggttccgccccagacctactaaattagaaaccctgagagggtttaaaaataagccacccaggtgatgctgattcgtgctcgggattcagagctatggccgcagggatttaacacccaccagtatccatttaaatatatatatataatcataagctcttttttaacagttggaaaattcatatcattatttttgctccttggactcttcttccacagatttttatcacaatgtaatacatttttcaggcttgagagtcttttgtttgttactctatcacacttctctggaataaagttgtatacagaaatattatcacttaaaaaaaatttctgtctataagatactaaatattaaacgttttttctagctgttatatattataatttatgaaacatcaaaattttcataaatcttattcaaataaaatattacaaattcatctcctaataagatgagtgagaatctctttattctcagtagttcacatatcctcggatgaagtaatcatcttgcttactgcacgaatgagctgggagtcagcatcatttctattcttatttaacactaaatgttgaaaaactgtgtttgcataaataagttgatgagaacagaagttttgttaaaatagttctttcccaattaattgaatcttttctaaactatacaaccaaaactgtatagtaatctagcattggaaattatttttaaaacctaaaaacgtgactagaatcctcttcaactttgttgaaagagaagaactagagcctgcttatgtggtaacagaatgttaccccgctattaaaagcgttcttgtaatttttgtaatttctggaatatatatgccccccaaatattgaccaagacttatcaaatgactttcctgaagatgtacctttcttaatatacacatttgggaaaatcaaatgttgtgatttgtattattgtgtagtgatttttaactagaatatccatgtctatgatgatggctgcactgtaaagcttctacttaagggaatggcattggcacagcccctaatacaggtcatggtccctggatatgtgcaatgtggtggccctaacatgcttttgccttatcagttacttaaaatatattttcattaaaattaagcacgcaactcagtttatggaaaataaccttcgtgttgtctaattagccaaatgaggaatcgttgtcagcccaatcaagtcagccttaatttctgtcagagggggggaaaaaagtgtgacttaattttgagttaaaagtgttgatacgtaccccttgaccaaccctcttgcttctgaatttgtaactggacacagacataaacaagcagaagatgcttgctgtgcattgccaaccacacgaaataaggggcaacagttttcatgctaaaaccttagcctcagttgtcctggggctcatcctcctgagcaaggcatcctttaccaacaatcaggacgtagaagagaggtcattaaaaacaaaacagagcaaagcaccctttccactacccactctgacatagatctgaacacagtccattcaaaaacaggacaaagcccttctttctaccaggcctcactcgacaaagtgtgcgtagcccggggagataaacgtgggcgtctctgcactgtcatgggttggatgatggtccccagaaagatatgtccaccgcctaatatgcaaagcctatgaatgtgagtttacttgcagatgtaattaagttaaagatctcaagatgaaatcatcctggattatgctgggggcccctcaatccggtcacatgtgtcctcataagagacattcagagggagacagatagacagggagcagaacacaaggccctgtgaagacagaggcaaagactgaagtgatgcagccttgggccaaggaatgcctggagcccccagaagccggaagaggcaaggatcccccatagaacctccacagggagtgtgaccccgctggcaccttcatttcggacttctggcctccagaactgtgagagtataagtttctgttgttctaagccaccaggcttgtggtactttgccttggcagccacaggacgcagacacaggcattcaggctgaaggaggcttgccaaagccagtcttcctcactgcatagcatctgctgcttctcagcttcttggaagatgccagatgagcatgcccttatttcatatcgtaaggaaaggtgattataaaaaggggattgagaaagcaaaactggcatgaagactgaagaagtgaagcaaaagcatcttctaaaatggccaggctggggctggccaggtggggcctgtgttccagttaaggacaggcggaacccttacatgcatgttacttggtaaaacaaactgagatgtttgatgctttctttgagatctgagtttctggttctataaataggaacttacatgaatttagacttaaaaagaaaaagtcccctagagtccttgtcccttaataatgaagcagagaatcaggtctgggcagatcagatcataatttccagaaggataaaacagggatgacatattctccaccccagacccctttgcactttgggttcaaattagtcatctcttctccagggtttggagtccatggagttccattctcagctgtcctctcatccccatgaagaggagccatgggcttggccttgtctctgggcttgtgtcctcatcgggctccgcagtctgcatctcatgctcactccagctccagtgatgatcaaagtttgtgtttctcccttggttcgtgtgaaaggacatctgcactctacgtgcttgtcagagcgcatctgcagctcagcaccaagccaggatcaccggctagtagttcagaggccaactatatacataggactgcctgagggatacagtgcacccttgctccagattggtacttctgaaaatggaaggccacacactttcagagcctggtgaaggaatggactttcaaccatgtgctacacaatcatatttttgtgttcaattttatggaggtacacagacgctcccccaacaaagtccattcctatgaatcccagtggttgtagatatcctcaaagttatccagaccatcaaaaagctgtacacctggtcagaaaatttatttccctgttaagatgttcatcccaaactgcactttagtctcctgccatctgcttccagtaaggactcctgaacaaaagtgctctgcccttcctcacttgctttgcagtagaactactgtgaatgatgttcatcctaatatagggcattgtcttcatgacataatgagaagaccttctcccagatctgcaggcctaaaagagccaggcctccttggataagcatttatgttggcagagtccatgactcagcatgatatcctttatgtgatgcggagctggatttgctgatctcctctttgtagataagcctcgtcctggccatatcttttttttccctcaaccctgatttcctcacttatttctttaaaaatttattcaccaaggaagatgacaatatctggggcacatgctgaaggcggctcatttggtttatctctctctatggagttttcctctctcttttcctcctgctcctctcctctcccatcagacacttccacccagccatttccaaaagaagagctttcaagggctactcctcatcactgcatgaacctctctgggcatgagcaaaacactccacagagattgacaggtgcagctgagatggctttctgccttcatcccccaaagtgaaaaacaaataggtattaatataaattctgatgaatatatagattgtacaatgcttattttaaaaatttggtctcttggccaggcgcggtgtctcatgcctgtaatcccaacactttgggaggccaaggtgggtggatcacttgaaatctggagttcaggaccagcctgaccaacatggtgaactaaaaatacaaaatttttagttctctactaaaaatacaaaattagccagacatggcggcacatgcctgtaatcccagctactcgggaagctgagggaggagaatcgcttgaacctgggaggaggtggttgcagtgagccaagaccacaccattacactccagcctgggcaataagagcaaaactccatctcaaaaaaaaaaaaaaaaaaaaaaaagagagagaaaaagaaagaaagaaaaataaatttggtctcttgcagacatttgcaaaagcttcctcaagtctgtttttttttttaaataaagaggcataataataataaacagacaaatacatttcttaaatttctattatctgtatcccttgtccagtaataataccatgatctctgtcttgatgctttctgtccccagagtaagactgccgactacgttgccttttaaaaaaataggtatatcacacagctgcagttaactgacgcttggtcagttagactggtttttatacagtgttggttgttacatagcagtttaaataatatggccagttgttatgctcaacaacaatttagaatgcaatacatttcaatagaattaaactggctattataacgcaataaccctcacctccaggtgtatcttcaaagaaattacaaaagtaaattgagaagaacgagctttttagtttttcccctgagagatatccaattttaacaaagctattactggtctagtgttatcacatggaaaactgattcttagtaattcacaaacgaaggtttgtaactaattaggtcccctttgccaaaattaagacacaaaccaattacaaaattgacacttttaagtgtagcatcaaaaatgtttgcagctgttggcaataagaaagcagacgacaaattgtaacaatgaaaaaaaacaaaatcaaacacattttaatgcatgaaaatgtggaggaagttaataagagatcaaagggaaatgattttccgtagttacaaatcaaacaagacataaaccaaaaatgacttattgtctttagcttaggagccaccaaatcagagccctgaaaaacatgtttttgtacacaaaaaagtaaaagaataagaaaatgggattttgttaccctacttacaaaacaaagattttcttaatttgggcttcaatcattttaataggtgccattttgtgtttgaagtatatttcctcctttcgtggcccatcaatctgtgagagaaaaatgtcaaaggaccattttctttctaatgagtttctatgtctgttcttaattgtagatctttcatgttaccttattttaaatctaccgtaactcatgatatattttgccaataacttatgtcagttataacataaacattgaggagtttggtatgaaaaaattaataactgttgaaacaattcctctcaatttctttttatcaaattgcttagttcaattttgatcattaatatcccatgggggtcattgcacagagttgcctctttctgtagaattcaccagtgttttaatttttatcattttatttcactattaaaggatttttctcaaatccatgatatcattcagtgttttattcttgagctctaggagtaggttaaacgatatgtaaaatcctttctccttccagttcatggtgctgattctagcattaaccacctgggtcaaatcccaagggcactgtttacctgctgtgggacttagggcggttacgcaccagtacatgacttctatctaaaaaggaaggaagaatgttactgatctcacagagcagattaaaacaattcaatcactcatgcctagtccatgggaagctcctaacaaaatcactgctatcattgctgttctgactataattagtaataacatgattactgtttttgtagttttagttgtcatcttgctgtagtcctgagaaagcctcaattcccttctcaataaaataatgttgaagattcagggaaactttaaaatttataatgaaacgaacaaaaaaatcttggatgaagtccaagttacatttctatttttggcctgtggaagaagtttgcaccaactctcggtagatggaactgggttgagataaatttaggtaaataaaggttggacgacctttgatgttccctacagaatccactagaaagggtgaggcaagatgggcctagatgctgcattttgaagatctgaagatggacaaacctttctctgatcatttaaaaagcggcttgggtgcactgggggtgggagtatggctgcatagagtccagagacccaaacttggagaattgccaggtctccacgactctacccctgaggatggcctctggaaggaaaaagaccacaaccaaacactgagaaagtactaggggacgtcatcttgagacctcagctagggtacatgcctcagtcagaaattaaccacggcaactggagcctgactctgaatggagcctgagaggcaggagaagaggcagccagaagccatgagaagcatggagggaaaggcttctggagaagtgaagagacgatacataaaatttgtttttaatgtgtgataaaaacattttataaagtgatgagctgcattagggtgggaaataaagtaaattatatggtggatgaattcaagtgtgctactggctgtgcagaagaaaagacaggcaagacagaaaataataacctaatgaataacctgtttggaaagtttcagattgtataacaaagccagagggagagtaaaacatttgcagtttctcctatgacccggtagagtcaatattcaaaaaaaaattttagtattacctttaaaaataagaggttaaacaatttttgaaaaaacttaaaactgataaaatatttgacatgaccactggctcaaaatgaaatcaaaaccatagttataaggtataaatatattaaacatgagatctgatgcggtagctcacgcctgtaatcccagcactttgggagcctgaggggggcagatcatttgaggtcaggagttcaagaccagcctgatcaacatggtgaaaccctatctctactaaaaatacaaaaaaattagccaggcgtggtggcacgtgcctgtaatctcagctacttgggaggttgaggcaggagaatcgcttgaacccagaaggcacaggttgcagtgagctgagatcatgacactgcactctagcctgggtgacagagcgagatgccatctcaaaaaataaaataaaataaataatagagtaaaataaaaataaaaatagaatataaaaaattaaagcatatagccaagtatgtaatcagagggacattcatgctttaaatgctttcattacagatgagatgaaacaaagtgaactaaacaaactactaaagaaattcgcaaggccgggtgtggtggctcatgactgtaatcccagcactctgggaggcctaggcaggcggatcacctgaggttgggagtttgagaccagactgaccaacatggagaaaccctgtctctactaataatacaaaattagccagccgtggtggcacatgcctgtaatcccagctacttgggaggctgaggcaggagaattgcttgaacctgggaggtggaggttgctgtgaggctagatcacgccattgcactccaacctgggcaacatgactgaaactccgtctcaaaaaaaataaaaaaagaaggaagaaattcacaaaaggcactgcacaggaaggaggacgaggagaaggagaaaggaaagaaggaagagaaggagagaaagaaataacacaattgcaagggaagccttttaatttgaactaaatctgaaagacaccttttttgtttaaaaaaaaagacaacctcttgaaacaaaaaaagacaaacaaaaattttaaaaatcaggaaaaagaaaaaaggaaattgtcctcaaaaatacaaaattttgttcacgttcaaaatactgcatctgatatctaggctttagaggtagatcattttatagatgagttctttgaacctccaaagaaagaattagttcatataatagataaattattcagggcattaaaaaaaatagaaccaagttacccagttcattttatcaagctagtaaaggcacattaggccaaagagtgacaaatacaacacagaataaattaaagttcaagtccaatttcacttggaaatacagatgttgaacacaattcaactattcatgaaaaaataatctgccccataaagaattattgatcctattaatgcaagactagtttagtatgagaagatagatatttttgtatgtttagagatccaatatgaaaaactaagaatccttctatttgccaaaaaatgttcaaagaatttcaaaactatttgctatattttaaaagtgcaataacaaatagaatactttatagacatcattttacaaatctcacaccagcagctattatgcttaattttaaaatgttaaagacattctggttaaaatcaggaataaaataatcattgttattattttatataattctagtttacacagtaagatgtggaaataaagaaaaaaatcactaagaaggttaagatcaaagttattagcaactgcagaaaaaaaaaagattttaaaatccaggaaaattatttaaaaaatttctgagcattaggaagaaaattcaataaagcaacaagaagaaaacatcagtctctacctcaccaatataaaaaatccttaacaggtggggatattttcacaaacattagtaatataaagcactaaggaataaattcattttttaaaaaaccattttattatgaaaaataaggaacaaaaggctatgttctcagactggaacctgttgaatattttaatatgtccattttcctcagtgaatatgtagttctaatggaattctaatctaaaccccaatgtattttttcctggaacttcaaaaatatgactcaaaaaccaaaagaatgagattgtacaaatggcttaggtattttgtattaatagttttcaagtggattatttatgtttgatcactacagcagtatcataaaataactcgcgtgacattctcaaatgttgtcaacatgatgtcaaagttggcatcccaaaattcctgagcgatatttttcaatggttgtacagaaagcatctttctgttaaagttgtcgtgttttatcttgtttttaacaaagctgagacaaattttcccactgactttcactcacagttcaaaaatgtgctcttacaggaaaacctaaaagaggggaagggaaatagcctccagacacataaacacacccgagaagtcagatgaattctatttaacaacaacaaacaaattcctaagtattatactctataaaggcagagtgtcctggaaatgccatctggtgccgtgcaatctggattcctgtgagtgccagggacaagtggctgaaccgcaatgagatacggccaaacaccagaaacttcacgaaagaatattatcttgtaaatgtgttcagagaaaataattttgtccatgctgtttctgtgtgtgtgttttagattaatctttcccaatattttatacagcatataaagcatatagcgtatcaagtatataaagtatatatattgaaaatggagtggcatcctgtttctgtttttacaataaaggagacacttcttgagaactaagctcaaaacagttcctggctcactcagagtccttagtacttaactgtaggaatttcaaaatgatgaatgtcagatggtacaatacagaagaatagaggtaaattgtgaagtcagagagaatgaatccagatgcaagaacatcaattcgttctcacagttgcctgcaaactatggactaaacacaatgattagaatatctatttcatgtaaacatgctaaataatcgaacatgtaagttcaatcagagatgcaattaactctgcacaccaaaaatcaaagtgatgaagctgagcattcgcgaattgaatcagttcccttcgacgctttcatgctcccattaatatgtagctgatgccactttctgacttcgaaggacgatttattcttctgaggatgatttatatgagttgaaatgatacacttctattttattacttgtgcctactgaccttgagccactaccaagtcacagagattcacatcaaaagccaaagtcagattctgtcaccaaaactcatggtctcagggattctgtgattttttttttctggcatctaaactctgtctataaacacactgtccttgtggactgtaattactcatagaaggaccaagtgctgcttttatgaagtctctgatgtttgccatatctctggacagtcgtgataggaacctgatgagttgaaagctgactgtccgtcagccaccttgcctttcttctttctacaagcctatattattttaattgcagtatgctgctgctgattcttaactactttgccctctacaaagacattattagctaaagccctgtagcatctttgaagtaatgattcatttttttcttaaatcaacataaagttagcggactccctggggcattctcagcccaaggaagaatcacaagtatgcatccctgacaaaaaagaagcaagtctgttttttcccaaagttcttcagaaaaaaagtatcccataatttatcaggtaatgcattccagtgtctttattaactcaaaaaaaaaatctggtgtttaaccttatgccaatgtgtgaaaaacagaacttcactataccttacacaaacaaagctaatccatagaatcctgaacacaatgaggcatttcctcatccattccaccactgtcttttcatcaggattctgagtaagttgattttttaaaaatgaccctgattcagtatccagcttagggttcctaacattgaaatggaatcattcatcaaggtcacaattatgaaataatgaggtttccagactagaatctatgtgtttacctagtttcgttataggcccaatttaacaagtaatacgaattgtgatcttaggtaatgtagacttctattacagaccagccatagattcacggaaaatatacatgctaccctggaggtgcccttcactatccttgcacccattttctattttccacccatgcaccccattttccacccatgcacttggccaggaagcagcagaaaagagagattaggaaggcctttctcaggaactcaaatctatatcgcatgatcactcaggagcgttgggatataatgcgcttgcttgctaggacacccgtaacaaagtaccacagatggagtggcttaaattacagcattttgtttgatcacagtcctggaggctagaaacccaagatcaaggtgtcagcaggatcagttttctctgttttctctgtggactctctccttggcctgtagatgaccgtcttctctctgtcttcatgtggcttctttctgtgcatgtctctgtcctcatctcctcttcttatcaggatgccggtcatgttagatttaagacccatcctaataacctcattcttaactgaattacctctttaaagaccctgtttccaaatacagtcacattctgaggttatgggagttaggactgcaacatatcaattgtgtgcaagtgaagtgtggggacacaatttagttcatagcatagagaaagcatcagcattgcagcaacatttctcaaaaaaatgatggagttgttcaacactcctgacacaggtgaaccccgctggcaaattagtttctcaaaagcggaagtgggcagaacaaattatatttccttatgtgtgtgtgtggagaaggggagacaagggattcaagctgaacaagattattatttcattagcaacatggcagacacgcagacacacacacacacacacacacacacacacacacacacacacacacacacacagtcttataatcatattcatctgtttcttcccggacccctccttccaatgaaattccttctctttacccatctggcaacaagatgaatggcagcttttctagctctaggttgagtaactttcagttactgcagggagcaaactgcctttctgacaagaagaatgaaatatgaaagggtgacattgggtgtttcaaaactcctcctcagtatcttacagatattgcacgtgcttataacctggtacaatgacaaaggaaaaaaatgcctgtttctctgggaagcaagaaccaccatcaatagactgacatgaactaaaggaaatctaaatgctagaaatgatcaatgatgattagacaaatactaattttaaagcatatctatgtgtattgactgcaaatacttttgtaaagttattccttcgtatattgaacaattttctccagttcttatcataacagtttttcacatgttctatatagtttataagataactaaacttttcccaaatcaagtttacacaccaaaattatagttcctcttctttcttgcagtcatattgttaccatttataaccaaaattttgcaaaaagtgaagagaatccttttttttagaatgaacaatttcttaatttaatataaagtttctgttagagtgagattaatgtgatgtacaggggcaaaactgcccaaaaggtcattttatgtagataacaaaacagaagttagatttcccatcttcagaaacatttaggacgatgttgagcatgaaatccactcctagagctgtatgttttaggttctctcatttctccaagtcagtcagtttaaaggctctattcttcttgtttcccttaaaccttggaatactcttccaaataaaaatctatcaaagacctgtccaataagtgccaaatacttctaacaattttgcatgtgtgggtgtaaaacaaggcatttattcattaactatgtatttattaaactcttactcttctagtgctaagtcactgctcctgaaccagggaaaattttgcaacccgccctcaggacatttgtgatgtctgcagacattttcattatcacactggttgggggagagggttgcaactggcatctaggtaaagaccagagatgctgctaaacatcctaaaatgcacaggacagcccctccaccaaagaaatatctggtccaaactgccgttggtgccgagggggaaaatctatgtagatccttgaaaataaaaagaaagtcatagataaagactggaaatgattagaaacccacccggctgagcctggcctaaattgtcaagcagaaactatgagttaaatagttactgtttcaagcaaatacgtttgaggttgacgtgtttcacagaaatagttaagtgatacaaattgttaattgaaacaatgggcctgaatgagagcacccaaaatgatcttgtcaaaccagaagacataagggcagaaggatagaaggatggaatgctgacgagaggcaggtttcagaggactggtggagagaaagagaggagccagcaaaagtaagggcattgggggtgggggtgtcagatggagggagaaagaaaacaaggaagacagaggtaagagagtcagcatgaacagttacaggaaaggaggggaaggcaatcagatgaaagggagaggccagaaagagaaaaagtattaataggaatatcctgttaaacaatacctctttaacttcacaccttaaagaaaaaacaaagctagattccaggaatttgtttttaggcacagggaccacagttgggctgacactttactggcctcctgaaagaatgaacagataattgagattctggtcagtgcccataataccagaattaagggcaaatccctctgccaacagctggagaactgtcctcactgggcagtgaagacatctcatgtgtagccaccaagatttcatcatggccatggcttgtcactgtcaggagcactttcaggtatgatactgttaggtggggctatagatttgaaaacttgtcaaaccaacatcctccaaacagaaggctgaattaaaaacaataactaagtctataatactgatgggtgctttaggcaatgaagctcatctgacaggtccagcaggcatttgatagaaggggagttgttccagggagcctgtactctgtagagcgtcatgagggcacccactggtggaaggagcaacagggccacatggagagaagagggggactgtacctgcacaggggctccaacaacatatacacaaagcacccctgatcagcaggagtgacaggaatgaggtagaccaatccccggtaagctatgaggaccagcctttgagtggaacttaaatggccaccaagaaaccatgtgaccttcctcagaacatgaaagaacaaagtcttggggaaccttggcattcctgtcactctccatgtgaagatttggaagcttgcttacattgcatctgtgcctacaactgtcctaggtcagttggagtggataaggaggcaggactggatgtcagaaggagattttattcatagtcttcaaaggtaaagcatagctgctcttttaactactagactaaatgcatactcatagaacacctaatatcctaagtccaagattttatttaggagtgagagattcaactttgcagtaatagaaactgattccaaagtggtcaaagtcataaagctgatttgtagtaaaatcacacaaaatattaatttgccctggatccctagtctagaaaatttttgactgcactatgttgcacttaaacaggaaatattaattggcactctgataggtgaataaattcagggacaagaactgaggtgcagcgattcccctatcactagacagagctaggatgaaattcaaatccagatcataagtgttggaccccatgagcttaagagtaccttaatttttgttttatgttatgttcttctcaattttctgcattaccatttcttccctcaaaaagttacacctcccccagagtatcttctttttttattgacccatgttctttatctactttctgcagcaacagctccactgagaaaaaaaaaaaatcagatattacaaatctaatttagtaacatgaaatagttcccatgagctgcaagctggctgctcgtgagctgtggtgagatttaagtatttaaatgtatacggttaataccctcaaagcacagcaaaaggcagttcacgatgaagaaaccaaatgaagtcatcctaaaattgcagattttttaagaagcagaaacatacagatttcaaaaaggataaggaaaaataatggacagatgacatgaaaaattagttcacacacaaaaaagtggtagacaagtggccaactaatatacaactgaggttcatactaacttataacagaatgcaaataaaactctagtttctcattcttactatcagattgctaaagattaagaattttaataacactcaaggatgataagagagttggaaaacagacattttcatatattcttaataggaatgtaaattggtgcaaacttcttgaaggaaaatttggaagtaactatcagaatgcaaaatgcacatgccctgcggtgttaccagtttacttctagcaatctatccaacaggtgtaggtgcacaaatgagcttacaagtttattcattgcaggattatttgtaatagcagaaaactaagcacaagctaagcactcattagtggctaattggttgttcttcttcaatgggaaaaaaaccatacaatcattctgtttttaattgaaataaatgtatacgtggtcttaggctgaaacttcacactagaattaccgcaaaaaaaaaatcccacaacaattcagaaaattgcgtgcaagacatgcatgcatgtgtataaagaggcttctctgtgcatggaccattaatagaccaacaccagaaaactattcagagtggctacccctggctagaagttctaggggaggtgtgagtagaaatggaagatgatctttaatttttatactatgctcctttgtcatctttaagttatatcttgtgagcatgcatgtattgctttcctaataactaagctatttaatgaaaagaagtcacactgcttcagataagtaaactaaaattaaaattcagttctgattgactgtatcaattctaagtgtcattttggccaatttagtcctgaacccaggggattttagagtcgccaactttgctggtgtgtctgggattgaagggtttctgggatataaggcttttagtgctggccaagcacggtggttcacgcctgtaatcgcagcactttggaaggctgaggtgggcagaacaactgagatcaggagctcaagaccagcctggccaatatggtgaaacaccatctctactaaaaatacaaaaaattagccgggcatcgtggtgcatgtcggtaatcccagctactcgggaggctgaggcaggagagaattgcttgaacctgggaggtagaggttgcagtgagccaagatcatgccattgcactccagcctgggagacaagagtgaaactccatccccccccaaaaaaagacttttagtgctaaaactaaagcagttcagagaccagcaggtcaccttactgggcttggtgagaggaagggacctgggtgagtgaggttcctctacaaagaccaaattccccttaggtggatccaacagatcaaatggaagaagctagaagtccctttggccctcatacctaaatcacattctccaaaataagttcttttagaaataaatacaatgttctgatctccatcagaactgagggacagaagatgggttttattttaggagacttcctcaaacccacaacaaataattatatacctgctactacaaactagcaccatttcttatggtgacaattcaaatgtcctcaccccacttttcaggagtgttgaggctatcttgggccagtggggaagggaggaagtagagccctggccatactcagaaccaggggaactggcctggcctgcgaagccacaacccaaacacctgtgaccaaaccaggcctctcaggccaagatatacacaagtaggaactgtccagtgggtagacggggtcttccgagcaattcccagactctcagaggccacagcgtcattcatggttccaggtgctctgtcctattctgagcaaaactcaaaagcactggtggggaccaggctagtgagagttagacaaaatgtccatgctccaggaaacaatgaaaggttttagggaaatcatctttctcattaagggagacaaaacatcagaaaccaaagaagttgagttgtacagacatgaaaaccctgctgtatctgagtagatgagagggtaggagggagaaaggcaggcagaataatggagctcagaggatatttgagtgctcagaactcatcccatgctacccgacggagagcagagaggaaggcttggtccactccctgggtgctgctggggagggagctgcaggcatggcaaggcctgtcttaagcaggtggtagaattttcagcctccactcccccgacagggcagggctggagaaagctggccctgatattaaaggagtattttgaagtattaaatgatgcggtttttttaaaaaatatttttcttccctttatttctctctatcccaaagcgtcccctgcacacacacatatttattagttactcagcttactcttgcctcaggatagagatgagatgcagtgaaggacagaaaaatcctaagctctttaaggttcttatttctaacagcagtcactgccccagagccaagagaggatcttaggcagagacaaaatacccaaaacctcaacaggagatggatttttctgaaggctcgggaaggattccctcaggctggtggtggagctgggagaagaatgagaaggcaggaagatgggaacaaagagatccatgagtcctgcagactcccaactccccagcacacctccaaccccaggatgacatggcagaccctcaggagggaacaaaggcaggctacgcccatcctcatcatccaggactctcaatggcccatcagacatttccatccccaagtcatcttaaaagaccagagaactatttgacctgaagaaaacacacagccagagcaaagtgctgatgttgggagttcaagaccagcctggccaacatggggaaaccccgtctctagtgaaattacaaaaattagccgggcgtggtggtgtgtgcctgtagtcccagctactcggtagggtgaagcaagagaatcgcttgaacccgggaagcagaggttgcagtgagctgacatcgcaccactgcactctagcctgggcgacagagtgagactctgtctcatacaaaacaaaacaacacaaaacaaaaaggcacttttgcagctctcggtgcaagccctcccccaagcttttgttctgtgtaacctcatggaaccctagcacaactcagggagggaggtggtgcgaaataactgaggctaactactgtgcaggagctgcaaagaccctgcagatgcccctgtgtcactcactggctagaacaacactttgctcacagcctctccctgcaaacacatgccactctctgcctggagcttcttctcaccagagtttctggatgagctgactcatgggtctcagtgtgaagctttatctctagcgtttaatgaaagtgaggagacagaaaggactcaactatgaatattctgtctttacggcgcaagctcctggccgcatagatcagcatttgaaggcagccgaggaaaatgaaacaaacttcaaagtccaaagaggaaaaaaagaagggcccgtagaatattcttcaaatgaaattaactgaccaccagatgctctgaggttttcaggctactcagcttaaatcagagggagcgtatcctagcgatggcaggccctgttcggccacagactgtcactttcttttggttctcaagtaagaatccttgaggtgctgtgccgcagagcagattcaattttgttcacttaattttcatctctcctacatggttttcttctacaaaaacggagataccattttcttcaagggccatttaccatataaagaaatacatataaagggagtaaaagaaaattaatataatcatgtcataaggcaatggatttttgtctctccttttacacagtctgacttttgcatacattgattaaaagctccaccagcgtctgtcacatactatttatatggaagctttatcacaaaacagaaacaaatggtctctttttttttttcttttcagtcctcatgactgctacctgggtttacgccctcttcctttcatagtttttatctcacccagcattcaatcattaaatcttggggtttggagataaggcctttctctctcctgtgtatgtcagaaatgctttccggagaaagtcatggaatgcccaacctgtgctgacttaaactctcgacatttattgctatgtaacaaaaagttctagggttgattggtggctcagcagtatctccaaacacccaggctctgtctgttccccaactcagccacatcaagcataataatttcttacctcactgtcacaaaatagctgccacagctccaggcaccatgctcccacacagttatattcaaaagcaagaaactcacgaagaaaccagggaagtgagagtgcctttatcctttagctctttcttccatggagggagagcattaggacaaatatctaatgcatgtggggcttaaaacccagatgatgggttgatgggtgcagcaaaccaccatggcacatgtatacctacataacaaacctgcacattccgcacatgtatcctagaacttaaagtagaaaaaaaaaaaaaaaagaaaagaaaaccctttccagaaataccttccacagactcactcattggctagaagtgggtcattgtttcaattatagggcctcgctgatttttaagtaactgccagttcagtttctttctcttctttctaattgctgcattccccaaatcatcattctactgaaccaatatcctcctaaaaggtccctgcctcaaatctaccctccataccaatgctactccagtactcagtaaggtggccagtcttcaagaagcccccatgactcctgcctccttgcatttatacccttatgaagtcccctcccactggttgggtgtggccaaaagaacatggcagaagtggtgggattttgtttctgaggttagatgataaaagacactgtggcttccgtcttggtctctctcatcccttctctgaggacagccactgccacattttgaggatactcagccactctctggagagatccacagagcaaagatggatgcctcttgccaacagctgcacaagtgatcttggaggtgaatccccacccaagtcaagccctcagctaacattgtgactaacacctcatgagaagctcgaagctggaaacacccagctaatctgctccctaattccttacccatagaaaatgtgagataataagtgtttgttattttaagtcactaaatttgggggtgatttattatgcagtgatagataatgaattcacttactgtgaaactgtcttggttaaaacccataaatggtctctaccacttacagcagaggacctggcattgccagtaggtgagttttggtccacggagtcttttgaaatattttgaactgatgtttcaaaattgggagatgttaaatagacatcataacatcttgccaaccaggtccacatttccacagaacacccaaggccttggccagaggattggctgtctcctttacaaagagcatgccttccaactaccaaaggcctgggccaaaggattgcctgtcttctttatgagagcatgcactccaactcactgagaggattggctgtctcctttacaaagagtatgctctccaacttatcgagtgccctccactcacccaaggcctgggccagaggattggctgtctcctttacaaagagtatgctctccaattcattgagtgccctccactctaattcccccaatagtagtgaggacatgtcatagttgccactttttgatccctgcatgaaccattactttagttatgtctgagacatagttttgtgaacctttgcccctaccaaaaatgggcaaacaaaagatagactgaaatatctctagtaaataaaaagctagaaaaggtttccgcacacctaaggaaacagtcaacagagaaagaaggtaacctatagaatgggagaaaatatttgcaaatcatacatctgataagaggctaatatctaaaatatataaggaactcaattcaatagccaaaaacaaaacaaaaacaatccacaaatgacctgattaaaaaatttgcaatggattgcaataaatattcctccaaagaatacatacaaatggccaataagtatatgaaaagatgctcaacatcattaattattaaggcaatgcaaatcaaaaccacaatgagatagcaccccacacctgttaggatggtcattatatatatatgcatacacacacacacacatatatatataaccagattatatatattatatatataatatattatatataatatataattatatttatatataatttatgatatatatttatatatatttaaaaaacagaaaataagtgtcagaatgcggagaatagaaacccttgtgcattgttgatgggaatgtaaaatgtaaaatgatgcagcctctatgaaaaacactatggagatcatcaaaaaattcaaaatagaatgaccaagcggaatccagcaatcccacttctgagtatttatctaaaagaactgaaatcaggatctcaaagagatacctgcactcccatgttcaccgcagcattattcacaataaccaagaggtggaaacaactgaaatgtccattgatgggtgagtggataaagaaaatacagtatatccatacaatggaatattattcagccttacaaagaactgaatcctgtaatatgctacaacacagatgaacttcgaggacattttactaaacgaaataagtcatcacagaaggacaaatactgcatgatttcagttatatgaggtatctaaagtagtcaaactcacagaagcacagagtagaatggtggatgccaggggctggtgggaggtggaaacggggaggtgttcgataggtctagagtttcagtcacgcaagagaaaaagttccagagatctgctgcacaacagtgtgcttatagtttacaatactatattgtatacttaagaatttgataagagaacagacttcatgttgtatttatttatttatttattttctgaaatggagtctcactctgtggcccaggctggagcgcagtggtgcaatctcgctgcaaactctacctcccaggttttagagattctcccacctcagcctcctgagtagctgggattacaggcacctgctaccacacctggctaattttttgtatttttttagtagagttggggtttcgtcatgttggccaggctggtctcgaactcctgacctcaggcgatgcacccacctcggcctcctgaagtgctgggattacaggcatgagccactgtgcccagccttatgttcaacgttttttttttttcaccacaacaaaagagagaaagagagaaggaaggaaggaagggagggagggagggagggagggagggagggaatagaaagtggggtaacatctttctttgttagagaatattttcatcttttaacatgtaaacaaagtgtctaacaactataagcaggtctcagttcactcatttatcttacctgcctggtccctttaggcatcagtgtttattatcccaggtctacagggcagtggtgcttcataggcacagtccaggttctctggaatccagcccagaccaccaattcttgctgtcttaccactttgtgacatgtctcccactgtgatggttcacattatatgctgacttggctggggtatggtgcccagtagtttggtcaaacaccagtctagatgttgctgtgaaggtaatttttagatgtgattaacatttaaattggtggaatttactaaagcagattatcttccatcttgtaggtgggactcatctaatcagttgacagtcttaagagcgaagattgaggcttctatagacgaaggaattcagcctcaaaactgcaatacagaaagcctgcctgagtttccagcttgcctggcctgccatgtggaattcagactccagactacaacaccaactcatacctgaatttccagcctgctggcttgtccaacagattttgttcagcacgcacatcatgtgagtcaactctttaaagtaaataaatgtgtctagcacgtgcgctgtctctctctctccttcctccatttattacacacatacagatgggtgtgtgtatgtatgaaaggaatgtgggagggtgggtatattagttagggttctccaaagatgtggaacaaagatacagaacaagtgggaaagacagatctttctgtatctttggagaaccctaactaatatacccaccctcccaccttcctcacaccaccaccttctatcctccatgtccttggtcatgcacttggccctggtcatgccacccccttccaccaggacatcttgccctcccatccccccagcaatgcattctcctttaactcagtccaactgtcaccttgcccaggaagctccccgtgaccacgcagactgggatatatttttctccccgatgacgctcgtttgtgcagatccctctcaacccacacattaagttggaacatgacaacttcctttatgtggcccaccagaagaggaaccgtgtcttattctgtcaaatgaatgaataaataaacggatgaatcccaacgtgttattactgaggaggacaaacataataatcttagacaaaagtagttttacagaattaccatgtaaatcaccatagaatagaataaatgctttgtaatttagggggaaacagaaggattttctgggcttctggcaaagctttttcctaactaaatcatttcaggcacagcttttgcaaatgcgtcttctgctggtcataattatgcgactcccaccccccactgctttgaattactttgtgctaacaccaaaattgttccacagagagtaggatttatttgctgaaatgtgatgaggagaagtgggataagagacatacttcacatgcggtgcctgttgctagcacagctgtatttctgagaaatatatttcagtcttttggctccatttcttttgtagtttaataactgaagtacaaagctcatgaaagctgggaatgtgttggaaggtcagtgaggaaaaatgcacgtggtgcagttaggagagacaagggagttaaaataacaggagaaattgatcacttacgatctttctggttggtggtttatggctaaatgtctgtttcagctaaagaccaaacactggctcacagctacaaagaaagtagaacaattaaaaaactcagcaaggagaattccttttgtacctctattataagcatattgtttatttaaaattattttatgtaatgccaatagagtaatatcttcatgtcattatataaatgtaatggcagtggctagttttgccattggatgacagtcctacacactggaacacattttctcacctagcagaaagccttgcctgcagcactcaccaaatgcctcctacagtatcttcctcatgtgcacaaatggctttatgtcagaaatcaacatccactgagacaccagaaatttgaacaggtccctaaagacaggttgactgcttttcctccctgtggcacagtcatttgcagtctttacttggtattgcatctgtaaatgggatgtagataatatcgccatcatttccagggaatatagtgttatccacatcagcgttcatgataacaaacacaatgtcccagctgaactttgtaatcagtacttttgggagaaccaagtctgttttagtttaacagatgcatctgatgttgttatctaaccatctgaggctgtgatgaagcacagaacgcaggctttgtcatcagccagtgctacaccatatccagggccggcttcaccagatgtgtgatcttgggcaagatgttttgcctctctgacctgcagtactctgctctgtaaaggaggtccataaaattctctttggaggatcaatatgaaaatcagaaacaataaattaaactatctggaatagggattggcacataagagatgacaaaaaacaaaagaaagtgtttgtaatagaatatggctgacactattcctgctggttcgggattctggctgaagctttaaattgagaatggaagaaaagcctttcatgttccaaaggaaagtgctgaacacatttcccagcacttctgaaagatcgaagagccaatctagaaacagaactctgtgtctagcatgatacatgcaatatgtgtgcaacatgcaacttgcatgtatatacacctatattatgtgtgcatatgtacatacagtatctatatacacacctacacatatgtaaataaagctcattaaacaggatgtgccaatttgtcagccaatggggaattgatgtggattctccctccatcatgagagagggaactagggtgctcgtccactctttcaagctaaggaaaggggactccaggaagatatgtcaaaagaaactacacacacttcaagagggagagattggcaccttgctccccagcacagccagtgcactacagactgaacaaagtgtaaagggagctcctgaaagaactaaacgtgtgtgtgtgtctaggaatttggggcatatggaagcagagactgctgcctctcctattctgaataattctgaagatgggaaactggcaggagcagtgcaccataaaagccagggaccgaggatgcacttggggatgctacagcaggtggttgaacctcacagtttgaaagcacccacccaattgggcagcctgctggactgagggctcccagcaccaggaggctgtgggtatgaggccattggaagcaacaacagaggagaactgcaaaaggccctccatacagcttattgatttatttggagaggcttctgcggggccactaggcaaccacaaaggtgctcccaagggagtgccagctttggggaccagccacatgcataggggacaggacaggtgggtttcaacagcctcatgtacaggagacttgtcctctttcctccagtctgttttcccccaacccctgccctagagaggtgaggagaaggaaggagaccccaagccagggaacagaagagctttgaactggatgggagactgaagctttccctctacctagattgttaatacctgacagtgaatctcctcttacaaactgagccagagcatcaagaaggctatgaacgaatctccctgagatgccttcagtgagcagggaagggaaagccaacagagcaagattgaaatataagtgggagaaaagtaaagccatttcctgtttatatacttcagccttcagaggccacaaaaaaccagctacatacgattatgttatttcggagcctccaaatggagtgacacatactcttttactgccaattaccaaggcgtggaaggtggagagaggactctctagctcctctgctccatctctttgtggctatcacattggcttcaatacaatgtgacttaggtacccaaattattctagtattgagacaggcaagtgtaaagaggtccctggagaaacttcaaccagcctggtcactgggaggaatgtgcgctggggaggagcctcgggaagtctgtgccattttgcagcagggaggagcctggcctctcttgttctggggtggggaaactgggattcaatctgtgaggcaggaagccagctagcaggactctggttttgctgagagtccctgtttcccttttttcccttttcacccaataaaccctgcttttctcacccttcaaagtgtctctgagcctaatttttcatggttgtgtgacaaggaccctgcttttagctaactaaggagaaagtcctacaacaatatagtgggacaaaacccagagacaacaatcgatttcagccaatccagattctaccaagtctgtaaacagtacatatattatatatatatatatatatgcttacagttacttccaaacctctttttctcataatcacccaaacctagactaatgagttcccccatttctgctctcaaaatttctccaaacaagcccttttctctaggggtacagaattcctcataagctgaatttgtaccttctctttgtactgtaatctatgatcatgcataagtctttctctgaaggggaaaaaatgacaacttttgacttgaaatccagctctggatttacctagaagtcaagcttgttaaaatatggtcctcagggtttagaagacgagggtgagctaattctgagtctcagcctgcctaccaaaccagccatacgatcgatacggaagacagataaaaccacacaggactcatgccttcagcatgaccagacaacagagaacactgcaaccttcaaattgcctgaaagtaacaaattccaacagaactctcaccacctactcatagctgctaagagcctgtggatgcagagagcagagagggaagcagaaaagagctaagaaaataaacagagggagcagagggccacgaggaagcacaaactcaccctagaaagaggaaatgaaatagacaatgcaaaacaacccaataccagtcaggacttggagatgcataggaaggcactggagagtgggtggggccagaaggggtggcctcagaacatactacttgtgggggataatcagatctaaagaaaagatctgatgttccttggagatgagacagagacgggaaagaaggacttaagaagggggaataaggagcctgcagaaacacaacagtaaactagaataagtggagagaccccttgctcttgatttggaggtctcggtgttatcaagatgtcagttctccctaatttataaatgtagtgcaagaccaacaaaaattctaaggagctttttaatggagacagacacattagaaaacaacacacaagaatatctaggaacacatcaaaaaggaataacttggtgggggtgagaaagggataataccgctaccagatgttaaaacataatatagacttcccacaattaaaacagagtggcactggcacatgaatagactgacatcaaagaaacaataaaatgtcaaggaaaagatgaaaaaaaagaatttccatttggaaaaacataaaagtagatccatccgtcaaaccctacataagaatgaactctgaatgaatcagaaatgtaaatgtaaaaataaaaggacatatactagaaaaaaataaattcttctacaacctatgtatatagtaaaaggctaggtctgacttaaaatttaaatgcaataaaatactaatatgtttgtttgcataaattaaaattttaaaaaaggttgtatggaataactacaccattagtaaatttctttttattttattttttattttagatggagtctcactctgttgccacgctggagtgcagtggcttgatctcggctcactgcaacctctgcctcccgggttcaagcaattctcctgcctaagcttcctgagtagctgggaccacaggcacacgccaccatgcccagcaatttttttttttttttttgtatttttagtagagacggtgtttcgccgtgttggccaggatcgtcttgatctcctgaccttgtgatctgcccaccttggcctcccaaagtgttgggattacaggcgtgagccactgcgcccagccaccataagtaaatttttaaatgacaaaatggaagaaaaatttgcaacatacattgcaaatagaagaattaatgtcactaatgtacaaggcactttgcaaaatcaaggatcaaaaaccaaaagtcctacagaaaaatgggcaaacacatgaaaaactattcattaaaagaaacagatacatggcctagaaccatatgaaaagatgctcaattttgtttataataaaagtgcaccaagaggctgggtgcagtggctcacacctgtaatcccaacactttgagaggcaaagacaggaagactgcttgaggccaggagtttaagaccagcctgagcaacacagacaccctcatctctacaaaacaaaacaaaacaaaacaaatcaaatcaggcagttagtggaaaaggaggcaacatttttgaccaggtggtcaaaattacaccacccatgtgaaggacatagtatgtgcttccagaagggatgacagaggacacagtatcttctatgcagtgggatggccgataacacacctcaacccaatcacaaggaagcttcagtcaagcataaaatagggagcattctgtttaaaaagtgaaggggctactgtattaaaaaaaaaaatcaatgtcttaaaaggcaaagaaaaatcatggaattgttctagattaaagtaggctaaagagtcatgacaactaaatgccatgcccaattctgaactgaaccctgtactggagaaaaagtgttacaaaggatattaattattatgttaactgacaaaattagaatatgggcagtggattagttaaaggtattgcatcaatgtgtgtgtaaatcaatagtgtaacatcattagtgtatgtggttatattaataaaagatatttttctacttttaggaaatacacactgaagtatttagtaggaaggaccatgatacacataacttatctgcaaatgattcgaaaaaaattgtgtatgtgtgtgtgtgtacacagagaaagagagagagattgagagaacataaatgataaatcaaatgggttaaaaacaagtgattctgggtaaagactgtaaggatgttctttgtactatttttggttttgcaaccttcggagatgtaaaatttgttttaacaaaaaacctagaagcaatacttgtttcactcttcactctccccacttcctcgcttttgtctaccctgcaattcactgttaccaagcctgggtctccactcttccactgaaaactattctggcaaaaggccccagtgcttccttaaatgggacatccaacaggacttttttaattattcatcttgcttgagtcagtggcagcactggactcttctggcttcctgctgctgcttaaaaagctacacttctggccgggcgcggtggctcacgcctgtaatcccagcactttgggaggccgaggcgggcggatcacgaggtcaggaaatcgagaccacggtgaaaccccgtctctactaaaaatacaaaaaaaattagccgggcgtggtggcgggcgcctgtagtaccagctactcaggaggctgaggcaggagaatggcgtcaacctgggaggcggagcttgcagtgagccgagatcgcaccactgcactccagcctgggcgacagagcgaagattccgattcaaaaaaaaaaaaaaaaaaaacaaaaacaaaaacaaactacccctctatgctattttcttttcttgccttcatgaccactcctctttggctttcctttctttctttttcttcctctactcaccttttaaatgtgagtttcctaagattccttatttagatctcatcttactcaacatttccctaagaatattcttccatttttatggctccaaataccccaaactggagaggcagttaaatagttgattattaaaaattgattagtatattatttagctcttgctgtatgccaaccaaccacaaaaatctctgtagcattcaacaaaaagcacttactctcgtggatctgcgggttgtagaatttggctagtctgggctgggctttcctgggcatggctttaagccacagggtgggctcacatctactcagtgagtttctcaccctctgtggaatggtgggcaagttgggacatcttctcatggcaatggcaggaagcaagagagcaaacggaaatgtggaatgtacctctgaaggcctaaggccaggactgacccactgtcatttcaacccacattccttaggccaaagaaaatcacacagtcaagcctaacgccaaggggaagcgaagtctgctccatctcaggctggaaggattaagagtctgacgagaaagagagtgactgcaggaaagggtggggaactgcacctgtctgcagtaggaatgtatgaactgacttggaaactgtttcaaccttccctggcaggaaaggatgagctacggagagcagagttcctcaaggtggggcatcaacaaggacagatgagagggaaggagcagagagaagcagtctaccttgaagattcactcagtgaggaattttaaaacctctgcatctcgaaggtttccagattttctttccaccctagcattttccagggagccccaggagtgccatgctgcacttggagggctgctgtgcccatttctcttgtcacattccattagacagatgcctcagctgctgcaatgctggaaaatctagaacatgatgtgctgttccactagggctgctgcagcgcccaccctgcctgctgcagggcagtagctaagaactgcgagacgcgaggtttcccttgcccatgtgcaacctgcttacctatataaatagatagctgatcaagccttttttttggcaaaaattctctgacaggctaggagcaaagcacatgccagcaaagggcaaaggggctctccatagtctatctttgagggttcttgtgaagttactatgtgtggcatgaaggctgcttacatttttacatgcatttgatccctttaaaatggtccagaagaaagtggtatatgaaagtacattctgaaaccagaaacatggagcatgacacttcaagctacaggatctggagtcaggtgggtgttccccggtgctgctagccagctttgatcttaactctcccaagggtcaactcttcatctgggaagtatggccaatcctaagtcacagcattatataagagtgaaacaaaagcctgtgtgaaagtccctggtgtcctgactaacccacagtaggcgctgaatgaatagaaccttttaaaggtgttatcatcatcatcatttgcagcattgctggacttttttctcttcctagctcacctcctacaaatgtgttactggattgtgacaaatatatttttggacatttttagttgacaactgcaagtgatattgaatattgcaaattaattgacagtttaactgcttagaggatttctcttactttgggtaattggaaagtaggaaattaaaggaaaagcaaatatgatattatttgagtattatttatgaaataggctcaatatttcatttcaataaaatttcatgtattttccaaaaatatctactttttctactatactaccttcaacttatccaaaataaaacctaataagcaatagtaatagtcaacagtcaaatattgactaacttctgttccaggcagcttctaacatagttcccaagaaaccctacctccttataggtggccagaccagtaacttaacttgctacttctgagaagatgttttaaaagactcttccttattaatctctctctctctcttcttacttgctcactctgatggagcaagctgccattttgtaaacctaagggtaaaggaactgatgatgatgatggtctctggccaacagctggtaaggacctgaggccctcaatccaacagcccaggaggaaccgctgccaagaggaccccccacaggggacccctgaggccaccatgtctctgactgcaacctcatgaaagactcagagcttctgcacccaacttaactgtgcccagattcctgacccatagacacagtgaaataataaatgctgtcattttaagctactaagttaaggtaattttttacataccaatagataactgataaatctacattgtactaacactatctggaagtttagatgtaatctacgtaaaatggaaaggttaaatttgctggtttctggagaaacccaatggatctctttggagacaaaatgttctctttccatgtcctttggagcaggggttgttgtggagtattattcttagaaagtgaaatgctaagcttcagcattgtgggtcagtctcaacttgcaaagcaaaagtttagatctccatattctttttacttgtattcagtagctatgttatcttcctcctttccattgcctgagctattttctgcattactgatccctcacacagccatctcagcttactacagaaaaatacctcctggtatttagaatgttcaaaacacttgagcaagcatattcacaacccatactgttgccaaggctgaataattgggcttggaatatgcctggcaccatcactccagatgaagccctagacggctgccatcggctctgctttgcccttactgcttacatggaagtggtcatttaggctgtgaaatggtcagacagaggagcttaccactaagaagcctctgctgcatgacaaacaccctgcctcaaagattgtgcctaattcttgagtgggcaacctgcctctaaagcagatggatagagtgaaagcaggatggagatggagagcgagcacagaaatatttcagtctagggtcatattggcatttgggagcttgtcaccatctgctgttcccggggttcccagcttgctaatccagcttgcagatggattgacatttttcaatttcttaaatcttgggaagagttttggtggttctctgttgttgccatgaagactgggcctgttctctgtcaaaatgcagccaaggtctatagctaaggtgcctagattctaccacttcattatcgtgggcttctagtcttttcccgaggggagagtgcactgataattgtggactgcggggcaaaagcttattacctgtcttcacattgtgttgcatgggcccaacagcacatttttataaagagaagacaataaatttgaagagatgaggccaactcctctcaactcctcaactcctgccacacctgttccccatgactggccagtcatggacaatatctgacaaacactcccccttcccagggctccttccattaggatcactcccaggtgtgcagtgccaggaagaggggagatgcccaccctcactgccaaggagaggcaggggtgtgccagggcacttgggtgcagggatgagccgccattggcaactcagctggccccactggccatgccctcgcaggctctcagctttctggtgcacctggtgatgctagtgaccctcatcaggggtgaatgcacctggctggcatgatgaccagttgtgctgccgggcacaaggctcccagctgctctttgctctcttagtcctgggaggagctttgcactggatccagggagaaaggagtagcgcttggacattggtcccaatgtcaccgaaataaggcagagggctctttctttgttcttcctcattgttcctttgggatgaccctgtgacctatgacctgtggaagatggagccatctcagtctttctcctgttgggatgtggggatgtagttgagaattgcattgatcactttgcaaaagggcttcttcgtgaagacttaaggaacagctcatgtttcagtgtcaggaagaacagtcttcaattcctgagaaactgaccagtgcatgccttattgaaatgcaactgtggctgatttcatttgcatcttcccatcggccacattaggccaagaaccatatttgtggcccaccttccaccacatacaaggctgtatggccagcaaggcaacctttttttctggctctattttaacttcagaccctttaatctttatttggccttttaaaaatgcctctcttagatgtttctttcttttttttttttttttttactatgttgaattattatatcctttaaggtcattttccctgttcttttgcaatgaaatagaacataaatagtatacttaacatgctaaaataaacttttctcccaactgttatttccaagacaaaaatccattttatatcctatcccaccatgtagggactgcaaatgtagtctttatgttgtccttaagaaaatctaccaataagataaagcattttccaggaaaccactgagacacattgtatcctattcctgtgcagattacggtaataactgacaaatctctgatgtcacagagccaggtggagcacaggaatgacttcatttcttcaacaaatatgagttttccttgggagagctttgagcaagtcttctctggtgtgtggcttcagggcatattcatgtgtacccacttggctggacactgggagcagagtcagaaagtgggtatggaggcacttctctcaaatgactttacaatttaggagaaaatcctggttgcaatgtaattcttccagaagcaatgactaaatcagtcaattcagcattatagaaccatgcaagtgtgtgcattaagccctggaaatactggaggcattttgtggggcagcccatttgaaacacattggtgctgtgcttctgtgatttggtaaccagcagccacatgggccacctgagtcaccgagctgcctaaaatccgtagtgtacaggtgatgagggggactcctgagagaagggggtgaactaggtgatggcatcctagtgagaggtgacagcgtgctggcagtggtgacagcgagcccttgctcgctctgggcgcctcctctgcttgggctcccactgtggcggcacttgagcccttcagcccgctgctgcactgtgggagcccccttctgggctggccaaggccggagccggcttcctcagcttgcagggaggtgtggagggagaggcgcgagcgggaaccggggctgcgcgcggagcttgtgggccagtgggagttctgggtaggcatgggcttggcaggccccgcacttggagcagccggctggccctgctggccctgctggccctgggcaatgaggggcttagcacccgggccagcagctgtgaagggtgtactgggtcccccagcagtgccggcctaccggcgctgcgctcgatttctcgccaggccttagctgcctccccacggggcagggctcgggacctgcagcccgccatgcctgagcaccgcccctcccccatccgcccccgtgggcttctgtgcggccccagcctccccgacgagcaccgccccctgctccacggcgcccagccccaccgaccacccaagggctgaggagtgcaggcacacggcacgggactggcaggcagctccacctgcagctccagtgcgggatccactgggtgaagccagctgggctcctgcgtctggtggggacgtggagaacctttatgtctagttaagggattataaatacaccaatcagcagcctgtgtctagctcagggtttgtgaatgcaccagtggacactctgtatctagctattctggtggggccttggagaacctttatgtctagctcagggattgtaaatacaccaatcggcactctgtatctagctcaaggtttgtaaacacaccaatcagcaccctgtgtctagctcagggtttgtgaatgcaccaatcgacaccctgtatctaactactctggtggggccttggagaacctttatgtctagctcagggattgtaaatacaccaattggcactctgtgtctacctcaaggtttgtgaacacaccaatcagcactctgtgtctacctcagggtttgtgaatgcaccaatcgacactctgtatctagctactctggtggggacttggagaacctttgtgttgacactctgtatctagctaatctggtggggaggtggagaacctttgtgtctagctcagggattgtaaatgcaccaatcagcgccctgtcaaaacagaccactgggctctaccagtcagcaggatgtgggtgaggccagataagagaataaaagcaggttgtccgagccagcagtggcaacccgctcgggtccccttccacactgtggaagcttagttctttcactctttgcaataaatcttgctgctgctcactctttgggtccacactgcctttatgagctgtaacactcactgtgaaggtctatagcttcactcctgagccagcgaaaccaccaacccaccagaaggaagaaacttcgaacacatccaaacatcagaaggaacaaactccagacgcgccaccttaagagctgtaatagttaccgcgagggtccgcggcttcattcttgaagtcagtgagaccaagaacccaccaattccagacacactagcaccaactgaggatgatggcttatggatttcccaaatttaaaactgggacttctcaacagagaagctgaacacgaaagcttcaccaagccattttccttttgataagaaagtgctaattagcaccatgcattctccatagaagacttgttttcacactggtttacctacggatggagttttcatgtaaatcatgagtgacagaggggcccatcatcaatgtttaaaacggaatgtgtacatggtattgctcaacctctttgagaaatatgaccccatcatttcatattagtagtacaagtagtcatttgaaattccagtcacagcagttcctgagccacaaacatacccacaaaacacatgcttggatggcgtgtgatctcacctgcatttacacttgatcaagcctttcatattgtagacagtttatttcttcctcattccatccttgaattgttaggcctcaaagagatgaggtattatgtgatagtcatctttgttcctcagatcttagtacatttccaccaggaagcagacatttaaaagtgatcattgaataaacagagttaatggaaaataaaaataattagtctcagataacacttttcggagttaactgacatgatgtttccatatttgctgggacattttatccttctctatttgagaaaccaagagagtagacttcatcaactcaggcaggtaatcttacagccgaaagccatgagaatgctttggagattcagaagtctagatcccaagtaaaagactgtcaactcctaccacccaggaaagaaagagattccccagactggagagagaagagaaatcagattgaaaataatagcagctaagatataggtggcctctgagcaaagggtggcactggtgtccaacccacaccaagcctcagaggtgctgacaaggagtgcaggacagctggagccttgaaacagcagagacctggccccaggtagatggtaacgaagctgcaagagccagagtagaagtgtctgcgtggtcggcttcttgcttgagggcccaaggcagccttgcagagctcccagggccccagtgaggtgcaggactagctaaacactccaagcatccaagcacttagcctcatggggttgcccaagcccagtgagcatgagtaggaaggggtagaatgcatcttgggtatgaatgcagggcagtcgccagatctacagatgagccaaacagaaatggggaacaatggagacacatgaagcctggaaagcaaagaacagagatgcaacaggagagtctgaactctgaagggacaactaagtactggatagatcaagcccctgtctcctccccctagattaaatagaaccctagaaaggttggcaaaacccaaattgttagactacatttctaccaccccaatagaatggggtctcaaagttgagttatagaaaaaaaaatcttgcacaacagagataatgtagattaaacttatctacattatctacaaataacaaccatattgcctgcaatacacaaatgaagatgcaatatatctgatattagcacagttttcactggtttcataacagacatttttaaaaataagggaacaaagttccaatatgacattgcatttacacagtgttttcacgacctgaaattcaagtgcttttagacaaaatagtcttttacacagtcactgttggcagaccgccaccatgtaacttgtgttttcaaatattcaaggtaggagaaagggtcaggactcatttaggaagtctggtagaagtcaagtttgcaaaaaatgaatttacccaaatgtatagaaggcttgccctactagggtggcctatttcatgtggatgtaaatagttcatgggggatgagagctgctgggaagtaggggagtaagggatagagaagcccatttcccagatgagctgaagaaatggagagcgaaacccaagggcaagtggcacgtctgcaagtagagctcttgccagcccttagtggcagatctgggaacatggggtttgcaagactcaacacactccattcttggaggaaaccagtggctccttgggacccaaagaagattccatggcatctcgatctcagcagggaaaactgaggcccggcgcagttaggataggctctcttgttcaggactgaagaggcttccctgatgcaggcagggagttggtcagcgtctgctgaggagacaaagcctgagctatcttctggctcagagagaaagagcaggcaggaagaaaaaccagcatccagctgtgccacagatgtgcttccacctctgtcttgccctctcaccctcgcctttaatcccattttataaaaactcatactcagaggttagctgggttggaccccagtctgaccaacccacagcccaggctggccacaatgtgtgtgtgtgcttagcaggggggcagtttttggggactgcaaaaggagggtctataaagaaggacctcatctctcaccccctaggggcagcctctatgggggaggacgatggtccctgacatcatgggacagtcacgaatgagggtctgtcctgggtcaggctggtgggcaagttgatctggcctctccacaaggctggctcttgcctcccccattagtcagtagcactgctgctcgtggctctttttagtttctgccttatgaccatatttgacacactgcctccaacctaaggtccctatttattcttgggcacacgccttggtgacatgctaccactgccctccctgcccagaattgtgtttggcaagctgtggagaagcttccagaatccaaaagacccttttttttaaatatactttaagttttagggtacatgtgcacaatgtgcaggtttgtttgaatggagacaattagtttaaagcaggcacgcgtaaaaccggaggcagcacttaaataaggcacaaacatgcctttaaatgttgttttaaagtcaacctttactttcatcctcaacgacttaattgacagaaacaacaagtgtatctgccaatatgtgggccggctcagtgacccatccactgagaagtagaaagcatatcatgttttgagttacagtttattgagcattaagctttcttcctgttttttctcacttttcagagtgatatccacagatattttcctataactgtgtgtaacatgactgtgcccaacgttagactggtggaatggtagataaagggggcaagaattcacaaaagggaagtcctgggaaaggaaattgagagtttataaatatatgaatgccagctcatttttattttttaaatactctgtacaacacaccaacataaaatcataggatatagtggtgattgcattcttatgcatatatctttgggtattaattttacgaaagatataaagatgattttgatgcagatggattccacatgttactgagaacatgaaaaggaggatcagacggaagcaagagaaaaattccaccttaggctctttcttgaaaggtgcagtttctccaccattgacatctccttagacctcacagtgaactggcaagtaggtccagggaagagatttctatagtatcttggctttgagtaaaagaaaatggacccaaaagcctcatcttcacaagacaaccttttggaaatagatagaaggcttgataccaaatgtgcttgaggtgtagctccaaagcagcaaataaaggcgctgccacacctgtgcaggtgccacacccgtgcaggtaccatccagtgggggcctggggcatcgcatgtcccagagcacccaggcacagggaggctgctcagcagtaggatgtgtggcttttgaggactcaaagacacttagggggtctctgcttctgcatttccaagaggacagatagctggggcaggtgcaccaccccactgagacaccagggcatgaagagtggcatgatatggtttggctgtgtccccacccaaatctcatttatactgtagctcccataattcccacgtgttgtaggagggacccagtgggaggtaattgaatcatggggcagttcccccatactgtcatcatggtagtgaataagtcccattagatctgatagttttataaggcatttcccttttctcttggctctcattctctcttgtctgctgccatttaagggatgccattgtgaggcctctccagcctcatggaactttgagtctgttaaacttctttttctttataaatcacccagtttcaggtatgcctttatcagcagtgtgaaaacagactaatacatagcacataggtggactgaaatccgctgtcccccatgagtgtgtaccgacaggtatgccctccaccagctgagcacaccagcacccacctcccctccctgacctgctcgcagccagcccacgcccaagccctgctgacattcatctcctttatctcttagcctgacaactcccctccttccccaccacactccactcaaagcaacgtcatctatcacctgaacctcctcactgactgctctgcctccactcctgcctccctcccaccggcatctgtccccaagctgcatccagactccagggaacacaaactcagccgcggcacccccttcgctgcctcctcctcgtgtcttctgttgccctcgtggtagggactgacatcctgatatggcccatgaggccccctggagtctgcccccacccagcggcttcctcaccatcacaacggattcccctctctgagcttctcctaggtggccatccgcccatgcctccaacattctactctcccttcttccaccaggcatttgcacacctgcagtttcctctttctgaaatattccttcagcactccttacttaataaattgctactcatctttcaaatacagccaacttcccattcttctggaaagtattcctggatccctggaaaggccacagttcccatgttgtactccatgtgtgtctttttgcagcacttacatgatttccattttacctgtggttgtgtcactttttgataactagctgtccttcctactagaccagaagcttctggtgggcaggacatgtctgcttttacaaatcatggtaaccatggtacttagtttagttgttgacatgtagccagcactttcttattcatttgctagttatggttaacgctgtgctaaactctggagtttaaacaatgaaccaggcaggcaaggccttgccttcatggtgtttttattttattgcaagagagatacaaacacaatagagattatgatgtttacaatgtttaaaaataaggactgctatgatagagaataatggcaagatacatggagtcatcagcaaagacctcctgaagcaagtgacatgaaaacagagatccaactggtgggaaagaacgagatttgcccaaaccagggaggaatattcccaacactggaagcagcaagagccaaggccctgaagcaaggacgagggcagcctttagtaatgtgtccagaaggcccgagttcttggagcagagcattgaaggaaatagtggttgataatacaactggaaagatgtgcagcgaccagcagaagaggaagagtttggatgttattctgagtgaatgggggagtcattgaggggactaaggcagaagaataaccacacctcgtttacatataaggctctccaggtgggctttatggagaaaggattgcacagagggtggcttggatagggcagagccatggacaaggggaagatggaaggagatctgtcccagaggcatagacaggaggccagggtgtccttaggaattctggcttccatagcagggtggatggtggctcatttactgaggtggagaagactattgaagaatgcatgggttgatggatgaataaacaaacaagcaaatatgtagagataaatagtacaataaaggagactgggccttcagggtgagatatattcataaggcaaaaaagcttccatatcggtcagggttctgctgagaaagagaaccaatgggatatgtatataaagagatttattttaaggaagtagctcacatgatcatagagggtagcaagttgatatttgcagggcagcccacaggctggaaactcagacaggagcggatattgcaatcttgaggaagaattattttcttcccagggaaaccttgtatttttttctcttaaagctttcaactgattaaatgaggcccacacatattattcatgataatctcctttacttacagtcacctgattatagatcttaaacacatctgcaagatgcccttcacagcaacacctagatttgtgtttgattaaataactgggtactataccttggatacattgacacataaaaataacaatcacaactctaaatgattgttccgtggaaaccactaggctttaccaataatataactcagaggtcagcaaactatggtccatgggccaaattttgccttccatctgtttttgtgaataaagttttattggaacacagccatgccaactcatttgtgcattgtctatggctgcctttgtgtaacagccacagaggtgagcagttaggacagagaccaaacagcccgcaaagcataacgtatttactatctggccctttacaggaaaactttgttgagccctggtgtcacttcattttgtggaattactcaggcaaagtgactgctgctaggcaatagtcaaagtcaaaatggttaatgggtctgaaaccagtggagatctgggaaaattttaaaagaatagtcaaacatgacaagaggtatcactggggaaaagaaacccaaaacattagcatttggcttccaagcagctcacattctggccttagacaactgttacctcactgctcagaaatggaagcttgaagctcgtgtggaaaaccgacctcctaataaatctcacacagaggatgcagcaatttgttatgcgtgagaaaatggcactgggaaagcaaaacacagccagcttgcttcatatcacaagtagcaattgggctcaggttttcacctaatttttaagcagcttatcaccacctccgaaaagaaaaaaaaaattctaaaaattgcattgcttttttttttctgagaagagcatattatgaagtgtaaacattaagaaagtcatttcccaatataactatttccaagctttgtctaccacttgtgctatcatccaaatgttggtgtccccttctccctgaaaatttggatgttggaacctaatctttagtgggatactagtaggaggtgaggcctttggggaggtgattaagtcatgaggtcagaaccctcatgaataggattagtgcctttgtaaaagacatgtgagagagcctgtttgccccttctgctatgtgaggacaccatgagaataatctgcaggagatgcaagaagcagaggcccttcactagacatggcatctgctggcaccttgatatcagacttcacagcctccagaactgtgagaaatagatgtctgttgctaataaattacccaacctaaggtattttattatagcagcccaaactgactaacacaactcactacctttaaatatttttgtccaatcaatacagctccctctcccttttttggggaataaaaccttgctgaaatgaacggactctaatatcttgatttattaacccacatctgagccaaaatgatgtttgtttgagaatctacttagtactgactgaaagaaactgtacaagaggtttttttgccaatgtgtgagaaaatagatcagagataagattaatctttacaaaagacaaaaagcttacaatgctttgccaaataaaattaactttcataatttgcctactatgtatttactatgctatgctatctgtttagcatacaaaccccctacaatccctacagtaatcctagatggtgcctacgttttaatctcaggtttatagatgagaaactaagacaacctggacttaaagccaggccaccttactccacaggccacaccccccaccacggtgaacactacagctgtgataagacaacagaaaattgcttatccaaaataataaattatatatttatattccccttgactcacctgaatagtgttcatttttatttagaaatgtaactgtattcgtttgttctcatactgctatgaagaactacctgagactgagtaatttatgaagaaaagaggtttaattgattcacaattctgtaggctgtacaggaagcattgctagggaggcctcaggaaacttacagtcgtggcagtaggcaaaggggaagcaggcgcgtcttcacgtggtgacaggagagagcgagcaagggggaagtgccacacacttttaaatgaccagatctcctaagaattcactcactatcatgagaactggaaggcggaagtctgtccctgtgattcaatcacctcccaccaggcccctccaacactggagattacaattcaacgtgagatttgggtgaggacacagagccaaattctaacatcttgatttactaacctacatctgagccaaaataatgcttgtttgagaatctactttaagtaacaactgaaaaaaatttatgagttttttattgccaatgcgtgagagaatatatcacatactgacaagataaaataagattaatatttacaaaaggcaaaaagctcacgatgctttgtcaaataaaattgataatttccctaccatgtatttactatgctatgctgtgtatcaaacaaaaccccctacaatccctacagtaatcctagatggtgccttcattttaacctcaggtttatagaagagaaactaagacaacctggacttaaagccaggccaccttactccacaggccacaccccccaccatggtgaaaactacagttgcgatgttaagataacagaaaactgctattcataatagtaaattatatacttacatccctcgactcatctgaatagtgttcatgtttatttaggaatgtaactttttaaagaatgcaaagttttatttaagaacctgcaaagttacctcatataacagcaatattcctgccattatgctgcatatggagatagaaacctataacaatcatctttccctctaacttgcttccaccttctccagtgggtgacagaaaagacagataggacctgtacatccagctttctctgctaccccttgaaaaagctccatctattccaatcagtgggcatgcagcttcctggttttcttacacttgctgttactcatagagtatctcgtgctgttgtttgcatttttactagtttcagcttattttagggtttcacttaacgcacagctttgtacggaaagtcatagattccactgctcctctcagtgttttacacaggttttactgaaacccaaacccctgcctagcatccctctttttcttcctcacttcccatggcaaagtcagaatttattcttgagatttcaatcttctcagccttttagctttcctggctgtgggaccgcagaaagctagcactgcagctatggtctagcaggacagcgtcccagccttattccctctgcacttaccatttctgtgaacactggctcagtgtccaaccacaagccccatctgctctcttgtgaagtggaccagaagtgtccaggattaatgctgcttaggctgagagtaggtggatcaacatcccagctccctcacccttcctgtagatgacatttcagtttcatgttctacactttctcccagagtttctcaatggcaccattctccagttggccacggtggtaaattgcttggtgatgcattttgtatctctgttgtgccttgcaaaacccacttcctaattgctgtttcttgggatggcctcccaaataaagtacttgtgtttgacatcttatctcaggtcctgctggggaatccaaattaagtcagcatgctgtataacataccccatctcccctctctataaggacatttcttttagactatctcttatttcagtcctgagctccaccttgtcaagtattctggatacccatgagggcttagcaaaagggcctatgtctgtcaccctggatgggaactagccacttcaggaaagctctgtgatagccatgtgtaaggtcatagttagaaatgcccccaccctttctcattaagttctccctacccttattcacatttggcactttatttaactcttcccattcatatattttgagacttaggctgaatttagcaactttacatcttctaccctttctcattgtgctaaagtctccatcagggtcatgcaaatggggaaataaaggttgagcaaatggggaaatattattctccatatggattgtgaaagtgtgcaacctataccactgtcagcagcagctctggtcttcatcctgccccattgttttctgaaggtgcacaatccagcctcctactagaagaacccagactcttgtttccccattcacaatgggggtgttcacttacacattaggtcaacatagttgcaggaggttctagaatctagccactttggctctatcacttattagctgagtgaccttggacaagttatttaacttcccaccagctcagtttctcatctggaaattgagaacaatttcaattataacaatgtcataaaatctttgtgtcaggtgaaatcatgcatgctgagtgctttgacagcacccagcattttgcgggtttttgacagatgtcagtcaccaccgactctctgtcttccccttctgcaggtccagcctccagggcgatgacaagggtgagagagaaatatgagcccagcctgccaggtcaggaacaaggagagcgaggagctgcctttccttttccctggctccttccaagtggcagtgtggacaaacagaacaggcaagatgctgtggatgtggagctgaatgattcatcatgcacatcaatttaaccagagtcagttagcagtatcccaaagctctgaaggacaggggctcaattaaccttttaatacacaagtcaaatttcttgtcttcatgacttacttctttaccagcaaaaagcctccaaaacccttctcagatctttgtccaaggtgaggctaaactctgtcactggtggggcttcctctaattccctgtgttgttctgtctgctgtgatgttatcactctaagagggagggtgcattttgaggatgacagagaaggacacgtatgatgcagtgttaacgcagacctttctctccacctggatgaagaactacgttctctggccgccctcatacttgtcgttaaaagaacgtaaattatttcacaattctctcccctcaaacacacccactatttctctttcttcctgcaagagctgagtttttttctcttcaggataaactagcacattcttttaattcccaggaaattatacttttccagggatgattaccacccattctcagagtttataagtccaagggtaaggccctgatccaattggggctggagctacagatgagaatgaaaatgacagaccatctctgtgtgctcctggactgtgagaggtaaaatttggaatctgacagctgtcacgtttcctgataaatgaaccagagaagtggagggagaagggaggcctgggaaaaaggcgctcctcctaggcttcaagtcctgaagccaaagcacattctttactttgagtcccaaaaggcaactcattattattccaataacaccacctttgtttagtctgataggggtacggtttctgtcactagccaacctagcgatgattattacattatttaaattaaacacccatttctatttttgggaggccctcgtgggtgatcaacctgctgatttatgaaccaattcatgctacggtagtgatggggaatagcagttaccacactatcttttgttataccaactttgccttgacacccaatgtttaatgtcttgacctaaagtaatgactaataaaccccaatgccagcaaagaggaagcccacagagaaccagcatcagtgcagatgagtctcaaggcaacacccaaatatcccactaggcctctctcttcctgcatacacatatgttaaggcttgaatttaatttttttctcacactataaagctaagctgtgtcagtaatccccatgccaacctgctggagaaaaagtcaatctaacatcattacatttttctggctattttaattcagttaaaaaaataaaaataaaaaaccacattttccctagtacctgcctatttctagaaaaagctaactggaaatcagaaacaaagaagacagcctttaactgctttattaatgggagcttggtcatgtcatttccaagttcttctttttccaaaagacccaactgatagtcccgtattcataaggcacctgctccctcacccctacaagttcaaatccagttttctttcccttttggagcttttcctggtgaaattatagcttctcatagtgaaggtgaacagcgtgctggcttatctggtccctccgtcaccttccccacccctcatctgccctctgcaggtcagggtgtcaacagtctccaggacaggtgttaactaacctacccctggaggcactatgtgttgggcagtgagaaacccaaactacattccagactcactcatttgaaaatggaattaataaaactgggaattaatgaataacaatattttagaaggagtcacaattgcaagatgccctgctaacccagcatccaaaaaactgctgtttactctgtcatctttggcaatacacaccattattacatcttagttgcttaatccgtaagaggcaggtaagatgccaagcaattccttggagttatggtaagttattcatgcaaacactatatttattaagtgattcaagcataaaggtcattcaacgcttacgctctctttctaatgcccttctgatgctccttcttttaaagcctggtggcaaaagcactcccaactcagaacacaggagtacaacttgaattcagagaatttaagatgatctctaaatcaggatgagtcttacaatccaagctatgtcttagaattacataaaataatggtgcattttatataatcagtggcattttagatttgatgaaatacagcaactgaattagtcctcccagaattcaaggtctttttaaagcaggatttaattcatatctcagtagctttccccaaaattttcagcaattgcaccctgcccacctattcatgaagctgagagggatcacaggagttgtctagtcccaagtccccagagatgttttctggtgatagactgtaaccaaaacgacctctggtatttattaagtttgcaaaatcttgtgtcaaagttttctcagagccttttatatgctaattgaaattatggatttgtccgaaaggtgttctagactttagaatttccctcacttatttgaccattaaaccttttatcctaggactgatttgtaggcgaataaaaatgctgaaaaaaagtgagaccttgaaagattacacaacctgcccccaaagacccagttaataagtggtacagtaaagaatgcagtctggcttttcttattctgcttctgattctcctaccacacagcactgcttcatggatcagttttcaatgaaatgaataaaaggcaccatggtgtagttctctcttcactcacgcacttccctcagaatttcaaagccaacgagttaacaaaaagacaaatttacactggaaatcaacaaccatctaagctgtggaattttttagtgcattgtgatgtccattaaaatctgtcacccaattgccttccaaaaccccagagcaactgaaacacacaagcgtttttgagtgggcaggggttaaggggcagaagccaagagaggatcagagacatctcccagtaacacaggggcccatttccctgaacctgtcaaaacctttgagcaggtaacaccgaggagtgggtctcctgtggctggctttgcaactccttctcttccgattatgaaaatatccttcttacactgcaccgtaatcatttgaatttttattgttttcactcaaaagctcctaagttatttagataagcaccattaaacaaaaatctgagtaattagttcttttgatgtgtcctagtggcagtggaggaacttgaagacgtttattaactgttagatcagtcccaggtgggacttattataaacagagcttagccccagagcagccgctcattaaatactgaacaggaattaggtatttctctcttcccatgccattcttcatcaaccagcctctaccacttgggtaggattattatattatatattttatgccactaaataccacaaatcattgcttacgtgaagtcccggaggtggggctagaacacaatcacaccctcctttagagactgcgacccagagagaacaatcagaagggactcccagagatccgctatttaatcctctcatttggctggtcagagacagagatccaaagaaattaagagattttctcaaggccaacagctggtcaatgggacccgcttctcccatctcttgctttagtaaattttccatgccaagacattttcaagtgcttgacagtcacccacggatgctgactgctctgagtgatctatggcaaaccacccactcttttcccagaatgataaatgtttcttatgtctaatgttgatataaaatgttatgaaaacgagaaaatttgggggatcttagaaaataaaagaaagatttacatgaaataaaaatgagtggttttatctcgtgtatgttggaaaacagaatagaagttgattggcatccatggcagaaggggatctgggttctcacttgttcccacctgttcaagcatcccagtggagtcctcagtcctcaagtctgtaaaccaggctgaacagccccaggtgaccgggacacagtgggaagtgagtcaactaacccctaaaagctcctcccagtcccagggtcgtgccttcattcttgaaggtcggtttctctacagcataaacgtcattattcataaggctttctcccctgtgtcatgtaacatagggcagcacaaacaagactgtttttttttaatacatagatggagtttcgctcttgttgcccaggctgcagtgcaatggcacaatctcggctcaccacaacctctgcctcctggggtcaagagattctcctgcctcagcctcccgaatatctgggattacacgcatgcaccactacgcctgactaattttgtatttttagtagagatgggtttctccatgctggtctcaaactcctgacctcaggtgatctgcccgcctcagcctcccaaagagctgggattacagacgtgagccaccacgtctggcctgcacaaacaagattttaaatatgttttcctgttactctccgagtgttttgctaacagatgatttgcaaagaatatacatagaaagacagctctcattcacccactgagaatcagcctcctgaaaactttaggcagactcaataaaaataaacttatcactacatccctgctcctaagttccatgcagaacacacatcaggagtctgtagcaaaatacctctactcccctgagagatttgtacatgctaatctcaatgtccctaacatagcatttaacagcttcaccagccacatggaaacagaagaaacaccaagtttttgtggggaaaacatttcaaaaggacaaaatatctttgaacctgactctaccttactatcatttctcatttttatgtcttatttaagatctgtgaaaaacaatccaaggtttagtgctgattttcttaacaaaagaaaatactcaaggttgttttcataaatagacaatcttaactcaattttcttctgttaccacatgccacatttaaataacctcaatggccaggaaaacttaaaaagggaactttcatgagttaggtagggcttggctgcatctaattcaatgtcattcacaagaaaagctaaaaatctttacctgcctgaagttcttaatggaaggggaggaagaaacccaaaagataaatgaacaatgcatgtctaaattaaaactgaaccaaaaaaaaagacatcagtcagagaaacagtcagagaaacagagagaaaagtagcaactttaagcatgatgaataactgatccacatccttagcaaaaacaagatctcatcaggaaccaatcaggagcaccaacctgaatttgctgattcatggaaagcaataggtgattaaaaaaaaaaaagcctgagcctctttcttttccatttccccaaccagacaacctgcgaagacactacacacttatgatacattccagattaactttaccaaccaactctcttggactttactgttaattagtgcagaggcaactcccttttttctcttctgcctcccaggcttcccctctggatgctaatgaaatagggagatttctaagtttcattgtctcagttgagcagtgctattctttttttttttaattttattattattatactttaacttttagggtacatgtgcacaacgtgcaggtttgttacatatgtatacatgtgccatgttggtgtgctgcacccattaacttgtgattcagcattaggtatatctcctaatgctatcttttctacaggcaatatggaaaaaataaacatggaagatttctggatggaaacagtttacaatcaaacatcccattgttgacaaaatcatcataattgtcacttcgcgcctctttgccaactgtataattagtgtcattaccagtaagtcatggaaatataaatgatagtggattatacaacccaaaactgcataaacatgaatattttatggtacctaagcaatgtcacgaattgtacataacatagacttggcatttgcttccagcagatcttaagatttctcacccagactaagtgcacagtcttaccatatagctttagaaagatgtttctggatggatgttaccaaaggcaagtgaggaggaggaggagaggagggaaaaaattctctttggaaatgatttttaaaaacacaattattagtgtatttttatgtttaggacatgaaattccatttttatattttcctacatggaatataatttcaaaagaaaatatttttaaaataacaatttaaagccaaatgtattcaattttgtattgcctactatccgatcactcatgtttggatactttggcaaatatgttagaccagatcactctgcacccaagttgcctatactctccctgactggggtgatctcttcctttcccctctgcccaagaccagctcaagacacactgctctctcccttctttgaatttctaaaggccagactctggaaaacataggttttgacatttttaagactctgtaaattatggcaatcaaactctttttgtttgtgtatacatttggaattgccatacttctacaagcactcccgtttttagtgtctaatattgggccggtgggtcataggtactctgtcaatatgtaaggaaaattattaagtggacacgttcattagtttttatggaaaataagatgggaatggaaaaatattggataaaacccaactattcttttcaacagaattagatcacaccctggtaatcaaaagcatccatacagcaacaagtggtccgtgtggtccttaaaacatgccagtaggggttgagaaataccctcctaatcaaggtgattattcatgacaaacttgtatatatagtaagggccaggtgagtctttcatgacatcattagattatcagatctttgaggaaacagagtggtgtctggtttgtttatagctgtggtgggcaaaacaatggcccccaaagacatccacatcctaatccctggaactggtgactatgtgaggttataccaagcaaaaacaaagcacaaagtgttcttttttctttattcttaacctagaaaatgtttatcatatttaaattttccattttgactcagttactgtgctttctgaacatgtatacaatgttatggtgaagtttcagaaaatctttgaaatctgcagctgcattagacaaagagtataaatgtacctgttcaaagtttaaaacataaatttctgtttgaaaaacgaagatggactgataggttgaaacttcatcttacaaggtttatagtgacacaaagcagttgacacaatgacatttctgcttgaggaaacttactgtgggtacattgaagagaatgaattggtggaaaaaggctgcgggcagaccaagtaagaagttgttacattaaccccagcaagggatgcagtggcctggcctcatggcagtggggctaggcaaaagtagatgaattctaggaaaggttaggaggtaatattgacaggagttggcaactggaggaaaaagagggagaagtcaatgggatctggaccacatggtgaaagacaaccgttcagtaaggagcagagcatgagatattatggttgagtatgaaatttattatggttggacataatataataagttgaagggagagatttttttaagaaacatatatttggaagtcattaatatatgaatacaaatggaggtcactgagtatgaaaacacccagggtagcatagccaagacaatactaggcaaaaagaacaaagctggagtcatcacactacctgacttcaaactatactacaagcctacagtaaccaaaacagcatggtactggtaccaaaacagatacacagaccaatagaacagaagagagacctcagaaataacaccacacatctacaaccatctgaccttcaacaaacctgacaaaaacaagcaaagaggaaaggattctctatttaataaatggtgctgggaaaactggctagccataagcagaaaacagaaactggaccctttccttataccttatacaaaaattaattcaaggtagatttaagacttaaatgtaaaacccaaaaccataaaaaccctagaaaaaagctaggcaatatcattcaggacataggcatgggcaaacacttcatgactaaaacaccaaaagcaattgcaacaaaagccgaaattgacaaatgggatctaatcaaactaaagaacttctgcacagcaaaagaaactatcatcagaatgaacaggcaacctaaagaatgggagaaaatttttgcaatctacccatctgacaaagggctactatccagaatctacaaggaacttaaacaaattttcaagaaaaaaaaccaaccccatcgaaaagtaggcaaagcatatgaacagatacttctcaaaagaagacatgtatgtggccaacaaacatatgaaaaaaaggtcatcatcactggtcattcaagagatgcaaatcaaaaccacaatgagataccatctcatgccagttagaatggcgatcattaaaaagtcaggaaacaacaggtgctggagaggatgtggagaaataggaacactattacactattgctgggaatgtaaattagttcaaccattgtggaagacagtgtagtgattcctcaaggatctagaaccagaaatatcatttgacccagcaatcccattactggatatatacccaaaggattataaatcattctactataaagacacatgcacacatatgtttattgaaggactatttataatagcaaagacttggaatcaacccaaatgcccatcaatgatagactggataaagaaaatgtggcacatatacaccatggaatactgtgcagccataaaaaagaatgagttcatgtcctttgtagggacatagatgaagctggaagtcatcattctcagcaaactaacacagtaacagaaaaccaaacatcacacgttctcactcataagtgggaggtgaacaatgagaacacatggacacagggaggggaacatcacatacgaaggcccatcagtgggtgggaggcaaggtgagggagagcattaggacaaatacctaatgtatgtggggcttaaaacctagatgatgggttgataggtgcagcaaaccaccatggcacatgtatacctatgaaacaaacctgcaagttctgcatatgtatcccagaagttaaagtaaaataaataaaatttaaaaagaaaacacccagggtaagtgtacagattgaggacctagggaaaaacctctgaggaacatcattttcaaggaacaggacagaagacaaattgacaaaggagactaagttcatgactagatagaataaaaaccaggagaatttagtgttatgatagctaagagagaagatttccagatggtggatattaaccaagtcaaatgctgctgggaaatgaaacaagacaaaagattgggcattggagtttgcaatatggatatcattaggaacctggttgagaatattttagtgaagttttggggacagagataggcctgaagggtgttaaagaggggtgaatgtaagattgtgtctttgaggtgctatacaggaacacatgagtggggtaatttataaaggaaagaggtttatttggctcacagttctgtagaacattcaaaaagcatggcaccagcatctgtttctggtgagaaattcaggctgcttccactcaaggcagaatgggagggggaactggcatgcagagatcacatggcaagagaagaaacaagaaagaggtgaggaggtgctgggctctttttaacaaccagcttttgcaggaactaatagagcaagaagagaactcactcattaccataaggatggcaccaaattattcacaagggatacgcctccatgacccaaacacctcccattaggccccacctccaacactgagaatcaaatttcaacgtgcagcataagggacaaatattccaattataacagagcaccaggggagaaagtaggaaaaacaagtgggacacctctttcaataagtttagctaaaaaggagaacaaaaaatgagatggtaaagatttgtaacttttttttttttttgaaaagagagaaatgctaatctggagaggccagtaaagaggatgaggttgaaaattcaggtcagcatgaggataactagtgtcacaaggtacctggggagctgggatgggtctagcccagggattaggggatgtgttatggataataataaaaaacatgtcttcactgtaatgggatggagtgaggaaagaatggacatggtggctgcaggtgagattttcaatatggtggaggaaaactgaagcagtttccttctgctggctttttattcttctgttaagtaggacatgaagttttctaaatgcttgattttgaaaggagagctattctagcatttaaaccaaacttttaatacaaataaatccaagattttcatgtggtaccatctctgcataggtctaaatttttatttatttatttatttgagacggagtcttgctctgtcacccaggctggagtgcagtggcacaatcgcggctcactgcaggtctaaatttataagaccataatctaatggtttaaaacaatttaaaaagaggttgcaatgttatttgatgctcaactttataaaagagcttgtcttagtctatttactgtagctataacagaatttctgagatggggtagttgataaataaaagaggtttatttggctcatgattctggtgactggagagttcaagattgggtagctatatctcatggagccctcaggcgctttcactcatggtggaaggtggaaggggagctggtgtgtgcagagatcacatgccatgagagtaagcaagagaaagagggagggagatagtaggcttttttcagcaaccagctctcaagggaatgaataaagcaagaactcattcaccccagaggaagggcattaatctattcatgaggagtctgcctctatgacccaaatacatcccattaggcctcacttccaacactggggataaaatttcaacatgaagtttggaggggacaaatatccaaaccatagcagagctcattcataatacacaaaaagaattctcaaccccctttgactcctctacaaatctctcacttctgtagcttctcaagagcctcccaaacaccaaaaatacccctccatacccagccagggccaactttcctttctctcttctcattctttgccttctagctctctattatgaaaataaactgaaggcttttagctaaatctttttctctttcttcttatttttagacttctcccccttctatccattttccagatttaaagttttccatcacagtagatccagcaacaggtctggaaaatacagaattttactcagaagactctaataggaatataaaatgaatgaacataggggaagaactcacacatgattaagtcaaggcacagccctctcatcagtaagacacaagctaccctcgtagaatgtgatgtcaaagttggagaatggcctagcatagccatcaccatttgtgtagaccttaaatgctgagggctgccccctcccaaaagaacagaggttaagtggataaaaaagagtgatcaataactccgaaaaattgaccatggcatagtgatgtagctgatactggacaaaatttgaattattgatcatgtacagcatctgtacatttaaggcattaattcttcagatactgaaagattctaaaaggaatgaacaggaatgttaaccacaggacttattggagactataggttaggctgagccaggaacaaaatccctctatgcattaataaacttagtaaacccacagggaatgtgggagatgctttccactcttccatgtagctgttgaagggctcattacctgtgcacacaaacaagagaaaaatcaaaattcctctcccataaagcgatacttcaaagaaattgtcttataagtcaagtacaaagaacaacaaaatcacactggattaacacaacaaaactgatttcctgctcatgcaaagttatttgtggatccagcaaccttggagaacaggtgtcctccaaggcaatgtctcagcctcctaggctgctgtgaacctctcttttctctgactcaacatgcatccatatggccactaaggggaaaagagtactggagagtttccatgctggacatacccctttgcctcttgagaggccctcaccagcattcttcaccctgattttggttgcaggaggcagatctgtttggaatgcataaatgagctatcttgtcttctggcttctcattcgatttgaccaataggatgcaccagcaggagatccaagggcagaaactgggtgagtttagggcgttattcctccactcacttcctgtgaaatcacagtggcctggctgcacccctctacggaggaccagcacttgctcacatactgtctgcctccctatctcttccactctctgcattcttgtacttgctcccttcccttgccttttcaagcttaggtgctgtaagacctccccagagtacaccaccatcctgctgctttcttaaaacatagcccacacctttgcaaacttaaactccagcctagtccctttagtaaactcttccattactcagattttaaatgatttgctctgaacgtggcccacatcacttccacttgaaatcatcgaccagaattagttacattccttgcttaactttaacaggaatgggaagtttaatcctctcaattacccaagagaaaggagaaccagatattggcgaaaactagaagtctactgctgagacctagcaatagacataatgtgatttacatgataattatagagaagcaggtcactttctcactttcatcattagaaacagcacataactcatcacaatcccttttcagtgtgcttccaaacagttggagcacttccaaaagcagtgatcaagtacaaaattaccaaatcaatcctcaaattggcaatcagattgaaataactgtttcctctcaggttaaagaagattaaccattagctctttagaagaataagcagggcagtcacagactttatgcaatattgattggatgtatcctcacatacaaatgccatagagtagctctcagggagctattacacaactgtctcaggagaggcagagataccatgttatacttcaatacgtatatgatgattgattaaaacaaccagaggtaggtgtaatactagctactggccagcccagaaatgaccagggcatgcagaataagaatagactggagtcaggagctggatgtctttggccacatcttttagtctggttccttaaatataaactaaggcaactagatcaaaggttttttatctgtgataaatggatctatctcattagatctgctaaaatgttacaaaattggaaatatatttgcttgtgtggttttctaatggaaaatattcacaggtttcataagacctacagaaatatcctataaccctcccccacccccaccaaaagaggttagaaccacagggctggatgatgtcacacactgcttccaaatccaacattttataattctatggtcacttctggtcaatatattggtctgatgaaaagaccatataatatattctcatgaaactaaaactttcccagtatagagacagcagacaggtaatgctcaatagaggtatgtaaatctgaatctgtatttatttttcctaatttttgaaaatgtcatctgtaaaaggtcagagaaacatctgttataaatgattccttctgttttctttttattatttaccccaaaataaggattcccacacttgctttacatttcatatttgttttactctcagtgactctatataaagtaagaggtatacaagagtttcctccaaatgagattacatgactattcaactttgaaacaagatcctgaaatacctatttaaataaccagtaattgttatgcacaaaatcttctccaaagaacaaactttaaaatggttattagcaactcttaatggaccaaattttctaactcaatgtcctaaggtacctaaaccacctgctctcagctttattgtcctgttgctttaattaaccataggttcagtttaacttgcattctaattgggtccttgactaattgtgcattaaatacttggtagcacaatacagataagtaactatcaactttcatttgaacatagaaagcaatctgggaaggcttaggatgtcattagactgtagttgatggtttcccgtggaaacaaaggagaaggaaaagattaaaatgactcaaaagcatgatcgatacccacaggcatacatcagagatcagaaatctttaaaataaagttttgtgttaagttagatacactacccattctggcattttcaaagtgtatttagggtgaggctgaattcaactccaggattcaggagaggttgaatgtgcagattcttataagaacttgtgagtatatgtcctggtattcactgtcttgtcagccaatgttagcttttggcaatggcagaaaataactgagtcctctgtactccagggtccatgtagctctactgaaaacttgtttcttctttacatgctcttctttccactctggctttcctaacacctaaatgtctgatatccctctttctccaacaattacttaaatattggtgctatctggccgtctagcctgaggcccctcacattgtttttatgcatgaatgaagaactcccacttacgaattcttagcaaatatatcattttttttatactttaagttttagggtacatgtgcacaacatgcaggtttgttacatatgtgtacatgtgccatgttagtgtgctgcacccattaactcgtcatttaacattaggtatatctcctaatgctatccctccccttccccccaccccacaataggccccggtgtgtgatgttcccctttctgtggccacgtgttctcattgctcaattcccacctatgagtgagaacatgcggtgtttagttttttctccttgtgatagtttgctgagactgatggtttccagcttcatccatgtccctacaaaggacatgaactcatcctttttcatggctgcatagtattccatagtgtatatgtgccacattttcttaatccagtctatcactgttggacatttggcttggttccaagtctttgctattgtgaatagtgccgcaataaacatacgtgtgcatgtgtctttatagcagcatgatttataatcctttgggtatatacccagtaatgggatggctgggtcaaatggtatttctagttctagatccctgaagaatcgccacactgacttccacaatggttgaactagtttatagtcccaccaacagtgtaaaattgttcctatttctccacatcctctccagcaccggttgtttcctgacattttaatgatcaccattctaactggtttgagatggtatctcattgtggttttgatttgcatttctctgatggccagtgatgataagcattttttcatgtgtcttttggctgcataaatgtcttcttttgagaagcatctgttcatatcctttgcccactttttgatggggttgtttgtttttttcttgtaaatttttgagttcattgtagattctggatattagccctttgtcagatgagtagattgcaaaaattttctcccattctgtaggttgcctgttcactctgatggtggtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggtttcaggtctaacatttaagtcttcaatccatcttgaattaatttttgtataaggtgtaaggaagggatccagtttcagctttctacatatggctagccagttttcccagcaccatttattaaatagggaatcgtttctccatttcttgtttttgtcatgtttgtcaaagatcagatggttgtagatatgcggcattatttctgagggctctgttctgttccattggtctatatatctgttttggtaccagtaccatgctgttttggtcactgtagccttgtagtatagtttgaagtcaggtagcatgatgaacatcagtgtgaaaatcctcaataaaatactggcaaaccaaatccagcagcacatcaaaaagcttatccaccatgatcaagtgggcttcatccctgggatgcaaggctggttcaatatatgcaaatcaataaacgtaatccagcatataaacagaaccaaaaacaaaaaccatatgattatctcaatagatgcagaaaaggcctttgacaaaattcaacaacccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtcttggaagttctggccagggcaatcaggcaggagaaggaaatattcaattaggaaaagaggaagtcaaattgtccctgtttgcagacgacatgattgtatacctagaaaaccccatcgtcttagcccaaagtctccttaagctgataggcaacttcagcaaagtctcaggatacaaaatcaatgtgcaaaaatcacaagcattcttatacatcaataacagagagccaaatcacgagtgaactcccattcacagttgcttcaaagagaataaaataccttggaatccaacttaggagggatgtgaaggacctcttcaaggagagctacaaaccactgctcaatgaaataaaagaggatacaaacaaatggaagaacattccacgctcatgggtaggaagaattaacatcgtgaaaatggccatactgcccaaggtaatttatagattcaatgccatccccatcaagctaccaatgactttcttcacagaattggaaaaaactactttaaagttcatatggaaccaaaaaagagcccgcattgccaagtcaatcctaagccaaaagaacaaagctggaggtaaagatatcatttataaaatcttgtctaacatagatagtcttcctctaatttccatttcaggttttaaaaatttttgataagacaagggattagtcagatgggttaattccataatttacggttcattagcccaattcggtataccctcaaaactttcagcctaagaagagtcctagagatcctgcctcagactggggatatagctttgttaccagaaaagagtcccgatccagactccgagagagtagtacttggatactgcaaaagaaagaatttagggcgagttcatacagtaaagtgaaagcaactttattaagaaagtaaagaaagaaataggccaggcatggtggctcacgcctgtaatcccagcactttgggaggctgaggcaggtggattgcctgagctcaggagtttgggaccagcctgggcaacatggtgaaacctgtctctactaaaatacaaaaaattagccaggcgtggtagcgtgcgcctgtaatcccagctactcgggaggctgaggcgggagaattgcttgattccaggaggtggagcttgcagtgagccaagatcgtgccatggcattccagcctgggcgacagagtgagactccatctccaaaaaaaaaaaaaaaaaagaaaaacagaaagtaaaggaataaagaatggctattccattgacagagcagccccgcagactgctggttgtccgtttttatagttatttcttgattacatgctaaacaaggggtgaattattcatgagttttccagaaaggcatgggcaatttcccagaactgagggtttctcctgattttagaccacataaggtaactttctgacattgctatggcatgtgtacactgtcatggcactggtgggagtgtagcagtgaggacagtcagaggtgactctcatagccatcttggttttggtgggttttagccagcttctttactgcaagttgctttatcagcaatgtctttatgacctgtattttgttctcctacctcagcctgtgacttagaatgcctaaccatctgggaatgcagaccagtagatctcagctttattctacccagccccaatttaaaatggagttgctctggttcaaatgcctctgacagtttggcagcatctaaatgacatcagtttggaagtttgtaccccaagagtctacacgagggagcataaagtagttcaaagtgcctgctataatcctttccatgagatctaagagtaaagcctaaattgctggcctgtaccttacgcgagagccttcagggaagcatcagagtaaaacaaaaattatctggagatgacaaagacttatggttgtggtcaatttattactgtaattaatatcagaatgcaggaggatacaattcccattagagtatagagaataattatttcataagggtttgatcaatgtctcccaagagtaaggcaaatccccagaatcttcttataagaaatatactttctgaaatactcatgttcatattcataacattgtacctctacaaactcaagaggaggttaagcatctcttctaatttgacagcttttcccatggggctcttgcaatactgttgggctaatttaagaaatacatagcacataaaacaaaattttttttatgtttgtcttttcatacagtaagaaagtaaatctttgtgagtggttgggggcctttgggaaatttcaaaggtatttttcggtgtaaaagatatcatgacatttttattttattttttctaaatataggagctgatctttgcaaggcaaagtcgaaagggttgtcaggagatttggggcacttgattttgattagatcataagcacctgagaaacaactgcatggtgatctgtttaatcaatgtgacaagaaaatattttgaaataaacataaaagataatatgctcataaagaaccttagttctttcacatgtgagaaaagtttgttctctggatttttcttcaacaatcaaggacataataaagtcaaaataaagcacacacataaagcacagaaaatggttctggtaggcacaggttctctgctccccagacagatttcagagaagttaaagaataatctttcattctgtaaacgaaggcattaatcatcaaaccaaggaaataaacccatcaaaaatgaaccaacatttaagattttaatttactttatgccttcttttcagatttagttattaaaaaccaaggcaaataaaattcattttccaggtctcatattttactgagctctttcatagtgtggaacaaattgacttttatattaggataaaactactctcctttttcttacaaaacaaaggcatatgcccacctgcctttctctgtcatgacctctagtatagtctcaaccacagatactgattacagtttctcatcaaggtgaatatttcctatttcacagagaaaaatagagggtatatgattgagaagtgtcattctgcagcattttagcagaatagcacggctcatgaacacatttaacacagctttggacagtcacagccaccccttttacatcttcttaaagtggcaaaaatgacatttattaacatgatatagactcttcagcatgtagaattataaaacttaaaatcatgcttagacatcaagatttcagtattctgcattacttacacaatgtctagatatctaagaattacccattaattagcttaaattaatattagttcaagactttaaattacctaaagaccttggaaattacatttaaactagcacgctgaaaaacataattaccactgatagaaaagtttgttagaaaaatgattcaatttagttgaacacaaattacttttctcataatctttaaaactctgtaggagtattattagcttattttatctcaaaacctatataattttagaaagtttaggctatttttttcatgagaaaaacaacccaagtaaaataacatgtatatacagttaatatcaataattttgaaaccatgattattaaataaattgttcccatttgccaaatatatatattaattatgtgaacctagattcttaaaagttttcaacgtagcagtttgtgtaaaaataatttttaaagtatagcacatttttaaaagtctagcacttttaaagtattagaaatttgattttactactttaaagaaactctaagaatatttgatttacttaggtatgtattcatctctataagtaattagaacaaagctcttttaactgaagaaccataacaacctaatttattaatatctcctggaaatagggaagaaatcataccagtccaatgagggattacggcctttgtcagttacgtatacacaaacacacaaacatgaaaacatatacagaatttacagcttcagttctacagcaactgccccaggtcaaaataaacatagacacatacgaactccgtggtccagatttcaaagagctgttctccttcccagaaatttttaattggttggagctcaaaatagacaaacaaaatctaaaagaacccaacaaagaactgtgtctctcacccaacagagaagagaccattattgtccacctatagagatcaacaaattgaagataatagaaccatatttccaatccttgctgcctccaaggaggaataaattagtatccgtgtgagcaagaaacaaaaacaaaacacaaaatcagggaaaaggaagaaaataaagagaaaatcaaggttaaacttctacagccacttggaacttagactgagagccaagaaaagactcccccaggcttcggcagcccatgaggtgcacttgtcccataacagttgtcaagtaaatcctgtcgtctccctggggcttctaaactaatatagaataattttcaaatggtaaaattatgactgtcatacaaatataaaataaacaggggtgaacagttttactttcctcatgaattcatgaaaaaacgctgatatttaagcatttatgcccagaacatgcagctggaatggtgaaccatataattttgcacagcttccttaagtcatagctattggaactgtagaagtcaaagcagatggtggtgactccattatttaatctggttcacaaaacatcgtatctgtcacatgctctttgtaacatctaaggtaattacaaacatttattatttaaaatttgatttttataattgtcaaaatatattcaaaatttagttggctaaattggttgaatgatcaaactggacaaccatcattgtaccaggaggctgaaaccatgggctcagtctctcccactgacactgaccaactttgcactcaacactctggaaatccagcatctcattcataaaatgtaaaggtcaggatgcacactctttgagggcctttccagctccaaagtcgatggcaatgttgtcaatgaaagatcaacagatcagtgcattatacccagggtgcttgtacagttaaaaagtttctggcccccttcccagatacaccaaacagaatttgggtggaatccaggaatctgcattttaaataatatccatattattcttatacaaactaaagtttgaaaatcattagtatatggatgtttttcccctgaacaaaaaccagttatgactgaaaaatagttatcgagtttttctggtaagtggtacactactcagtgccttcaagtaaaggtgatctacattacaagttgtctaaaatgatgtttgaaaaggaaccaggttgtcaggttgtcactatttttaaagtggtggtttattatggtacatggttcattataccaactataagattttgagtatctgcttagttcaccagtgaacagctgtgaaccaatgtgtagattcttttacccattcctcttgcttttccctttcttctttcttagaagtggtttagagaaaacaaataaaaccaaaagctggttctttgaaaatataaataaacttggtaaatctttcactacactaaccaacaaaatgagagacaagacacaaattatcaatatcagaacttaaagaggggtcataactaccagtcctatggttagtaaaaggctaattaaaaataccagcaataatgttttacccacaaatctgataacttggtaagacagaccaattccttgaaaaacacaaataatcaaaattcatatgagaagtaatttgaataagcctgtgttattaaagaaattaaatcaacaagtaataaccttacaaaacagaaaggacctggctcagctggaattactggtgaattctaccaaacatttaaagaagaactaataccaatttttacaatgccttccaagaagatagaagtagagggaacatttcccaacttaatatgaggccagcattgccctaatatcaaaaccatgcaaagacattataagacaggaaatctgtagacgaacatttgtcatgtacacagacttaaaaaccctcaacagaatattagcaaataaaatacaaccaagtgtaagaagaattgtatacaactaagtgggaaatattacaggtatgcaaggctgtttcaacattcagacatcaatcattgtggtccaccatgtcaacaggctaaataagaaaaatcatataatcatatcaatggatgtagaaaaaccatttgacaggatctaacacccagtcatgatgaaaatcctcagtacacaaaaaggataaaggaagcttctcaacttgatttaaagccataccaagatgtcagtagctaacatcatacttacttgtgagaaacggaatgctttcctcttaagatcaggaaaaaagtaagatattgtctctcactatttctacacaacactatttctacaaaacattctagaaatcctaagtagtgcaatatgacaagcaagggttatacagattggaaagaaagaaaaccctcttcgtccaccgccataccagcctgaacgcacccgagctcgtcgatctccgaagctaagcagggttgggcctggttagtacttggatgggagaaaactgtcttcattcacaaatgatatgattatctatgcagaaaaccccctaagaatccacaaaataactcttggagctaataagagaataacaaggtcataggatataaggttaatacacaaaagattattgcttttatcttataaatggttgctctttcattgtggaaaaatgttcacccaaataaatgggccttgccactctgagaaggttgtgacccaactgaggagaaaatacatcttcctctgagaattaataagcctctgcaaggaatagcaaaacatattttttctttttattactttatctttctcattttttattttccttggagctgaacaggagggaagctagacaagaattaaaggtcaaatagcctaactagaggaaggtcttgatggttatacttcaagtcccagaaaaaaaaaaaaaagtacagttagatgatagaaaatggagatttatggttgctttacacaaataataaaataaaagacttaaatctttactccacttgaaaactccagaaggatagaagaaattgcattagtcttttgcaaaaatattttgataactttttcttacttatgtgttccatttgtcattttctctaaactacacctgccccaccttgaaatgtttttatctaggctttgaatgcctttgctcagttatccagcaggctatgatcctctgcgtctgctctctgccgatgtgtgagtgcatcaaatgcaagggttgcaagagtaattatgactctgttactgcacagctccgtaatcatgacaataaaacctggtaaaaatgctcagaccacatcttagcctggttccagacagtgttcatttctgaagctcacttttcttggctttctgtgtagctccactgacaagttttccaaacctttgaagtctggcaaaattcccaaaccccaggactcctcaggagagatgcagcagtggaagctgagctgactgcctttaggctgggtcatggcgtccccacgagccttgcaccacccaccatcacttccttgtcacttcagagccctcaacaagacaaaagggctcaccaaaaaaacacctcctctttattacaagaacatggaaaccttttttccagcctcacactggtaataataaaagaatatgctgtctaaagtctttctgtttttacctaggagatggaagccgctaagggtaggtcattagcctatcctgtaagcttttcactcttccacctccacatacaaccgcccctaaaataaaagacccctatgtagcaaaatacctgctcaaaggaatttctgcaaataaaggcacaaaacaggatattgtaccttttatatttttggtgagagtcaagggaccccagtctcggattattaaaattactaaacgtggttcatatcaccaagttcaaagggggtaaaaaggattaagcttcacagcattccacacgaaaatgtatcactggtaatgtgtcttttccaaccacaacaaagatgccacgtgggttgctacatggagaagtgttcaagtattgcgtgtcacaatatagacccggtaaattgtcttcggaactttcacttttccaaaatgggtttctgtgtgaaaatctgcaatgatctgaatcttttcccttgagtcctggtgtttaaaagatagcacaaaagctgctcagaaatctaggcttgacacctgctagctagaattcaaaaaggaaagagtggcaaagttcacaccacttgagaagaagatctctttcagaaatagccttgtggcaatggagagcaatctgcaatttgtaagagttccctgcctctaaacttacttaggaaattattccactgggatgagatttgcctaaattggaaacagaaagaattctctttggaaaattcctatcaaaaagaaaggaaaaaccatgtctcattgccatttccccataggattcttttctacaaacacacaccaagataacatatataagactccaagaagcccattcagagaaagaaatatatacaaaattgcaaaaacagaagataattactgaaaggacaagcataaattaactttttgcttttcctaaaataacatctatattgaaactttgtttacgcttaaccttcggagaattagttttgaaggatttttaattaaactgaagaagtagaatcaagaaagttgcaaaaaaaggggaagctgttagaaatattatgtatggccaggcacggtggctcacgcctgtaatcccaacactttgggaggccgaggcgggtggatcacaaggtcaagagatcgagaccatcctggtcaatatggtaaaactccatctctcccaaaaatacaaaaattagctgggcatagtggtgcgcgcctgtagtcccagctactcaggaggctgaggcaggagaattgcttgaacctgggaggcaggggttgcagtgagccgagattgcacccactgcactccagcttgggtgacagagcgagactccatctcaaaaaaaaaagaaaagaaaaattatgtatgagagaaaacagcaatgctagaatttgttctgtgactccatgaatgggaacaaggaaacataccacaggaagttattgtctacaaatgaaccagatgtgcagcaacatctgaaaacctgctctgccgtggggcactgtaggaagaaatgcaaaagcgagaatcggaagaacaaaggaatgagagggtagagccaagtgccgcaacccagcatccaaccaagaattagagacatcaaaaccccgggatggggccttagactctgccaggaacaaagaagtgggaaataaacgtaaaacaggccattttcaaatgaattgctgtgtgctcctaaccaatccaacagagcatcgtttagctagtaaaacaatatggaaaataaaagttaatgtttgtagaaattcagaaaggaaaataatgcaagaatctaattacttcccaacttagggaggataaaggagaagacacaaaagattgaagtgaaaattgaaatgacctcctatgcttttatccttcctagatttcaatgggcttgctattcaaaaataaattaaaaggttgtgtgtttaacagtcagactacagaaagacagactatttgaaatttataggagacaaacttgtgttttaaaaaataaaaggaaaaattcacaattgtttttccctaattctgggaaaggttatatcacttcttcatctgaaattttcaaaaagtgtatcaatatggcacttacttttctaccaccctatgtagcttcggatggtgtccgacacatctgtaacactcagttctataaaaacttctaagagcacttttaaatgttagcacttttaagattgaattaccctgggagtattgaggctttcagtattaaaataatttctggctagcattttcgagctgttcccaacatcttattaaatacctatagaaaccagctataaaactgaaattcacattttcagcaaactaagactcacagtcagtcagcttacagctcggatctaggaggaatttctaccagaaaatgacaaatctgagaagaattagaatgtgttcactaacaagtaggtcccttacacatagaagcatatatgtaaacattgtcacccttaaagacaggaaaacatcagctcattcacactctgtcctatagcagagaagcattttggatggaaaacaatttctctagatatatcaaacaagagaacatggcacaggatacagcaatttcagttctagaagccatgtctaaagaaagagcctgagattttgaccaaggtttatgtataaaattatttatggcacctgtttaaaaccaaatgaggaaactacaaaccacttgaaccaccactagcaagggaagagttaaataaatcatcacacagccaatgagactacttacataaactgtgaaacaaaaacacgaaaatatgctcacaatacaacatcaagtgataaaaagtagagcacaaatttaggatataaaatgtatttatagtatgaacccagttacgttaaaatcacacatatatacacacacacaaacacacacatctagaaaaaccctggaattcaataaatgagttagtagtggttgtctctaggaggcagaaacaaaacaacattaaaatttctctacactgagcagatggctcttctataataataaaaatagtacaaatattgttatttaaattaaaaaaatcaagtactcattgtgaggcttagaacaacattgaacttttactatcacttattcttgtcttaagagagacaaattaattgcttattcctgaacctcagataataacatatgccccctgggttgggatgggattcagtgaaataatttaatccaaataatatattttaagtgccaagtacaactctagcacaaattaggtatgaataaatgctggtcaaatctgtatacatacattggaagtagtcagtgatctgttcaaaaaaaaaaaaaatccacgaaacttcattccagatgagcaattcaattgctgcttctccacaggcatgggaagctcacacccacacagctgatctttagcgcccaccaccatctggaagatgccttccagtgcagtttgggactctccccttgatggataccagatggcacagaaagtcctaaagacatgcttcatactggtggcagaaacacaggcaagacacacagagatgaaaataatggaagacctaatgcaagaataaacgacccagtacctcattctatagcaagttctcacatcagtgcccctggaataactttagagcatattattaaaactgtgttttcatgtcccacaaggacatagactagattacccgaagacaaaagcatcaatgtgtcaaatgtgcatataggtggcctaaggcaatgagaaataggttttcatttcactttattaacattttatctgaattgcatttctctttgtctggtgctctgtgatcatactgggctgagttattcacagccaggatgctacttggccttccagatttattcttcattatctccaaataaaataattaaattgtatgcaggaatacagcacaaagccaaagatcttgtaatgcatttttaaaagtaaatcatcatccatgcagaaaagcaatataatggaatatttaaattttgccagtgaaaacctccaacaaacctagataatcctgaatctgtaggtgtttcatatttttaatgcagaaagatgtgaaataaatgtttacaaatgcttactttacattcaaaatcagtttctatgtgaagccaaaacatgtaggaaagaggggtctaaaatatttttaacaatttgaagctggctaaggattgagactaaaacagacttcaggccctttacagggaaacaaaacaaaaatgctggaagaaggtagcaggcagagtgatcaatacagaatggtggtgaagcaggattttctacatgcattcctgcctggggcagttctgagtaccccaaaggatcccagaggtcacctgggttggatgagtctcataaccccttataaggcaatgatcacggatcagtatctacccttcagcttttgtccccagtacacatctgtcaactgaatacaaggtaagggaggtgttccgaatgtgggccaaacagtgcactgtggtggttgatgtgtctttctctgtgcaggcctgagtttccattcctgggcaaccccatacagtggaggactgactcagactaatggccagcctctgaactacatgactgtggcagaggttaaagcatacagagagggagggaggtgtgactcagttatgaacctgtcatagccaggagctcacagaatcctctcttggtttcctccaccgccctggctgctcctcacttcctcattgatcactgatgctggcatgccttgggctccatcctatgctctcttctctcccatccatgcactcttctttcatgagtctaaacaacacctacacatggatggagcccaaatccatctctccagccatggcctctccagagcttcagggagtgcatctgactgcctacccaatggatccactgacatttctggaagacacctgtgatttaacataaagcctatcatttcctcctccaaatttgttcctttcatcgttcttcccatcttggcaaatggcatgccctcccccgcaatcccacgcatcatccaggccccaaatctaggatgcatccttcatttctctctctacgtcggtgctcatatgcaaaccatatcctgaccccacctgctccttgccagctctcctacttcctgacttgtctgagctgtccagatctcttgttcacacagtgagcctcgaagctggacccacattgccaactgttggatcctggctctgccacttactcactgagtcaaatctatgtggctcagttttctcatcagtaaaacagggaaaataatattcctgatctcctagggtcattgaagggcttcatcaaagtaaggctggcacccagcaagcactgcctcactgggtcttgatcctcagcaggcctcctgacccgtaaccacagtctgtttcctatgtgacagccagggtcacccattcaaaaccagatcaggtggggcgtggtgtctcacgcctgtactctcagcacgttgggaggccgagggtggtggatcacttgaggtcaggagtttgagcctggccaacatggtgaaaccctgtctgtactaaaactacaaaaactggctggcatggtggcgcacacctgtagtcccagatacttgggaagctgagacaggagaattgcttgaatccaggaggcagaggttgcagtgagctgagatcgtgccacagtactccagcctgggccacagagcgagactccgtctcaaaaaaaaaaaaaaaaaaagccagattacatcactccttcacttagaaccctgtactggattccctttttaatttgaatcaagcccccacactccttcctgaggccaacaggcatgatctctctcctgcccccaccctaactgcatctgctgtcaggagcctccttgtccattacccatccagcacgccatctgtccatccttacgttccccacacatgccaacacatccctctctggagactgtgcactctctctgtctggaatgttctacccgaagtctgcacatggctggcatcttcctgtccttcaggtctcagcccaggttcaccagctaaaagacacctgccttgggtcccagacactctctcacacatttgctctgtttcattgtattcacaaaatccctcatttccttctctcctccctaaagcctctcagttttgaatcccatgtcatcaaattgtatcacccattgaccttcatgaaactgtcaactcacactcaacatgtctagcaagtttgacttcctaggtcagcgctgctttcccatgaccactcctattctatccttggtcaccccatggcctcctggttccttaaacacttctcctccaccagtctcagccactgcatctttcctcctccttcgcctccttgctgacctccatcccctccttctccaactcccattccttgaacagtcactactgctttctttggccagtgccctcaaaactcttggcactcacactttgtcataattgcttggcaaatcagctaccctgaaatccagctctctaccaactgaatgtagcagagaaaacatgttgactaattgcttcttttttaaagaaactatttttatgggtacgtaataggtgtatatctttatggggtgcataagatattttgatataggcatacaatgcataataagcacatcaaggtaaatagggtatccatcaactcaaacatcatcttttctttgtattacaaatgatacaatcctcctttggttatttcaaaatatacaataaattattgttgactgtagtcaccctgttgtattatcaaatgctagatcttattcattctatctaattatatttttgtacccattaactagctccacttcccacgccctcatcactaccctttccagcctctggtaacaatcattctactctctgtttccatgacttcagttgttttaatttttagctctcataaataagtgagaacttatttgtctttctgtgcctggtttatttcacttaacataatgacctctagttccatttatgttgttgcaaatgacaggatctcattctttttttatggctgaatagtacaccattgcacatatgtaccatgttttctttatctattaatctgttgatggaaacaggttgcttgcaaatcttggctattgtgaacaatgctgcaataaacatggaagtgcagatatctcttttatatactgatttctttggggtatatacctagcagtgggattgctggattatataaaggttctatttatagtctagtgaagaacctccaaactgttctccataatggttgtactaatttacattctcactaacaatgtatgagggttccttttctccacatctttgccagaatttgttattgcctgtcttttggatataagccattttaactggagtaagataatatctcattatagttttgatttgcagttctctgatggtcagcgatgttgacccccttttcatacacctgtttatcacttgtatgtcttcttttgagaaatatctatttggatattttgcccatttttgaactggattgttagattttttttgtatagagttgtttgagctccttgtatattctggttactaatcccttgtcagatggatagtttgcaaatattttctcccattctatggattatctcttcagtttcttgattctttccttgtctgtgcagaagctttttaacttgatgtgatcccctttgtccatttctgctttgtttgcctgtgcttgtggagttttactcaagaaatctgtgccccaactccaatgtcctggagagtttccccaatgttttattgtagtaatttcatagtttgggtattaaatttaagtctttaatccattttagtttgattttttatatggcaagatggggtctagtattgttcttcttcagatggatattcagttttcccacatgtttattgaagagattatcctttcaccaatgtatgttcttggcacctttgtccaaaacgaggtcattgtaaatgtatgggtttgtttccaggttctctattctgtttaattggtctatgtgtctgtttttatgccagtaccatgctgccttggttactataactctgcaataatttgaaatcaagtgaagtaattcttccagttttgctccttttgctcaggataactggctatttggctattttgggtcttttgtggttccatataaattttaggattgttttttctatttctctgagaaatgtcattggtattttgatagggatggcattaaatctatagattactttggttagtatggacattttaacaatattgattcttccaaactgtaaaaatggaatatctttacactttttgtgtgtcctcttcaatttcttgcatcaattatagaaatatctcacttattttattacattaattcctaggtatttaatttcatttgtagctattgtaaatgtgattactttcttgatttcttttttggattgttcactgttggcatatagaaaaggtactcatttttgtatgttacttttgtatcctgcaactttactgcattggtttctcagttctaatagttttttggtggactcgttaggttttcccaaatataataatatctgcaaacaaggataatttggcttcttcctttccaatttggtttccctttctttctttctcttgtctgattgctctaattaggacttctagtactatgtggaataacagtggtgagaatgggcatccttgtcatgttgcagatcagaaaggaaaggcctccagcttttctccattcagtgtgaagctagctgtgcatttgtcgtatatggcttgcattgtgtgttgagttatgttcttctacatccaatttttgagggtatttatcatgaagggatgtttaattttataaactgttttttcagcatcagttgaaatgatcacatggtttttattcttcattctgttgatatgatgtatcacattgattgccagtgtgaatcaatctttgccagatctttgccagattttggcaaagttttttcagcatcagttgaaatgatcacgtggtttttattcttcattctgttgatatgatgtatcacactgattgatttgcatatgttaaaccatccttgcatccctgggataaatcatccttgattatgatgaattatcttgttaatgtgttgttgaatttgatttgctaatattttgctaagggttttgcatcaattttcatgggaatattggtctgtaggtttatttttctgatgtgtttttatctggttttggtatcagggtaaaagtggccttatagaatgagtttgaaagtattctttcctcctcttttttcagaatagtctgagtagtattggtatgaattatttaaatgtttgttaatattctgcagtgaaaccatcaggtccagggcttttctttgctgggagactttttattatggctcctatcttgttatttgttattagtctgttcaagttttgaatttcttcatggtacaatcttagtagattgtatgtgtccagcaatgtatctgtttctaggttttcccacttattggcatatagttgctcacagtagcctctaatgatcacttgaatttctgaagtgtcagttgtaatgtctcatttttcatctctggttttatttatttgggtcttctctttttttcttcatctggctaaaagtttgtcaattttgtttatctcttcaaaaaacaacttttaattttgtttatcttttttattgttctatttatttcaacttcatttatttctgctctgatctttattatttcttttattctactaattttgagttctatttgcccttgcttttctagtttttaagatgcaccattaggttgtttattcgaagtttttcttctttcctgatgtaggcacttacagctataaattttccctcttagtactgtttttgctatatcccataggttttggtacgttatattgccattatgatttgcttcaagacatttttcaatttccttcttaatttcttcattgacacactggccattctggagcatattgtttaatttccatgtgtttgtatagtttccaaagtttctcttgttattgatttgtagcattatgtcattgtggtcagagaagatgcttgatatcatttcaatttttttaatgttttaagacttgttttgtgaccttatatgtggtgtatccttgagaatgatctttgcgctgaggagaaggatgtgtattctgcagctgttggataaaatgttgggtaaatgtctactaggttcatttggtctatagtgtagattaagtccaatgtttctttgttgattttgtctggaagatctaatgctaaaagacaggtgttgaagtctccagctatgattgtattggggcctctctctctctttagttctaataatatttgctttatatagctgggtgttccagtgttgggtgcatatgtatttaaaattgttatatactcttatggattgacccctttattgttatatgatatcctttgtgtcttcttacagtttttgtcttaaagtctattttgtctgatataagtatagctacttctgctcttttttggtttctacttgcatggaatatctttttccatccctttattttcagtctatgtgttctttatagatgaagtgttttccttgtagacagtagggcattgggtattgtgtttttcatccattcagccactctttgcgttttgattagagtttagtccatttactaatgtcaccatgtaccaatgttattattgataagtaagaatatactcctgccactttgttatttttctggttgtcttgtggtcttcttttccttctttccttccttcatttcttttttttagtgaaggtgactttgtctggtggtgtgatttaatttcttgattttcattttttttgtgtgtatctgtcatatgttttttgatttgaggttaccatgaggcttgcaaatactatcttagaaccaactattttaagctaataacaacactgcataaacaaacaagcaaacaatcaaaaagtaataaaaatgctacactttaacttcatcctctctctttttaactttttttttgttctagttacacttactgtatgtaacgtctatttcttgaaaactgtttgtagcaatttattttgattggttaatcttgtagtctttatatttaagatatgagtagtttacacaccacaattacactgttacaatattctgtgtttttctgtgtatttactaatagcagtgagttttgtaccttcagatgatttcttattgctcattaacatccttttctttcagactgaagaactccctttggcatttctcacaggacaggtctggtgttgatgaaatccctcagcttttatctgtctgggaaagtctttctttctctttcatgcttgaagaatattttcactggatatattattctaggatataagatttttccttcagcactttaaatatgtcatgccactctctcctggcttgtatgatttccactagaaagtcggctgccaaatgtattagagctgtattaaatgttatttattttctcctgctgctttaggatactttctttacccttgacttttgagtgcttgctaattaaatgtcttgatgtagtcttctttgggttaaatctgcttgatgttctatagccttcttgtacttgaatgttgatatatttctgtacatttgcaaaattttctgttattaccctgttgaacaaaactttctacccctatctctttttccacctcctctttaagaccactaactcctagatttgcctttggaggttattttctaaatctttcaggcatgctgcattctttcttactctgctttcttttgtcttctctgactgtgtattttcaaatagcctgtcttcaagttcacctaattgtttcttccatttgatcaagtctactgttaagagactcaggcatccttcggatgtcaattgcaattttcaactccagaatttctgcttgattctttgtaattatttcagtctctttgttaggtttatccgatggaattctgaattcctctgctgtgttatcttgagttccattgagtttcctcaaaacagctattttgaattctctgtctgaaagatcacataatctgtttctccatgattgatcactgataaccttattaagttcgtttagtgagatcacgttttcctggaaggtcttgatgtttgtggatgtttgtcaatgtctgggcattcaagagcttggcatttattgtagtcctgacaacccgcatttgtttgtactcattgttcttgggaaggctttccagagatttgaaggcacttgggtgttatgatctaagcttttggtcatgtagccatatctgcattagggggcaccccaagcctaataacgttgtggttcttgcagactcatagaggtactgcctttgtggtcttggataagatccagaataattctctggattaccaggcggagactcttgttcttttccctaacttccaccagacaaagtctctctctgtgctgagctgcctgaagctgggaaaggtgacacaggcacctctgtggccaccaccagtgggagtgtgctgggtcagacctgaggccaccacagtgcttggtctcacctaggactggtgtaaccactgcccagctaccaccaatattcactcaaggccctagggctctacaatcagcagctgcaaaagcaagcttaggcttctgtccttccctttagggtggcaagatcacctcagtctcaggcaggtccagagatgtcattcaggagccagggcctggagtcagaaaccttaggaatctactcagtactctgttctaccatggctgagctggcacctaaaccaaaagacaaagtctttcccactcctgccctcccctttctgcacacaaaggactctccctgtgtccaccgccatcccaggcctgtggtgaatattgcctggctactgccaatgttcactcaaggctaagggctctttagtcagcttgtggtgaatgctgtcaggcctgggactcttccttcaggacagtgggctccttgctggcccagggcagtccagaaatgctgtctgagagccaacttctggaactggggaccctgagatcctacttggtgctccatcccactgtggctgagctggtggtacctgaggtgcaagacaatgtctccattactcttcactctcctttttcaagcaggagtctcttccatagacatcacagctggaaatgtgctgagtcatatctgaagccaggatgtttctgagtctcacccagggcccacagtgagtactgtctgggggctgctgttgattattcagggctcaagggctctctctctctagtcagcaggtgatgaatcctgccaggactgggttcttcccttcaaggcagtgggttcccttctggcccagggtatatctagaaattttgcccagaagccagggcctggaatgggggcctcaggactctgttgggtgccccatcctactgtggctgagctgatatccaagttgcaagacaaagtcctctttactctcccctctcctcacctcaagaaaaaaataaataaaaaggaatctctcccagaggtttgagctgagctgcctggagttggggtagggaggggtggcacaagcgctcccttggctgccccagctggtgtctccctaggttgcatgcttcccaagtccactgactgtgagccctggacttgcccaggatttgcagttctggtgacccagactgcctttcaggttgattcagaaccccagaacactttagcccatggtggcaaggcttgttggaactcgggttctcaccactgggataggtgattcccctctggctagggctggtctaactgctccctctgtggacacaggctgagttctgcccagttttgctttccactgtgacagggcagcactgtgttccaatgcaaagtcctgtagtcactgcactctccctcccccaagtgcatggattctctctccatgccacatgcccactgccaggtaataggggagggatggtgtcagcaattcaaaactgtctttcctaccctcttcagtgcctccttcagtgacgtgaaattaaaaagaggtagtgtgatcgctcctgtgacttttggtttttatgaaggtgcttttttgtgtggacagttgtttctatccagagtaatttggtgtttctgcagggaggatgatcagtggaggcttccattcacccatcttctcctgcctcctctcctaatcacctcttaaattcatgaggagattcaagtgggcctttagtgaggtcaggcacaaccacccatgaagccctgttttactcactttcccattcctcctagatgactatttcacctgactttcagcttaatgacgtggcttcctgcttgacgtggaaagtggaagcactcagaggaagatggccagactccccacaccacattttccttcttacagtcgtctatgttgacacattctgccttccatctacaggcattccttggagatattgcaggttcagttccagaccaccacaataaaacaaatgtcccaataaagtgagtcatatgaattttctgctttccaagtgcatatagaaattatgtttgcactataatgtagtctattaagtgtgcaataacatatgtttaaaaaatgtacatacagtaattaaaaatacttttttgataaaaaatgctaacgatcatctgagccttcagcaagttgtaatctttttgctggtgaagggtcttgcttctatgttgatggctgttgattgatcatgagggtggttgctgaaggctgggctggctgtggaaatttcttaaaatgagacaacagtgaagtttgctgcatcgattgactctctctttcatgaaagatttctctgaagcatgcaatactgtttgataacattttacccagagaacctctttcaaaattggaatcaatcccctcaaaccctgctactgctttatcaaataagtttatgcaatattctaagtcttttgtggttgtttcaataatagtcacagcatctttgccaggagtagattccctctcaagagaccactttctgtgctcattcgtaagaagcagctcctcaactgctaaagtttgatcatgacattgaagcaattcagtcgcatcttcgggctccacttcgaattccagttctcccactattttcaccatatctgccattacttccttcgctgaagccttgaatccctcaaagtcatccatgagttttggaatcaacttcaaaactccagttaatgttgatactttaacctctttccatgaatcacaagtgttcttaatgacatctagatgggtgaatcctttccagaaggcttcgaatttgctttgcccagatccatcacagtaatcactatctatagcagctatagccttatgaaaacatttcttaaataataagacttgaaagtcaaaattaccctttgatccatgggctgcagattgatgctgtgttagcaggcatgaagacattagtctccttgtacatctccacatctccatcagagcttttgggaggccaggtgttttttttttttttgagacggagtcttgctctgtcgcccaggccggactgcggactgcagtggcgcaatctcggctcactgcaagctccgcttcccgggttcacgccattctcctgcctcagcctcctgagtagctgggactacaggcgcccgccaccgcgcccggctaattttttgtatttttagtagagacagggtttcaccttgttagccaggatggtttcgatctcctgacctcatgatccacctgcctcggcctcccaaagtgctgggattacaggcgtgagccaccacgcccggcgggaggccaggtgttttgctggtgagtagtaatattctgaaaaaagtttctttttttcctaaacagtagatctcgatggtgggcttaaaatattcaataaaccatgttgtaaacagatgtgctgtcattcaggctttgttgtttcatttacagagcaggcagagtagatttagcataattgttaagggccctaggatttcaaaatggtaaatgagccctggcttcaacttaaagttaccagctgcattagcccctaacaagataatcaatctgtctcccaaagctttgaagccaggaattgtcttctctctagcttggaaagtcctagatggcatcttcttccaatacaaggttgttttgtctacattgacaatcgattatttagttcagtgacattcataacttgtcttagctaaatcttctagataactttctgcaccttctatgccagcacttgctgcctcaccttgcacttttatgttatggagatggcttacttcctcaagcctcatgaatcaacctcttctagcttccaacttttctcctgtagttttctcacctctctcaaaagaaagttagggccttgctctggattaggctttggcttaaggggctgttgttgctgatttgatcttctagccagactgctaaaactttctccatgtcagcaataaggcccttttgctttcttatcattcgtgtgttcacgggagtggcacttttaatgtcctccaagaaatcttccttcgcattcacagcttggctgtttggcacaagagacttagctttcagcctgttttggctttcaacatgccttcctgagatggtttggatgttttttcccctgcaaatatcatgttgaaatgtgacctgcagtgttggagatgggacctggtgagaggtgtttgggccatggtggcatatctctcatgaatggcttggtgccgtcctcgcagtaatgatttagttctcactacaagttcatgtgagatccaattgtttaaaagagtctggacctccttcctctctcccttgctccatctcttgtcatgtgacatgcctgctcctgcttagccttccaccgtgagtaaaagcttcctgagacctcaccagaaggggagtacatgccagtgtcatgcttcctatacaacctgcaaaactgtgaaccaattaaatctcatcgttataaattactcagtgtcaggtattcctttatagcaacaaaaacagaataacacacttcctcaccaagtttaaccatttctagcttttgctttacagtgagagatgtcaactcttcctgtcacttgaacacttagggctattaactggcctattttcaatattattctgtatcatgtaatagggaggcaagaggagaggaagagagatggggaaacagctggtcagtggagaaatcagaacacacacatttattgcttacatttgatgtcttatatgcatgcagtttgtgatgcttccaaacaattatgatagtaacatcaaagatcactcactgatcacagatcatcataacagatataataataatgaaaaagtctgaaacattgcaagagttaccaaaatgttacacagagacctgaagtgagtatatattgctgggaaacagcatagatagtcttgttggatgcaaggctgtcgcaaatcttcaatttgtaaataacccattacctgcaaagtgcagtaaagagaagcacaataaaatgagatatgcctgtacttaccctcagctgacttctgatgcacactagagtttaacaattcaacaaacactgctagagatgaacccacttttctgtgaaaggccaatctttctgtgtgccacataccctgtgacctgttcaaagacattgtccagcacggccccttttctctcctgcaccatcagttttccccctttctacaagatcatttcctttgacatagaagactgctgttaatcatctcatctcatggaaaagaacatcaccccctcccactctgacagttacctgacctgcagctctctgcccctgtacagcaattctcctgggaagagatttctttgctggactcttctttgcttaacttctcttctggaattatttcctgaactcattttcctcatgttccatcaccagccctccactgcactgaaaggttccctactacagttacacaggacctttgtgtcacaaaatccagaggtcaattctgattcagattcctttggctaactggtcatcagctgcatttgacagagctgggaccccctacccactaatggacattgctaattctataagtgtcctggctacctcacttgttgcttcttctccatctccacgtctttctgcatcaacattaagaagtcaggagaaggggctcttccttcttccgtaatgattatactcttttggtaaattcaaccaaattcatagcttcaattctatctgtaccagtcaagattctccagacaaatggaactaacagaatgtgtgtgtgtgtgtgtgcgcgcgcgcgcgcatgcacgcacatgtgcgttcatgttaggttatagtacagttatttaatcaaacactaatctaggtatttttgtaaatgtggttaacatctataatcttgttaacttcaagttaaaaagaataccctcaactctgtgaggaataggcctcatgcaagtagttgcaggtcttaagagcgaaaactgaggtttcccagaaaacaatgaattctgcttcaagactgcagcatcaactccctcctgagtttctagtccaccagcttgcctatgcatttcaaacttgccagctcccacaattgtgtgagccaatttcttaaagtaaatctcttaatgcgtaatatattttatgtaggatatatatcctatagcctagccaagttgacacataaaactaaccatcaaatgatccatgtaccatgaccctgattcatattttcagtccaaattgttttgtgtatccacttgcttactcaatatctccacttgggtaacaacacaatttttaaagttgaactttacctgcagactttttgctctcatttggtggcaacttgatccttcctgtcctgcagtctgaaaatgttagaatcatccttggctcctctcattcacaccctgcattcaaatcctgctggctccgacatctcacagcctccactgctcccacatttgtccccagcaccatgtctcacctggactgctgcaatggcctccagagctgcttctgcccttgtgtgctggggtctgattgcaacacagcaacccaagcgactctcctaatctgtaactgagacaagctatttcttcacactagaccacaccacttctccactgagtaaaaggcacagtccctgcccaggaggcctccagagatctgtccccttttcctcactgacttaaattccccactctgctgtatgtgtaaaccactctgacaacactgtcctccctgtgttcccaaaagacaacagacacactctgctccagtgcttggaccctagaatactccctctgcctgggatctgcttctcccagatgcccacatgctcactctgcctacttcaaggaacttgaataatgcccttctcagcaaggccccctgcatgtgccatttgaacctgcagcctctccatccatcatccctgcctatcctcaccctgctctgacttgtccttgtgtttggagccttctcacctttacccctactattccattgactcattacatttattgtctggtctttcttccccattaaaatggggatagatgtctttctggttttttacactgatgtttctcaagcacatagaatagcatctggctcaagcgggtcctcaataaatatttgtggaataaatgagtcatttgtgaatatatcttgatgtgctattccttctcacttgaacattacagtggaagctccatggagacaagggcttgcctctcttactcaggcccctccagcagtccatgcacagggcaggcctggcaaatacttgttggggacttctgaccaatgaaggtctttggagatgaaagagaggccaattcctacaagttacaggatctcatagtcctcttttcccaaggttcactgtgctgggatttgcaggtttctggaagattttgaagtgagcactctacttttaaagccacagtatccagtttactgatgaactccactctgccttttccccttcaaaacctgatgcccttaccaagctgatttcccctgggtgggcatcctgatgggtggggcggggcggggctgggggggtcccacccacatattaagccctgacttgctggaactggtctgaacatttgtgcctcagggcaagtcaaagcaagacccctttgcaccaagccaggcattgttttagaactctgactccagcactgcatggtctccagctgcagggaccttgtctttacatcactgatgggcgcattaaccacaaactaagagtcgtgcatgcaagaatttcaacctacctcatctgtagcttaaaaacacttttaaaggcaatacatcttttcttttctttctaaagggactaaatgttgccttgtccagtggaaaaaaaaaatctacttataaaaagcattctttgggggaaagagggagtgattcttatctgaaaaccaatggagcaaaaggactaacattttacaagcttcagtaaaacccaggaaaacctctcagaatgaggatagctagggaggacagaaacccacgagctagagggaggtcaaagtcctggctctttagtgggtgttgctgaagttgacaaatagcaggcatttgtgtggtttgcagacatcgctgtccttgcctccccatggctgcagaaggggcgtgtctcctgtcttcatcaaatctctgcagccccgttgccttctccttgccttactctattggcttttgaatacttcattaacttttaaatccagccatttaaatgcttgcatagcctagttcccctttacctaaaagaatcattacaacattgtctctctcctcatatacttaaatcatctcactcaggcatctgcaaagataatctcaacgattctacttaaactccttagctattaagaaaggcagtaacatcaacaggctgagctggcccttgaaatgggagaagctcctaacagcatctggtcagcttagctgatgcaattgcaaggctggcctggagaaggccccatccagagactcctccctgcagaaccagatggcttcaagaatatgtgcatccgtgctgggccctgggagctggggttctacttaaacacctttggacctgctgggacgtccttccttgagtgtaagcccagtttctcaagcccatatcctcttcttttgattacaacattgtaaattattaaataaaattttcatactgatttcctttagagtaaaagaattttgtgcttttttaatggaataagaatatttcaatctttctttcttttctcttggttatttctagtgctttaaaatgtgaacaccaaaactatttttttattataacagaaaagccaaaatattgtttaaaatatgtgtagccaagacaaatcttattatacatgctcatatcttggaagaacttgtgcacagttaatgggttgatgagtgaagcattcaagacagggagttgctcagcactggagtgtccagaggtcttgaaggtcctggttaggagcccagtctccagagctgcgctacctggattcacatcccagctgcatctcttcctggctgtatgaccttggacaaatgacttaacctctctgtgcttcagttttccacagtaaaataagtatgagaacactacctagggcatcaggatgtgaagtttaaataagttaataaacttaaagaacacaggatggtactgaccattgcatgccatgtaagggtttactatgaacattagctcttaatgctctataattgaatataattttgatttggaatatctatctaaccaggctagcaggagtctttcttctgtctctggggtgtcctgtggagagggaaaatcccccaaatccccaggctgggaccaggccaaggtctgtccacagaggacactactgagagcccttgggctctcatacatccaggactcaccacaactgctgggtctccctgaggtccatatgccagaaaatacttctcaagtacctgctcatgtgtgctatccccagcagctggcatgaggcctgagagtgtgcccagcacactggcagagaacattcaatgtaggcaaaggaaaaagaacagacagcctgggaggatagcacagggtttcaaccttatgcataagaatcatgaaaaggtctcatcgtcaaaccgccagcctgcccctgaaaagcaggccagagtaaaaaggttcagagctcacaaaagaaatgtattgcctctcagtcctggaggctgaaagtccaaaatcagggtgtccgcagggccccgctccctcagaagctccagaggaggatccttccttgcatcttcccagcatcagtggctgccaccaatccttgggtttccctggctggtggcagcatcactcgaagccctgtgtgtctctgtctttgcatggccatcttcatataaggacactgttcagattagattaggggtccaccctactctagtatgacctcatctcaacttaactaattacatgtgcaggaagactgtttataaataacatcctactctgagatcctgggggttaggacttcaacatatcatttttggggagacacaattcaacccagaacagtatcccatgttaaattaaaggggctatatatttttcagcaaaaaagaggaatgcatctcttcataaagacatagacatataattttactggaatgaaaccttatcttacatgcccttttcaccatggctacagctccccactctctcatctccccacagccaggtgagttctgttgccatttgttgctatgtgtatccttccatatgcttctatttactcaaatgagcctacacacacctatgtaggcagatactcattgtgtaaatatgcatcttcaggggaggtttttgtcacggttttacaaaaatagaatcaatcatttcaagtgccttttgtaaattttgcttttatcacacaataacatctgggggaagtcctgccaagccatcttccaaggctctaaagcattatctttaatgattgtattatgtattctgcagtgtgggcattagccaaaaattaacagtgattatcttaagacacttgggggtagggtctctcttcctttatctttgtggagatttgatagctgttcaataaatatgagtatgtttgaattgaagctgaaacatttttcaaaaatctcaactctgatagcattgatgccatttatacaattttattccttcttgaggacactgacattttagggtcccagagactatgtttaacattccctataaaccatcacatttatttatcttaccagcccaaggaggttaaagtctccatctaaagacagggcaggaggttcagagacctgggcacacagcgtagtgggcagactgaggactcaaaccctgaactaacaacctcccacacccatcactctctgccatattaggtttcaaaagttacacatcatctcatatgctagacttggctctggaaatctagttttggttgttcccaaacccaccctccaaagttatatgaccactgaaaatatacaaagtaatgaagcagagccaaaaagtaaacaaaaaagttttagcaatccatgacccctgctgctctgcagagaactgtcctaattttcctttgcttatttaaaatcagtgacttgacttcagtcacatatgttacacatacataatctagtttctagaagcagaatagaaacacttactcatacacgactgggcaggatgtcattaggaaaaggtgaaggaggtgacaatttggggttccaggccctgagttgagggaggacagtggtgacctattaaactagacaatggctaagattgtcatgcttgtttgctgtctctgagagcatatttcctaggaaagatgtttaggagtatttgacaaagacccatatgaaagttccttcacagcatattttacctctaactgtctatgaattcatgtgtgactttgatatagatgctgtaaactttggtacacaaagtaactaagtcccatcacagtatggaagggatgtgaatttcaaaggtgagtaagtggtgcctagaatttacctttcttaccttcctgaaatagcacgtacaataacacggttctcaacgtgggctgagtattctaaacacctaggaactaaaaagtttaaaagtgctgacacctgtatttcaatgaattgatttaattagtataggatgtagctgagcatcgagattccataaactcttcaaatgactcgaatatgcagcagaagttgagacccacagccctaggagatttgaggggaaagcattaaaattgttaaaaattagaaggactgtttgtgaaataagataaaattaaggagaaataacctcctttactgagcaatgtagccttctatgagctgcccccaaccttgctcttcagtcccaccttccattcttccccacattttttgttgtagctgaaacatactttctctgcataagccacatcattcttctcctcttatgctttgtaaatattttcccctctcccaggaatctttctctaaatgaatcctgcactttcttggtgattccatctaagtggtctatttggacagaacttcagtggactcactgcatttccctcaactatatgttttggcccaagtttctccacttgacctcagtgaacaccaaagagacagagatgttgcgccatgcattcccatcacctagccaggtgactagcacatcatagacagtcaacaaatggctgtggggtgaagtcaggaagcaaaacagcattaggaagtatgtatcagcttctcaccaattgtagtattgagaaatttatcatcttgacaggcataaacatgtaagagaaaatttgctttgcaaattatagcacccaaaagcttaaaagaaaacatcatgaaaaagacaggtaaaattgaactcattccatctaatatggtgtttaaaaatgtgtctccattttttctttgtacttattatcaaaaaccaggtattgcaaaagtatattagtaatcacattattcttttttcagtctgatggaaatacaagatacaagtggtcctacagaagaactcttccctttggaagactgaaatgcctggtaacacatggctgcaaatgtttgctgatctctctaatcaatcccctgcaagctcactagccaagtggcagtgacactttggaaatatcagaacctggtaatttatttcttgactgtcttcccaaacaattaaggacctaacatctgcgtgctaagcaaccatgggctactcctttccagcaactttgcaagaaacactgtcagaactccttaaaaacaatcaactctgaaaaagaggaccccagagagtgtctgcacttgagtgaatgttgcccaagcaagggcaaacttctgccacatacagcacatgtttttaaagatgaagttcttgtccagggtgtctggcaattgtgtggcactttgaattagactttgcagaatgacagcaatttgaccaacagcgtctgaggggcagatgctttctgcacactctcaagctcaatgtggcacaatccaggcgattttgcaatgctggatgcatggtgagcctgctgggctgtcaacagccgcacaaagtgaggttgtgccagaatcatggggtgttcagcattcaaagagaactcagatatcacctcattcagccccttcacagtacagataaatggagagagaccagagagcttaatgatttcttgttgaaggatcacacatagaaaggtatatgtgtgttcaatccaaatttgcaggcttaaattcgagttctctgcctgcctaatctaaattggctatttgcactgtccaaacacaccagttgatattctgaacttcctttgactttccacccgataagcagcttaaggatgactgactgtattgacttgcccaagtcaagctggggctgcacggatggtctctatccattgcttctgctgtgcatggctaatacagctcccagccaccgggtaatccttgctagcatccagttattttgctgtcactcaccacctctgggcaatctttatctctgacctaaaaacccgtgagagctaattcctagaatttaaagaatttccaacaggtatgtgagagtagaagcatttctactaagatctttgtctcttaaaaaaaataaaataaaaaaggagcagatagccacaaagaaacaagaaaatataattatgggtctatttgtcttgcctttcatctcagagagaaatgtggcatcttgtagagcatgtgggttgatttcagccgaacaacagtaaactcattagaagctacaagatggggtattttagaaaagaatacagagtggaggttgtaagtgaaatatgaaaatgtttttattctaaaactagaataaattttctatgtaaattttcttcatgacacagagataaaattaagtgaaaaacaaaaatagaagaatggtctctaatttttgcctccccaccacaaaaacaggggctatgcaaggacaatgtatgcatttatacacatgcctatgagccatgagtctccattttcttgtttgtatcatggtttcacaaagataatacctgtctcctcctacttaacaacctctaaagcaaatacaacaaaaatgagctagtagacaccattcccatgcctacccccaagtaacttatccagctttgaaagaattaccatccaaaggaggaaaacgggcatcaacccaggagcctgggaaaggtatttgatacaaagcatcaaatctgccaggcatttgatactaagtaatgacttcaaaagcaaggtgaccagaggaagctttagatcttcctctgcaggaacagtttgacttttgctttaaacctggcacaatttaatctttatttgaaggatatacatacagagtcattttcttcattaagctgccttgacgtgcgcagatccttcgacagatttaaatcaacatgcttgaaaaatgggcacaaataatttggcatgtgaaacgggataggatcttctccaataaaacatggaacttcaacgtggagccaattacaacgttgcatagattctaagacatcaccaattgtaaggcagattttcatttttcaaatgactgagaaaaaatgtgtgaattaaggtatagcaggatccctccatgacagcctgtgtaccagatgcatgaatcgatcacaccagtctctccttagtttaaatgtctttatcctgctgtgtggatctggcaatttctcctgccttcagcagcattggtggttgtgtgctaggcaattcttctccacacatctcagtagtcatttgtgtccacctacttcttttcttgggtttggtaagttatgctgtggcaacaaacaccatccaaatcccagggatttacagcaacaagtatattgcaacaagtatattggctgtggttctgcttcgtaagtcctgcagtccagaataaaagaacagcccctactggggacatgccatcctcatggcagaaggccaagaggaactgcagaagagtgtgatggctcctaaggcctctgcccagaagaaacatatatcactctgctcatgttctttgccaaagaaatcacatggtcaggcacaacattatcaggatgtgaagtatgctcctctcacatgcaatgcacaaaggacaggccctggagggagggatccagtacagaggggcagtgaatgttttcaacaaatgttacaatctaccattaagccttcgatggtcactttgcaaggaaatagagaatgtggttattctgacaaagagcagtatttgctccactgataacacattttataccctgccactctgttttcatgcctttttgtgtatttaataatttttactttaaatgccaaaaatatgtaaattttggagataatttaaacatcaattaaactcaaccatatagttagcaacaacatacatgactcaactgaagccacatcggtgtagcaactggggccgagtctacccaaacacaggcaatgccaactgtgtcacggctgtttcccgtcaacggcaagcataaatcatcatcatttgtaagatgcatctcacttgcacatgtgttgaaatgtaaaaaaagaaaaaaagtatcgtacaattaaatacagcattgtgtgtgtctgtgtgtgcatgtgtgtgtgtaaaataagaatttttttttcttttttgagacagtctcaccctgtcgcccaggctgcagtgcagtggtgtaatctcggctcattgcaacctccgcctcccaggttcaagcaattcttccgcctcagcctcctgagtagctggcattacagtcactcgctaccacgcctggctaatttttttttgtatttttagtagagttttttagtggggttttgccacattggccaggctggtcttaaactcttgatctcaagtgatccacccacttctgcctctcaaagtgctgggattacaggcatgtgccactgtgcctggcctataaaataatatttgtttatcagctcttaaatgctctgcattcttgctctttggagcatggtctgtggcccagcactatggatgtcttccaggggctggttaccagtgaaaaatcttgagccccaaccaagactcttgactaagaatattaacaagatctatgagtgaaccatatgctcactaagttagataagcagtattctaaatgacattagtcttatagctgtgaagtgcattatagtggagtgaacacacacacacatacacacacacacacggatcatgggtatgatgagatgactctgctcagaatcctcccttgcagccttggccccagcatgtacagtgagagagaagagcatctcagggttatcccattcagcaggacgagtgcaatgacaaggacagatcaggtatctccaaccctggctgtgcattaacatcacctggcaaagtttttaaaaatgctgaaaccggaccgggtgcagtggctcatgcctgtggtcccggcactttgggaggccaaggtaggtgaatcacttgaggccaggagttcgagaccaacctgggcaacacagtgaaaccccatctctactaaaaatacaaaaattggccaggcatcatggcgcatacctgtgattctggctgcacaacaggctgaggcaagagaattgcttgaacccaggaggtggaggttgcagtgagctgagatcatgccactgcactccagcctgggcaatgaagcaagactccatctaaaaaaagaaagaaaagaaaagaagaaaaatactgatacctaggccctgtcctccaagattcatttggtttagggtacctgtgtttttagatacttccccacatgactctgttgtacagcctgggtgtggggcttccaatgtagaggacgcatgcagatagaaggtccatttgtgaactagaaacagagctatctgagctctcctgtgagcagccgaatcttcttcaccgtcaagatcactgtataaataatatattctcatgtagggggcaggaaagagaacgagatgtgttggatagagtttagtgccaccaggagtcaggattcaagtgggataacaaggacttcggatttgatttgattgcagatccatgtgtcatgtctaatacacattcaatgtagggaaaccacacaaatttgaagtcccaagacctggatctggaacttttttctactgatcatcttttttttacccttgaataacccacctatgctccccaaggctcactttcaaataggtgttcatatcacagaaacacacacatatatgcatgtaaatgcatgaacattcacattcacatatagcaatttttaaaacataatgaacctctgctattttccaagacttttaggttgtcatggtcataaatacagaatgaacccatctgttctatctggtagcctatagatataaacctgggattgatgacatgattactgggagaagtaggctttcttcccgtgttataactttgaaatgtctgacctatcttgcactaggttacaaacactggcaacgatcaacccgacttttgaagtggaaaaattacttgcacggcagctattgacaacacgactttcattccaaaaggatataaaactcaaaagtgagtgtgaatgctggtgatcccatatttctttgctcaggtgtcaatgctatatccctgggaagttcccaaatgactactcctgcttgacgacttaggaggaaacatggcagcgatcattaatctcatggggaaagtggtatgtatgatgaaaaaagatctatatatgaatctttacttctactttgggatataaaaaataggactcactgagaagaagaacatgaaggcctctatatgatctttcttcctccactcagttctgcttttcatctttaaactggtgatattctgatcaaaatgttcattctatcccaaatccaagcatattctcttgaaagtgaaggggatcccacaattaaaagcaaaaatgccaacatctcaccactgtgctaatagggatgattccattgcatataaaagatgcattttcttagaaagaatcttcatgaaacagactttgctcaagtccacctatacatagagcatgaaggtgatcaagagactcttccaggagtttcttctaacacatccagcaaaacacggtcctaaaatggcaggactggaaaaaagagctactcaaaatacatgaggtacttgttttctttgtgggctttttgttcctggagggggaggaattaggaggggaaagggcataggaaatgatgcagacatattgtataaattaggaatggcctaagctaattgaagataaaagggaataaaacacacatgttagggaagtttggtttcaaaacaactcaatactacctatgctgttatgggataatgagcaaaaggtagttctttcaactcaggtaactaagaaagagaaaactaaactttgatcactatagaggaaaccaaatacagtaaatgggaaaaccttagggacagatggagaaggacagtattaagtttgtgggggtgtcataagataggaggccttggaagacacaataaaatcagctcagatgcccatatgcacactcaatgcaggtgctccgctgcagttctcagtcaaggaccaggcctgcagtctggggtggtgagtccttcagcattggatgtggtgtgtggtcaggcagaacagaaaccagatgcagccctggggtgcggggtctcattcagtcaagtcagggaatgagaagctgtgaattattaggctgctgcttttgaaaagtggatagggagacaacataaaacaccaggaggcatggacagtgaggcctggagaagtgctggcaccctgcaagctgatcattctgggtgtggtacccagaccctgtgtctcggtccagaaccacactccagagctgagcctcagatgaaagttggcccttcctgaaggattcagaaacattgtactcaggaagatacagaaaacttcagaaataatgaagcaaaactaacccacagaattaatactttgtgttgaatttaggaatgaactgtgtaaccaggatttgtgtaaccagggttttgtgtcaccaggattttttaaaatcttgtaaccaggatttttaaaaatctctgggtcatttaagtcatttgaaacatctctgttattccagcatattagagcatgggactttttggccttgggttttaaaattttttagttgattctagacttgtggtttgaatttgaaagaaataagatttaagtttgcaaagagtctttgaagttcaagagaacttgattgatttattatatttataagagctgggtaagtgatttgaaggaattggtttattgtaagtctatcctgttagggatataaaaggattcagatatattaaatttataaaatattttttaaatgcttatgggaatttaactacttcagtttacacgtttgagtgcttaagtgaattgtatttgttcaattgatgagttaatcaacaaatattaataaacaaatataagtgatcattcttattttacacaaaaattactaaatttattatttaaaacaaagtttgtcactttaacaggttaagaaaaaattaattttcaacttaaaaattgagcctctatttaaacaattaccctaagtaaacttttctgagaaaatatctttactaaaatgttttttcttaagtcttaactgttatatacctcatacgaattcagaaaggggtcacattttgctttgaaacataagtatggttgttctgttttccttattaaccatttgaagggagaaaaaattatcccaatattgcagctaagtttagagtcctgctgtggagatacagcctttcttggtagaatgtcaaacttgaatccattcaacctacacacattaataatataataatgataatttcagtatttgggtttatctttcacttttgcaaagaataactgtacatattcatgaagtacatagtgatgttttaatacatataatgtatggtgatcagatcagggtaactggcacatccatcatctcaagcccttattatttctttttgtggggggacagatattcaacgtcctctttctagctatttgaaactgtatcatatagtcaactgtagtcaccctacagtggtacagaacactggaacttactctggccatcggcttctctaatcagcgttttctacaaagcaaccagaggcaatttatgattctttctatctacttgaaacctggagacacatgcaccttactaacatcatgatgaagtgtccttggacttgactgctaagactattccatttctaggagactttttccccttggggctagaggacaaagtaatatcttcaaaagctaaaagctcttgaacacaaaaagggcccagcaccatgtctagcacataacaggtgtgcaacataccagggtttccctattctcagctcttttacttcaagccttaattgccttctacctccaagaaaaaaaaaagaaaagtagccaggtctaggagtcaggatgccattggaggtttcggataatgtcttgaggactcagaagatgaagctgctatagggcataatttccctttcctggtcacacttggccccatccaagacaaagtaggaacaatttccttcggcacaggctcaagtgctgaagaagtttttcaagttcatcccctcctggttttccttgtgctctcaagagttcccaatctaagctctaattcagggtcctgatcctgatccttgtgctcagaggaacatggatgtgctttggagcagcccttgaatttgtctgtgttggtgaatttgtgtgacaaatttggggtaagtgtaattgaatattgtcattttatagggagaggatccacagcttccatcctattctctaagggtccagaaaagtgaagctcaaccaccccagacatttcccaggtcctctccctcaccgaaacatactgacctctgtccatttcctgggaacttgtctgcaggcaaatagacaaattaaccccaatgaagatggcaggagatgacagggacctcagggttgctcttcaagagccagaataaacttcatacaacaaaagagtcactgatgtggcatgtcaggacactgatcaaggcattaaaggtgtttgaagattgtaggttaagaatttaaatacagcagaataatttaactcttacaagaccacacagtagacacaaaaatgcttgctaaacagatgtgtccacagtagcccttccctgtgaacaaaagtctttcattgactcactgctcatatctaccccactgggcccaggcaccagccctagcagaaatgcagggactgtcaccctacccacttgctgtgagcagaacctatagcttcagggtagggagaggacaattcaagaggatatggccagcaagggtctcaaataggactttatgcatcatactgcctctttgagtaaggtgaacaactgtctgggttttagcactgaaattcctgcatcctgggaaacctctcagtccccacaaattgggaagatttgttgccctgcatacaaaaatccccaaatttcctccttctgggaagtattcagagcttccatcctaagccaaaacaacaaaagagtggcctgaaagtcctttaaagatgtgtcatttgaaaacataaaggaaagtctttggcgcagaaaatagctattttctggaaaaaaaaaaaaaaaaaagaaaagaaaaaaaaaaagaaaagtgttctctgccagtggcaccacaccaattccttgataactggcagactttgactcaagcagcactcaactttgaatcaaagttaaattaaaaagccctacttcaaactgtcatattttcctccacttgtttcctataactaccccctgctaacccaaacatgtttcccttcacaggactgtccttagtcggcagacattgttgctacagtcactgggaaacactgctccatatataggcaacgtgtcttggagccacatgttctgcccttcaacatcctcctgggatcctcctggggtgctaggaggagtttgattgggctcaccaatcctcagcctttgctagatgaagagcattatgggggatgagaggatgtcacaactgtcccctagaccaatgcttccaacccagatgattatgcctcctccccggggaagacttggcaatatttgaagatgttgattgttgtgactggaaggtttgctactggcatgtagtgcgtagaggccaggggtactgctgacgtaccctacaatgcacaggatagccccccaacaacatagaattcaatgtcaatgtcagtagtcagtgagggtcctctcagaggctgctttatagcatgtggggtacttggaagacaaggcagcccgaagtttgcacatttaccaccttctctgagacacagcctcactgcttctgaatgagaaaaaaagcttgttttagcaggagacagaagaaagcatgaattaacagcaaaaaattctagtctatagaataaaaatatctcctacccagccgaggaatcaggaacaattagtgcctaatataggttgttgatgatgatgccaccggtgattctgcagctcattcctctgttgacttaaatcccaggaatcaggaaaaattagtgcctaataaaggttgttgacgatgatgccactgctgattctgcaactcatccttctgttgacttacgtagcaggctgtttttagcttaattttgaactctttttgaaataccttgcaaattctacaattataaaaaaaaatctacgtagattttaaaaaatgaatttgcaaggtattccaaagagaattcaacattaaactaaaaacagcaccctacataagtcatgttcaactaatacacctgcatatttgcctccaaagatgtgtatacgaatgttcacagcagcattattcacgatagtttaaaagtggaaacaatcgggatacccatcagctggtgaactggccatggaagcatggaacatccacgcaatggaatacatgtgataataaaagggaacgagaacataaatgagcctcaaaaacattaggctaaatgaaagaagccagacagaaaagatcccatggtgtacgatttgattaatatgaacgatcttttcttaaaaataaatctacagaaagagaagattcgtggttgccttgagttgggagagggctcctagggttgggaatggggattgatcacaaatggacatgaggaatgtttctggggtagtgtaaatgtcctaaaattggattatggtgataattgtacaattctgtaaatttacaaaaaaaattgaattgtatacttaaaacaggtgaaattatatggttagtaattacacatcaataaagctcttgccaaaaatctactgaacttggattgtttttctgatatttggtaggaaatgttgtagaaagaacatttaattagaaaaaattatatttatgtcctagccctgattctactcataattaatggcatcactacaaggaaggcattgatttcctcctggactcagtttccccatctgtaaaatgctgagggtcccagaaatactgtttatccttcatgctgtgagctttggttaactggctgctcacatttcaacaggaagagcagatggccacaacttaactcatgagcctgggtcactactttacaacaattaaatcaggcttgaagtccgctttggtttacagagaatgaactgactgtgccaacgtaagtaaaatccagtaccacatggacagctgaagcaatctctcccgcaaactcagcctgcttatcatcagaaaggatgctccttccaaacaatatccctcagaggtatagacagagcatgtctgccatcttcccacacaaacccagggaaggaccaggacactgactacctctcaggcaggcatatacacacccaaagaggttcctctcccctttctaagcctggctatagtgccacttcacctgctttagacaactgctgggacatgcagtgatccacagaccagtatctgcagcaggacagtgcctccccctcaccaatgcctgttaggttgtctctctaaagcgccacttgtcactaggtgggaagaaaaccacagctctaccccttatcatttttaggacattaaaactgcaacaacaaaattaaggggccaccctagttcaaaatattttccaaaatgctgacactttttcattcacaaattcccacctgtgtcatgcatagtgcaaactaattaactaagtatcagtgacaattatagctcctcaatcacaaaattatcttccaaagagaatttccttagcaaggtgaggagatttagccaggctgcatcaaatcagaaacatcatctaagaaagccaaaactgagggatcctgaggcagaggattcaccttgaataccagctgctcatcaagatttattagaggacatgtttcagtgagaacagtagactaagatacacaccagtccagaaatattgaattatttcttctcttaaaacaactcagctgtgtcttttcccaccataccgtttcactgatcctctgaaataatttgcaactctgtcactatatcactaaattagggggcataattctcccaattaagcatttaagtcaaacaagaagaagagaaagaaagaaacatctcctggcatcttttactaaactttaaagtaactgaagacttgttcttgccaaacggtaagtgctaaatcctgagggctgtcacagcttcaaacgagctaacagatgtttgttctcaagcacattttcctctcaatggcattttgagggtatcataaacttcctaacacagtatttcagtggaaacgtttttcgtaagattattttgttatcataaaaaaatcccacaagcatttttgaatatatgttgctctataggaaacaactaatgagatttagcaatgtggaaaaaggtagaaactgccaaggtgagttcatttacaagcacacgtggagatgaaccttaagcaggcctatttctttcctcttttggcctacctcctataactcctagtatagaacagagggacaattggcaatggctgaagaatttttggttgtcataattgggtatgctagtggatagaggccagggatgctgttcaaaatcctacgatgttccaaacagcccctaacgacaaaattacgcagcccaatatgtcaatagtgtagacattgaaaaatgctggcatagacagatataatttcatttgggttcatatctctgggaatgagacatattttctacctgtgtttagcttagtcttagaccagacacataaacacaggtttccaatgtaatacagagttctctcaaatacagcagcctttgtggtgggagggagggtctactgtggaaagaatgggaggtggtgaaatacacttaacacagtgaagagctaaggaagggcttcctagctcttcacataggcctgtgatggaagatgaataagaattggccaaactaaggagagggcaagggcaagtagatgtgtaggcacctccaagtgcctgtgtatagagtgaagggaggaagggccagctctgcagcaccttgaatgccaagctgggttttatctggtgggccatggtcatgagggtcatgggccacttctagtccttctcatgccacctctttcaaattatccattggccctgttgtggactaaatgtttgcattcccctaaaattcatattttgaagccctatctcccagtgtgatggaattagaagatggggtctttgggagataattacatttaaataaggcccttggggtagagcccccataagagtagtacccttataagaaaaagaagaggctgggcatggtggctcaaccctgtaatccccgtactttgggaggccaaggcaggcagatcacctgaggtcaggagtttgagaacagccttgtaaacatggtgaaaccccgtctctactaaaactacaaaaattaggctggcatggtggcaggagcctataatcccagcttctcaggagggtgaggcaggagaattgcttgaacctgggaggcggagttgcagtgagcagagatcacactattgcattccagcctgggcgacaaagtgagagagaaaccagatgttccttcttctctccaccatgtgaggatacaggaaaaaggcagccatctgcaggacaggaagagggccattaccagaacctgaacatgctggcaccttgatgcaagaccaccagaactgagagaaatcaatgcctgttctttaagccactcagtctatgatattttgttatagaagcccaagctgatatttttggaggattaagatggcagataggaggcaggactagcttgcagctcccactcaggtggacacagcagtgtgtggagacttacatcataaactttggctccaagaactactacaggaacataccaggaaagccaagagaatccacagaccctttgaaggaaagggatcaccgttgcaggctccctgagatgccaaaaactgtgagtctgcttgctttttcaagggggaagctggtggtctggggcaagttctcagtcctggtcactggccgcctggaaatagactcaatgctgttgtggggcacagtgggaagtgagaccagcctttaggactgctggctgcatcaggagggggcaaggcctgtgactgctggctttcccacactttcctggcaacgtgcatgacacagcagaggcagccataattcccctgggaacataactccattggactgggaaccactcccccatcccccacagcagccacggcaagccctgcctggggagagtctgagctcagacatacctatccctgccccaacctggtggtctttctctacccacccgggtagctgaagacaaaggtcataatctcttgggagctctatggccctgccaactgcctgagaaacctgaatacttaaccaggcatccctagggcaagcttgcatcttccttatagtaccatagctgatgcactattgaaagcaccacctactggctggcagccaaccaacacaaaaccaacacactaaaccaaaatacaagcaaggaccctcacaaagtctactttactcccctgctaccttcatgggagcaggttctggtatccatggctgagagatctgaagacagatcacatcacaggaccctgcagatgttccccagtaccagcccagagctcagtagctcctctgcgtggctagacccagaaaagcaaaaacaatcactgcagttcagctcccaggaagtcccaaccctaggtgaagagtgcaaagacctcatcaaaggagcaccccgtggaacaaaagaatctgaacaagcagcccttgagtcccagatcttccctctgacataatgtacccaaaggagaaggaaccagaaaagcaattctgctaatatgacaaagcactgttctttatcacccccaaaagatcataggtccaaagatctatggatccaaaccaagatcatagatccaaaccaagacaaaatctctgaattaaaagaattaagggctgggcacggtggcttacacctgtaatcccagcaatttcggaggccaaggcaggcggatcacaagatcaggagattgagaccatcctggtcaacatggtgaaaccccatctctactaaaaatacaaaaaaattagccggacgtggtggcgggcatctgtagtcccagctactcgggtggctgaggcagcagaatggtgtgaacctgggaggcagagcttgcagtgagccgagatcgcgccactgcactccagcctgggcaacacagcgagactccgtctaaaaataaaaataaaaaagaattaagaaggtcaatcattaagcagatgaaggaggcaccagagaaaggtgaagtccaacttaaagaaatcaaaaacctgatacaggatatgaaaggaaaagtcttcagtgaaatagcacaaataaaaaacaatcacaacttctggaaatcaaggacacacttagagaaatgcaaaatgtactggaaagtctaagcaatagaattgaacaagcaaaagaaagaatgtcagagcttgaagaccagcctttgaaattaattcaattcatttaacacaaaaaagaattttaaaaaatggaaaaagcttccaagaagtttgggactatgttaaatgttcaaacctaagaataattggtgttactgaggaagaagataaatctaaaagtttggaaaatatatttaagggaataaatgaggaaaactttcctggcctgctagagatctagacttccaaatataagaagctcaaagaacacctgggaaattcatcacaagaagttcatcacctaggcacatagtcatcaggttacctaaagtcaagtcaaagaaaagaattttaagagctgtgaggcaaaagcatcaggtaatctataaaggaaaacctatcagattaacagcagacttctcagcagaaaccctacaagttagaagggactggggtcctatctttagcctcctcaaacaaagcaaatatcagccaagaattttgtacccagtgaaactaagcttcatgaatgaaggaaagatacagtcttttccagacaaacaaatgctgagaaaatttgccactatgaagccaccactacaagaattgctacaaggagctctaaatcttgaaacaaatccttgaaacacacaaaatagaacctccttaaagcataaatctcacaggactatataacaataacacaatgaaaaaaaggtatttaggcaacaaatagcatgatgagtagaatagtacctcatatctcaatactaacattgaatgtaaatggtctaaatgctccacttaaaagaccacacaatggcagactggataagaattcaccaaccaagtttctgctgtcttcaagagactcacctaacacataaggattcacataaacttaaggtaaaggggaggaaagagatattccatgccaatggacaccaaaagagagtaggggtaactattcttatatcagataaaacaaactttaaagcaacagcagtttaaaaagacaaagagggacattatataatgataaaaggactaatgcaacaggaaaatatcacaatcctaaatatatatgcacctaacactggagctcccaaatttataaaacaattaccctgctagacctaagaaatgacattgatggcaacataataacagtgggggactttaatactccactgacagcaccagatgggtcatcaagacagaaagtcaacaaagaaacaatggacttaaatcataccccacaacaaatggacttaacagatatttacagaacattctatccaacaactgcagaatatacaatctattcttcagcacatggaacattctccaagatagaccatatgataggccacaaaacaagtctcaataaatttaagaatatcaaaattatatcaagtactctctcagaccacagtggaataaaattggaaacaaactccgaaagaaaccctcgaaaccatgcaaatacatggaaattaaacaacctgttcctgaataatcattgttttgacaataaaatcaagatggaaataaaaaattctttgaactgaacaataacagtgataaaacttgtccaaacctctgggatacaccaaaggcagtgctaagaggaaagttcatagcattaaatgcctaaataaaaagtctgaaaaagcacaaatagacaatctaagctcatgcctcatggaactacggaaacaagaacaaacaaaacccaagcccaggagaagaaaagaaataatcaagatcgagcagaactaaatgaaattgaaacaaaagaaaacaatgcaaaatataaatgaaacaaaaagctagttcattgaaaagataaatataattgataggccattaacatgataaacaaaaaaaagaagacagaagatgcaaataagctcaattacaaaacaaatgggagatattagaaccgataccacagaaatccaaaagattatacaaggctactatgaacaactatatgcacataaactagaaaacctagaggagacagataaattcctggaaatatacaatcctcctaaattaaatgaggaagatatagagactctgaacagactaataacaagcaggaagattgaaatggtaatttaaaaaattatcaaaaataaaacatccaggaccaggcagattcacagccgaattctatcagacattcaaagaagaattggtaacaatcctattgacactattccaaacaatagagaaagaggaaattctccctaaatcattcaatgaagccagtatcaccctaataccaaaaccagggaaagacataaccaaaaaaatggaaactacagacccatatccctgaagaacatagatgcaaaaattctcaacaaaatactagctaacagaatctaacagcatatcaaaaagataatccaccatgatcaagtgggtctcacaccagaaaggtggggatggtataacatatgtaagtcaataaatgtgatacaccacataaacaaaattaaaaacaaaaatcacatgatcatctcaatagatgcagaaaaacatgtgacaaaatccagcatccctttataattaaaaccttcatcaaaattagcatagaagggacataccttaaggtaataaaagccatctatgacaaacccacagccaacattacactgaacagggaaatgttgaaagaattcccactgagaactagaacaagacaaggatacccaggttcaccacttctattcaacacagtactggaagtcctagccagagcaattagataagagaaagaaattaaggacatccaggtcagtaaagaggaagtcaaactgtgactgtttgctgacgacatgattctatatctagaaaactctaaagactcatccaaaaagcttctagaactggaaaatgatttcagcaaagttgcaagatacaaaattaacgcacataaatcagtagctctgctatataccaacaatgaccaagctgagaatcatatcaagaactcaatcccttttacaatagctgcaaaaaaaataaaataaaatacttaggaaaatacctaatcaagaaggtaaaagacctctacaaggaaaactacaaaacactgctgaaagaaatcgtagataacacaaatgggaacacatcctatgctcattgatgtgtagaatcaatattgtgaaaatgaccatacagccaaaagcaatctataaattcaatgcaatttccatcaaaatatcaccatcattcttcacagaactagaaaaaacaatcctaaaattcctgtggaaccaaaaaagagttcacatagccaaagcaggatgaagcaaaaagaacaaatctggaggcatcacattgcctgacttcaaactactataaggccattgtcatcaaaactgcatggtactggtacaaaaatcatagaccaaaggaacagaataaagaatccagaaaagaaataaagagtcaaatacttacagccaattgattttcggccaagcaaacaaaaacataaagtagggaaaggccaccctattcaacaaatggtgctgggacaattggcaagccacgtgtagaagaatgaaactggattctcatttctcatcttatacaaaaatcaactcaagataaatcaaagacttagatctatgacctgaaaccataactttcatttgagaagataacatcagaaaaactcttctagacattggcttaggcaaagagttcatgatcaagaacccaaaaacaaatgcaacaaaaacagataaatagatgggaattaattaaactaaaaagcttatgcacagcagaagaaataatcaacaaagttaacagacaacccacagagtggagaaagtcttcataatctatacatctgacaaaggactaacatccagaatctacagagaactcaaaaaatatcagcaagaaaaaaacaaacaatcccatccaaaagtgggctaaggacataaatagaaaattctcaaaagaagatatacaaatggtcaacaagcatatgaaaaaaataccgaacgtcactaattatcagggaaatgcaaataaaaaccacaatgcaataccacctcactgctgcaagaatggccatattcaaaaaatgaaaagataatagatgatggcatggatgtattgaaaagggaacacatttacactgtgggtgggaatgtaaacaagtacaaccactatggaaaagtgtggacattcttcaaagaacgaaaagtatatctattatttgatccagcattcccactactaggtatctacccagaggaaaagaagtcattgtacgaaaaagatacttgcacatgcctgtttatagcagcacaatttgcaatttcaaaaatatggaaccagcccaaatgcccatcaatcaactagtagatatagaaaatttggtatatctacataccatggaatactattaagccatgaaaaaggaattaagtaatggcattcacagcaatctgaatagaattggagatggaattggagactatcattataagtgaagtaattcaggaatgaaaaagtaaacatcatatgttctcactcataagtgggagctaagctatgaggaagcaaaggcataagaatgatacattggacttttgggactcaagggtaatgatgagaggtaagagataaaagaatagacattgcatgcagtgtacactgcttgagtgtaaccaaacacaacctgatccctaaaaacctattgaaataaaaataaaacaaatcaaaacaaacaattaaaataaaataaaattttaaaatgaagttttattagaacataaaaaaaaaagtagcccaagttaactgagacagaaatttgtaccaagaagtggggtgttgctctaaaaatctccttaaaatgtgaaagcagctttagaactggtattaggtagagactgacagagttttgaagtgcatgctagaaaaagccaagattgccatgaaaggactactaaaggggagtctgatgaagactcagaaagaaaagaagaaatctgcagagaacacatccaccttcttagagactacataagtgattgtgaacactgaatgttggtagaaatatgagccattctgatgaagtcacagatgaaaacaaggaacatgttatcaggcaatgaagtaaaggtaatccctattatatagtggcaaagaacttgactaacgtgttcataaatgaagttagctatttagctgaggagatttctgagcaaagtgttgaaagagtggcttggttcctcccaactgcctatagaaaaatgtaagaagagagaaatcaattaaagaaggaattgttgagtaaaaaagaaccagaacttacagatttggaaaatccttagcctatccatatttttaaaaaatgagaatgtttggaagataatattaagggtatggctatttgatgaggagactactgtgagtgtcaaccatggacctaatcagccacctcaacagaagcaagaaatgggattagcaaaaactttgacaagtagtatgaaaagaaacagagaaaatgagacagaatgaaggctgcaaacatataccattcctcagaggaaaaaataggatgatagggaagatgattcagagattattagggctaccactttcaccacaggcttatgaggtggacctagttcctccttggtctcaaaggatggggctaactctctcatttcaataggtcagaatgttcccaactattgccataggggtggggccactgaagatatccttgtgggtgggtccccatggagcaggaggagcagggccagtccattgcactgtgagaatgatgctgccatcattgtcctgctaagacaaatttaaatttttgtcttgctaagaacttccttatgacccatcactccttccttctttcctattcttcccttttggaatgagaacgtctatcctatacctgtctcatcattgcagtttggaagcacacaacttgtctggtttcacagattcatagctggagaggaattctgtctcatgacgaagcatacctcaagtctctctttagactagacttcagactttaaattttagagctgatgctagaataagttaaaatttggggggctgttgggatagaatacatgtcttttgcatgtaagaaagacaggaatttcagagggccatgaagggaatgttacggactgaatatttgtgttccctcaaaattcatatgtcaaaggctgaacttccaatgtgatggtattagtaggtggagtctttgggaggtgattaggtttagatgaggtcatgaaggtagaccctccattatgggattagtgtccttataagaagaggaggagataccaggcctacgagacacagcaagaagttattcatctgcaagccaggaagagggccctcaccagaacccaatcatggttacatcctgatcttggacctccagaactgtgacaaataaatggctgttatttaagccacccagtctgatattttcttgtagcagaatgaacagatgaagacaggtcctctccacttttcacttttcttcatgtccagcttaaaatccttgatccagtaataaaaaccacatcaccaccttgattacattctctgttctttccacctctatcctttatcaatgccaatgaagaccttcattcttaaatgggatctctttgtattccttcttagagccacacatgaatctacaattgtctcaaaataaaatattttttaaaacgcaccttctttctggatgatgccaactatctgacatgcctaaaagtgaacaactcaagttagtgaagatactttcaggctgattgtggtcatcaactttacatggaacctctctcccccatgctttccttctcttacactcattcttttatttttattattgattctcatgtgtgtgaaacacaggtagaacagaggcttgaatgtgccttggtctctgggaggcaggacaagtctacttttagcatgtgtgctaggggaagctatatctcacttactcttcaacagaccccaatctgtcttttgtttccaccatccagtgaaaggcaaggtcaccgatgtctttatctaccaaatccaaagggtgccagtgagatattacttgacctcgcattagcatttgacatattctcgtctctgaaaatattcttctctcttgacttctatgtgtctcctgtggcaagatatgaaagtttcagcccatgtgaatatagaaacttcaccacgcttgggattttctccatttgttttgtgctgtatgagacagattaaagataaattcttctcctcacttccgggggaggttggaagtctttggtcttcatggaaaggcaagccacacctggacttattctggctctgagtttaatgggccatgaggagtaagaagacagtaggtttcaggggggcatggggttataaagaaggtttgagataaggatgcacaagagaactgctagagggatatggaagcaatggagagattaccaccagatggagcccctggaagtgaggtgctaatatctggaaaactgctgagaaggaggaggatccataatccagggagcattagaaaagtggacccttctgaatatcatggcaaagggcattgcttgagggcccaggaggctgatgagaatggaaccttgcctgacaatcacccagtcttcttccaatggaaaatgttgcactattttcacatgaatgtcttctctttgtctacacccacaccagagaaagctcctatctgtctataccagcactttacccactggctgaagacccccagctatgccccaagactatgcctggttcctatcgcatgacctcacgtggatgttccttgttatggtttaaatgtgtgtgttcccctaaaactcatatgttgaaacctaattaccaaggtggtgttatcagaaggtggtccttttgggagatgattaggtcatgagagtaacgtcctcataaacatgatttgtatctttctaaaagaggccccagagagctgcccagacacttcaccatgcgaggatgcagcaagaagaagccatctgtgaaccaggaactggtcctcaccagacactgaatctgctgacaccttggttttggggtttccagcctccagaacaatgagatgtaaatctctgttgcttataaaccacacagtctacgacattttgttatagcagtccaaacagactaaaatttttcttacatattttaaaatccccatacccataagcctaaagagtgaggtctgttcatgaagtgggcatcccctgccccctaaacttagtggtgaagagggacaaaatatgtaagctcaaaggctacaagctaggacagttgttcctgagcctcgtcttacactgccttctccacctcttcctctgactttgccggacgcatttgctccatctcctctgctggttcctccctggttctgaatacctcggaactctgtccttttttcttcttcttcttctgcctagaaaatcatatctattaccatgactttaacaacacccacattctgatcactccaaattgatacattcaggccaatgaaacccaggtttagacatccagctgcttacttcatgtccacatctgtgtgtttcatagacatctgaagcatagcatgttgaaaattacagggcccttatgatgtgtttctgccaatctctccaaccaaatgacaagccatcccttccctcaacctttcaacacaacagcctcttgggcaccctttcctttctcaaacatgacacaccctttctcatcacaggggctgtgcacatgatattccttctgccccaaacttcctccccccgcattgcttgctcttgtcattatttcaactgtcatctcctcagagagactttctctcccactctgtatctaaagtaggtctcactgttattttctatgaattcaccctctatagcataaatcaccattatgtttatctgtattgtccttcacccccctgccccacccaataacccatgaatttcatgagggcaaagactatactacatccccagtacctggaatactgtctggttcggagaaaaagagaagatgttcgataaatattcattaaatgaatgactggtaaacattagagtatacatataataatattatatatatgtatgtatgtatgtatatatatgaagttgaagaggtgtagagaggtgggtaagagatgagttttattttacatgtgttgagcttggaggacatagaggaccaatgaatggatcaatccagcagatgattgggctctaagtgtgaaggtaaggggggccagagataaagatataggaggaattcaacaaaactatggccaaagtcacagatgagaatgaaatggcccaaaaaaagtcagtagagtgagaataggggaccaagaacagaaccccacagaaaactacctagaggttacctgctgctcagtcaccactatttcaccatttccaccaagctctcctgcctactcctctgccttgtctagaatagggggccaggaacttagtaacagtcaccacggtaggcgctgggaataaacagtgaccaaaacaaacttggtcactgccgtagaacagttcatgggtagtgaaagcaagccatgtggacagtcactgggtggcagagaccatgcctcccagtttttttctcttcagttttagttggtcatctgactgcccagaggaaaagctacatttcttaattgcctttcttgcaatttggtgtagacatggattaagttttagcaatgggttatgagcagaaggaagggacactgttgtgagttgaactgtgttccccacaaattcatataataaaatcctaacccctgttgaggaatgtgaacttatttggagataaggtctttatagaggtaatcaagttaaaatgaggtcattttaaacaaggaccttatctaatatgactagtttctttataaaaagggggaaattggacacagagatacccatagagagaagacaatggaagagacaaagggagaagatggtaacctacaagtcaagaagagaggcttggaacagatcttttcctcacagccctcagaaagaaccaactgccaatactcagtcttgaacttctagcttccacaactgtgagacaatacatttctgttgtttaatccatcagtctctggaactttgttacagtagcccttgcaaactagtaaagaaaccacttcgaggtcataactctagaaaaggatatgtatgaacctcctggcccttctcccactttgctggcctggggatgactagacttgcagcagctatcttggatgcagaagtggaagccatgtgttgagtttggcagggccacaccacagttgacaaagcacccttgactgcacccctctggactgttacagaacagagaaagaaaggtttgtttgttctaagccacaatattttgggtctctttgttacagtatagattccttagcctgtattctaactgatacatattgcataaaggtcatggataactgtaaataaagtcatatatgacttccaaataatgcttgaaaatgaattatatttgacctcccatcctaattatacattctacatcaaatttatagaattgaaagtacatcctgccacatctgtctctgcctcctaaccctccagattggctggtctcatcaattctaacttggttttcattattgacttcatctcttttcccatttgcagaccattcaaagaatctcttccaagatttttccttcatattccttaggttaccttagctcctctatttcactccagtctggttttcaagtttaaaatgctttccagaatacaaatctgacactccactattcttttctttccaacccaggcacaattcaacatgattcagccatcatcattacaggtaaagtactttcctaaaacactcatcttcctctgctctgtcttttgctgaggtatgcagccccctttgatgttaaatggacttctttctgtgacagtacttgaagacaatgggatctggctagacatctgtaggtttccttaatgtcagcattaaatacagatttattgttaattgatacatttatgccgagttttctaaatcaatggaaagtgaaaaaaaaaaatgctcacaaaatgctaagaattttttctcactttaaggaaagtccatggcaagaatgttctcttatctaagcaggaatatctagagtaaaaaatttggaaatcaaacatggttactgtagtgtttttattctaatcgattccactgttctcgagcccattttttttcatccagatattccatgaaagttcaaatagggaatacattctacattccagatcaaaatttaaaatcactgaagcatttgtctacaaatgcaagctgattggtcaatcctacgttctttctttattctagaatgaagggcaatgtggatacatctgaatcattcaacaatgacataacttaccttctctatgacccaatttacttgcctaattttggtgactcagtggactaaggagaagatgaaatatggagaaattatatttcttttgctggatctgtcagaaaaaaaaagtgtatgactttggggagaaaaatatccttcctctgactttgcttccacatttgcaaaacaggaacagaaaagtcccactaacttagtaataaattatctcattactgagtgtaaacactgttattgtttagcatttatttctgcaatctgtcaggatattttgaaatttctccatgaactatacatcttaatacagtgtttctccttctctcttcacatggcgtgtcggagaaagcgaggcagaatggtgaacacatgggtgatgtaaatgaaatgctgtttaatttattttcaaatggataaaaggaaatgtaattaagctccctaaaagccttccaaataaacttcccttaaaggagtagaaaaggaggttgtaattgatcaaagtagctacgtcaagtgtcagattccttgacacttggagacagaccagattaagatagccagcagagaatcaattgcagtacaagccagaggcttcacaggactgggggaaaataccagaaatgtggattagatgctggtcagcatcaagaagcaaacacactccatgtctgaagtcttgggcttagatgtacaactggtgtaagtgaaccctctctcttcttaatgcacaaacaagtcaatgtgtgtttatattagataagcagatgatagatgatagatagatggatagacaacagatagatagataatctcctatctttttatttaatgaggaaaagccaagatatcagcctaaaaccactaaaaaagagagagaaagcaagccctatgggtctgcaggtcccaagagaaagacttccttctgctacattgcatgctaccaaggatagcaggggatccacagcaaataatatctactcaagtctgtattgtacatttgttaaattctgatccctgaccaaaaaaaaaaagaaggaaccctggtagaacaactataaatatacatactcaacatctcacatgtcccatagtaaatgccacaaaatgagcatgctttgtatttgttctaaaattgttactcttcagagtattcaaactaaaaacaaaactatatttatatctcaggattctataactccaccagctttggaatggcaagaatgagaagtggtcaccctcttagggtcattaatgttcctgaaacttacacttcatagaaacaggcatttttatcctttttaaaaatatatgtgtatgccctaactaatcaacagcctggacacatagacccaactttgaattgattgtggaattaactctcgtgtcaatagagaggaagtcatcaaggtgtaaatttcctctctcaaggattatatgtctttatcataaaaatcataaaataaaatcatgagtttccattaaaaagtgactattttatgatccacagtttatcaactgtcagctatacactgttttgattctttgctttcctcttttcaacatgatcaaatatgaacatgctattaagtcttaaccctggcatgctatttttgaaaagatattatataatgaatatctgccataaaatagtatataagtatatgtgataatcaatcgcaattgattattttagtttattgtctttccaacaagacagtgaagattcgaagcattctattgttaaaataaggttttaaaaacagaaaaaaaatgaaaaattaccaggaatggagaattaaagcacaatataaaacccctgtaataaagagtcattgcctcacagatgaacataaattgaaaaatctattgctttttttttctgcagacatttctcaggatagtgccatactaccattcatgggagatgcttatcacaaatagtcagaaataatgtatctcagggagaagtatttcattattaggtatgatgaaaagcaatattactagaggcattccatcatcaagttctcttagcctattttgaaaggtctttaagaaaaggtattcacaagcaagcatgaaaactatgaagcatcaaggcagttgatgattctaataatagtataactgatcatttatacactgtaaatataacctactgagctcatcataatgattaaagttgaagtttaagacaatgcaaaataaatgtttaaatgaaacacactgagatgacaacagtggttaacttagagtgggtctgatcagcggtcttttaaatttcattctttctagcttgcaaattttctacaatatataggtagtatttttataataaaaattttaattttgttaattttttccaggcttactaatattttcacctgcaatgtgcttccagtgtgtatgagtcaaaatctttgataggactttgaagtctacaaaagtgagcggaatatcaggaaaactgattttaagcccacatgtcacaagccaaaggaacatgtccgatttaagctctctgtgcacgaggtttaatatctgtaaaaacatcttctcctggaaaaagatacccctaactgaaaacagccgttgtgtcatagagatgggaatgagattagattttattttctattttgcacatgcctacgctttaaatttatttcatttggaaaaaaatattttctgttttcttggaaaaagtttgactttttaatgacaattttacaggcatcaacaattatgcactttttgattgcacagtaagaactgatctagaaaaaattaaattgagatacttttcaaactggaagaaatttaaatcactgaggtaacaagtatggggtttcttttgggggtgagggcaatgttctagttagatagtggtgatggttgcatgatcttgtaaataccctaaagatcattaaactttaaaatggagaattttcttgtatgtgaataatgtctcaaagcaaaacaaaactagaagatactgaggagcatcagatttgggacagaattacctgagctcgtatgaatttgttttcacactactgtaaagacactacctgaaactggaaaatgtataaacgaaagaggtttcattgactcatagttccatattgctggggaggcttcaggaaacttacaatcacggtagaaggtgaaggggaagcgagccttgtcttacatggaggcaggagagcgagagggagagggagagggggagggggaggggaagtgccacactttgaaatcatcagctcccatgagaactcactcaccatcacaaaaatagcatgggagaaactgcttccatgatccaatcacctcccaccatgtccctccctctacacatggggattataattcaagataagatttggatgaggacacagaaccaaaccatatcagagaccattccgtataatcactgtctcctccttgccaaaaagtgagagacagacacaggactcagggacaatcagcagaggctgtcacgtccttaaggccatctcatccataactcagatttttttaaatcaaattgtgttatacaagtgggctcatttggccatattaaggggaggctgtcagtgaagacattttcttacctcattaggacaagaaacattcttgctctctcagagtcagagatttgggcgacattatctctctagagtatatgccttgagtgtggtcaccccaagattttctctaccctctgtagcctatgttgatacctctgtcagttggcttttgctgcataattaaacatccccaaatttagtggcttaaggcaaccaccatccatgtggctcatgtatacaggtcagccatgtgggctgaagctcttctgggctcagctgctcaggtgagtgagctggctgtgggccagggtgatgggtgactgggcaatgtctccctcttcatacagcaggcaaacctgggctctctcatccagcacagcatgcttcaaaaagaacaagtaaagcgttcaagatcttttaagcctagacctggaactgcacaggccacttcatccacatcctcagggtgagactcagtcgcaagtccatcctggacccaaggggtggggaaataggcctcacctcttgatgggaggaagcatagagtcacattgcaagatgtgggacacaaggaggggaaacatgcttggaagcaacctaccgccacacagccccaacaacatagacttcaaaattgtaaacacaaaagaaagaaacattcaagggctctcagctcacacagttaatcttcccagtgggacacagggaacataatgatttaatgacttcgaagccatgtattattcaaagaggaagagttctcactgagaaaacatcccaagtaaactgaaacacatctgcactcctcattactgttcctctccctccctgccctccttagagccctcagttactgctttaggtagataaacagggtttgattcaactgaaaggggagctgtagccattatacaacctcagatgaggattgctgagagagatctagggatggtaaatggcgactcaaagactcctcaatgagtctaagcctagggaaggtgctgagtttgtggttcttaaagcaaaggactcgaggtcaccatcgctcagagatgagacaatctctcagctccatttcatgctgatatatttcctcagatccattacatgcgagcttaatttttttaaggtgaaggtttctgcaacctggaaaacaaagcaataatcttacaatacagtagaattgggcagaagtccccaactatctctgcacatcagaatcgctgagcacacttaataaaaacactacgtcttgggctccatcctcaggcattgtgatccaataggtttagagtttagtgcagagacataatttcagcaagcttcccagttgtctggatgagcttagttttattaggtaagaaatggggataactgtatctgctgcatctggcttccactgatgtatcaatagatacggatgggtgcggcatgctgacatgaggtgcattaaagcagataagccatatcaaaacacaaaacctccacagcaggcaagcttatactgggcatattccaaccttactttgcaagatgtccattttcagttccttgccatctactgattactcattaaaatctaggacattcatgttaacccaggcatactgtaggattgtgtacagctgcaagttacaaatatgcaaaaaaagcgtactgcacaagacagaaatgtatttgttcccatgtaagtatttcagccctgtcatgacaagccagctccatgaaacataaagagacccccagctcctcccatctaaccactttgccatgcctcaacctcatgatataaaataaaattggggatccagaaatcacatttatatcccaagcagaagtctggagaaaggggaaaagatgaagcaaacagccccttcttttaaagagcattcccagtttgcacactctattttcacctgcattccattgatcagaaacttaagcacatggaaaggaagtcactagaaagaaagactggaagattccatctctattccagactgccatagggggctgaaatttctgtggaagaaagataaattgtaggacaagaagaaacccctgccatacccaggctttgtcagaacgcctatctctgctttgagcctataaaattttcataccccaaagtgttcattgtggaattatttattataacagtaaaaatttgaaaacaaataaaatggccaacaataggaaaattattaagtcaactacagtacatcaatttcataaaataacatagaatcaccagaaaagttggttaccaagattatataatcctttttagcatgtagtggtgtctagcctcttccactttctctcttaaatacctgcaaagcacaaacactcacagcactgaaaacccggcctgagagacaagccagttcctccatcctagaggaaataaccacaggcagcacaaagagcttgatttagataaatccaaccaggcttcagttcacagcaaactcaaactctgctttatgaaacaaattcctcctgaaaacaaaaacgaaagaacaaaaacaagaagacattttccatcccccaaacatctgtcccaaggccctgaactaattagtattctggcccaggatcccaggccacccttccaggactgggagatgaacagagtcgattttcccaccagcattcctgagctctcctgccatcatcagcctatatccacatggaaacatgaatcccgggaaagagcttggcaggaagtcaggaagaggagatgccagcagaatgttggtgctttctggccaaggatatctcaggagtaaaactttataggtggagagggagaaagagagagacccttgatagcagtgcaggccaacaactgtagctgtgcaagaactttattggttctaaatataaaaaaacaacacagggagggcagatgtacattaggtgagaaccttagagactgagaatcccagcaggagctctgcacatgaaacagcacctccctttcatctgtaggttcaagaatggattctttcactttctaagtgagcagagagaagactcaagcacaccaccaccaccaccacccccttcttcttcacaagcacgggacaggaacaggtatttccatgcttggtgaggagtgtcaataaaagcacaacctcaaatctggaaaggtcattggagggacagctctttgatgaatcttgtgtattagagagttgaactttacagtcattatttggcatcttaagtagaatgtgagaaggtctcactattttgaaacacctgcagaatgtacacaaggctaggaccaactgaaatgaagaaacaagagcatgatctaaacaggaggtgcctgggtatgattccaaagagatgcaagatgctatggcaaatagaacatttctgaaaggatacatgagaaattgataatagtgattgcctttgagacagggaagtggggaaccacagacacaagcattaactggaaaatcatttggtggtatgttattttgtacttaattaattgtatcaggtttattaaattttcaataaaaagagagatacttgagacaaaaacaacactttcactttggctctttctccgttaatttctagccttatgacctggggaaagatattaaaatcactccacgtgtcagtttcacatgtataaaatctaagacctgaaagtctagcagccatgcccagccctggcaaatgtcacctaaggctggggcttggaagtcaccatcaagaaggggaaggagcattccagttgactctgtggtcatgaccactgctcttgctgtcagtaacacctgtaatcacactacatttttgtgagattggcttcgttcttttcctttaatacactaaattctttccttccttaagactttcgtataggttaatccactagtttttaatgttttgtttctaattttcacatggctatatcttactcaattttctgatactgattatcagatgtcactgttctgattccttgatgtcacttcctcaaaaaggacttccctgaccccccatttatactttctcagaaaattttgttcttttctttcataatatgtaatgtatgcatgtgtaattttttttttttttttttttttgagacggaggctcactctgttgcccaggctggagtgcagtggcacagtcttggctcactgctgcctccacctcccggattcaagcaattctcctgcctcagcctcccaagtagctgggactacaggtgtgtgccaccacgcctggctaattttctgtatttttagtagacacggggtttcactgtgttagccaggatgctctcgatcttctgacctcgtgatccgcccgcctcggcctcccaaagtgctgggattacaggtgtgagccaccgtgcccagcctgtaatatttatttctgtaaaatatatgtaacatatgttatatgtacatatgtccttttccttgcttttcacatacaaatttatatggcagtttattgcatattaatgtattcagagttagacagtattctaatggataatctgtgatttttaatcagtcccctattgatgaaattaagataattttcccattcttttgctggtaaaaattgtgctacaataaaaaacagtaatagcttttttaaaagatactatgacagagataacgttgcaagggtagacactgttgctgctgcaggaagtagacagcaatgatgagtaggtcaaagctgactgctctctcagaatgaaagcatctcttcctctccaccaaaaaaaaaaaaaaaaaaaaatcttggcttggaaaaacagaacaagaactgtccaggacttatgtttttcaagaataactataaaatgtcatgaagaataaaaaagacttatataaaagtatatttttctggattagaaggatttaataataaaaagcaaaccagtcttccccttttgataagagtgtaaaatgctatattttgggagaggaggcaatttggcagcttatcatagcgtttctcaaccatttttctttcccattatcattcccctaaaaaggctttttagatatttttcctcatgctctcacccatgaaattttaatcctacagatatgctgaatatctactcatatgctttatatataactatgctcttgacatagaaacagcaaaattttgtcatccacctccagacaggaagagagggagggaggaagggaggaagggagggaaaagggaagggaagggaaggggaagaggaaggggaagggagggaagggaagggaagggaaaaggaaaggaaaggaagcagaaaggcagaaaggggggaaagaggaagggaaaaaggaggggaggggaaaggacaggaggggaggagagggaaagggaggaaggaagggagggaaagggaggaagggagggaaaggaaggaagggaaggaaaggaagggaggaaggaagggagggagggagggacagatggacggagggaggaaggaaggaaggaaagaaagaaaggaagatatgctcctttgggtacagtttcaacccaactgaaaatgcatgctcactactaattcgaatagaagttgtctccatctgggtccagtaggaagcagaattcaaatcaaatggttcaaagtgccacttacagaatgtgggcaacactgatagaactaaaaaagatatgaggcacccagagacaagccacatggagtggtgctgtcactcaagaagtttgccttggagggctgggggaggaaagtgttgcccgcctgcctcctgagaactgaagctatggcaaaggaactgcccacccagcacaattagcagatgtgtagggcacaggcactgccaaaacatggcaccagctttggagtggaagtgcctccttcccgctctcccaccagctttccgtcttctgcgcctgactccccttagtcaagctcacctggaggccacacctataaaactgacagtaattcctgaaatcatctaatacccagtccataatcctatctctccagtagtccccaaaatgaatcaaggaccactcatgcttctagtatttagggttgttaggtcttttctgatctggaactttcttcataaaaccgacttgatggaacagcagccagatggtgttctgtgcaatgtctcaccttctgaatgtggccaactgcttcctcatggtgccatttagcttgatattctatcctttgcatttcctataaactggaaatgaggcctaatgcctggactaatgttaagcttttctaacaggattacatcacagggatgggtaaggctgtggtccgcctatggctcactgcagtggctcatgcctataatcccagcactttggggggccgaggcaggtggatcacctgaggtcaggagtttgagaccagcctggccaacatagtgaaaccccgtctctactaaaaatataaaaattagccaggtgtggtggtgggcgcctgtaatcccagctactcaggagtttgaggcaggagaatagcttgaacctgggcagcggaggttgcagcgagccaagatcatgccactacactccaacctgggcaacaagagtgaaaactctgaaaaaaaaaaaaaaggcaggggggaagagaaaggaaaagggaaaggaaaggagacacaaggtatctatcccacctggagttatgcaaacatggacatctcctaagtagaggtgatgaaaaccagacccttgcactgtaagatacagcccccaacccaacagaaaactgacttgtgcagtgttcagcttgccaccaaagatgcaggctttcactaatctccagcctaatggttttttaaccaattgatgaagctgttttaaataaattatttcctgatataaaatagcaatgtctaatactatcatttcctttctacttactagctggtattctgtattatctgttctcaggctgctaatagagacatacctgagactgcataatttataaaggaaagaggtttaacagactcacagttccacatggctggggaggcctcacaatcacagcagaagagcatgggatgtcttacatggtggcagggaagagagagcttgtgcaggggaactccccttcataaaaccatcagatcttgtgaaacctactcactatcatgagaacagcacaggaaagacctgcccccgtgattcaattatctcccaccaggtcccttccatgacacatgggaattgtgggggctacaattcaagatgagatttgggtgtggacacagtcaaaccacatcacattcttctgtaagatggaactttctctcaacaactagactatttggttaccctaaaaaacagctcctcctggggaggcatgataactgctcaattttcctgcttctcaaattagagtacatggaattgctgcctcaaataaagtcaatgagatttttcaggctttttcttttgtgaatattgttaaagacacatgtatttccacacattcaatctgtaaaaataacaaaaatagctgtcacgctcaaattgttataagtttagccaatgggagcactttcaagcttaatcctattttttttgtatattcatctgagaaaccttccttgctttctggcacaacaagcgattccagactcattttatacctttcttggcctgaaataagtcactgctccaaggagccatgattccttacaggggtaaatgttattaaaggccaaaatccagtgggttagggtgcccattgctaccaagctgatattgtttctaggccatttcagtggtcagaaaaagaaacggtaatttttataattacatttaacatttacatttaattacatttaacatttacattacatttaacattataagtcatagatttataaaatatttttaatctatcattataatgtccttcactttatcctataaaatacataaaataatttttgtataatgatgctaatatcattactaataaatccataattcacttgaagcttaaaatttctataactcttcttgagctgtaacaaattaaaggtttctattcagttccatatattaatgtcacttaaaataaatcttttccatggtatgatatgaatttgacatacaattatgtttcaatttgctttaaattttactaatacctacatgatcccagggttaaaacaacgtaaaaagaaacacactaaaatgtctcaactggaaactatttcattggtttcttatttattcttgcactttttatttttacaaataggtacataagaagaaagaatacttttgcaaaaagtcagcccactgaaatacattaattagtaaattttccacttaatacaggttagggctaacctatatcgttttaaaggctgttcaagataacttttttataactacacataaaaaaagaggtttgcttttttcagtgaccatgtactacttctgaccttaaaacatatttttgaaaaaggaaaacaaatttagggacacattttagccccagtcttgtttgtcccgtgggcagcatttggcatttactggtcacccctccttctggaaaccttgttttttccatttccatggatccacaccccttgattttcctgccttctacttaccaaattccactggcaatgctgctccttctcaccagctcttaccacttggcattctttagggtctccaatacttctaatactacacaccctcccaggacaatttaatctacccttttagctccaatttccacctctgataatgaatttcaattctataactttacccagctcctgagcctcagaaatctatatgcaactgctgacaggatgtctcccttttccgctcacagacacaacattttcaacaggcaccagcttgagttcatcaccttgtgccccttcctccttcctcctccagtcttcctggagttagaaatggtaccaacctaggggcacagtcatcaggcttcccttcacctgtcacctcctttcttacccacctccagggcaatcccaatcctctcaattctacctgcaacacgacatcgctgtacatccatttgtcctagtccagtccatctcctggattgggcaagcattgtctctagtctattccaacacctcctgcttcccattttcatcctctgtgacccacttgccatgttgtattcagaacaatcttttaaaacataaattgggccaggaacagtggctcatgcttgaatgtcagcacttttggaggccaaggcaggaggagtacttgagtccaggatttcaagaccaacctgggcaacatagtgagattccatccctatacacacacacccgggtgtggtggcatgcacacacacacacacacacacacacacaatcacacatatccaggtgttgtggcatgcacttgtagtcccagctactcaagaggctgaagtgggactatcacttgaacctggaaggttgaggctacagtgagccatgatcatcccactgcattccagcctgggtgacagagacagaaggagaccttctctctaaataaataaaatacaaattaagtatcaggtaaatacctttatctgattaaaatccagcaattccttattatcacaataaaatccaagtttatgtacttatatttcaaacaaatttacctacttctaatccttgcatgatggagtttttcagcaataccttctacgatattccgctttgctaaatgttcattttatttctagaattcaaaatattttctagtaccttcatatttctgcaaagctgtttttcctctacctagaatattacttttctcctcaactcctctttcaaatgcttagctcatactcattctttaggtcttttttatttttatttatttatttattttttgagacagagtttcactcttgtcacctaggctggagtgccatggcacagtctcagctcactgcaacctctgcctcctgggttcaagcaattctcctgcctcggcctcctgagtagctgagattacaggcatccaccaccatgtctggctaatttttgtatttttagtagagacagggtttcaccatgttggccaggctggtctcgagctcctgacctcaggtgatctgcccgcctcaggctcccaaagtgctgggattacagacatgagtcaccacacccagcctaggtctcatgttaattactacaactgaggcccaggaattacggcattttaagtataacatataatgcttccaaagtaccaagtatatggtgtgacatgaggcaggctgttaataaatgttagctatttatataatttaggttgttcatgggtaacaaagtaatttccagactgaattcatctttgaaatcaactgctttgcatttgcataattcatatccctgtttttctatactggaagctaaaaactgtgattttctaatttgcaatgtcatgtagagataagtgggagataacttattctgaatgatacagttgaattccagaccattgtaaacagctgtccattcttacttaaatgctgtaaattttgctttttatcatatatttatattctaaagctgttttacatcagagagatgatatgtcaaccttgaaacatcactgtctagtaacaacaaaaccccaaaataagacaaaactttttattttacttcaggttggtggagaagagtttcattagatctactgggtatatggactctgtaggaacactgattgtgaggctgaggatgtagccagtgctgtgttatgaatacagaggaaatgggctcctgcatagcatggatgataatcaacaattgataaagaacctcagctgtgttgagaacttgaaataaactgacttgtgttggaagggaagccactgaatgcaaggctatctactgctagggagaaaaattacggcaaagtaatcattgtttagccagaggctaaaatttctgcaaaagctctgagataaaaattttgaataataaaggcatttaaatttaaacctcactagcacttcttcttaatcatacacagacctaataattctcataaaaacagaaaagttcagctcttcaccataccatggcaggtgggagacacagaagggggaaaagaatcataacacagggaagggaccagagacaccccacggtcattcctctaagaacatctcaggatgctgagaaattatcttatctttgtgaccatagacaagggcatcatttgaccaatgaccaaaatcatatctgtttctagatctcctcttgaccaaattaattgtactgtgattactgaaattaaaattcatatagatctatttttctgcttttgattgcagtgaagaacaataagcagcactaaattctgtctccgctttcctgctggaaaggaggaacctggcctgctaaaccccagctgagggcttaagccatgggcccaggagtggcagggaactgtcccttcagctccagaataatgagtcatggttgatgcaaataacccagaggagcattcctccagagatcaagacagagaggtaaagttgaagggtaagctaaaaccacaggcagtgtaccccaagcgaaaaaaagcttcagaagaaaaaaaagaggctgagacacaaaaggggggaatgaatcatggcacagcaaagggaccagagatactgcctagtcattcctctaagaatacctcaggaccctgagatttgatcttatctttgtgaccttatctttgtgaccattgaccttgtcacacatggtcacaaggataagataaagctgctcccacagcaggtgggaggccacaagcatttttgcatagaccacccacagctttggccatgaagggaagtagctcttaagggtactaggcctgctccaagatttactggataaaaacaggagcaagagaacagattggatggatggatggatggatggatggatggatagacagatagacagacagacagacagataacaaagggagagatgatagacatagatagttagatatagacagatgacaaagaaagatgacagatatatacagaaatacagataggtaggtagatagttgacagacacagatgacagatgattgacagataggtggatgataggtatatgacaaagaaagagagatatgatagacatagaaagataggtagacagatagatgatagatgacagacacaaaaatagatgacagacacagaaaaatagatgacagactatgtagatgactgacaatagaaagatggatgacagaaaaaagatgatagacataaatagagagatgatagatggttggtaggtaggtaggtagatagacacgtgcgcgcgcacacacacacacacacacacacacacacatacaacagagacaaaacagacatacaggtataaagcttctgagtttctgcattggaagggattttaagatgcctacctgataccaaagtaagaatcatttctctgctatccccaaccaataacgtactaactctgaggtcttcttccttctttctttattcttctccaagagaatattttcatggtcacaaagatcatccagtttgacactttttaagaggtgaacatagatatagagaagacagcaacttaatcaagctgtggcatttttcctgagcctctgttgactcagaggctttagtctttccagtaaattcctatgcatatgaatttttaaaaaatcatctcatgcttgcatgttcttggaaaaatctaagtccattgggtgattgttcaacaccattaagatgtcagcaaatcagtgggcaaagtttatgaagagacatttacaaaaagaagaaggaaatctcactaacaagcataatataattataacttctggagagtatgctggtgacaggggaaacagattgcagttgggactgtaacttggtggaactcgtctcaaggcaatttgagaacgttatcaacaacagcaaatacgtttatttccattgacccgggaagctcagcagtagtattatatcatgaggaaatactgataatatagagcaaagtattatgcacattttccacagggctatgactagaagcaaaaaaaatatatagttatataaactatggcatagtgtcacgaaacaataaaattttatagcatttagaagtgtttgttttattctaaatttaaaataacagaatacagaaatatatatatgcaatataatgtagacatttttaactagagaaaactgctaaaagaaaattcagtgaaagattaaacgtgagtatgggggatgcaattacatttttgtttctctgtgtgcaaacttttggcaattttgttttctttaacaagcatgtttctgtttttttttcaaatcgtaacatattagttttaaagaaaaactaggcttattatactcatttttttagatttctgtttcatcaaggggttactgtaatatcaactccttgtcttttctcctccaaggcaaaataattcttgcttattaaacctttcttcacaagtcttacctcccagctccttaattatatttgcgatttttatctgaaaaggtcgttaggtctttctttaaaaattttccaaacaaaattctgacatactagagagcccactgaatcacttatttgttgggaaattcttagagatatttcagtttaactctgacaatttcgcaatggaaaagaaaaaggaggccgagaggaatgacgtgcgcttcacagttttagaaaaagccaactagcaccagggccagccttcttagtttactctctttcatctacataacctgttatcaagtccagctcatctccggcttaggttctttgtgtctttgatctgctgaccatgctgggtcttatagttcagtaacatgttaaacataaggatcaatgaaaatatgcatacattgacatcttggcatttcaccagttttcagtgaaacaaacgagcaacacttttccttcttttgttccagatgtccgcatgccctccttattcacatacaagtaaggtgcagaaatgaggttaagcagagtccaacaagtcactcatcaaaacatgctggtgattgtcctgaaatatgatctcagactcatggctgaacataggtgtgcattcatgtttcaaggttttactaaaaaggtgaaacgtaaggcaaaactatgagaagggagaaggtggacctttccgccatcttctgctcccagccagggttctcctgtagctggaaagcagtgcttctctcagcccctgtcgataggaatccctgcttctcaagtgttcctctaagcagaggagaaaattaactgttgggattcaaaggtgtcccttctaggacacattgcctccatgtaaatcaaaagcaaaatgagccaactatgtggcagctcattccacacaagtgggcaaactttggtgtaagattaatgaaaagaaatgaaaaagacgtagcaagccaaaatacccataatacaattgaagcactttgcaaatattcctctatgtttttgtaaaccgaaagttgtctgagacaggtctcaatcaatttaggaagtttattttgccaagtttaaggatgtactcgtgacagtgacacagcctcaggaggtcctgatgacatgtgtctgaggtggtcagggtacagcttgcttttatacattttagggagacatcagacatcaatcaatatgtagaagatgtacatcgttttaatcaggtaaggcgggacgacaagaggcagaggctttcaggacataggtagataagagacaaaagattgcattcttctgagtcctctatcagccttgcactgaatacacagtttagtctggctcagtgaatctgcatttatcacataaacagcagggcagagaaagcagccaggtatgcatttgtctcaggcgagcctcagagagatgactttgagttctgtctgtcctttgtccgtaaggaattttcttgtaggcaaattgtgaggaaggtatgcagctttttatctttgtagctatcttatttaggaatacaatctgaggcaggtttctgacacagttcccagcttgattttttcccttggcttagtgattttggggtcccaagatgtattttcctttcacattttataactgtaacttttcaacgctgttgctaaaagtatcctttattatggaatattttctttgtgagctgtgaaaagacaaagttaaggcaaaatgacaaagaagggttacaaatgaaaagatgccctgatgctgatggataaatgcaagctggaagacagctgggtgacaacttatgtcaggtaaaaagggacacattgatggtatcaaaaaacaaaagaagattaagaacaaatatccataaaagaagaaaaatacttgtgtggtacaaaggaaaaatcaccccatcagattaggcaaatctgattaagagtgaaacatatgaatataataaaaatataaatacagttgtatcacatgaaactgctgttttggtaggtcaagaatagttgaatattggtaatggtttagcccaaagaattcacttagaggaggcatagacttcctgttgcatgtgagaattgagttcctgcaaaccagtccttttattattgctctaaactttccaacttttaaaaaagaccctgaggcatcagtgttggcttctcagagccccaggtgagtaaagcagaacagctgacattgtaagcaggcgattcctgtctggtagggccactagctggtgactcctttgttcagtacggagatggattcagctccccagctgctcccttaatcttcaccacatcccccttccaggccctacctggaagagcgtaaggtccctggctgtagggaaagggcaggaagcagagcagaactgtttctgcgtcaagcgctcaggagctaggagctgggagctgggcgcactgacttgggatcccaactgcctgggtctaagccccagctgtgcttctccccagagtttcctcaacatcctgtttcctcgtttagaaatctaagccacagaatcccatcttagtgggtcaagtgacccccaattgagttagcacatgcaaggtgcttaaaataaacagtacctggcacaaaaagaaactcaataaatgttcacaattgtgattttaatcttttgtgtggatgagtgcagttgcagaaaggaaaagctgggtacacataaaaacagttttaaaaaatgcccagagtacagagttatttacgctaatgtgttcacacctatggagaaaagtttgtagaatgaaaaaaaaatattttaaagatcaaatagagcaaagcaaccacagcaaatacttgtatttctctagtttcatcttcagacgttccccagggacacaggcaatagctccctcccctgcattagaaagatgactgtcaaaattaatctgcagtattaggggtagtgctgacagtttcatctctgtaaatgttattactgcattaaaaaaaaaaaagaaacccacaaacctctgcccatctttgtagtccaggcacttggagagttcttacggggagaagcacttctccccatcgatagaaattcaatttgctgcacaagttaagatgcagtaaacttgtctctcccttgctttactgctgctttcacaatcataaaacgagcctaatgtttaaatgttagaaagcatttaatatttaatcgttggagattaagtctctttcatgacgcctgagctgcccagcaacaggttagaaattgattgtctgccgacccctaggggcacggcagcagctcagctttcaacatctgcccccagctttctaaggctcagaaacgccaaaggaaatgaaaagtttcctcttccaaagcagttgccagttcctaggggccagcacatggcagcatctggaaaggccaaggggagatggatgtgtgcacatgaaaatgggtgatgttctgggacccaaatatctggcaacaggagaacagcagagccagggcctcagagaagctctctccactgtggccagggggagcccttgtgtccccacattcatgtgacgctacactagaaacaccttttttctgcccactggacatacattcagtgtcaggtgacctagacccattcacagatatctgctggcacttcacaccatccacattttttttcttttgtgcctgtcaataagaacagagaacacaggcaaaagaaagaaaggaataattgcttgctgtcacctattcagcctctaatagagccaattctgaaagaaaagaattcagtgctacttcccagcaggatgctgacaccatgaatgacatcatacagccagacctcaggcaaccagggagcccgcatgaaagacgagtgatgccaaggaagaacacccatggtgccacctgacagtcatgtcctgcaaagtggcagggggagaggaagcctgggagggcctgggttcaaatccctgctgggcccctctcccacagcctaatgttgggcaagaagaacctctctcaactcagtgtccttgttataacaacaggcttaggatgccttgatcccagggtggctgagttaaaactgtaggaaaaatcatttaggaaaaaccctataaatgtttgttaaaactggatctgaaatgagttaatcatcagaccccagataaaatcagttatttgtgtgtgatatggtttggctgcgtccccacccaaatcttatcttgaattcccacctgttgtgggagggacccagtaggaggtaattgaatcatgggggcaggtctttcccatgctgttctcgtgatagcaaataagtctcatgagatctgttgcttttaaaaaggggagtttccctgaacgagttctcttctcttgtctgccaccatgtgagacgtgccttttaccttctgcttgtgaggcctccccagccatgtggaactgtaagtccaataaacctctttcttttgtaaatttcccagtcttgggtatgtctttaccagcagcatgaaaatggactaataaagtgtgttatttggaacttcagtgttaaataaattctgtcatcatcaaatcccttcgtgggctgaagtttcttgaccttggcactactgacatttggggcaggataattctttgttggagggctgtcatgtgcattgtggggtgtttagcagtatcgctggcctctactcacaagatgccagcagcatccctccatacgccccaggttatgacaaccaaaattgtacccacatattgacaatttccttggggcaggaggaaaatcgccccaggcaggagccactgctatgtataatggaatgctaagaggaataactacaggaactattctttgctgcctatctgctgcatattaaacatagtgagataatagtagaattagaaagtgtccttttcctgatggttagtgataaccgttccataaagcaaatagcaaaaccaccccttgttcccatatctaaagtcagatctcagcctgctccagggacacaaacacaaagtgtgactgggaggacaaggcttatacttgaaaatcattgcaagattttgcttatttatatcagcaaaaaaccaagaaacatgcatgaggatctaatgatgttcgactaaggagcaggaaatgtaacactgagttggtcttaacattttaatcatggtgcattgctgagagattccagatttaatacgttattttatgcagatggaagtggctctaacacgtgactggttggctggctggctggctgaaattggaactcaatggtgaactgtttttaatgaggctgagatgccagaacttccctggaatactgtagaagatgaacccaaaggcttaggaaaatagaaatattggactacaacatacatgcacatatgcacacatacacacaaatacacacacatcactacattcacagagagctcccacagactcttcccgaggcatggagaagtgaggagacccccgcatcctgaagaggtctgtgccagctgctctctgtaggctggttatggtgacggatggggtcctagaatagcagaggccacatggcagcccttaactagaagagagggtgagcatatttaccatggggacagcaaggtttccaggaatgttttaatccgcaggaacctttggtggatgctaattgctcggagcatgccttggaagtaaataggcgggcagcttcctaaattgttcctggatctatatatcaaggatgaatttgcctctgctggtcagaatggagcgatggcccctcgccctgtttccaggctcaggacctgcaccttcctgtgggcctggctcctcccaaccttctcaccccagacttcttgcctcctgctttgttctgctttcctccattgcacacacacgtctccactggaaacaccttcttcatttctttaacaaatgccttctacacaggaaccgtcttggctttgggatacaaatgtgaacaaaacaaaaacccctgcctcgtggagcgacagcatgttttgctgattattgcagcatctgggatgtcatctgtcttgtttgttgctatgggcccagcactagaaaagcacctggtatatagtaggttcacattagataggcactgaatggatgcctgcactgtctgctcgccattgagtaagacagtctgtgtctctttcatggtctctctttactcaaatatctgtgagtcccagcattgcttcctcagttggatcacatcacagagcaagcttcagctatggtgagcatctctgtcaagtccatggatgaaatgcagagacaacccccccagggcaggagtctccaaaccaggatgatgatcagaatcactttgggaagctttgaaaaagcacagatccctgggtatagaccccagaatttctgactttccaggtctgggatggggtctgagtatctgtaaaagtgcccaggaatcttttggtgctctgctgtggtgcgccccgtctctgcacctctagtccatcctcacccttctccaggcatatctgtgggcccctggtttttttcccagaagccgagtctgagaaagatcaagagtatgtgggaaagaggagaatgaaggagcgaatagaatacgcctcttaaaatgtagacacccaatctgaacatctgcccctcatgccagccaagacagctcctgagccatattttttcatccctgatatgcgaagaaaaagctacaaagcaggttgcctgttatgcatacatgatgtgaaatgacacctcaaggtacagctttctgttcttcagcagctgaggttatcactgacatttgcctctgattctcatatccacagttatgaagatggaataaaccaggggttctgagagctttaaatgctggacagtacttctgctccgaaagcacaactctcctctgcatcaactcctagcaagcccaataaaatggattcttggatatacattttttaggaagagagtaagatgcaatgttctattaggaaaggaagctcagttccttaaggtcatcttcaacgctggaaatgattcacatttggaacactgacctcccgtgctttttctgaggtgtgtttcaacaccaacagcaggctaaaccaaacatctgaaatgcagtgagagctggatggttagaaggctctggtttcagacctggactaactggacactgaaatctgggctggagtacttattccagaagccgatggaaaaacatcacgttttaaaagtcaaatccttgactcaggatcataacatcatcagcatcgagcaggtctctgttatcaccacagtgatgaagcctgagctgcgcagccgctagggtaaagagggctctgtgctcagctctgtgaagacaaggaggcagattctcaagagcttagagctttgcacagctgcagagtgggcagggatgaatgcaggagagggagtgggaaagcagcacagacacggtaaaaggaaaaataatttaggctgatggaactctcaggtttccgacactcaaactgccatgtgaaaagcaagtggtaagaattcatatatgatatcagcaataaaataacatcctgttgtacaacaaaatacactgaaagacaacctttagtcttttataacgacaagcagatctcataagtaaatgaaaagctagtccattactctttttattccttaaaacaaaataaaaaaagaaaagctttcagtgacatgatgaaattactatcacaacactcttgacaatctccaaatagggaaggtgtgtttctacgctgaaacaggagaaattgtgcttgaggaatccaataagtacaaagtgactcaaagctctatcacagctgtcaataaagaatgaacagacaaaattcttcacaggcttaacatgagaggcattgagcgttttgcaaggctgaacaacagacgggtagtttttgcatgtgcagtgctgtcagaagttgtaaaagtaaacacacgtctttttttttttaaggtagtccattacaggtaattacatatttaaagtatagtcatttttcctgccttccatatttaactattcttatctcagtcattttaatacagaatacttaatgtaatcgatttttatatttctaggggaaaggaaacttctagcccctttgcaggccaaacccaatttggcttaccattctagactttcgtcctcccagaaggattctgaatccaactctttaggaaaatgactttgaatgggttgtgattacaagcaaatgagatgaaaagagtcaacgttttggactcttgctctccttgctaccttgtatttcagctgcataaagttccctggtgagattttgccacctatgtcattgattacatcaatgtgagctgcaggaagggtgagctaaactgaggactgtctgcacaagtgagatattcctcactcttcttcaatttaccacgaaaacagggtagctctgagcctcaaaaaagtgtagctcagacttctgggattcacattaactcatccaaccatcgagtttacatctcctgttcaatctctttcagagttctttatctgaatgaatggcaccaatattcatcttgttttttatccttcccatctttctcctctaccatccatttttagttattcatatcttattatcttttggtggtgactataaagattagggcatgcactcttcttgactatttaaactctaacatgaattaagatttttaccactatcttaatgttacattaactccatttattcccttatgttttttgaattgttgtcatgcattttaattctatatattcctatatattttagatcccaaggctttatcattttgtacagtcaatgttcatttatatttatcacttatgttgctcttcatttcttactgtatttctgtgtttctgataggattacttttattttccctgaagaactccattagaatatttttagtgaaggtgtgctagtaacaaactctttcagtttttatctaaaaatgttatctattcacattcactttatttttcattttattttatttatttatttatttatttattttttttttttttttttttttttttttttttttttgagatggagtctcacactttcacccagctggagtgcagtggcacaatctcagctcactgcaaactctgcctcccggtttcacgccattctcctgcctcagctcacatttacttttaaaagacatattcacaaagcacataaatctaggttggtctttcagcactttaaagcttttattctactgtgatctaacttccatcatattcatttagaagtcagctgtctgtcttatatttctaccttgagagcatgtgtcctatttttctctctggatgctttcaagggttatctctttgtcatttgtttttgcaagcttactttgaatttatccatattgagaatcacagtgcttcttgaatatggtgctgaatgtctttaatctgtcatttttctcttgaaatattacatattccctttcatcttctccttctaggaaaaaattatacatttattggtgcctttcgccatatttcacatgtttctttacttacatacattcagcattccactttttgccttgctgtagttcagcctggatattttctactttcttagtttgtttacaaattctctattctgatgtactgaatttgctattaaactcatatcatgagttgtaatataatttattaaattttttagttttagagattccatttaactctgttttataaatttcagttcctaaggacattctccactctgttattctattttcttgaccaaaacatgatgggaaatgcaatctctctgggatccttagcatccctttctgttcttgctggtggtgccaacaataaaaggctgtggccagtctacctgggccattttccaagactgtgtttgtagtcagtaattttgaggaataatgtaatgtctccctccagaacagagagcaagctttcttagtgtttgctataaaagcatgggattctctaaacttgatgttctccagctgtgatgcaaacccactgcatgtgtagcattcatctgagctatatagcattgcccctgtggaatttggaggccaggaggcaatgtgaatatgcttacatccatcatgtgctcgctgagccataagtaatacagttctttctttgacctagaagtctcatgttctcttccagcatttgtaaagcagtaacagattaacttatctgtaagtaaggtgaggtcaaattcccgaccaggaaaccaagcacaattattttaatgtatgtgtgtaaaaaccttcatcacttgtagatctgtgtctgtctctactgtcctttgttttttcttagtcctgttttttggtgtgtctcataattttttattgaaagtcagacattatctattaaaaaatagtaaagcccctggagcatgttatcttcctccagggaaggttcaacctatattctggtaggaagtctttctttctctcttttttttttttttttttttttgagagacagtctcactctgttgcccaggctggagtgcagtggcacaatctcagctcactgcaacctccacctcccaggtttaagcaattctcctgcctcagcctccagagtagctggaactacaagtgcccaccaccacggccggctaatttcttttgtattttagtagagaaggggttccaccatgttgtccaggctggtctcaaactcctgagctcaggcaatctgcccgcctcagcctcccaaagagctgggattacaggcatgagccactgtgcccagcacagtctgtcttttgaagcagctcaatccacccagctactaagctgatttgtggcaaagttgcagtttttacaagtttctatctctggcttatctctactcctagagtctagttttccatgggtcctaattggaagcctgaaacctttactgtttactagggcctctcctgcttggtaagtcttgacctctaattattgggtcataactgccttgcgatggccaaaatctcttctgtacttttgatagctttctactcagcttcttagtctcttgcccatacaatctaacaattggacaaatagcttgaggaagaaaaccatgaatttgggcttatttccatatgccatgctcatttataagaatctagcatctctgttctgcccatcttggacacttcaaattacaaatttttgctatccaaccccaggctaaaagttcagctggcttctctgccttttatgcaggactcttttcctgtcttttttaacctctcacttactgtaaattctctgagggaagaagtagctcacagaatgttggctcacctctctataattcttttccctctggattatttgtgattgaagtttttgttgcttcagcagttcttccatgtctttaatctgacttttaaataaatatttactctgtcttttctcattttgtggaaaagtctttggtcttccacaacccaaagtaccatttctgacatgcccttatcctttataaccagtacttcctaaatgtttctcacatcattccacttttctccatctcctccaccattaccatttcacttcttacctacagtatagaatatcttgcaactaatctatcttcagccacgattttcacttttaatctgttctctataagcaactatagtgatattacaacaaaaaagtattagtttcatatttctgtatagcaaggtgccacacatttaaccgtttaaaaccaaacaagtttactatttcacagtttccatccatccagagatgaagggtaaaccacgaaaaatataaagcattttcaggctatagacttaataaagaatggtagcctcaaaattcctctgtttctgaagtgaggagatggctgggtaccagaatatgaccccagtagcacaggaatccaagcacagtttagttaagttctctgttcagagtatcactggtcttcaacatagttgcaagctgggctacattctcaactgaaggcttcactgtggaagaatccttttccaaactcattcaggctttgcagatagacaaaaagctagagccttttgttggctgtctgctagaagctgccctcatattctagaggtttcactcagttccttgccatgtgaacttcctcaacatgcctgccctcttcatcaagctagcaaggataatttcttgctctagtatattaagacagaatcctacataatgtagtattatcattgggaatgacatctcatcatctttgcgtattctactggtgagaaggaagtcacaggttctacccacactcaaggaaagggaagtatgaaggatataaaccaggagggctgagatcatggagacaatcttagaattctgccatttttctattatattagcctcttcccagattaaaacccttccatggcttcccattgctaataggaaaaaaattttaatgacttataaattcctgaatgatctaaaccctaactctctatcttcatctcatgctatgccctcccttattacttgtattccagtcacatttttcagttctttatatttgccctattctttcttaccacagggccttctacattaattcttacctaggtcatgcctgttcattctttaagtttcaatttaagcgtgatttcctatgtaagtcttccctgacatatttaaacaggataaacctcattatatagcctcaaatacatcttgtttgtaatttcatatagtgcattcacttatttacgtgattatttggtttcagcacatctcccctcctagactataagctccataaaatcagatgctttctctgagtttggctccattgtatcctaattagctatgaactctatattctgcttggaagctttcagcatttttttaggccttttgtaatagatgaacttttctacaaaaaaagtaagctaatcaaagagctttctaaatcatctgattctataaaccagagccaggatgaaagagagtctgagaatgaccgtggcccttgccaggtgaattttcccaaagctgaggtctgaccatgatatttacatgatcaatgtcttcaatagtgtcaattgtcatcaaaaattttttacactccttattggacataaaaggccctctgtgacctggaccaaactaatgtttccaaacctatttcctattacatcctgctatggactgaatatttgtgtccctccaaaattcctacattgaagccctaatgcccaatgtgatggtatttggaggtggaatctttgagtggtaattaggtttaggtgatgtcatgggagtggagccctcatgatgggtttagtgcccttataagaagaggaagaaagagatctttctctccctccaccccacatgcaccaaggaaaggccatgtgagcacacagtgagaaggtggctgtcagcaagctggaagcagatcttcgtgggtattattggtatatttgcctgacagattaacatgtgttattaaatttaaaaactagtctgttctgctttatctcccccgtagaatctagatatgttgcatgcagtaaacatttaatgatatttgctggataaatttgttgcaagtgaaagtagtttctgggcaagctccagattcaaggcagaaaaaaaaatgttagtgctcttcagggataaggcagtcattcaatgtgtcttagttgtcaagtgtgaaaaagattcaaggtgccaagtatggtgcattaattcaaatgaaattgggccccaagtacttcagaaatatgacagacaagctagatatcatatcaggaaagcaaagaataaaggaaggagaataaaggctgaagccgtaatacaatgagtctatttgcaaattgagcctaaattaaggaccaagtaagagatgaagtgagaaaatgtttgcaaagtgtccgccaaatgcaatggattattagagtaattctttttaatttggtttactggtggacataacgattattgataatgtagtcaagaatatcttgtgaaataaagatgcacattctagggtaacagtccaaaacagaaacaaaaataacaccaaccaaacaaaaataagagaggcaatgtcaaatgccaaataaaatgtaaaggaataaatgaaaacatattattcatatattagcatgagcttgaaggtaatgtttcactctgagaccaattactacaaggaaggagatagaaaactggggcaataaactattttttaatagtagaaaaaggtgtgtaacacaaatataattagatgagatttatataaaccaagaaagctatttccgatgaagggctagaaaacaaagaaggtctttgaatgaagaaatggatacttcaacaaagaagtaacaagcagtatgcaaaagtttacaaagtcctgaaactttaagcaccactgactaattactgcatattgtttccacccatagggactatgtctttctgagcaagagaaaagtttttggagggcgacgacaatgtttcatccattctggtctcctcatagtctgggacaatgttctacacactggacaatgtgtccagtgagccccaggtcatgttgtctgtgtctcccggacacgctatttctatgcatttgtcttagaacacacttctcctctcttttggaataagttaaaacagacagaacagagaccatttgaaataacattcctacatctttccatcagtgcatgcacatctcctattaaaaatattcaacactcaccttctctgaatgtactttactcttatgagaactgcatttaggtgaaaatatctgctcatgtctaaaccaatccccaaacacacacacattgcacacacacacacaaactaagacaaacaaacaaaaatgaactctacttgtaaaacctgaaatttcttgaaggctcagaagttcaaaataacaatatttcaatatgtgcccctaagttgaccaattgaaaacaaaaccaagcccacacttttctaactcactaaccctttttatgcttccaacttatttcaattgtctccttacactttcttttgaaatctgcttttctttcaggtgtaaccatgggcagcctcaaagttgcagtctcaggccatctgccttagctgttcaatgtctcagttacctcattaactcccatgatctcattacgaactgtgaaaatgattcccaaagctacagcccagctctgacagctcaccctctagcaagtcccatataggcagacacttacaggaaaacttcatagatgaccctaaaactcacaaaaccttacacgctgaaatccaagttgatcttcctctcaacaaccttctcaaattgtccattgttacaaacagccttatcatattcatatcatattcaggttttgaccataagaaaatgtttgtacttcttctcttttgtcctatgcctgatcttacataacatggtaaaggggtctattttagatccttttttaaaaaagttctttgggtttcccccttttgatttttataaaattataccctcaatacctaacttctagatccctgaaacaatacacaaattggtttccttggccctgggttctctagctctagaccatctgtcttaagtcagtttcactaaatgcagaacctgagataggatttcttgttcatgtgatcaattgagggagtgctcttagaagaagagagtgaaggcagcaggatgcagctagagcaaaatactaacaaaaatatactctcaccagggactggcttgagccaatgtcacatggaagctttggagcatcaacgacaagccagctggagttggtgccaccttgagacaaagtgaccagtcatttgtaagcctttgacggtcggtatgcctgatggttgagttgtttcgcctcctagaaggttccattagccaagggcaactctccagagacaggacagctgtgggccatagccacactaagagtagctggggcctgggtgcaccagtagtggaggtcatctgggcagggcaccaactacttccccaacaccagtggttctcaaagtgtggtccccggaccagtgaagtagcatcatccagaaacttgtcagacacgcaaattcctgggctctacctcagacttactgaatcagaaactctggagtgggactggatcccaacaatttgtgtttgaacactccctccaggtgattctgatgcacactaaggcttgagaaacatggcactacaccatccaacacagaactcatgaatacttcttaagtcccaaattagtattcactgatcaagaacctgaagtaactcttatcactgcttctgtcagcaataaattccgcaggtttacaataaatgccttccatcaaattagatgccttctattcctccaaagacccatctcagcaacgcttctttctttgtaactcttcatcatcatggaatcacaggatattggaagagaacttgaaggttaattaatctagctccctcctttttgcaaatgaaacaatggaggcatccaaattgtaagcatcttaaccaagattatgcaatgggaactcgggtctccttatgtcaagtttaatgcttgttgttatacattatgccgattttactccaaattaagggtatgaagtttcaggtttgacacgatgaataagctctggtcatctattgtacagcagaatgactacagttaataataatgtattacatacatgaaaatcactaagagagtagattttaaatgttctcaccacaaaaaaaataatgtggaagatgataccatgttaattagcttaatttaatcattttccaatgtctacatatatgaaaacagcacatggtacactgtaaatttatacaatttttatttgtcaattatatatatatgttaataaagttggggagatatttttaaaattaaaataaatttaagaaaagaaaattcattacaacatagtcacagctaggtcagctctacctctttaaattggtgtttgtgtttttgcctgcaactaatatacctgcttaaccgttttttaagtctgtttccattacttccttcaggaaaccgtccatgacaggcatggtttatgatgttcctatttgtcaggtatctaccatccccttgacacttccatgagaagaatacgtttccttgccaatcaatgttggtcttggaaggcgagaccagaggaatgtgaggagctgggaggaaccctgagtgcacatggggcaaaagcacagcatttggctgggacccaaccctccttctctccattgtgaaaacaagtcccagatggagatgttcctgggatccgaactgaaaagacacatggatcagaattaaacctgaccccagcttagagtcaagcaagtctaacccagtggggccacccctggtccacagacccaggttgagatatgaatatttaaccaccattctgtatcatttgttaaacagcactgccacaacaacacatgttcacacacacagttcaaatgctggagaccaagcatgtttccatgcattggaaatacatgaactcacttaattaacaaccctatgaagtaggcgctattattaagtcaattttacaaatgaataccctaaagcaagagaagtgatgtaatctgcccaatgctgcatggctgtgatacaactagaccacccagctctgaaggtcatgctgtcctccactctgcaggtgacatttcaggcatctggacacttctgtgttcccccctcctctgggttcccagacttccataggaattcctgtagctttgcccttatctcatcatgttgaggtacaaaggttcacttgatgtatctcacctcctaggtggagaggctaaatactacctggtccacttaaagagcctgtaacaaggagttcagtaaacactggttaattgacaaactatgaagactcaaactcagctctcaggaccaagggctagtgctgatgctgtggtctcccaggcaagctcccatcttcctctatacctttcatgcatctgggggcagcacagctccatccctgtcttgactagctctcctagaccaaacactcacccagatatcacagctccccatgatctatcctcagcatatcttttccatctcctctttcatttatctcacagttcgtgctaagtcccactcaagcactccactgtctctcactcctatctgacatgaaagtccctcaactatgcatggtctattccaccctaaccacaggtgcaaacctttcccaccctcaaagcgcagcccaaacacctatcccctgggcgccccagctgaacatcctcttccctcctctgggctttaatagcacatctctgtggctttggtgtctgtgtctctaggcctatgacattgcttgtctacaaactctctatgtgtgtgcttatttctgttacttccacaagcctcttaaagctagggtccatgtcaaatccatctacattatcccaaagcacagaacacatgactttcaatttatggcaagcattcaataactatttccataatcaaaaagtgatggtaaaactggcttgcttttgtgaggtattattcactgttagcttgttctaaagggagctgggtgatggcatgcagcagaatccatcacggagggtacatcacccaccagctttccatctgcagatgttgcccattgtagagcagcatgctgcctgttcaggcactgttgccaaacagaaggttctcttggcagaagaactggcacatgctgggctctgcaggctgtgcccccgaaccagctcttccacattggcaaatgggcatccttgaaattgccctgccccatcccccacaggcctcctaccacccaaacagatgggcacacgtgtaagtatgccggggagcaagtgtgtacatcaggttggagctcctgataaaagatttgtctctcatacatggtatcaaccccgtccaaagagcaaaagcacaccactgtgaaatgggaggtgttgcaaaggaattgccttcatattctaattttgggatccattaattaaagagtcccagacctggagtgggagggggagaatgagaaagagctgaaagagaacattctgtttccctttaaagttttggctggtggcatcagtggacctggaaatgaatgttgtctcttttcaggtggagttcagatttaaggcatttttcaggagcagctaaatccacgacctgagatttctattgctgcctgcaagacagctggataaaggcagttctctcagggactagtatgcctccacacacaggtaagagtaaaagtttaataaattatctataaaccatgtttatagagagaatgatacactcaacatccaaacttattgataacctagttgcagtaatgtcagaatcgagttgaaaacctttattgactcaggttgtcttcattgtctgaaggcgcatgttggctagacaacaaagacagtggtgggagcagccaacatggcctttggtgtacattacaaatttaaaagcctaaaattgacaaagaaataataccacctataactctagagcactttaattctggtcttttttgagacactaaagacaaataagaactgcattgatccacttgatctacagatctcacaagtaatttcttctgctgggatttgtttttttttttttttcttttactttccaaactctaaaatatccatgactcatttggaacacaagaagtgcagcatgaacatcccagttggtcatctgcagaatatgccaaacagcacaggatgcggggaagccacataatggagaacagatcatcgtctggcaaagcaactgtccaatggccagcaggtggcccagttgctggaccaatatgctgcccagtactggaaggtgctcagtctcagaaatgggttataaatacccatacagggctgtgacatgtggaagctaagagccttaaagacttcaagctttgctggtcacactaggggcgtcaagtgcttctctgtagatagaatctatccagtctgtttattgtctgccttttaaaagtcactcctcatttccagacagcttcagatagaggcttgactagggattaaatatccatcattaatatggctcagagacattgaaaaagaataagagagaagagaagaagagtttaaatacctcctgtagaagggctatctcactgtgacagctctggatgtttcatttattaaacaatggaaggtatagtatattatagatgtgcttaaaaaatcatttacaaaggagaattactttatttttaatgaagaatcaagccttatcctctaggaggctttacaaaaatggttttgaagaaattaacctctaattttatttatttaaatgcatgtatttctaaagcttcaaaattattgaggtccactagttgttttttttttcaaagttactttagctagttggatgacttaactgtagatcacaagagtgtccaaacttattttcactccccagaatttttttcattctctcctgtttctgtcaggaggtcactatgttcatttgcctggtagcaggatgaatggcaaactcctggcatgtacaagttgaggaagctgcaatttgctccccctttctcttgaaggtcactaaatttaatactgtgattgaaactcagtgcctcccacaaatctccagagaactgtgattcataaggaggaagataatttggaggtgggatatgttaacctgtgcacacgtgttaagcaattataaattgtttcctttcatctgtctcagatgtaatacatagcaagactctgaagtataaatcctctttaaaatgagacagtcgggcaatagcccatgaggatacgtgggttcattcacaacactgatacccctgtacaacatcagatggtgacaaatgagactgattttcagcttggcttgacttgaactggtagcttctatctttggcttccttcttgcaggaaaaaaaaaaatatatatatatatgtctcatttagcccattggcatcattcccagtcaatgaatgagcatgacacttctcccagtaaccatctcaaagttttctagctgagctagttagtatagaaaatgttttggcactggaaaacagatgatagaaatcattgtttcacttggtgcacgggagagcagtggggaggtaggatatgcaggacaaagtagttttgactttgcctctcccagtccatgtaacctttgatatcccagaattggaatccctggatacacatgaaacacattaatgcatcacaggcaagcccaaaaattagggcttagtccaggaaggtttttggcttttcccaggaaagaattcaaaggtgagccagtggtagaagaaaacaactttattgagatggcagtgttacagcttcgtgactgctcccgcagagcagggctaccctacaggctgtgtcaagagcagcagctcaggcacagctcacagttaaaagtgagctcatggttaaactcacttttaattacatgccaattaaggggtagattattcagaaatttttggaaaaggaatggtaactttcaggacattgccatggaaaggggcagtaacttccaggtgttgtcatggaaacaggtggtaacttccaggtgttgccgtggcaatggtaaactgtcatggtgctggtgggcatgtcttatggagaggtactttgggtgcctcttccctgattcagccagtctttaatctggtccagagtcaagtcccacctcctacctcaacatgactgtatccctgaatacacaagaaacccttggcgatatctaggtcttctaattggggatgacaaggggagcatatacaggaataaacctttgctggagaaccacgcagtggctcctgatggggtgggaatgggcataaaagagatatgaggcagagtgaccaatgacagaggatcacaacaagaaaaggcacatttgagagcaattataaggtcaatgatactgagaagtgctgcacttctaaatctacctcccaataacatattggtctaaattgaaagggttcttcctgtttttaatcatacatgattttaatttaactcacacagtctccctgtactagtttgctagagctgctgtggtaaaataccaaaactagatggcttaaacaacagtgacttattgtcacacagttctgtagacaagaagtctaagatccagctgtcagcagggttggttcctttgaagactgtgagggagaatctgcttcagcctctctagcttctaaaggtttgctcgctgggatctttggtgttgcttggcttgtagacacatcaccccaacctctggctttatgtacacatgtcattcttcctgtgtgtgtctctctgtgcataaattcctttttttttttttaagaaggacaccagtcatattggattagggcctcacctgctccattgtgacttcatattaactaattacatctacaacaacctaatttccaaataaggtcacattctgagcttctgggagttaagaccccaacatgtaaatctggagggatgcaattcaacacgtaatattccctaacacaatatttccataacagtctgtagcgtcttcttcaggctaagggattggggcctcatctatcagagttgtaataaggaacaaaggttgttgaaggtaagatgagactcaagattcaataatatgttcaaactgcagaatcaaagagtatattgaggccaaatatctaaaaaagaaagtttgatggattgctaaagtaagaggatcagaaggaagtattaaaactaagataaggatacagaaagttgcaatactggatttgacataaatgtacaaaaaacagggaaggttaaataaatcgtgatacaaccatcaaaattaaagatttggtaagtattttctcatcccatgaataaaggcccattgatctttttgttgaaggatattcagcccatattaaccagggttgaagatcctacataaaaagatttgagttgccattttctcaaataataccctcagacactgactcttcataatgggttctgctagtacaactctgaaagtcttagagagaagtttattcattccattcaaaggatacttgtttcgagagcccccagctaaatttgggttctagtaccagaacagctagcaaccctgccctaatgggacatgaagggtacctggacatgggtgtttacagtgtacctttcacgggatacttcttttacttggcagacttcctaattcttacttgactgacttgcaatcagggagtccctcacataggaaacttgtttacactggcagatgcccttatggctcttatctgacccatctccagtttagtcctgcctgaccattgctcaggcactgggagcctgactttctagtctccctggcaacagggaaaatccggccaggataacctctagttctttagatggaaggtgcaaattcaatacaccatcacaataggaaataagtttaaagagtttttacttataggtcctaggcaaaggagttgacaatgagtcaagagtgaagctctccatcctcagtcatgcaggcagaaatggagtcaggcagagagagacagagagagcgtgcacacatgagtgcatgctctcagcagcatatataaaagaacagcgtatcagtcacttcaagtaattgggcaaatgcctgaatgatccctttaaagaaagcagaaggaagtgcagagctcagtctgccagactggagagagatgcctccaagtttttatctttggccactggcttgagccatttgagtatagcatggaactaaaggctgtgtcaatggtgactgagccctgcttctgatatgagaaagtcaaacttgttttcaaaatagatgctgatgcaagataaaatcataagtatttaccacaatgccttcaggtattagggcctaaggtttggttttgctttttggtttttgttttttgcttttcaatcctggttaagaagtgctaaaagatattatagccctacattctgattggtatcaagggcaaattttccttcttttacaatgtgttttctagttttttttttattttgttacaatcagcataaaggaagaaaagattatgcctttgaataagaattgtatttacattttactttttaaaaagaaggcaataacttgcatttctaacaatggtttattagaaccaaaccttcagatagaagcaactaagaatgctagataaaatatttaaaacgtctccttataagaatttaagaactgacagatagccaaaataaaatctaaggaaagctgaaatccagaaagccaagcacaagaaacttactctactttgacctgcagttacttgcctaccccgagaaattcctgctttgattctgcaatctcccttggatagcacaagatgcagaggtcaatgcccaggctgtatcccaagtggagacactaataggaggctctccttatattaagcaaggggagaaaaaaaaaggacaatgaactcatggttatagtgctacacataaactcctctctcacatctttgcaggagaatacagaggaagttgttgggccctgtctggagtaggtattaaaggaaaagaaagagtgttcctaccaaattatagacattagctacagcattgcctgggagatacagggatccacagattacaaacttgtttatggtcacccaagaccagacatacagaaacttggcagtagcaaatgcatattctctctatagagaaaattgtctattgaccttcaaaatattaccacaataaaacccttagacaataaactgcacacaaataaccaagcacacaaggaaagaaatcaccatgagtaaaatcaagaagaaacagtagaataactgaatcatacccacaagattacagtatttcaaagagatatctgcactcccatgtttattgcagcactattcacgatggtcaagatatggaataaatctaagtatccatcaacacatgaatggataaagaatatatggtatatatacacaatggaatactattcagccataaaaaggataaaatcatgccatttggctcaatggggatagaactggtggccattatgtaaagtaaaataagcccagtacagaaagacaaacattgcatgttctcactgattcatatatattaatacagaataaagtaaagtagattctatggaagcatagagtagaattgtggtaaccaaaggttgggaagggaagtgagaaggaggagatgaagagaagttggttaaggggtacaaaaatacagttagatagaagaagtacgttttagtatttgacagtacggttggagaattaaagttaacaataatattgtatatttcaaaatgcctagaagaattgcaagacaaagaaaagttaaacgtttgaaagaaaagataaatgtttaaggtgatggatatctcaattaccctgatttgattattatacattgtatgcaggtatccaaagggcaatgtaacccaaaaatgtgaacaactggtatatatggagcatcaggaagagtagctaatggatgtggagcttaataccaaggcgatgggttgatttgtgcagcaaaccaccatggttcacgtttacctgtgtagcatacctgtacatcctgcacatatacccgagcttaaaagttgaaggaaaataaataaatttaatataaatatttattttgaattctttatcaggaagtttgtatatctccatgtcttttgggtcagctactagaagattattgtgttctttgggtaggagttatgtctcgttattggttttttgtgtttcttgttgacttacattgaggtctgaacatttgaaaaagtagaggcttgttccagtctgcagactggctttgtcttgggggagcccttcaccagtcagcctacccagagattctgggtataccacctggtatggttcatgagcaggcttgctgctaatgtcctccagcaggctggcctgtttcttgggtcagcaggtgagcagaccctggtgcctgggtctgcaggtgccaacctggtgactagggccatggggggtattctagggctggggtgggcatgaagtctggggctgtaggggccatcccagtgctgggggtggtctggagcctagggctgctggggctaccctggccctagggtgggcctagagtctgaatctgtgggggctgacctggccctagggtagatccaaagccactgaggcccagtctggatcctggggctgaggcaggcctgaagactgagtctgccaggccggactggagcctggggctgcaggatccagccttggactagggtagtcctataggttcagtccagagggaccggcctggagtcttaggttatggtgagcccagtgttgggttttactgtggcaggcccagtgttggcatccaaggcaaagtgcagtgcttacttttctctcctttccccaagtgaagggtatctctctccatgccgtgctgcctgaagttgggggcagtgatgcaggtaatataaagctgtccttctcaccctccccagtgctactcataacatcaggatgaagcttacaaacaacacattgagtaaaaggagtcagacataaaagaacacattgatatgattccctcaatgttaagttcaagagcaggataatctaaactacattgtttagtgatgctttttataagagataaaaatatctttaaaaagcaatgatataattaacaaaatgtcagaacaaagattagtctctgggaggacaatatagaaggaaattgggagtctgacgaggctctgtttcttagactgaatggttgttacaggggtgctttctttaaaagtgttccttaaacaacagcttgtatagattgtatgcacttccctgtctgtataatataattcaaaataaaacaagggaaataatttgcaaaagaaaatgtctcctggatgtcttggacttagaaaataaaagcaagaattagtaggtagcagacaagctgtaagcaattttgcacagttgggtatacaaagtggtattggctgatagttttcacattccactcacggagaggtagatgggtttaatagctgtgtttaaagtgtcagatgcaagaacaatgataggtttcccttaaacgattttcactaattccctcccagctcaagaacttttttcattaaaatggtcctttgctgcctatcagaaacaattaaatcctcacctcatagcagtctccatcttacgtcaaccactccctttggcccccaaaatatacctccaatattatctaacacgaactggaattgccacatggtcaaggcaataaagaaataaagccacgaaagaaaccaaatgaaagcaaaggtataaaatgatttagatgttagtctgcagaaagaaaaagctgaaggaattagaaacagccacaggaactttctgtgaaccaggagaggcacttccatttacaaaccacactttgtttttcatagagtgggcttgatcatcacttaagaactgaaaattcagcattccttctaaggtgcattttgttcaaattgatataagtgccccagatggtttggcttatggtatcccattgattattgcgttctgctcttgcaagtcatagatctgttgtaatctaactgtctggggagtggccattattctagtttcaaacccattctgtcctcagtcacacgcattcaagcaaagtaatgcagggggaccagataaaagccgcccattagaaacctcagttgctgcttgcctctcccacagaattgaatatattactccagctatcgtcaacaaacatgcttcaacaacaggatcctcactgtttggaagacagcccctgagacccagagcaaatgggtcaaagtctcagttacatcagtataactacaaagacaataattcttacctctctcacaggatccagtgaaaaagtaagtgaataaaaatagactgaaaacagcaatgtaaggagctaaaagtactgtgtgcattgttgtaaaatattaagtcaacagtccaatcatttattgccactgaaagtctaatatcttatctgacaggttgtaaactttcagagacataagcttgaagtgtgtatgtttgtgtgttttaagtgtgaactgaagcaggtggcaataaggggaagaaggaggggaaatgggaagaaaagtaacacgaagaagaaatgcataaagaagagaccatgatccagtgggcaaataactcagttgaatctttgaagaaacaggtgtcaatgcttgttatcatggtgaaggtcaagtaacatttttctagacatttatctttactgctctctgctaggaatgacaccagcgcatcacaatactgccctcctagcctctcagcctgtgctgcctcccaccatggaggcacaccactgccattctccatttaccttccctcatctccctccccagctcaggctccttgcctcacagctcatctctccagactctgagtacatttcaaactgtctatggcaccaaataataagacaaaacaaaataggaaataacaagctaaagaatcaggtctaggaaggaagctccctttcagtcagaaccctctagtttcttgtgttacttcaggtcggctgtggatttgatgtgtaaaaggatgtgtggggaaagagagcagaaattaggaaaagccttcagcctgggatgtaggtctgatactgcggaaggagagagggatagaatattggagagcaagagtctcaaactgcaggaaaaaatggcttggccagacctatgggcagtccttaaggcaaagttacccactggagagctccatgtcatgtctcagtacccatctgtgctcagccactggatggctgcagcctgcagaaaggttggtcgcagtgaaaatgtgggagcagttaaaaagggacacaggtggggccatttgtgcttcctgcagcaagacgatctaagcagcagcccctcaagaaatatgttcctttacctattggtcacctgaaagtaagggccttttttttttgctcactccatagcatagaagttgcaaactgactgtaatggacaatctgggaagatgaggtttttttttttttttgctattgcatttgggtattgaatagtgttttaaaaacttttgagctagtgaccaatatttaaaacaaatagattttacatttttaaaattcacacttccagcttttcttgaaatgaaatgcaaagggacaacattctttcacgctggtggaaaaacagccttcccccttagtggacattcactctgcagctggccgtatttcccaccattcctttatgcctacaccagcccacgcacggatcactttactgactgttctccatgatcatttaaggctttaagtctcctgcattcatgcctgtgtcaccattagaacataatatcactgacggcaattattttgtctgtttggatcattgacaggcaattaattgcctgcaacagtacaagttacatattagctgcccaataaatatttgttcaataaaatagggtgctatcaacatagagtgttggaagaaattgagtggatggtggtggagaaaaggcacttgtttcagagtcttgtctatggttagctttgcactacccacacacaaccaaactggcacctaagggagaaggtgagactccagacacagcagtagagggtgcttgttctaaggaatatgtagaatcaaggtggtacagaatgggtgtgtatacagcagcaaaaagtctccccttgcatgtcctgtaccctctcgcaggacttctttactctcctttcaaatttaggatgagggagtgggtttgtacagagaagcagtgcttatctcagctcctgccctagccccagctcagcctgaagcattgctacaaaatactcactgggtcacattccagggcagccaggcatgaggggtcctcaccccagagctaacgcacacttaagcataatggaacgaattgagttcaatgatgatgcgatgggtgatcctcaaatggcataaaaatgcacatggacaaatattgcaaatcaaaccgagaactgctgccagaggccagtcccccgtggtgtctcaccagctctgaaaatgattaccagatgataaagcagagcaggctccctgcaatctgattacgaggagggactggcaaatccattaggagcaaacaggcctccttcaagtccattttacttgctaaaatcaagcaacgttaagtttaaaaaaaaaaatgagccaatttttcatcccattctcattgcctcatagtcagtgcattcgttttcagttaaaagagctgggaaggtttgcgctttgagagcaaaccttcctgctattaaaaatcaaagtcagacgtaagcctggcatgaagcagagagctagtacctttagtttgtgggcaacctgttctgacagcctaacctgcagaaaagcagccgtggaggaagggaagcaactctgaccttctgtgcatcagaccgcacagagccctctgcttgtgtcctgtcacataattccctattccctggataaggagatttataaagaatccactaagttagaacaggaagggattttagcacttgtgtaatctacctttctcttagtcttatttcgttttatgattattattattattttgagacagggtctggctctgtcacccagactggaatgcagtggcgtgatctcagctcactacaacctctcccccatctcttgccccctgggctcaagccatcctcccagctcagcctcccaagtagctgggaccacagacatgcaccaccacacgtacttaatttttctgtttttagtagagagagtttcttgccatgttgcccaggctggtcttgaattactgagctcaagcaatccacccgcctcagcctcccaaactgctgggattccaggcatgagccactgcgcccagccttagatttattttaaaaccacatcatcttttaataagcataaaaaatgttcatgtcctcgaaagatcttgacatggctggctccagctctaccccacctctagcttgagagtctttttcttgtacacttccagtagccaacaggtttcagagctttgtattccatagagtacatgatggaaacaatgaaccattttccctgaaatatgaaaatataatatcatattaaatatgctttgaaactaaacacttccctctaccaccatcaccacctatcaagattctgatacaggcttcgctgacttggtttggccctctcatgttatacagaaagcggctgagacccaaagatttttttttttttttttttttgagatggagtctcgctctatcgcccagactggagtgcagtagcgtgatgatctcggctcactgcaaagctctgcctcctgggttcacgccattctcctgcctcagcctaccgagtagctgggacgtgggctcccaccaacacgtctaattttttgtatttttagtagagatggggtttcactgtgttagccaggatggtctcgatctcctgacctcgtgatctgcccccttggcctcccatagtgtttggattacgggcgtgagccaccgcacctagccaggcccaaagattattactgacctgaggctgcagacttgcttttcttcctaatgctggaacctaaccccgtgttccctgactcacattagattgctctctcagtgctcagggctttatactccaaacccagggcttcatacatgactgcccaagaacaagaggaaattgtgaaaagtgtctttgaagaggatcatataaacagtaatcttttgtattggcatcatttggatagtggtgttgggacccaagggtgaacacacccctccccttcaaaagttctggtcaataaagaacactcagaggacagtgctccttgggacagttacccaagtaaagttcaggtctgtactcaactaatggctaagcaattctccaataaccaccagaggatagggctctcgggtgaaagctagattagaaaatatgacctagagcttagaccaaacatgatttttaaattctgaacactactcctgctatgcccataactgaatacaagtaggccaacaaaacaaaagaatggctacttcttctggggttgggaagagggagccctgtcctgctctgctttcctcaatggagcagaagctaagtgcatatttcttcttgaacacacacctgagaagcagtcaagaggccctgctgtgcctgagtgtggtctacctatgcgtaagaggtggaggaaagagatggaacatgttcatgccaactttcccacccgataggaagaggtaactttagcagaagtttcccatctcttcttagaaggtaaagtagcctggccgggtgcagtggctcatgcctgtaatcccagcactttgggaggctgagacaggcgggtctcttgaggtcagaagtttgagaccagactggccaacacggtgaaacaccatctctctcaaaactacaaaaaaaaaattagctgggcatggtggcatgcacctgtagtcccagctacccaggaggctgatgcaggagaatcactggaaccggggagatggaggttgcagtgagccaagatcgcgccacttcactccagcctgggtgacaagagctagactccactcaaaaaaaaaaaaaagaaggtgaagtagcctatcaccataggctacttcatatgatgatagagtgctctatcatcatccagttcccatacacaaaaaattaaacccattaatggaatggtaaaaagtacattctttattgaaccagaaactgaggaattccagagattggaagtgacagggtacagctagagaaggagacttcagcctgtggcatgcaggaagaccctctggaaagggagacagaggccacaaactgccccataaccaagcgagggcactagcttaaggctgtgatcacaaggccaccagcaagtggtggtgactcagcaagctggatggttgacctcctcatatcttctttcttccttgggtcagggagcattacaggaataaacacgtccatacgggtggatgaaataaaagcaggagttggaccagagataagtgattatggaggctgtcagaggatcactctggctgctgagtggagaacagtttatatgaggtgtggagggggagcaaggaagccagtgggtgtggctgcagtctttcaggagatggagctaatggtgtcctggatgagggtatgaatgaaggaatggagagaaggacacaaattctagtgatatccaggatgtaaaatcaacaagacaaagtcatgggtcaagtatgattttgtatcccactatgcctatggattcacaatacaatgaccttagtacacttccactctatttactcatcccttataatttttgctcttcttctcatgtttgtagtgataatgtatgttaaacatctcaatgcattatttttgatgtttttatagtcactattcatttcatttccattttctgttggtcttcctttcagcattctgtgtttttacctgggatcactttcctctgaactgaagaactccctttgctgttttctttaacacaaatgggctcctgaaaagttctcttagttttgacttttctgaaagtatttcttttatttccactttgcttttgaagaatgttttgctaattaaagtaaaattctaggttcacagttattttcttatatcactttaacgagattattcaattgtgttttgactctcattgtttcccatcacaagtcagttgtcactcttcctgtttcctttcaaagtcatctgccttttcaacacttctggctcctttcaggatctccttttgtgtttggtgttcaaaaatgacagtgatatgctaaagcatggttttctttgtatttatcctgctgaggctcataggccatgattttgagtcttaatgtcctcccaaaatcttgaaaaatacttgcctatgattatgtttctgttcattttctttctcctctctttctggaactacaattatacctgaaattcaatcttttcattatgacccatatatctcttacttactcttctatacattgagactttttatctctctgtgttttttaatatctctctggacatattctacagactttcttccagtttactaattctctctactaccctaccatgatgcccattgattgaaatctcaatttcatttatttttatttttccattataggatttccattggaatttttatggtttctggttctctgctgaaatccttcatcttgtaattgtatttcttgaacatcttaattgcgagtatttaatatccatgtacaataactccaatttctaattgtctatgggtctgtttttactatctgtatttctcttgtttttggacaaaccttatttttttgtacacctgttttattttcaaacacaacattgtcaaatgttgtataaaaaatgtagagacaatttaagactttgaataaggttatcactctccagagagaaactaatttttcctctggcaaatcactttttttccgtctgggactgagctgattagaagttgtttttcagtctttctgaggaatggcatgtttccagttcacccttactcataggatataggccttaagcataacaaccaaaaacctgcagtaatcacaggacttctccttagaaggtcattcactacaatttttgtccctctatccttgtgagactacaaagaactttgcttataatcttaacttctcagatgtcatttttgttttctgattttgcacttgccttctaggcaaaagcagctccaaatgccagacacctctctttgtttccctcttttttctgtatcttagccccagaaatgctcattgcctgagcagctctttgaagccttcaaatatgtgtctatacctgtgtgtatgtatgttctatattttctcattattcttcctgaatccaaaaccacgtggtcagccaaaaacagaaaggggcaaaagatgatgcatgggtttgtttctgacttgcttaatagattttataataatgacattcaccattacagggaattccagaaaaggactgactgctgacaagattggttcttggctggcatctgggaacttacatttcaggagggtttctgctgttaactgataagcaccattcaccgagccaaaagtatctgtgaaaagaattggtttttgttgaactcctgctttcctgctgggaatctgaaattgcatacatgccagacacagaggggatatatattagtccactctcatgctgctaataaagacatatcccagaccaggtaatttataaaggaaagaggtttaattgactcacagttcggcatggctggggaggcctcacaatcatggtggaaggcaaagaaagagcaaaggaatgtcttaaatggtggcaggaaagagtgtatgcaagggatctgctctttataaaaccatcagatctcatgagacttattcactgtcacaagaacagcatgggagaacctgcccccatgattcaattacttcccactaagtcccttccatgacacattggggaatgtgggagctgaaattcaagatgagatttgggtggggacacagccaaaccatatgattctgttcctggcccctcccaaatcttatgccctcacatttcgaaaccaatcatgccttcccagcagtcctccaaagtcttaactcatttcaacattaactcaaaagtccgcagtccaaagtctcatctaagacaagtcaagtcccttccaactatgagcctgtaaaatcaaaaacaagttatttacttcctacatacaatggggatacaagcattgggtaaatatgcccatgctaaatgggagaaattggcaaaaacaaaggagctacaggccccatgcaagtgtgaaatccagcagggcagtcaaatctcaaagctccaaaatgatctcctttgactccatgtctcacatccaggtcattctgatgcaagaagtgggctccaaggccttggggagctccactcctgtggcttaatagggtatagaccccctactggctgctttcacaggctggcattgtttgcagcttttccaggtgcatggtgcaagctgttggtggatctaccattctggggtttggaagatggaggtctcttctcacagctccactaggcagtgctccagtggggactctgtgtaggggctctaaccccacatttcccttccacactgctctagcagagattctccatgagggccctgcccctgaagcaaacttctgcctggacatccagacatttccatacatcctctgaaatctaggttccgaatcctcaattcttgacttctgtgcactctcaaattcaacaccacgtggaagctgttaaggcttgggtctggaactctctgaagccacagcctgagctgtaccttggccccttttagccacagctggagtggctaggatgcaaagtaccaagttcctaggttgcacacagcaggggggccctgggcctggcccaggaagccatttttccctcctagtcctcagagcctgtgatgggagggacttccatgaaggtctctgacatgctttggagacattttccccattttcttggtgactaacatttggctcctcattatttatgcaaatttttgcaggtggcttgaatttctccccagaaaatggggttttcttttctattgcatcattaggctgcaaaatttccaaacctttatgctctgcttcctcttcaagctttgccacttagaattttcctctgctgcataccctaaattatctctctcaggttcgaagtttcacagatctctagggcaggggcaaaatgccaccagtctctttgcctagctatagtgaccttttctccagttcccaggaagttcttcatctccatttgagaccacctcagcctggactttattgtccatatcactatctgcattttggtcaaagccattcaataagtctctaggaagttcaaaactttcccacatcttcctgttttctgagccctccaagtctctaggaagttccaaactttcccacattttcctatcttcttctgagccctccaaactgttccaacctctgcctgttacccagttccaaagtcacttccacaattttgggtatctttacagcagcgttcaactctctgcagtatcaatttactgtattagtccattctcatgctgctaataaagacatacccaagactgggtaatttataaaggaaagagatttaattgactcaaagtttagcatggctggggaggcctcacaatcatggcaaaaggcgaaggaagagcaaaggcatggtggcaggcaagagagtatgtgcagtgaactgccctttataaaacaaaaccatcagatctcatgaaacttattcactttcatgagaacagcacaggaaaaccaattcccatgattcaattacctcccaccaggtcattcccacgacatgtggagattatgagagctacaattcaagatgagattagggtggagacatagccaaactatatcagagtacctatgtgatcagcccccaataaaaatcctgagcagcaaggctctaataagcttcaataattgatgtttcagatgtattatcataattcattgctgaggtaattaagtgcatcctgtgtgactccactgggactagattgttgaaagtttgcacctggtttccccatgactttgccctatgtgccttttctctttgctaattgtggttggtatcctttttctgtaataaatcatagccatgagtatgactatatgctgaatcttgtgagtttttctagtgaatcatcaaacctgagcgtgatctttgggatttctcaagatagaacaactagagtggagaaaataataaatttagacttggacatattaagtactctttatattacttgaccttttatttatttgttgttttaccatgtacttctttagttctcaatctttcaacagcattagcatggttgaccacccatccttctggaaacatgactaagcctttttataacagagctatcacctggtttacttcttacctctcttcctctgactcccttgcaagtgcatgactttagattcttgggctgtcttctattctcactctgttctctctatattggtactttcatccacattcacagcttccaacacctcctacgtacaaaggattcacacatttacagctttggccttggtctcccttttaggctccataactgcatctcaacagcctatttatcttccagataggccagagtaacctcagattcttggtcatgccggcattcttataaaatatcaaaacaagtgctttgtttcagagcaccttctctttcctcacacttttcttctaccctcccatgaaaaggtatacatcctttgtctctgtagtcttagctgtcacatggtatgtctcctccctgtctatatcctttgatttaataggttcatccaataagactttattgaacatctactatgtacattaggctagacactggggatacaaagatggttaaaacatggacccactcttcaaagacttataggcaaataaataatggcaaacatagaaataaagtaccataaagtattataaatgtgattgcagagcagtatcaggacataatacgagcccccaaaagggtaagtagtccaatcccccagaaaatggaggaggagatgctggaactgcattttgaaagccaagtaggtgttctccatatggataggatgaatgagaggatcaaatgcacactgcagggagggacacatcatagtcactatgatgatggaaatccacaagagaaaatgtcatgaaagcaaactaaactaacttaaaatgcaaggtagtaattttctcaaaatagcatttatttgaaaacataagtaccagaagaatataagagatttaaaaaaagaactagcattttctacagttttgttacataatgcagggtttgaatcacctaggctctggatcagcctgtctctgttagatctcatgagaccagctggtgttgcccttcctgtcaataacagcaaaagacaagaaccaaggtcagtctccagggcacaatcaggagaatgtgagcaaaagggattatcagaggaaatcttaaaaaggagagaattggattaagaaagccaatgaaagatccaagttgaaagggcaggatcacctccccagacaattctagatgattacaggcaagatagactaccagtttgactatgtcctttccaagcttggcgagaaaacagttgtcatttcagaggctggctgcattcatataagcatcatattttcctgtagccaatgccataattactattcacaggaagatttggatgatgaatgacttcctggtaccacccaaatcatgccacagtgtccactctgtctgatccaattgtcatccctggacacagacgtaaagccctcagccctggctcgccagagcaatcacagagtttctccttgtcctccccaactgcacacactcggatgggggaagcctgttcaccaagagcaacagtatctacaggaggaattttaccccagatttttctctcttcatgcataaaaaggtgccatctgaaattatctcatctgtccaaaatggtgcccagacaaggggagaacagtccattgatagctgtcattcagttcaataactgtcaagcctttttttatgaataaggggctgcactagttgccattgagcattttaatatatacaagaaatgccctgtccaaatcagaatacaccctgggaaatggacaattcaacccaagtgtcataatttacctattgctagcaaacacaatgatcaaagggtacaactctgatatggacatatgcccagggcagaaaaagaaaatcaacagaaacaaattgattgcaaataatcttgattcattgctaatttcaaaagtgtagattttattacataataaagttatatatgggcataaatattctattatatagttttatctctagatcaaaaaagtaactttatttatgtatacatatttttgctcccaggcttataaacttttgcttttatggtatggtggtcttaaaaattaaagcaaaatattatctgcaatgtttcccaaaagtttccgtgtgattcagagagctcaacaatgatgcaacagcaggcatatagacatagcaatgcaattcacacccagctatttaactttttattttctagactgttatgattggctggattggaggatgaattctccagagcagttcacaccaacaaagagagaatcatatctgtagccacagcttctaatttttataattattttccccttttaaaaaaacccctttgcttaagccagtgcaaaaaaagtaattcaaaaatcaaactatttattataatcactgtccacccatcactctgggtagccagaatgagtgcgctggaaatagatatttaattagatatttccaaacagccctcacaccttttactttccactgcccttacaataactctgggatttttaaaatctaaaattggaatatgatacatgaatgtaagtaaatatagatatgcccagaaattaaattgcacctgtgaatttatcctacccttgggctactaaccaaagattctttaggtagattaatagtttaactctagcacatgaagaaatgatattttaattaagtttggggaaataatatatgcaggcaaaagataataaccatactctgtcaggtataactacattgacttgaagaaacagtgcatgtaatcctaaaattcgccagtgccctgtaatcattaatttttccattaattacattaatcattaatctgtcagacatgctctggcctaataataattgcaatcatttttttgaggatttagggtgcattagaaatggttctgagaacttcacaggcagacatcaccactcaggtaatcttcacaacaacctggtgagggagagctattttgattttccttttacatatgaggaaacaaagaattaaagaggctaaataacatgtcctgagtttaaacctaaccagtggaggtcctggtgtctgcatgggtgcttgctgctgagacccaggcccccacgctgcactaggctggcgctgtccactgacgtcctcccctggcttctctcggtaggatattctccctctctacgacgggccctggggaccccagactgacagtgctaaaaggctccctgtagagttcatggaaccccaagcatctggtctgatttctcctggccccacacaggggtgccccatatgaggagagcagaagaaaccactggaagaccaggcctttttttttttttttaacctcttctcgtattgcacagaatatttcaaatatttgaaatgtcaccaaaattcccatatcaacctaattcacaacagcaactgtgataaaaccaaagtatcttacatcctgagtgggagattaggaatagaaggaggagaaataaaaaagggaggggacgctgggctcggtggctcacacctgtaatcctagcactttgggaggccgaggcaggtggattgtctgagcttaggaattcaagaccagcctgggcaacatggtgaaaccccgtctctactaaaatacaaaagaaattagccggtagtggtggcctgcacttgtagtcccggctactcaggaagctgaggcaggagaattgcttgaaccctggaggcggaggttgcagtgagcggagattgagccattgcattccagcctgggcaacagagtgagactctgtctcggggaaaaaaaaaaaaaggaggggagggaagaggacggggaaaaaaagaaaagaaaaggggagggtaggggagggggagacagaaagaaaagagagagagagagagaggaagaaaaagagagagaggaaggaagaaaggaaggaagggagggagggaggaagagaaagaaagaaagacaaagtactacatggagtgagttggagtttattttaggacatcaaatatatctttacaaattgaaaaaattattgcaaaagcaaaatatacaacataaaattttataatgcattttctctacatgcaatattttaaactatatcctttatttttcctggcttggtggcagaaatttgccaacaacttttctttggaagaactgctctcgcttgagattatttctgtgctactttggttttcaaaactcctttattttataaaattatagaaatagtaggtggtgctagttttattgtttgctttcaatgtcctatatggcaaaggaagatgttagcaatcaggaaaaactgttggtatggttgtcttttgaaaaatgtgtagatcctaaaagtctagaaattcctgcattattcttcagggattccttagcatcttccccctccagccaagactcagggatcctatttcattttctgggtaagagtggaatcccaaagttttactaagagctcactctgctatctccttcaggtggcaagacattgctgccacagggcttttatatttaattatttttattcctgatccatagttttagtatgactcatgttaggtgtgaatccccgcgctacaggtctttcttgatacagaggtgaaagtcccagacttggagccccaagtcctgggtagagatgccacctccactctgtctgagcaataactccatctctttcaacccatctttttccttttctcagtcaagaagaaagatctttgtagaccacatggtgacctcccctttgcctcaatcccatcaacttctggtctttaagccaaaccaattgattttaaacttcccccaaaagtaatgcagatggacatcatccctcagacctgggtttatgggcattcttataataagggtccttctgaaacctcttcttgtgtgcttagggagcccccataaaagagatatggctcttctctgattctgtgaagtctcaacagggattgaaattaaataaaatctactgtgtgcaacagggtactgacagacttcatggaagagagaggaattctcaaaattaggaggcagctaggcatcatttccctcctccatttgattgcaaactcaaatgactttgggaaccaggcagggaaaatcaatgagggagcgggcaggagccaacaggggagtggtcgggaatgtggtggggaactggaaagggtatgtcctacctacagacattcatattcaaatatttttacaactcagcaccagccaagtcaaataaggctgccagctgaattcagctcctgtgcttccatcttgcaacttcaggtttagactagaaaaagaaagagtcttggagtcttgtctggggagacagacatttatgagcttggtccaacctgtgccatatgaaaggaacagcatgcagacactcacagcagtgaaacagccatgcggatctgtgttcccacaggttcatcacacagtacgaaatcccacagcctccccgacaaacctgttttgggtttggtcagggagaagggagatctggtgcactactggccagcattgaccattctgctgaaatccccatggagttaccacaactcaatggctcagatgtgtggctgcgctcgaatgggaggagggatgtgtgggaaagtgggttatgaggattccccaaaagtgagcagcatctccctccgagtaggttagaagcaggaggttacagtgattggcataaactggacaaatacagtgagtcctgtggggagacaccttggtgagtcccggaaaaagtgctcatgaacttctttggaaagggtttaatctcttaggtgctttctcaatgacctctggagactgtcctatttaatacctaagatcaacctcttcatttctgcattgtaactcccactttgccccatgtcttcagagaagacatctacatacccaactatggtagagactggaaacttaggccaggccttgccccacctccagagtggtgtcctctcctagcatctgcagcccaggagggacaggagaagtctggtagcccctgaagagcagaaacagctccagaaggatgagggcctggaactcacgagcccagctacatgtttcaggaagctgacccctgacaacaaatggaggaggaaaggacgacaaaccaaaaaaaaaaaaaaagtttgaaaggtttaaatatgtagcaatgtcccaaaagggcaaccaacacggtggctgcattcagaggacacgtgaggcatggcttagagtagaacccaaagacgattcctgagcttgcttctttatagtgtcattaaaataggaattccaggtctttctgcctcctttccccctagttatgactgttgaaggccacaattgttctcttgcgaatttggctagaaaactcatccttcacagaagccacatgaaacattttgtctaatcctaaagcaaaatctgtcatacccgagaagcacagtctttctcccattctgtttgtaatgaacattgcctttgctggtggggtttttaaaaaatattattattaaataaaaccttgccaaatgtattttgcagaagtatcttttatggaaaacagatggaaagagctaacctaaaaatgcaaatcgtaacattataatgacttcttaattttaaaaattatgaatacgacttcccaggagggactaaaagagacagtgacaacagctgcagaagaaacatcaggagtgggaggggactgcaaggccaaaaaggttgtctagttgcagagattacaaagaacattccttgtctttaaatgcagtgtgctgagcactcacgtgttcgattccaaagtgtttattcaggtaaacgaaaggaatgaagaaaccaccaatactcaagatgcaggttgctccccaaagtgtctacacatgccacaaggaatataaagttctagaaaaacacacttaatgtgtttcctccccactttcttcatggatcatcagacaggaatatgaaaccacagtttgcaaatgcttctgattcgtgtatgattactcaggtgttaaactcctcctgaaatgggcatttaacacagaggttccttatattttcacaactggcctctcttgaaacccactcttcaagaagattgaatgtttatgcattttcttattttttagaaagtggatgggttttctccccaaaccatgttttccactcttgaataacccaccgtcttcttccttccatctttctccttcttcctttccagaaaaagaagagattttagaaaactctttctatatggaaaggaaggagaaatattttcaagattttctagcagcaaattttaatattgcccctgtgaatgaaattcaatacacatacaaattatgcctctttctccccttcaattctttatactttttgaatagcaagtcaccaaaggtactcaaatacacacatgcagtctcccaattaatacatttagaagtaaatccaagaagcaatctgtcatcaattgtagtaacatactgtctccaatatgctgctctgggcttcctggcccatgccatatcagagtattaagtgctgtctctgggtaaatggttgactcacacgtgttctgagcggctctcatctcaacagagccgagagaaattaaacagctggaagcattttcaaatttctgtctgcgaactgcttaatgtatcagaactcaacatggatttcccactgagacagaagtgtaaaagttgttctttcttcttcctcttcttttttttgaaggcatctcctttcctttcacaaacagaatatcaagcttttcaagttctcaccataggttagagaaaagaaaaggagtcttaaaatcagtgatcacctcctactggagaaattgatcaaaatctcactggggaagaaagtagtggaggaagacagaaatggggttgtagctactatttctctctcctagaattaaacataatccactaggactggctccactgaaagcattttgactgctatgtgtggagaccatgagtcatttgggggctctcaatgaattcatgggttcagaaaacaaacacagtcacctcaacataatataatactattcagcagagaataaaatgcaatataaaatggttcatcttgaacaccatccagggtgttttgttgttgaagtaccaagaagtccctcaatatttctctgccttagtggagtaccgtatttccttttagattctcctccccacacttagcacccccgcccaggactgtgtcatagagtatagttccaggaggattcatcctgatcatctgattgctttccctcactagagccttgggctagttaccagattcagcattcacgagcattcaaacagaattggacatccagcaaatagaatctgacagcatttggaagtgaaccacgaacgcttgtatctaagcagcagctgtctgattacttagatgatatgattcttctaaaagttctctgtctttagtttggggttgtttttacttaggccatatggtcacttcatttttcttggtttgcagctataacaattacagtgagctccaaacgtagtaatcatgtatggggagagacaaggaggtcagctgggcttcctccaaatgcagtttgagagaagctttcagaatctagaggcatccatcaacatctttcatacacaagaataaaattgtacaaaactgtgtggatgttgtaggaactgtgtcaactaagctgagctaaaagcacatttcccagaattcccttccctgtgtggtcctgagtgagtgctggccacaagggatgttttgtatgaggtttggagtgcagacataaagaagcaactctatctccttccaccctgaaggccagtgagtgcagggtgccaggcactacagagttcacgcctaccatcactaacttccagcctcccagaaggtgtaatggagtgctcaaacctgcagctccttcagtttccacagcagggctgggactatggtgaggcaggtgaggaacttgccttggggcatgacaattaaagaggcacttagtagtcaaggcaaatattttaatgcaatgttctttaaaaatcaaagttaatgcagaaatacacatggtgaacaaactatcaacatatttaatacacaggaacagttacagttctgggatgaaccatattggagctagaagcaagaggaaaaattaataacactaatctcacaggtctgtgatctccttcttcagtttctctgatccctgggtgtcaggaacacatgcatttccatgatcaagggcacctgcctctcctgcaggttgcccacatggaggtggtgagggacatctgcaagctccagtttgccctcttgggatccagttcttctcgtggatcccagtttgtccatacttctccggacatctagctgtcctttccaactatcattctggtagacctatagcaacctcatgctcagccctcgacgcaagacaacaatcagcataggcagctccagcagcacccacatttgcaaggcctaattttaatttttataataacccccatactttatacacttgttgtggttctacttctctgacccataaagatgcctgacccatagagatgtgatgattatatgcaaactagaatataccaatgaggcatcaaacacaaattttgtgagaggtacgatcaaattgtatggtgaaatgtctacagctttcccccagcctgtttgaaccatcattttaccattgtcaagatgttgccttgtgttcctttgctaaatgactagaggctgggttggcagtggggtcaattgtttataattgataagagaacagataaccaggctatccttatgtttctgtgaggacagagatgttcccctgcagggtttgcttgattttcctttatcagcaataaagacaaggttacaagcccctgaagaagccatagagtatgcttaacatactcgagttctacaaacccaaaccccattgaaggaattttaaacactattgtgtttaaaagcaccagttgctaagttcagtcatacataaactatacgtaaagaggaaaaatatttacctctttaaggaccctggtaaaagtcctaggttatagattagtctctgagtaatcttctattgttatgctgagctctggagctggctaaactggagagtgaggctctcacacagtctctggggaagacacctgcttcctaaggaattttggctcagtttggatgaactatggtacatcagaaggagaaagaatttgttcctgaggcttcctaggagaatagctgggccatagagatgaaaacctaagtacagttaaacctaagattaacaactgcactgttcaaggaaccattctctgtcgtagatctagaccatggtttctcaatatcaacactattgacactgttgtgaaataattcttagttatagaggggctgtccttcacatttctgaatgctcagcagcatccctatcctctatcatgtagatgacaagagcaccaccagttgtgacaaccaaaaatgtctccaggcatttccaaatgactcctggacagcaaaagtgtccccagtgagaatagccatgtagacaacaacagacgctgggatactaattactaaaggcaaaagcagggacaaatcaatgtcagatattgggagatcagagttagataagaatgaatcttggtagacaaagtaaggcagaattgtagacaagaagaagcccaaaaccaagtcaataaccagagatgccatataccagataaaagtcatgtcagccatccctcctcactgggtggggcctcgctgcaggaatttcagcaactccagccaggggtttagggacagaactctgatgtccctgggactgagcccctggggaggaggaggagccacagtctccgtggatcagcagacttagtctttcccactgctggctctgagggatccaggcagtctggacaaataggattcccccagtgcagcataatccttccaccaaggggcagccagagtgccccaaagtggggcaacttcagcagtctcaggatacaaaatcaatgtgcaaaagtcacaagcattcctatatacaagcagtagacaaacagagagccaaatcatgaatgaactcccattcacaattaatacaaagagaataaaatacctaggaacacagggaatacagctaacaagggaagcgaaggacctcttcaagaactacaaaccaccactcaagaaagtcagagagaacacaaacaaatggaaaaacattccatgctcatgaacagaaagaatcaatatcatgaaaatggccatagtgcccaagtaatttatagattcaatgctattcccattaaacaaccattgacattcctcacagaattagaaaaaaactacttaaaagttaataaggaatgaaaaaaggcccatatagccaagacaatcctaagcaaagagaacaaagctggaagtatcatgtgacccaacttcaaactatattacaaggctacagtaaccaaaacagtatggtactggtacaaaaatagacacatagaccaatggaacagaatagagatctcataaataagaccacacatctacaatcaccttatcttcaacaaacctgacaaaaacaagcaatgaagaaaggatttcctatttaataaatgatgctgggagaactggctagccatatgcagaaaattgaaactgggccccttccttataacttacacaaaaattaactcaagatggattaaagacttaaatgtaaaacccaaaactataaaaaccttagaagaaaatctgggcaataccattcaggacataggcataggcaaagattttgtgacaaaaacatcaaaagcaattgcaacaaaagtgaaaattgacaaacagaatctaattaaactaaagagcttctgcacagcaaaagaaactattatcagagtgaacagacaacctacagaatgggagaaaatttttgcaatctatccatctgataaaggtctaatgtccagaatgtacaagatgcttaaatttacaagaaaaagacaaccccattaaaaagtggccaaaggacatgaacagacacttctcaaaagaagacatttatgtggccatcaaacatatgaaaaaaagctcaacatcagtgatcattagagaaatgcaaatcaaaaccacaatgagatagtatctcgtgccagtcagatgattattaaaaagtcaagaaatggctgggcgcagtggctcatggctgtaatcccagcattttgggaggccaaggcggggatcacttgaggccagtaattcaagaccagctaggccaacatggtgaaaccccatctctaataaaaatacaaaaattagctggacatggtggcaggtgcctgtaatcccagctacttggaaacctgaggcacgagaattgcttgaactccagaggtggaggttgcagtgagccgagatcatgccactgcactccagcctaggtgacagagcaaaactcttgtctcaaaaaatataaataaattaattaataaataaatagtcaagaaacaacagatgctagtgaggctgtggagaaataggaacgcttttacactgttggtgagattgtaaattagtttaaccattgtggaagatggtgttgttattcctcaaagacctggaaccagaaatatcacttgactcaggaatcccattactaggtatatacccaaaggaatataggaatataaaccattctatttaattattattctcaaaggaataaaggaatataaatcattctattaaaaagacacatgcatgcatatgttcattgcagcactattcacaatagtgaagacattggatcatcccaaacacccatcaatgatagactagataaagaaagtatggtacatatataccacgaaatactaggtagccataaaaaggaacaagatcatgtgctttgcagggacatggatggagctggaagccattatcctcagcaaagtaatgcaggaacagaaaaccaaacaccacatgttctcacttataagtgggagctgaacaatgagaacgtgtgggcacaaggaggggaatgacacacactggggcctgtccggggtacagggggagggagagcatcaggaagaatagctaatgcatcctgggcttaatacctaggtgatgggttgataagtgtggcaaaacaccatggcacacatttacctgtgtaacaaagctgcacatcctgcatatgtatcctggaacataaaatttaaaaaaataaataaataaaaataaaagtcaggttagaagtcgaagggaagtcaggctcaaatgaggggaaaacaagatgaccaacctggagaacctggaagcatacatggatttcgtacacatcaagaatttggtaacagttattggagagtttgagcacctgaggaatatatcactaatatttaaaggtaagacaaagattctcagtctttccagataaaattgattttatcagttagctattgatatgtaacaagcttcaccgagaattcagtggcttaagcagtgagcttttttatttttcctgagtctatgggtctgctgggagatcttctggttctggttgggctcacacatgcatctacgatcagctgtgggtccagtggccagctctgaggctctgagccaggctttctcaagtactttgggtaaatatcacagaatacaaatttacaatactatcctagtccattttcggctgcaaaacagaataccgcaaagtgggtaatttataatgaatagaactttgtttggctcacagttctggaggctaggcagtccagaggcacagcacctgcatctgttcagccatcttgtgaggaccttcctgttgcatcttcccttagtggaaaggagaaaacagaaggacaagtaaacatgggagacagtgagaaaatcgggctgaacccattcttttatcaagaaactactcctgtgataactaacacactcccaggataacatcattaatcccttcatgacagtggagtcctcattgcctaaacatcccttaaagtccccccttcttagggccaggcgtggtggctcatgcctgtaatcccagcactttgggaggcggaggtgggtggatcatgaggtcaggagatcgagaccatcctggctaacacaagaaaccctgtctctactaaaaacacaaaaaattagctgggtgtggtggtgggcgcctgtaatcccagctactcgggaggctgagggaggagaatggcatgaacccaggaggcagaggttgcagtgagtggagatcgtgccactgtactccagcctgggcaacagagtgagactctgacttaaaaaaaaaaaaaaaaaaaaagtccccacctcttaatactttacaatcacaattaaatttcaacatgagttttggaggagacaatcaaaccacagcagataccttttgatcttaactgctacattataaaacacaagttactattatttattactaaagtagcaatctatgggaagtataatggttagattctgtctgtattgtcaccccaaccattattatgctgtcagaatagccagcaacagcagtcactcttggcaacactaatttattcctctcagttaataactcttatttaaatgttagcttcaaaataactttgacctttttctaggaactagctgtttgtccaaaaataatcatctctttttatatacttccttttgcctaaattgtactttttgttgtcacataaactcctgtgattcaaaatgttcttactttctaaattgacattcactctcagtcttaaattaatatttcagcaaatgtaacaatagaacaaagcactagcatttactgagtgtctactatgtaccaggcactgtcttaggtgctatacataaactaactctttcaatctgcacagtaaccattttctgtagacaaagaaactagggtacccaaaggataagtgactcgcccaaggtcactcagccaatacatgagctgggattcaaaccccagtagtctgacctagaacccatgtttctaatcaatacactattgcctctgtaatgttgaataaattatagcaatacaatttttattttttaataattattatgaagttatgatttctttattaatggaaagttaaatataagtacagccatgtggttaaaaaatagaagatttgtgatcacttagaaattcaaagactgctgacttggctaatcagagagaatattaattcctttcatttgccttatacagctatcactgtaggcaaaatacaaattatttagtgtaatggaatccaatctctagctataataaaccataactttgtttctgcaacattgctctaattgactctgatcaaacatttttcagttatgtggtgttgttaagcttggaagttttaacaaattgaactaaaaatgatataagtcaggggggaaaaagaagctaaagtatgagaagctacagtttttatcaatagttccataccagcatctaattaagatgcaaaattatcctttaaaagaatgagttaatcaattaaaaattaatgtgggaggtgaacaacggccactgagtcagaaagttgggtgtggggagaatacatggcagcaaattaacttttgagagaaggaaagtgtttgtgtgataaatgcatataaaaatataaaacatatataaaaaaacaaaactcgcacagtgatcatttgaaaactcatttgcaaataaatgagaaaaaatatttgggggaagaaacttcaataaaattattagcaccatcaaagaaatggtttttcatagagaaaggatattaagaaaactgagggtggtgcatatactgttacaagcttcaaatatgatttttttatataattctttttttttttttttggagacggagtcttgctctgccacccaggctggagtgcagtggcacgatcttggctcactgcaacctccacctcccaggttcaagcaattctcctgccttaacctcccaagtagctgggactacaggtgcatgctgccaagcccagctaattttttgtattttagtagagacggggtttcaccgtgttgcccaggctggtctggaacttctgagctcaggcaattcaccggcctcagcctcccaaagtgctgggattacaggtgtgagccactgcgcccagcattttttttttttttttttttttgagacgagtctcactctgtcgcccaggctgaagtgtagtggtgcaatcgtggctcactgcaaactccacctctggggtccaagcaatcctgcctcagcccccctagtagctaggattacagttgcccaccaccatgcccagataatttttttgtatttttagtagagacggggttttgccacattgaccaggctggtctccaactcctgacctcagatgatccgcccacctcggcctctcaaagtgctgggattacagatgtgagccaccgttcccagtctatttttatataattgttaaaacaagcttctattacagtttaacacctatatgaagacataaatactatctatacatttcaatgcgtaatcagaaagtggtgggaggagagtgaggatcaaaaaactgtctattgggtactatgcttattaccttggggataaataatctgtacaccaaacccccaagacatgcaattaacctacataaccaacctgcacatgtatccctgaacctgaaataaaagttaaaaataataataaactggaacatctacgtaaccatcaccaaaggtaatggcgatggcccttaacaccacagcacagcttgaccaccgccactggaatgttctcatccttgtcttttggtacaacatatacccatttcttttgggaatggaattgctggagcataaaaaataatatgtgtagtcacttacatggagactaccaaagtgttttccaaagcaattgtacccatttatactctatccacagaatctgagtctctgttgcccttattcagatgtcattttgattttaactaaatgacaacttgatcacaccacatagtaataatcatatgcagttattaattatattgatctttgacatcatctattcaccaactggtatgaaagtatttcatattataacaacctatacaaccatattagtgcaaagttgctgaatataagccttgtcttccactataatgatgtcaaatgactttcaaatatatctcacattttagctcaacaaattccaagctatccttcccagtttcatcagcactctcagcactctcatcaagcagaaatgcaaatctttcttcctgcttcccctgctatcttcacaccttagtcccttcactatctgcctgttgagtttttctttgacattcaacacacgaggctcctccaccacctatgtatcacacatggtgacccaattctcctgaaccacactctatcacctgtcactcacttattcattggctccaacaatagccatttgtgccacatttaccatgtgcttgttaccaggctgccactaaggacaaaggcgaacaaagcatggaccctgtcctcgaggagctcacagggagaaacagacatgtcaatgaacaagtgcaatctgttataataagcataactagaaaagtggaaaaatagatggacataacacaggcgtaagaaagcgaggggtcaatttgcctgacaagaaaagacaatggatagaattttgcgtggaatctccaaagctaagcagggtactccaggaaagcaggtggggagtaggcaggacagcagggccacaggagcactcccatcaagaccctcccagtcctatacagacctaggaactcagtaccaggtttaataaggagccccgctgagagcaccagggaggcaggcagctaccgaaagggggttggggcttgcaggggactgctcagggtacattttctggttgcctcttttactctgagtgtaggcccccatctgcaccatgcccttcctgcccagatcctctttcccctccacccctcacatcaggagtagctttgtcaagagctccttcactgctcagccctctcacgggagctgccatggccgctgcctgactctgaaacacccctgaagccctccttttctcctcttactctagttctactagaaagccttaacagtcacaaagagtgcatctccaaaaaaaattattcaaccttgcctacgttttctctgtcaagtcacttccccaaagccccaaagacttgaagtgatctgctaattcccaagctcctacgaaataaggaaaggcttctgctatcccggacccaacacagcctgctgaactattttaaaaattaatcaatccgtaatgcatgtatgaagagccttctgcctaaagcacgcagattgcagggggagcatttcacagggtggacccaaagctgtgtgcaacggtgaggaaagggcatgctgtcattcccccaaaagtcccagatttcacaagcttacagtctgattaggagaatagacatgaatcagatttccagaaataaacagcaaattacaactaggataaatgctccaaaggaaacatccatggtgctaacagtggacagggaggggatgactcacagaggaggcaagggtgaccacatgagggtgggtgggggaggagtgagcagtgagaggagcccaagcaaggataatgccaagatagcagaagacagatggcatcttccaggaagggaaattaggtgaatgtgatcaaaatgaggcatattcagagaaacatttcagaggggatgaggatggaggactacttaagagttatgcagaagcctgaaggccaacttgagcatttaagatttgagtttgcactcccagtaatggctaagtatctgctatgagagcaaccattctcagactatttcttaaaaacacccttaaactatacagacctataaactcagtattagatttaataagcagcaccagggaggcaggcagctactgaaagggggtcggagcttgcaggggaatgctcagggtacatttctggttgtcttcctttactctgagtgcccccatctgcaccatgctggagcagatgaaaatgtgcagtcttactgtactgatgatggagggacaggtacggcagccctagtaactgaaaggaaagcaggatgtctggtagggagaaggagagtcccaaattctgtggatggatcctgctcatgtatctggctgacgtaggaccacacatgcacagggtagactccaggcagcccagctatggctaaaaataccttttgggctgctgtgatccactgggaaaatactgtttccattttgagttaagctgttgagtttacagttgaattaaagcattacagcgggggttttttgctcactgttttttattggtggcggggggtaaccagatttgcatgtttgcattttcagatagtgcttctgactttattgtgtggagcagattgtgctggggcaacagtgatgtaaccagacatcaggaggctgccaaaggcccctcatgtgagaggtcatggagcctcacaggactgggtcagaaggggcagagtctgaaagaagtggataccaagtcatcagagctggggtggggatccaacccaggctgacgaagcaagagagccaacaaggactccgtggtctcagacctgaaaccagaatagccatgacatttgtgatgatatgcaagctgggagaaagaccaggcttggtggggagcgtgagtggctttctggcagcagagtgtaaggtatattgagataccaagtaaaatgtcgggtgggctgattcacacggaagttagagagcggtcggggctaaagatataaatctacaagacaactgggtttaaggagtaatgaagctgtgggtgtgagtgggatcccctaaggataaaatatagggtaaaaagaaaaagggactcgggatccagccttcagaagaaatcccacagttttcatgaacaagttgagttggagacacctgcagagaagctagaaaaggcaaggtaaaaagaaaccagaacctttgtgttctctcaaaaaggccgcctacgtgatggttaagagcataaaacttctgacattctataagcctcaattcaaatacttcgtcaatatgtccacccatgacctcacactttcctgctctaacacttaaccctgatattccccctagaacctactactcctgcctagcccttcctcctccgcctcacatctcagggtcttgcagcttctgtaggtcccctatctgttctcactttgtaatcattattatcttttctcctccccagctttccaaccccattatatatatcattgtagggctcatgttgccatcctaaagtaacaaagactattacacagtatccttaaaaacataattttacagtctgatttgttctcttaaaagggacataaaagagtatttgaaatcagcaagactgaagctctacaaagactgatattttaaacatgtaagtgtccatgtaaactaatcatttttagtgggcctcactttacattatttgtttccttttgtcaattcgatatttaaatgactgactagtgaaatttcttgaccctgtttttaagggccactgtgacctacttataaccacgtgtcaactttaacaccggattccaaaaacaaggcacaatgtgagatgaaatgataatcaaagtggattactggaggtttgcttggaatcctggtcttccatgtggacatcgttttttggggacagcatctggggcttccttctgctaccacaaccatcctcaaagtatagtctggagacctcggtaggtgcccatggcctttttaagggtccacaaattcaaacctaataacatgaagtcattatgtggcttttaaaatctcattctctctctagtctacctcagagttttgatacagtatcaaagaagactattcataattatctaaaaagaaagccaacattaaaatgcatgccccttttccagccacacatctggaaaacagcaaatcacaacagactgaatacagaagcagatgtaagcaggcatccatcttctattaagcaggacgttaaagagctatgcaaaaatgtaaaacaatgccaatctctcatttcatgttctttcattttgggaaaaaaaaattttcataaaaagatattgttcatttagcatgtaatagatgtactatttttgtctttagtgaattattaaatactttttaaatttaattcctaacatggtaagtatctgccaacataactcacataagcaaagctctttggggccaggagacacatgagtactttggatcccatgcacagagtatgggttccaaaggtggctgggggagggctcagcattggccctccctctgctaagcctgcttgcccacaaagtgtacctacttctaggtggctgctatgaccccagaatccaaaaagtaaattgagcaaaagcccccagcccacagtgtttcctctgcccatataacatgcctctcattctctgcagatggaagcccagagaacagatattagaccaggactcgtattacacccagtacccatcagggcagttggacagtggctagaatattaaagaacttctgtaccccaagccaccaaagcacttcatgaccactccagctcctgcccaacaactcacaatcatacttgaccccttctgcaaataaaagggatagagcttggcaggctgaccccagtgcatcctacctaaccacctctagcttccccaggaccccatgggctggcccaagccctcccctccctcatagcccaccttaggttctgctctttttcttatatatttaaagtttcacccttccccatcagaacccatatgggccccaacacacacaccccaaccctctccctttattcctctccccacaatccctttgacccaggaggggcagatttagggggttttatttctttactttttatcctcttcctaatgtagagcagccagcctcttgcctagatatcaaagcagaagggccatccttgtaggctgcagaagacattctgatctgagtacgctgggctcagtctttgaaatgccacatgaatttcagatctactcttcttcccatgccatagcctaacaactttattactagtttctcaagctttgtagaactcttgcccccaaaagttcctgggggttatcatgtttttcttcccattccttcctttccaattacatcattttaaggccagtgattattagactttgcctcaccttagaatttcccagggaacttcaggtgtctagttgagctggtgtccaggttgagccctgaaccaactacataacaacctcaggatgggacccagggttcaagagtgtttcatgctctctggagatgccgctatgctgccaagactgagaaccagttatctaggctggatatttaggcatgtcttcttgattccctgcacttgacccccctccactgacccatatttagaactgtctgcggaaaagcgcctcttatgcccattctttccattggaacttcccctccctgaatgaatgggctgatagaagaagcaggctatgagtcaagtacaagagtattacactcaaaacaaacaaaaaaacaaaaaagcagcccttcttcaagagacacaagcccatttctattcccttatcttttcacagaccaagtatccctgcattcatttgcccttgtggtcactctcaggagagtgcagggcagatctgaccactgatcatgcaccagacaaagccacatgtcccacaaaagaacccctggaagctttataaactaccaatgactgcaccgctaccaaaaccaagtcactccagctttctgggatagggtcctggcagcaatatttttaaggttcccccaataattcttacatgcaaccagagagaagggctcagggaatctttgcaagtccagccttcttccttcttcccctacaaatatctgggtgatgtcttggttgccccagctttttttttttttttttggagacagagtctcagatgcccaggctggagtgcagtggtgtgatcttggctcagtgcaatctccacctcccgtggccgggctttctagtccatgttttcttttgtccattatcttgtatatcacctgggccacctgtgcttctgtccatgagtctttcagtctgttctgcctcattccaaagcccagcccagactcctatctccgacttcttcgctcagatggttgttggtcttaaatgagaagtacctagagcccaagggatgacagcactcattcaactgtgttttctaattgggctggtcaaacggtccacttcaaaattttttttaagttagtaaatgccttttttactgaaaaagtaatacatacttgtaataaaaaaaattccaacagcaaaagtgtattacaacaacgtaatctccttctacttcagttccctatcccccctctcccctcagagagaaggacttctatgcaaatacctgttcacttttgtacatctatcctgaggggctggtctactttgcagaaacaacatagattcttgtgatctgtctactgaataagactctgtgggaggaaaaaggaggaaggtcccatgaatctacctttaaagactgctcaggtggtcaaagattggatgggtgtgagaactgctgccaaaacacagtacctaacatggcctttaggcttttagggaacttggaaatatgataaaaagtgaatatatgttgaccctacgaaagttcatctgttaaagtcctaacccccagtacctcagaatgtaactgtgtttggacatgaggtctttaaagaggtaattaagttaaaatgaggtctttcccatgggccccaatccaatctgatttgtgtccttttaagaggaggaaattggccagacgtggtggctcacgcctgtaatccctgtactttgggaagccgaggcgggtggatcacttgaggtcagtagtttgagaccagcctggccaacatgacgaaaccccgtctctactaaaaatacaaaaaattagccagccgtggtggtgtgtgcctgtaatcccagctactcgggaggctgaggcaggagaatcgcttgaacctgggaagtggaggttgcagtgagccaagatcacgccattgtactccagccgtgagactctgtctcaaaaacaaaaacaaaaaaaaacagaagaggaaatttggacacacaaacagaggcagcagggagacacacacacacacacagaggaaataccgtgggaggacatggcgagaggccagccatctgcaaaccctggaggaaggcctcagaaaaaaccaaacctgcagacaccttgatcttggacttccagcttccagaactacatgaaaataaattgctgttatttaagccatccagtctgtagtaatttgttatgacagcgctagcaaactaatacagtaagttagttctatcctggtcacctagagatgctaaggaaggctataaacagatttatagacattggagactcctaaaatgaggtcatcagccccaaggccatggggcccctttgcaggtgaaaccacttcacagcaggtttctttgtgtggttcagttggtaaatttttggccaagatacaaagcaaaggttgccttataccaacttctacccagcatagtgagaatgaggttttcaggctttctggatgaggtttagcatttctctaaaatttaaaacatgaatgccagaaagtggtacacatacacatctaacataactggagaagaccatgtggtggtagggaggcttcctgatgaacaagtatagctgcaactgacaaagaactgtctgagtagcccagtgcagcaagttcagctcactctctaccttataccaaaggcctcggctttctcatgcctaagcacatgtcactgcgtgtgtgtgaaggggggtgatgggggagaaggaagggattaaggcagtatggcttctgcagaagagctgggactgcaaaaccagtgccttctgatggaaagccaacacatgaggaggagacacctggtttcttcctgctttgaaagtggacctggctttgatcaataagctattacaaatatgatgcacagttgtgagagaaaataacttctgtttcagaggaaatggcacagatgaagggaccgccattgcctttgaaagtcaataccaccccctgtagtgatgtagcagccacagccatatgcaatcactgtggctgagccgggcagcaggcagtctgctgattactggaatagcgctgcctcaaaaagcctgcagaggcgaggcttccttttgaatcagtgcaatggtcaacagagaggtctttcttttttcttttcttatccttttctgcctaaactctagaagcggacaataaccatcagagatctgttctgttacaaatccaatatatgcagtctgcccttctgggcactctatcaacagatctgccccagcccaccaatcttaaatcacactgtctacaatgctctcaaaaatattttatcacagacagtgcaatattctgtgtgtgcctttccactgaaattataattctagaggcatcagttgccctaataagaaacagagagtccagctgtaatctgatggagttacagtcaagaagccattgctttgtaaagctgatatgaacgcatctgaatttcaacctccaacctgtactgtgattattagcacatccagggttagggatgggtctttactggtgaaaatagtggcctctaaaatttctatgatgaatgttataactagcttcttagtgtgaaattaaagctatccaagatatgggtattggtgaaaatattttagagttaccccaacccttatacaaggtatatggatcctgagagacctgttagcttccccgcctccccaggcaacttgggtctagccaccaaggtgagaggtttctgcctatcagagggtgaccacaaaacacagagaactgggacttcacgaatcttacagaactggttggattatctctcgtgtcttttgctaatagtatttgtttagtaaatgtccatatgggtagcagaatttggtttgggactggctttctttaaactggcatttgaggttacaggagaatggctaaacctcagccacctttcattttttggaggctacattttataccaaaaagaacctaattggtttaggtcagtttagaaaacgtatccatcattattctccagacgggctgaagctctgcgagccttgtctctgttacttgtcctcccttctctaaccgccgacccaaaccgccgacccaaattctagacctccctcagggttcagccacttgaagatcatttccacttgaagaacactttctatggaaagtattcctcacctaatggctttactttgtgccccaaaaacaagggctaaagaaatcacgctagactttatccactttgccatgcctgtttggcaatgttgtttaggtcttaacacttcatgcctatattctaagtccttgcaaggcaaggacctcatttgccacactagttaattattttgtatctccccaagcaataaatccaatcccatgaacacagcaggacttgctaaatgcacccactgcttctgcatctactgtgtgcatgacaactttggggctaagaagggagacaacaatttggctccgatccccaagaagtcatccaggagaagagaatgaatgtcgatggttcagagaggcaagtctcttagcctctgcactcaagcattttaccatgaaaacatctgtgttatgtaatttctagggcaccaggaaaaatggctacttacccagaagactaaggatgatcttaacttttcctccagctaattatttaaagggatgtaacatgaggttttcttaaaacaaaacaaaacaaaataacagctagatatggctgggcacggtggctcatgcctataatcccagcactttgggaggccaaggtgggtagatcacaaggtcaggagttccagaccagcctggccaatatggtgaaaccccgtctctactaaaaatacaaaaattagctgggcgtggtggcgcatgcctgtaatcccagctactcgggagtctgaggcaggagaatcacttgaacccaggaggcagaggttgcagtgagccgagatcacgccgctgcactccagtctgggtgacagagcaagactccatctcaaaaaacaaaaaaacaaaaaacaaacaaaaacacctagatttgcaactggtgtgttcaagttaacaatccactactgtgtgtgtaagtttaggctaaccgcacgtctatacccagaacttaggcactggctgtttttgacttcaataactttcctgaaatgacaaagtaggcatgtattatatctttgcctaaagacaacttttatgagatcatacattcccattcttgggagggttctttcttttttctttttgctgaattaacatttgaaagaagaagtcatttggttttattaagcatgattcttctactttggtagactaagcagttcaaaatgtactaggaagatgatgaaagcaaccaaacaatttatctgaagagaaagataaaattactaagagcctgcagattaaagaacacattttctgttttagattgatatataaacacaacacttaaagaggaaacatgagccaaggacgcatcttcaatacagtccctcaaattttaactttaattaatcctccgaatttcataacaatgtattttctaatgacacggggactcacttcggaattctaagtaagactgttactgttcccaacgcatccttgtgttcctaatgactaagctttaaactattaatacatatcttaggttaattaagtgggctaattttccttgcctaataattgttcacgataatctaacactgtttaagctccaaaataaccatctttgaaaaatatacatccttaagtgtgtctcctcctattatcagtggggaaaatgtgacagtaaattactgagtaggaagtacagaattcccaaatacaaaggggcccagattttaaagtacttccaattttatggcacaataatctaatcttatcctcacaaagcctcctcatctcctggctccaagatcagaggaaattctttaagagagagggacgaggtagaagccgtgtgtacgtggttttgagaccttccctaagctaggcctattcctgctggcctctagttatgagaaagaacactgaggcctctcgcacatggctttgccaccaccagatggcacatcaccatgaaagcaggttacagacagaattctgccacagaaatcaatgtttcttggcaagcagtcatgaaacaatctgttcctagaaactctgcaaggtcccaggtcttggccacttagaaactcctcaagtcccttgcatgatcaggacacagaattcccaattaagaggcaggaagcaaaacaacagagagccctagatgaagggcaatactctaaaggagaacatgtagcagctgggccctccagattcctgcacccctgtccacagacaggcagaggggcctggacagggattaaccaacccacaatattccaacgatcatgcgcaccacccatttctttcaataaaacttatctgcaataatcctcatgctaattaacaattatctagtgcagacatttacagatggaggtcgttgaagacgggaagtggacatggaactgcgaattcttgttggctatctttaaaatgctaaccgtgcctaccattggaatgtgtatttctcttttggacactataaatgccaactaaccacccttaggacatagagtgaaactagcccacacatataaatattttacaccatctatactaaaatattttagaggaaaattatagacagacaacagtatgagcttaaggatggagtcggcactcaggatgtatgaccaccagaggagttcagagggacaggagtgactactgtcttcatttctccattccactctctcttatacagcccaagttttctgaaatagtataccaaggggaacttctttccctctcaatttgaacacaagacagcaaaatagctaaaggtggccgagtgtggtagctcatacctataatcccagcactttgggaagctgaggtgggcagatcacctgaggtcaggagttcaagaccagcctaaccaatatggtgaaaccccatctctactaaaaatacaaaaattagctgggtgtggtggcaggtgcctgtaatcccagctactcgggaggctgaggcagaagaattgcttgaacccgggaggtggaggttgcagtaagcccagatcgcgccactgcactccagcctgggcaacagagcaagactctgtctaaaaaaaaaaaaaaaatagctaaaggtgaaaatttcaaataagcagcctctcacaagaagacaaaaactagactctatgtaaatagatatgaaaacagtgccctctttaaagtgctttttttctccctgcttaatggtctagaaaagacacataattgccttataatcttacagaacctctatttgagcaacaaagttgagatgtcccaatggagtccagttggtgattacatcattagaaggtggttcccagcctgtggtccggtccccaaatgaatcaatcgatttggttgttcccagtttttttctattacaaataaagctgaatcatacaatatttggagtgaagataagtctccatttctctaagataaatgcccaaaagtgcattcgcttggtcatatggtaaggaaatgtttagtttcataagggcagtcatgcaagacagaagtaggcagaattcagagaggcagaattgtatactgggtacagatatgttctctctctgaaactaaatgtcttagttttatacacaagcttcacaacttaccacccatcagatcctcattgatcaaatggagattataatgataatgaggccatttcaacagcatcatggtgatgatttgattagttaattcatgacatgttcttagaaccacctctgacaaacactatcctttccacagatgttagctactaaaatttgcatgatttcagccaccagtaagatttaatattttaccctatattcattaacttactgaatttcttctcttatggattaaatgttcatgcttgaaaatacaagaaaagatttcattttgtttcagtatcaaatgcagcactgcattcaagaaagcttaaacacagaaacatcccgccagtggggcagagtacagtcgatttacacaagccagagttatatgtttcattatgtataggatatcactctatagtctaagatacacttgctcaaatggtttttttttttttttttttttagacggagtctggctctgtcgcccaggctggagtgcagtggcgtgatctcggctcactgcaagctccgcgtcccgggttcatgccattctcctgcctcagcctcccgagcagctgggactacaggcacctgccaccatgcccggctaatttttttttgtatttttagtagagacggggtttcaccgtgttaggcaggatggtctcgatctcctgacctcgtgatccgcccgcctcggcctcctgctcaaacggatttaatttgcgtggggaagaataatgctggttgcattcagccgcaacagagcagttgatcaggaacagaccctgtctgagaagcgtgtctctgtttgcactagtcgtcctcggaggacacaataccttggctcagattcgcagctgctttgctttgtacccttcactcactcagtaaataggtactagtgcctcccattagggccctgggttggaccctgagaagaccacagagaagggtaggcatctctccaggagctttgatcctgaacttgacttaaacaccagaacaaatggctgtgaaaggtggcaaacagctcaatacaaatgaatgtcacagtctagagatgatgtagcagcagaaaaaaggaattgctagagattgtaggggacaaagtaaagatgaaataagacttcttacagaaagcgactctggtgagactaagctaccagagaacctgtttgggctgagagaaaaccatcagcctagaaaagagggcatggccaaaagtttaggtatgcacaggggcgttcattcttctggaaaacaatgtggccagaggggacagtagaagccaggaaacaataagaaaaaaatattgaaagaattgtagtctgaatgtagaagctctagaatactgactgagtttacactttgctctgggtataataggggcctttgaaagctttgtaaaaggaagtgtacatcataagcagggtattttaggggataaatcttcctgcagtaagaagaatgaattggaaggggaaaagacagaaagtaaggcactctgtgggaaaataatttcaactgcgcaagcatgaagcgatgtggatccaggccggagacaggcaagaagactggaagtcagattgttctatttattttccggagaaaaagaaagcacacctatgctagaaaaatagcttcggcaaatgccccatataataaattgtccttcacttactccacccatgtgtttttgctttaactaaccatgaatagctgcttcagcaccagcctgtttatcatcctcccacgtccagcctagcaggactgaactgaaaggatctcagagtagtggactcgctggactgcaagatgctactcctgttaatcttccattactctttgatgttacgtctgtccctcagatatcacgggcaaagcatgccaagatattacagttgacacctggggtaagccagtcttttatcccctattatagctgtatagctcttaaacatagtgtgtcattgaataccatgctctactatttagccttactaaagacctgtgaggttataaaatctttattacaaatttcttattcataagtttataatttaacagtatgctattgaggcatacatgaactgagtgggtcaactaccacactgtggacatgttctagaatgttactgtgcttttggttcttcccagagggctgctgtctccccagatcctggaagcagaatccctgtagagcacataacacccccaaatttaacccagccatggctgtcatttggctggccagcaacccatgagataatttcttctaaaatttggctttcaatttctggtccagcatataaggagcttggaagtcaccactccaccttaacaacaagtcaaaagctaaacaaatggaaacatcaaaaattcttcttagatccatcatagaggtgaggtcacagggcaaacttctgccccacaaactggagagacaggcagatactaaaaatcacaacttactggagcagaaatccatgagcagaagcctctttggaaagtcacgctggggtaggaaaatctgaaccgtaattgacagttgctataaactcagcgtggacaggtctgaaagttaaaaactacagatcaatacagtgatcagtccccacctccccatacccctcaccacctttgaaaattttaatctcatggagcttaaccaggttctcacggtggctatcggagaaaaaatcactcgtgtcttcagcaggtagaagggaaaagtaaccattttgaaatatatcagataattcttttttaaaaaaaaatgtgtgagtatgtagtaagtgtatatatttctggtgtacatgagatgttttgatacaggcatgcaatgtgaaataagcacatcatgaataatgggtcatccgtcccctcaagcatttatcctttgagttacaaacaatccaagtacactcaggttattttaaaatgtacagttgagttactattgactatagccaccttgttctgctatcaaacagtaggtattattcatccatttttttgtacacattaaccatccccacctctataagtaagtgaaaaaacctacaagtaagtgagaacatgtgatgtttgtctttctgtgcctagcttatttcatttaacataataatctccagtttcatccatgttgtcctttattttttccaataggtttttggggaacaggtggtgcttggttacatggataagttttccgtggtgatttctgagattctggtgcagccatcacctaagcagtgtacactgtacccaatgtgtagtcttttatcccaaccctcacccaccctttcccccaagtccccaaagtccattgtatcatttttatacctttgtgttctcatagcttagctcctactgatgagtgagaacagatgatgtttggttttccatttccgagttacttcacttagaatactggtctagccacccaacagacctaccaggctctgggctggtactggagaatgtctgcaaggagtcctgtgatgtgatccatcttcaggtctctcagctgtggataccagcacctgctctggtggaggggagttaagtggactctgcaagggtcattggttatatttttgttaagtgtgctggttttgtgttgtttggcctccagccagactc

SEQ ID NO: 793 - DNA, 82047 bp, Homo sapiens
ctggagagaaatgcaggagctttattataaatcatttaatattcttgaagttaacaactgataaactcatttaggcaaacattttggatttaatgatctaaagctcacagatgcatgccacatctagctaaaagtacataaaaagcgcacctctggaaataacagccctccctctggctgaagactgagaagcattaaggatgcttctggatttctgcagcggcagggcaggggtctgcacaggcctgacctggtgttgctggagcgcggcatcccctcctgggtgctgctccgaaaggcaggctgggaggtgcttgctggggtgttccatggcagcgctgccaaccaagtctgggtctctaaaagccaccctcagtttataccaactgatcaggaaataggtggtgacagggccttgaagggtacatgccggcttcccttaagttgattagatgggaaaccaaacaccgtctttcaagtgtgaggctgtgccatgctccctcagggaggaggggcgctgggtctgaccaggtctgcctctgccctcaccagctggcagacgtgaactggagaacagcaccagaaaggctggtggttggcagctgctcacgacacagttgctgacctgcagcagatcggctgtgggtgagcaggacagtcaggccctccacaagcactgttctggagtttcgtctgactaggtgaaccctctggcttttcgaggacgcagggtaccctactgccaccagccagtgagcagactaggacatctctagacaggaaactcatctaaaaatcggaggacaacctgatgcacccaagtgacaatggacccaggcagctgtgcacaccaggtgggaggcgtttggaacagttagactcatcagtggataggtttttctagcacaaatggaatgtggtgtctcatgtccctagggagacaaagggcaggtttcttatctggtctttccaagctttcaactctctggctcaagtgtcccagaatgaactagaagtctattcctccaccctggtccgtggtcacttccagaactctgaagtggctcaggaggtgactcctgaaaggcagcccttgcttgatctcctggtggagcctgtctgggctgaggcgatgctgggcttgccgtgccgagatctcatgccagaagtcctccctcggagctacctgtctccagcctcattctttggcatgttgactcctggaattgaggggctatttctaagatgcatgctttttcggcttttctcatgggtgcctcatcagcctgcacaggatcccccatctcacgagagagggaaatttggcattgctgttccctgcctctaaggtcctttatgaggggccgcccaaactcattcccttagttcttactctcccacaggtgttgagattttattggcccatactaaaaagcatgcaatgactgaggttttctcctaaccttaatctcatcttctcaaatgtgtgccttcttgtttttaagaccatagacaaggacgtcaggtgactgctgaaatagaactaaagctaaaatttttctcggatcttggcaaattctgctaatggcacctctaggggcacaatgatcctcaaatgacatccaaccagactccccataaacaaggtttgggctggagctgtttctagttttaaatatggaaatgtaaggcaaaggacagagcacttggttttgccttagatttcccagcagagtaggatttgggcgaaactgctggttctctctgtcagggaaataccaagtgcagcagagccggggccatggggcaggctggtggactccaggctcacttgcgtggctgctggatgtgctgggttcttggggaaggatgcttgtccatggaggcatgcggcttctggtgagccacctgcgcagccgccggggggaaatctttgtcaccctgtcaggaaacacggaaagctcaggttaatcaataggaagcatggggtttgtgggtgaggaagccccaggccagtgcccaccagcgtccctgcggaaggatagcaattgtgtgtgaggaagcctcaggccagcatccaccagcgtccctgtaggaagcatggggtttgtatgtgaggaagccccaggccagggcccaccagcgcccctgcaggaagcatggggtttgtatgtgaggaagccccaggccagcgcccaccagcgtccctgcaggaagcatggcggttgtatgtgaggaacgtccaggccagcgcccatcaacgtccctgcaggaagcatggtgtttgtgggtgaggaacccccaggccagcacccaccagtgtccctgcaggaagcatggtgtttgtgggtgaggaacccccaggccagcacccaccagtgtccctgcaggaagcatggtgtttgtgggtgaggaagccccaggccagcgcccaccagcgtccctgcaggaagcatggggtatgtatgtgaggaagctccaggccagagcccaccagcgtccctacaggaagcatggcagttgtatgtgaggaagccccaggacagcgcccaacagagtccctgcaggaaggatggcggttgtataagaggaagctccaggccagcacccaccagcgttcctacaggaagcatggtgtttgtgggtgaggaagccccagaccagcgcccaccagcatccctgcaggaagcatggcggttgtatatgaggaagctccaggccagagcccaccagcgtcgctgtaggaagcatggggtttgtatgtgtggaaactacaggccagcagccaccagcatccctgtaggaagcatggtgtttgtgggtgaggaagccccaggccaacgcccaccagcgtccctgcaagaagcgtggggtttgtatgtgaggaagtcccaggccagcacccatcagcgtccctgcaggaagcatggtgtttgtgggtgaggaagccccagaccagtgcccaccagcgtccctgcaggaagcatggggtttgtatgtgagtaagccgaaggccagcagcaaccagcctccctgcaggaagcatggggtttgtatgtgaggaagccccaggccagcgtccaccagggtccctgtaggaagcatggcggttgtatatgaggaagctccaggccagcgcccaccagtgtcgctggaggaagcatggggtttgtgggtgaggaagccccataccagcgtccctgcaggaagcatggcagttgtatgtgaggaagccccaggccagcacccaccagcttccctgcaggaagcatggggtttgtgggtgaggaagctccaggccagcgcccaccagcgtccctgcaggaagcatggcagttgtatgtgaggaagcccaggccagcacccaccagcgtccctgcagggcaggcgtggactgtgaatggataaaggaaggtggaagtctgtcccttgtgggtgttagggggcctgggcaatcaaaaccagggaatggcaggtggcactgaggcccacacactggcaggacagcaagaatgctcactggctctgccccatgccgtgagacacaggaacatgcgactcccacagaactgacttggatgctgcggggtttcttctgctacatctgtatttgtgactatttaaattgggggcaggacagaaccaaatccaggatcttaagttcagatgtgccaccacagctgtgagccaggcctgggacgctggctgggaaggaaatgcacagggcgcctacgagacagagccaggttcggcctgtccagtctcaggagggactccctattttccagagggatcaatgggcttctgtgccaactgtgggtgtggccagggtggggtccacatgggcaggctggagccacacttctctggctggcaggttggctggctgcggtcacagctccaccaacagtgggctgtccccaacactggcactttcttcaggcatcctctgataagaaagtgaatgttctgagaacagcagccctatggacggcaatactgtggggttcactgcgggggtttgctgatgggagttcactggtgggaggtctgcgcttaagtcacaatgttgggtctcaccagacggcggctctggaaaggtaaaggatgcgagtctggcctgcggtctgcagaagcagcctctggggaaacgcggcaatgaagagagccatggccacagaggagatgagcagtggtgctgggttattccaggtagagtttaacaaaaccagaagcaaccaggagactccatgctgccatgcaaaagcctcaaacccaccgcagacactcccagacttacccgggcgatgaccccagagatgaacacagtgggtttaggtggactggaaaaaaagaagggaaaaggcagatttaacaaaacagtccacaacagggaacacggtggcagacgatgtgtatgtggatgagccaggctggagggcgtggaggcagaatgggaagcaaacctctcctctgcgttatttgttgtaatgatcacactacggggctcgggagcctccttctcctgaggctagttcagccccaagtacgagagagaaacagactgcagccaactgcgagtgaattgccttcaaccactttctatttgtgttttttttagggacagggtctctgtcacccaggctggaatgcagaggcacgatcatagctcacagcagcctccacctcctagactcaagtgatcctgcttcagtctcccgagtagctgggacaacaggtgtgcagcatcatacctggctattttcttttatttttgtagagacagggtcttgctatgttgcccaggctagtctcaaactcctggcctcaagccatccttccaccttggcctcccaaagtgctgggattacagggatgagccactgtgcccagcctatttttgttttttggttaaatcaacacattttaactatgggcaagcccatttatttggatttaatgagatcgtgaaacaggcgcttccctaaagcaggggagaagtagctttacatggtgtggacttggagactttctcactgcctcctcaaccctaggcttccccttccagcgtcctcacaggggagattctagagccaacacaaacctcccgtccccatcaatccctgagcattacaaatataaggtccttgggaaacatgtcacctcttgacatgttaactcacactgagctcacctaaactgccgagtattgagggaatggatgcagtaccaaagcagtacagctcagtgtgaaaaaacagacaagcccaaacaggctcaaatcgccagcaggtctaccacctggaaacacacactgttaacgtggggctatcctcccaggctttccttctatggacagatgtacgtgcttgtcttcttattaacttttttcttacaaaaatagttatactgttttgtaatctgccttctgaactaaggctatggcaagcatctctccatgtaattatatactcttctgtacacttattttttatggctacgtgtgccataatttaaaaacatcaggacacagtttgaggtagtggacaaggtgtgtgcacttccaaatgcctccaccaagaggtacagacacccaagacctggaggtgaatacaaggtcagcccagctgggacagcgcgatcgatcggggacactcacggaggtgggtggaggggaagcatctccctcttagttcagttttgcttaaggccagtcctgctgggtagagggggtagaatttatcccctgagctcaccagcctgtctcttcccagctctgcttctcctctgctgccagtggtcttttttaaggaatccacttgtcttagctttgttttgctgcagtcaaaagtcccagcattccgaaagttcactgactgtttacttccccaaagagtttaccaaaaacacctgaaattcccccaagtaatttctgttacttcgcgacattaagaaacttcaagttttactaagcagcacagagatgccccatacattaccttggttttatttagtgtttgttgtgtggttacccaggttggatttttttccccttcctttacgtacatgatttagctataggattaatagtcggccagaaatgagtaagctcagctcaagtttaaaagtcccgccacgtggtataactgaattcatttggattcttaaagcacatcctgctgtgatggctgataccatccacaggggagggcttccagggattcagggccaaggagtttgcatccaaagctcaggaactgtggtctgaattctaacattttagaaaagatttggaaaggaatacacaaatggcagcacaaagtttcttaacgtcgtttggaatgttcttttaaacatctaggaacagcctgaagcagggatggccccactctggtagcgaatcatatagtatcatcttcaacaaggcacagccgtctttccgtagcaggagtgcacagtggcttccactgtctccatgtcctatttgttttttaacctgctgaggctctgaaaggcggaaatgcaggacatcaccccactccagaaacttgatataaaatgtcatccatagagagtcaatctagtaagaatacatgcataataaagggaattagcttcctcaccaaactgagccctaaaaggtggctgaggaagcttgagtaattatatacatatataaacaccctcccctctacagacacacacacacacaaacaaacaccttgttttatggcatctgcttatcgcacttcacaggtaatgtgtttctttaggaattgaaggtttgtggcaactctgcataagcaagtctatgggtgtccatcttcattattattatgtctgttacagtgatctgtggtcattgatctttgatgttactactgtaattgttttggggcaccacgaaccgtgcccatataagatggtaaacttaatcaatacttgtcatatgtgttctgacagttctactgaccagccattccctgtctctctccttctcttcaggcctccctattccctgagacatagcaatattgaaattagggcaattaacaactctacaatggtctataatggcctggaagtattcaagtgaaaggaagagttgcatgtctctcactttcaatcaaaagctagaaatgacccagcttagcgaggaagacatgtcggaagctcagacaggctggtctcttgcaccaaatagccaagttgtgaatgcaaaggaagagttatgggagaaaattaaaaatgctactccagtgagcactggagtgagtgacaaggaagtaaaagagcattattgttgatatggagaaagttcgagtggtctggataaaagacaagccacaacattcccttaagccaaagtctaatctagagaaaggccctaactcccttcagttctatgaaggctaagagaggtgaggaagctgcagaagaaaagatggaaactagcagaggttggttcatgaggtttaaggaaagaagccatctccagaagataaaagtgcaaggtgaagcagcaactgctgaggaagaagctgcagcaagttctccagaagatctagctaagatcattgatgaaagtggccacactaaacaacagattttcaatgttgacaaaacagccttttattggaaaaagatgtcatctaggacttacacagctagagagggaagtcaatgactggtttcaaagcttccaagggcaggctgactcttagtagggactaatgcagctgatgactttaatttgaagccaatgctcatttaccattccaaacatcctagggcccttacgaattacataaaatctactctgtctgtgctctatacatgggatgacagagcctggatgacggcacattggtttacatcaaggtttactgcttattttaagcccactgttgagacctactgctcagaaaaaaagattcctttcaaagtattactgctgatttataatgctcctggccacccaagaccaagtatacaaggagattaatgttgttttcatgtctgctaaaacaacattcattctgcaacccatggatcaagaagtaattttgactttcaagtcttattatttaagaaataagtaattccactggtagatttgggcaaagtaaattgaaaaccttctggaaagaatttactactatagatgccactaagaatactcatgattcatgggaggaggtcaaaatatcaatattaacaggagtttggaagaagctgattccaaccctcatgggtaactttgagggggttcaagacttcactggaggaactaactgcagatgtggtgaaaacagcaagagaactaggattagaagtggagcctgaagatggaactgaatggctgcaatcttgtgattaaaatcctcagggatgaggagttgcttctcatggatgagcaaagaaagtgatttcttgagctggaatctacacctggtgaagatgctgtaaacactgaaaataacaacaaaggatatagaatattatataaacttaattgataaagcagtggcagggtttgagatgactgactccatttttgaaagaagttctaccatgggtaaaatgctatcaaacaacattgtatgctgcagagaaatctttctttcctgaaaggaagagttgatctatgttctatgtcacaaacttcattgttgtctttttttttttttttttttttttacagagggagagggtctcactctgttgcccaggctggagtacagtggtgtgatctctgctcactgcaacctctacctcccaggttcaagtgattctcatgcctcagcctccagagtagctgggattacaggcacacaccaccatgcctggctaatttttgtatttttagtagagacagggttttgtcacgtttgccaggctggtctcgaactcctggcctcaagtgatctacccaccttgacctccgaaagtgctaggattgcaggcatgagccatcacacctggcctgttgtcttattttaagaaactgccacagccactccaaccttcagcaaccaccaccccaatcagtcagcagccatcaacactgaggcaagaccctctaccaacaaaaagactgagcctcactgaaggctcagatgatcattagcatacagaatttttaaatttttaaaattttaaattaagttatgcattgttttttagacgtaatgctactgtacacttaataggctacagtggagggtaaacataacttttatatgcactgtgaaaccaaaaagttgtgggactcactttatcacaatatttgctttattatggtggcctggagcagaccctgcaatatctctgaggtctgcctgtacatattcattattgaaacgcagacaagcaaaacaagttaaaatcacttgtacttctgtattactgtacgtgtgtatttataaagattgacacacacacacaactactgtcccatcacaactgctgaatggccatggagactctggaggctaaaggagatccccagcaatgagggtggtctaccctgtgagtacgccaccctttgcagaggtggagtggaactccaggacgcagaggcgccatccagcagtagggcgccagcctggagaggcctccatgttgggtgttcctgacaggctccttggttgagcccagccccactgtgtagtagctgccacgtgaggctctcgggggacctggctatcaggaatctgtctccagcactggtcccctgtgtgcactgaggacgggagtctggagcccaggggcctgccacagtcccgcccttcctccctgccctcggtgctcctcagaggtgctgtcctctgggcgtctcctgcattgatcacgacaagggtggggttctatgcctcgagtatgtacccggagaaatgtgtgtgaacagtgatgatatgagatcatgacagctctgctctagcctgagtgctggaaaacacacacggaagctgaggcctagaaaccagcctctgactcccagggcacgctctttcctttcctaaacccacatttagcacctcactcccatgtgagctgctcaagacactgtcccatcgcaactgctgaatggccatggagaccctgggggctaaaggagacccccagcagtaagaatgaccctccccccacaggcccagctcattccaggagtgtccagggccatggttgcaggttgcagcgtctaagagtccacaggagtcattcacagatggcgctgtccttgtgaaaccccaaattcacggagatagctcctttgtgctgagtcatgactgaatctgctgagctttagtggcttggtggattctgctcataaagacagaggatgtcaatgaaaatcatgctaggctcagcataagaaatgtgcctctgccaaccactgggtggcgaggggtgaggtgaggcccaccgggtgtggcgatgagccagggactggtgtcctttgtgctgcatcctatacaaagtggctagtcattctgctggatgtggtgctggcgacttggctgagtgatggcaagactgagggtctgatgccgcagtcaaagggactcactcaggatggaaaggccgtgaacttgcccttgtgcacaccctgagggctgactccgagctgaggagcagggacagggaatgtcactcagtggcaagcttaggtcagagcagtctcttggggcacaaccaaaacagtgtgcattccacctaattaacctggggaagaacaacatgaaggcctgagacttcatcctgcactgctgtgctccagcgcccccatctgtttggcactggtaagaaataaggcactgaaagaaaagaaccccatgtgtccagcacttccgcaggcgaggtccttgctttaagactgcactttttacacaatattcaagaattgtgttgcatgagaaagtcttatcgagccgcaagaggcgactcggcgggaagtgacaggacaccagactgagggtctcctttagctctggtctgctcaaggcaaacgttcttcctaaagacagtccaagctctccctcccttctaacttcgctttgaaaccccagccagctcagcaactaattacaaaaaaattatgtaccattttagccatttttaagtatacagttcagtggcattaagtatattcatattattatgctatcatcacctttatctatttccagaactttttcatcattcccaacagaaagtctgtccccattaaacactagctccccattctctcctcctcccagcccctggccatcaccgtgagtttaactgccctagggatctcatgtaagtggaatcatacagtacttgtctttttgtgtctggcttattccatctagcataatattgtcaaggttcatttatgttgcagaatgtgtgggaattcttttttgaggctgaataacattccactgtacagacagaccacattctgcttatccattcatctgctgatggacacctggactgctgcgaatggtgcagctatggacgtgggtgtataaatatgtgctcgagtttctactttcaattattttgtgtgtaactcagaagtggaattgctgggttatatggtaattctgtgtttaactttctgaggaatcaccaacctgttttccacagcggctgttccattttagattcccaccagcaacgcacatgggttcctatttccccatatccctgccaacgctcgttgttttctgttttgttttattctgtttttttggataaaggctctattctaatgggtgtgaggaagtatcgtactgtggtttagatttagcaactaattttaagaataagcttccctgccacagaataataaatatcaatctgtattgatcattcattaaaggtctttatgaaccaaaagtcgcccccaaaattcttctctaaaactgaaaaggccataattggctgtaaggacatatggcagctgcccatgaaaagatggcaaaaggcaggcctcttccaaaatgtctaacagcgatatgtattttcatgtaacttgtcccgtgacagagcgtatgttgtgttgaaggttttcatcaagtttggcccaaaggcttcagagcccaatccttttttccaactataattaacagcaacttaaattggcaaataattatttatgacgtttataaagtaaaaacagttactaaactctttgagatgtggtagcttgaacaaaatctcacaagcgagaaaccccagtcaaaggtctgggtgtaaggctgtacatgcaaaacacacctattttaaatgccattaggcttccatgcaaagtataacctacatttctcaagtctaagaagtatgatagctgctttgaggatttatttaatctgatgaaaatcattctgacagatgctgttttgaagatgcaacattattttctctcaggaaacagagagtgaaaactatcaaccctgcccgccccatatcctcaggcctttccagactttaaaaactacacttatttaaattgaaaagaactgcaagccaggcagaattagccaggattagaatccagataacacttcctatacactagcagaaactgcagctttttcacacccagactaagcagccacctgatgtccgtgcacgtgggtctctattgtccatctggcaaggaccacatcaaactcttaaaaggaccctttgtccttaacaaaagtttgctattacttattttctaaattttcttaatgaagatttataccttattggcattctgtggaaactgcagacagacaggataaaatgccagaaacgctcagtgactgagtaaccctgtggaatgcagatatcatcaagactgagtttgatggtctcatctttaaaggaatgtggaaagggctgagaaacccaaattcatagttttaaaacttccctaaactcccaaacagcaactatttaactcaatatattcaagttactgctaccccaacatgtaactcatataaaaattgagaagacttttaacattcttttgtgttctaaggctttacaccctccctcatcatcgtggtgctctgacagcctggtttctgccccagttctgagaggtgtaaagcgatgcactcttgtgagttagagctggacaggaggttccctaccaggcagacggctgctgcaatctataccttcatcctttcgcagttgagagcttaagggccttcagtgggggccgcctggatgtctcccaggtgggccggattctgtctccctgcacttagtccagcgcccatcccaagtctaacgctcttccacaggacagtcctttggtatttgaagaaggctaccacaagcccccagaacatccctttcccagactcaaaggcatgatttcaaattccttcactctctcagctattctcccaactgcattccagtgcggtttctagagttttgcctagaactgtacgcgacaccccacatgtacctactcagtccccacaggacaccgatattgcaataatactttcccctgggctacagagagcaggtcagccaggaaatgaatccgggctccccaaaaggaccgattgctagtaatcttcaaataggactgctactgacaggcaacttgtgaacaaagtaatttgtatctgctgccctgctccagcctggctcaccacagctagttttgtggggtccttacccttcttcccttaaccctggagagcttctgcactcttagaaaaatgcagtgcccttcttcaccccaaaataggattctgtgcaacagggagggtccgatgtgcatctgactggtcagcctcttccttcccaagcatcctggtagggattagggtcagcttagttaccacgaaggtgaattctgggatggggagaaacatgcacacgcacacacacacacacacacacacacacacgtgcgtagtagtagtgaaactgggaatctggtcaaatctctgatcccactgaaagtaatcaaaatggcagcaaaggcattactggagagttgtacgtaacagaatcattttcatgttagttttgacctgggttcatggaagtctactcaagttatcctctgcaaatgctgtctccttttcatgtaaatgtactctatcagcaggaagcatgtacacagaaggcagggacacatggcctttaataagccactggtgctctattttccctaaaggatagaaatgatctcaggttgataaaagctactgtttatcaatcaccactatgtactatggaccaggtgctgagttaggcgctccccttagaagtgctgtatctaactctcttggtcctgtgaggcaggaactgtccatttcacagattggaatggtaaatcagaaaggaccagtcatttgcccaagggttgcacagtaataagtgctgggaaccagacttggaacgagggctgtatagtgcatgtaatcttggctccaagcccagtcccctcattttaaagcagagttttagcttgtcttctgtatatgatttagagatgcagagttttaaggtaagcaatctaaatgtaacctgagggtcctttattcaaccagacagtacaatatattcaaatctacctaaagatttactttctgacttgatagtggattttttttcctgaaaaatgatcacttatgtctctagcatttaactagcatacaaagcacttccacataaatcattagctcatctgagttccttcggcaggtgatgttctattttacggaggaagaaatggtgcctcagagaggctggaaccttgcttggggtcctgggggtggagcccgggaggaagcgcaagggctgtgctcttcagtcgggtcgtctgagatctccaccatctcagacgactctgttcctcagtctcgggaacaaaatgcaggggaggcttcaaaccatttaacagattcgaggcagccgacagggccagagacgattcagaaccacgcaaaggagggaccgtggcaaatggacaccatgagtgtgggctagagtgttggatgatccgggttcaaatcctgactctgccagggacaagctggtgagctggtggttgacttttctgaggcttagtttccttgtctataaaactggacagcaacagaccctaccttcttaggtgactctatatatgtgcatacacacacacacacacacacacgcacatacacacagcagaaagcaacagattctaaacagggtcgaaacacagtttccaaatttgcttctaggctgcctggcgggctctgtgctttcctgaggagggtgggcaaagagactgcttttccagggtaatgaccttgagaactgggccgcacctcaaatcaaaccctctgtcagtgcagaagaagaggcccttgggcctcacccactgtgtgctgatgaaaggtagtcacagtgtgtgcttagcacttgtgtaacagagaggacacgacactagagcactgcagtgggaggacagggtaccctcgatcagcttctgcccatacaaagtgaatggggctgggggctcttctcatgcactgatgaagggggtgacataggttgtggcccagcacatgcgctcattgaccgggaaaagcagtctcctcaggaaagcacagagcctgcagggcagcctagaagcaaattccaaaactcttgttttgactctgctcagaatccatagctttgtgcttccagagtttacagaaaatatattcccagctggggtgactttttaaacatttcccagtaagtcgatggaaaacaaatccgttcctgccatttttagttcttgaaataccttcttggcttggtcttaatttatttgggctattaattttctggacagcaaaataataattagcatggctggtgagcagagggaaacgtctcactcgattgcacccagacatttctggataacatcattcttcagagtgtgacagtcgaggctgtctccctccttcagcctggcttcagcactgacaacatttccacaagatggcactgctggtcctctcagcccgcgaacgctccggccagctcagccacctcaaggagaaatggaagccggccaggcactgcgggcgagggctgctggcacctgggcacgagggtgccccttctccccaggagtggctaattgtcacgagtctgaccaaaggcatataaaactcaacttcagtgtcgtaaacacaattctaaacccgagagaaaataatctggaacctaattccttctaaatttggcataagaaatttataacatttttcaaaagggcacaaccagaggtgcttttctaggtgagaatgcttgagctcatgttcacattggtctaacagcaccttctttgcagtgagatgctgttttcatacaactggaatcagccttcaaatccttcagtgaagaggctgggacggcaatctgccccttcctcagaactactgcttccaggacactgtgatttcaggacaaaacttcatctcaacctgttcttctgggtctgggccaggtctgggtctgtgtgggaaggatgctctcatttgggggttctgaaatatttctctccaggtagcattccacccacagatatttggctaattgttgatccagatgtcaaaacttcacagagatttttttttttttttagttaggaaaggctaaacccccaagttctgagtgtgttgggtgaatagggctcatcagtagatgacgtgttccacactctgcatgtagtgtgaaagccacagactgggagtctggtttaaacaggagggaaccttcattttccctctagacacagctccagaaagctcctgtgtgcccagcactcttcccattccagaccacttcagtttctggcgtgtggatcttccctccccctcctcctgctcttccctattgtacccctttccctggatgcaaagaaggggaaataacaacaggaagtgttaattacccttctcacatcttatggatttaatacgtagtgatggtcctgggccactgagagtctcaaaattcatcacatatacagaagcgaccacatctgaggggcacagcccaggcaccacttcctgaaagtgagccagggaatagggggtgtggcgggggggaggcttcagcctggtgtagaaatcccagacattctgctgccatctccacaggagtcataggcgattcagaaccacagacaaaagcagtgtcatggcacgtttgagggcttgggcttaggaaatagatggttctggggttgaatctcagttcagatgagcagcctctcaaagcctcagtgtccatctgtaagatgggaatgattcctactttgtagaatagggagtttaaagaaaataatgtattcactgtgcttggaataggcctccactgacaagctcatgtttagtggcaataagtaatgaattagtttcctatgtaaagacagtctagaaattgctttttgtcttctaaagcataacacttcctttctctctctctcatttctttcaagactggggaatttcagagtttctcagggcttctttgaagaatgccagcgggcccaccttgagtttcctcactcctttgttctaagcattgcgctgtgccatggcgcagggtttcagggcattactatgagaaaaggttcccccagcaccaaagagtgggaatccctgtccacctccactgccagcagcctgaacaattcaaacagtataaagcagcaaaaatgactgcttcctttccttaatgaaatgttccagagaaggtaacttttaggaagaatgtaggttatcattaagggcaaggggcaaacttaaaaaaaagggtgcatgtttaactacatggcaatgtggaacatactggggggaagcccgcctaggcttagctctaaagctacattgttgggagaccttggctgtaggtgggccatctctaaagacgctagatcaggcattggacatagtcctttgcagtattcagaaaggctcctggcactgccctaggaagtgcctgctcaccgtgctttattacatggttagctcgttacaagacagatgcgcggctgtccagcagggcctgaggacaattggtatgattattagtctgtataacgatcatctatgtattaaaaactttacatgttgcttgatttcagtatgtaacatttaccctaaaaaccgttccatctttgattctgaacacgtccacgctttagagtcactctttggaatttcaattatggggaggtgctggtgactgcttaatgctgattagacaggtgctttaaaaatcactctatttattgtctatattttgaaatgcaatcttcaggctcaagggtcatgttataaatggtttaatttttgggaggtgggtgtccatggttcaaagtacaaagtattttaaataggataaaactatggtggctctaaaaaggaaaatgatcatgtaggtagaaaaaaatccaacaagacaactgtcattggaattcctattagaaagaagtacacattaatccaatacagacaccaaaaaactcatctggtctgagtctacttccatctccggaagcacaggtggctgaccttaaatgggaccagctgtcactaggatgtttttgtgtcgaacccagcaacagaattagagagatgccagagttaacttgcactgaggatactttccagccaggtgtctggctggaaagtcacagagctacgcatctagcaagaatcaaagcctggcctgtgagaaccacgcacagtgtggactcaggtcagggacactgcatgatggacaagggctttctgaattcctgaattcaccaggaattatgtccttagtccacctttcccacacacagcaagggagggagttggtgagctgagagcacagctactcaccagccagccaggctgatgcagtaagtgtcctcagtggtctctggatctgcaaattcaactgctacctgactggaaatgctagctctggggaccctcctaaggcccttcctcagatcataccaagcacttgggccttttccagacttagcaaaaaaaaaaaaaaaaaaaaaaaaagagagcaaggtcaagtagacagaaaactaaactcacaaccaattctgcttactttccaaaaccagctagtgagttgggataacttacgttcaacccaacaaccctaccttcacccacgtttatagcaaacaccgccgagtattagaatacaatgggagcgcagcagggcaggctgtggtatagaccagcatcaaaggcccctaaagtttgggtttcgagaaatgcactgtgagccactaattaaagtcttcactcactccctgatattgactattcatgatgccctgatctctagtgactgggtctctcctgggtaaattaatattcagggccctaaggtttattgtggtttatttattagttggtttcattcatttattcacacacatactatacatatatatgtagagtgtcattctatctatcaatcatccatctatctgtcaacaaaagttctctgaaaaaggaatttggaggaaagagactttattccagtgaacagtttgcaaaccagggagacacagcctccaatataaaatgaaggtatgttccaaagaacaaaggaagacttgggttttagagcaaaagttcccacccaggttcccaatcaggtctgtttattcaaattaaaaaaaatgaaatttgcttagttctgattggctgatacggctgagtactggttggttggttcaggtgagctctaaaagtcccaaagataaaaaggtgcaggtttgggggggatctcagcatacctgtatgacccctagtcggcaaatggccacttggctctatttcaaatctggacccagtgagccactaaggatctatattggaagactggcccttccaggttcacatttgttcacatctacctacctacctacctacctacttacctatctgtctgtctgtctacggtgtttataagtatcaagcatgcctgaaaataaggaagcatttgcacaatctctggagcatctcctactttttcctgcctgtccagttgctggagggacataggagcttgtctccgcttcttatcactgtcatcttcttcctcctctccactaacaggcatttggtgttcacacactgtataggacgctgggttagggactgaggtgaagactggtcccagagggctccctaaatagcaagaggccaacaggccacacctgtgaggtttaccagaagctaatgcgaaagcaggtcaccatgggtttctggaaaagtgggctgtctctattttgatgtggccggtctctgtggcaaccccatgaaaactaagaatgtccttattgacaggaaggacttccacaagactgatcctccatcagggatgagaattcccccagagctattcctgaggacatgcagggaaccacagaatctctgtgaacttggtgaatgagcctttccagagaggaatgaaagggcaggggcaggaagcaaggggaattccagagtgtgctgcactaggccccaggcccacggctctcactccttcctgcttctcccaaaggttccctggggtgtcccctgccttgagggagcttcctttgctttccatgaggacagccagataatatgctttaccaccagcaaatctcaccagtgaagatatctatgtgccctgttattcacaaagtgaggaggcagatgctggatgatggacagagcaagctgcgaccctgagggcccctctccgagctgagatgcacctggagggcacaacctcgagcatgaagagggtaaccagaatggggccctgggtgggcccctccgcgggcaggatgtgacatacttctagggagcattagggctcaatggaaactttccactaagacgtcagaggggaattgatgtgtagtgtataatcctcactttgaggcgctatgtacacgtagacatctacatgagagccttccttcttccacatggctgggcagataagtccacccacctgacttctgaggcccactgagaagtgacagaaagtgcaagaacaacacaggtgcatttcaggagaactgccaccaccatctctaaggacagctgcaagccaccctgcaaatgttaatgaattagaatgcaaactaaggttggggccaaaggaggaactggaggctctttattctccttttcacatctgctgggacctgtaggaaggggagtcgttagggatgggagaagggaaggaaattttcagctgaggcacaggttctggtggggagttctcactggcactgttgcgccccaggggcagcgtggatgtgtggggcatggtagtcagcgtgcatggatctgtgctcaccaccactgtgcctgggcgcttccatcaggtaaatattcactgagcaaccacccagtgcctgcccagtgctgggtgctggagacccaggagccaccacccagatggggccggccttgctgcggcaagagggtgctgggctctctgcagcattataggactcaaggctgacttgacctgctttgcaaactaacccagggcccttgtttctctgggtcacgtgctataggtaagatggccctactgttttacattctgttatctcaaaccagaatacattggctgaccagcacaaggcagaatgtgtgaaaacagaactttcccagaaaatctgggccatggggcccctgctctgaatagacgggtgtgaaatgcctgtgtctgtgctgttccatgcatctgatgaacaagctgtcaccttagaaaccagagggaagaagcccacagagaggtgaacacccaggaggcaaaccatggcatctggctggggcatccgggtacttggtcaagacctgaagcaaccattggctatgagggcttatttcccaaggaaacaaaaaacgcagtgtttaaagtgagatacatgcataaagcacccagagaagtcatctgcctctgtgttgcttgtttaataaaggcaggtgaagatggaacaggagcactaactcacaacaccgatttaaaagaagtcagctgtatcatggagaacgcaagtcaaagaggagttcttttcaagctcaagatgcaatctgctgcttttcctcagcatttgcctcaataaggaaccaatttgaatatttttaaacccagcatctttatggttcagtaacggggctgagagccctaaaatggttttcaaggatgtaagtacaaacatactgtgcattgtagtttccaataatgattgcaatgtcagatgacattgtatttgtcttctatcagtttcttaaaataaataaataaataaaaaggttgagggggacggggggcgggggggcagtgggtggtgcaaccaatcccctgccatctcgtctctgaccagtagagggagaatgaacttcattcagggcagcaaattaggcctcaagttatccctaggatgatggttatgtccctgattccctgggacggtctgggttcaggcattggtcctggtgttattactagcagtgctttctttcactctcaaagcatgtcagactaaatatgctgcatggtcactccaagctgagacacagaattctggtatgatcctcaacttttccgggacacttaagtttcatttttcatggaagaaatgctcggattgcctgtgcttggttccaccttgatacttgagccagctgataaacagcaacttcaaggctggctcatgttctctttccatcactttccttcccctccaagggcaggacttatactttcccagctgtgttgccataagaacttcccaacatggctttaggcttatcacaacacagctttaggcttctgcacgcatggctccccttcaaggtcaaggaccatggtggaatttgttgtgtgcccagcgcctggcacatggtctggtgcgcacacatactcaacaaatgctttgagcaccaaatgacatcaccggtcagcgaccctcagcttagcacaagtttgtggtcgtggccaggcagtgaatgaaccagggtgcttagctggaactgtttgttgctcatttcttaggaatgagtaactctcatgccctgcccgcctcaaaggcttgcaaaagaggcaaaagagcgattagagatagtggatttatttttgtgacccgacaatctggctgagctggatctgctggccatgggttgatatctggagtccccaagcaaatgggcccttcctccagcttttgccagactgacctggaagattggcttttctccctctttagagggagctcaggctaacaggtacttcttcagatcttttcaaggcaaacttgagaatggtgatagagccatgagctgaagcttaaatgataagcacaattagctagaggcggtaaggaaaagagggatggggtgttatcaatgaccacattcacgagcctgaattaacgaattcaacaggaaaaactccatctaccttctttatggcaactcctggcagctgccaacaacagctggatggctttgcaggactcttgcctaaaccagagaaagactaagcatcaaaggtagctcatcttgttaagaaagcatgtctttttaataaagtgcgatgtcactcatgaccaaaaaaacccttgcaaaagggacagtaacatgcagacagatgtgcacccttaccctgagcataaacgatctggcatgccttgcctcctcagccagagtctcaaatgcctgaagaatctgggtcttaagttttcaactttcgtctccttacctaaggctactccacaatttctgggtttagtcatctgcaagtgaatgctgggaaacagcctgtttctgttgattccccttatcaccaagcacctaggagcagggctctgtgaggaatgactcactctgggcagtaggacacatcttacaaagcaggggtgctcccaaaatagggagcttacttgttgggacacagtaagatgtttttccctttagaaacaatatgaatgatgcttaggttcctaaactgtctcagaagacacgtaatccaagtgtaggctgtgaaatgctagtgtgctgagttggggctgagagctgggcctggctggctgtgggcttctacagagtagttgcagccctgtgcacaggcagggggggtgtcaccgactcgcatgtgggcaggtctttgctgcgcatcaggtgctttaagcttcggaacaactgtgcaggattctattttagtattctggaagcatcattgaggaagtagtccagtgaagttagctctaaaaaaactctttactctaacaattaaaagaaatatgccaaaggatccataagggatgaataaattattaaactattaagaagttgctataaatatgcagtgttaattcaataattcataacggactggtacaacaagattttttaaggctcataaaatactgctggctttggcagtagctagtgtcctggggctcatgccaattgcttctttacacagcagcctgggtgtggggggcacagggagccttcccctggctggctgcccaaggactccaggtagaggacagcgcagggcgtggctgtggggatgtgccttcactgcctctccagccttgctgggggccaggcactggcttgtctctatggcttcacaaaaaatacagcagcggtgaagagggggagaattcacagcaccatgctgtggcagaaagcagcatcccgagggctgggcaacctcttgcctgaacctgggaacagggcgtcctgcctgtcaaataccagccagcctggtgaccttcatctccacaggtgcctttgtaccccagagtttcctttatagtccctgatctcttttacctggagcccttggggctacataggtttcagaattcaggatttttcaagttttataaaggcaatatgttataaaaatcatatatagtgaacagttctggaggggcttgggcagcaccccatattcaaacccattaatttttctacagcaaaatgtatggatattacactaagtaggatttagggaccataaatatcctcacatcagctcaatttttgccaccatgagtttcagtgtgaaaacataaagccctctgcagttttctgagtgctctggaatgtgtatttgccttggagacatgggcactttccgctcaccacttcctatgtgtctctgtgctgtcgcccagtctgctgccaagaaagggaaatggattagaaacaggtaagacggtaaaactgtcaggaggtaaaaagattactcctggattacatggagatgccatggtcagctctatacacttatctgtatagagtaaaattggattcattcaattaagtgaaacccttggcaaagcagaatagaacaaatgtaatcagggaattttccccaaattgtatcttggtcttttctgggttaatagaactgagcaccaacacctgtcttctgtttgtgtggcctttcactgattctagagcccgttgcctgtgatccctcagtctttcctgcgcagtgtacagggccaggagcccacaagcatcactgacctccttttcatacaggtgagaaagcagcttagaggtagacagtccctgtggtcgagggaatgggaggaagtggagccaggacaagcacgtgggtcctcaaactttctggctagctctggtcttcctacacctgtcggatgcacaacctcagaattgtggcccaaaatacattctgcctggctctcatcctgcaatgcaatttgagtagcctgtggtcaactaaattctggaaacactacttcctgtatcctcctctgagagactgaaatgccccttagtgtaatggggctctgagtcatcttaaggaaaccagattaacttcctttcacccatttcctgatgcgtttgaatcaggaagccttttgggcagaacttccattagcatcagcccaccgcggcccacactacacacggtcgtgacacatgtattaaaggctgagttgcaattgtgttccatattttatgtagaggtgaaggtggtttacacattttggaaagagttttacctcggaggctaaataggggtcacagtgatctagtgggaggcccaggctagggaatccatttctccatcctccttttctccaccactgggtcacgtgctgtttggtcactggaaggacaagtctgtgtggcagaagcctgggctctctccactgctgtgtgagaacaaggctgtgcatttggccccagcctttcagctgccttgtcatttgtgatgaaacagaagcagttccatgcagggccacatgccctcatggtgtgtactatctgggcgaaacctgtcagacaacgggcatttttcatagagaaaggagaactcaactttggtctaagatgctctctgccctcctgcagttttcctttcctactcagtatcatctttcatggggagagaagcagatttaaatgtaaggtgcagtcatacctttgagtgctgattttcttttgttatgatttgatatacctatgtgttgaaaaattccacaaattatgaaatccttggttaggtgggtatgctggaccaggtgtgcttggtgagacattagttccatgagccataaaaaaagtgacattcctttggggatttactgcccctgaatcatgtgagagccccagaaacaaagcatttctcaaatatgcatcattttaggtagatgagaaagaagccacagtcacctccgccctctggactgcagagagcttagctcacatcggcatttgcatccaacagcacaacatggaaagcagtacacaacaagaacaggcagaagtgtcttcataaacacattttgcctaaatattctgtattaaccacagccatccacttacagggtgttaggataacttttagttctaggtgcttgactataaaatgatggcgatacatcaactactaatgaacatactactaataatagctagtatttctttctgactctgggcccagaactattctatgtactggagacacattaactcatgtaatcttcacaacagtcagcttaggtaatattattaataatcacagtttacagataaggacacatgcacagagaggttgaataacctgcctaaggctacacagtgagtaagaggagaagctaggaaccaaactcacaagtgtgacaccgaagcctgggctcctaactgcagctgatgctttcaaatccaaacctcaaatgcattaatgccttatatggcttgggcacaatcttgagaatttattcaaatgttacctggtttgtcagaaaatcggacagagatggacttgttaagacaaactcactttactaatcagtgacgaggcagttgagaaacattttacctggaagaatttcttgtctcttgtttatgagacaaaaatgatgatcggatttgataaagacacacttttactaacctagaaacagtatccaaatttaatacattaaattgtacctaatgaagaggccaacagatgtgtgcacctgatcctatgctgtaggtgggagcactgccctcgagaaaagggctcagcattccagaaaagcccagaaaaacccgatgcacacggcatgcttcaggtccatcttcatgaacaacacgaacatcctgtgtcctcccctaattaggtaacctggtcacgcgcttcctcctttcttgatctgaattcccacaactataagagggaaggatggcaggctaagttcaaaacccacatggagaagtcagaggggactggccttaaaaaaagccatgggtctgtccccaagtcagtcggccagtttgcaacgtctgaggtggctggggctcaatgtcaaatgaataatgaaaactcaactgggcatttacatttaagccaagtgctatgaaggggaaggccaaggtgctaaaggagcacacagcaggggtttaaactggtttggagggccagtgagatttcagctgatatctgaaaggtgtagcttagtcagctgagcaagtgttgagaggcagacatgtgggtgggttcgggaatgggagaactgcccaagggtgcattctgccttttctcaacagcagcacaaacttgagtaatttaaagattcatattcaaaaccccgtaacaatgtggccccagcactgagctgagggcaggagagctggtggtgtgatgcacgggtgatgtggtgcataaactatgtggtgcacaggcagtgtgatgcataggtggtgtgatgcatgggtgctgtgatgcaggggtggtgtgatttgcgatcagtgtggtgcacaggcagtgtgatgtgatttgtgagcagtgtggtgcacaggcggcgtgatgtacaggtggtgtgatgcacgggtggtgtgatttgcgatcagtgtggtgcacaggcggcgtgatgtacaggtggtgtgatgcatgggtggtgtggtgtgtgggtggtatggcacacaggtggcgtggcataggaatcatgtgatgcacaggtgctatggtgcaaagatggtgtgatggatgggtggcactggatgagtactggctctgctcatcatccagttctcttttagattaaattctccatgaatcacattaatttggtgcctcaccccatgctgtcgctacctccaagtggctctaattcttatttaggcttgaaattcttaagagttggatgctacactgaagagctgaatcatcctttaatattaagtacaaaggaatttcacgggcaatacaaacttgagcattgttacaactccaggcagatataccaacaggcagattataaagggcatatgctgtcagagcagagaaataacttgggagaatataaactgaaatgaccactttgaggaggaaaatttttaaaccaaattattaattcttctctactctggaattgcttaaaagattttctatcaaatggctttcctacattttcagtatgacccacaataaaaacctggatcattttacattgtgatgcagtgggcacaagtgcacacacacacatagagacacacagacacagacacacacatatacacacacagatacacacagacgcacatacacacatgcacagacatacatacacacacacatgcagacacatacacgcacacaggcatacacatatacacatatcagacacacacacacacacacacacgcacatatctccctaaacaaacaattctgccccttgtatcctgggatgcactaatcccatgtaatatgggatctgtatggtcccatccctgctgatctccatccactcaactgacttcatgacccaccaacgggctatagcgtacagtgtgaaaagcacagcgactctgaaaccatgttattaatgataacagtttccacacttccacttttctttgtcatcgtaagcaatgggggaaagtccttgtgcggttgtgcaggtggactcctacactgcaggcccatataggaatgcgtttggggtcaacagataaggctctggatgctgtgaaatgttctcagcacctctaactagggtgcaggagcacaggagcacagctgtgcctgttgttgggtgagtgatttttctgacagagtaaaaccttatttcgttggatttcactaatttgaagttcatgttcattgggtcaaaggttataggcaacataaacaagatagtagaaagaatattaaaatcaaaagaccctcaatctacaaataattgatacgttcattacaagtaatcctcctttgtgctttcagtcacatctcctctacgaggaattcacctggcacctctggaatagacaagcatgtgccatggcttgatcatgaaagtaccaccatatttctttgtatttaataatctggatttttaaaaagcacatctgactaccattcactataattaacacaaatagctgaagttctactgtatgaggtatgcattataaatgtttttaggtttgctattcaggacgtgtacatgcattcctataaaaacccaggtgagttactggggaaagaagatgaataaaagtccgactatgcgatgctgcagccgtggagctcacacagtgtgactactgcatggtgtggtgtgccagacccaaacgcaggacactcccagagtaacgaggtaggtaagggagcccagtacatcaatcccaccactggggagagcttggaaaggattttcaattccaacctcattgcttgggtgtgttcaaaacatcccactgcactgcccagagggttgcctcgtggtcagatgggtttggcaaatggttaaacagggctgtgtggctttctccgaggcatggtctccaggccaggtcacaagctaaggtgcataatgaatttccaggagagaatcctagaggctgcttgcctctgaccacatgacaggaagccaaggagcaggcttggaactctgctgcacagcagggctcccaccctccacaagggcattgaaaatgcgggcaatggaccagaggctgacagttacccacctggaacatgtcccagggaatacccccaaagggaagagtgctgggcactgcagcccttcttgtattctttagggcaatgatgtcctgggacccagggcatcggtatggattcacctgggactggtcagaatgcacatttctatatactacataagccttcctcaaacacagaggcccagcgatctgtgtgtaaccagccccaggtgatgctggcgctgctcgaggctgattgccaggctctgtgatgagggagaagtgcccacataaaggggctgcctgggagtttccgtcacctccaccttcagaaacaaaacagggaaaaatcacttcctcagcaaacgacccctccccttccctcggctacaaaacaatccagccccgaagcctcagggagaggtggctagggcccttctgagggcctgcttttggccaggggccataaggaagccttcacagcctcaatcacaccaaatcccctgaaaagtcctgtaaacggatatcacaggcccatctccaagatgagaagctgaggctcagggagttgcagttatctgacccaagccacagaatggccctggcagaggcaggtttagctcctgttctctgtgttcaccccactgcactgagaggcctcctgggaaacgtgtccacagccccaatacggacagaaccatgagggggccacagaagcctttcatggggcttagaggccacagagcgctctgagtgaggtcaggaggcctctggcatcgggcctggaagtgtggtgggatgatgggtgtgctctggagggtgcagaggaaggcacgagggtccacaccaatggacgggctggtgggaagcacagagcctgggagggtggctggagaaggtgccctgaaggcaggacgtgccttgacttctgcgggtgacagggcaagcaggctgggagtgtccttcagccctgcacctgtgcctgagtcccaatcaccgggtgttaagggacactgtggagtcagtgagaagcaggtatgaaagggaggggcaaatggaattgtctgggacaactgaaggtatctcaggcatctgcatcaagctgcccagttagcaataccaagctgagccaggggaagtggtgagggctgaggggttgtccgcagaggcacggtgtgagaaactgtggctgaaatgaatttaccctggagtgtgttgtgtgaggacagaagagacaaagagaaaaggcagtgcagctaataaataacaactgaggtctttaattaaacatcagtgaatctaagacttgaactcttgaaacatctgaagttgtcaacgtgaaataaatatggccatggggtccacactcccatgttttgaaatgaggggagagaaaagggttttgctctgctgtacacagcaaggggaaggtaggtgtgagcagacctcgggatcagcagggccaagagcagcgcatggctcccagttggtggctgaagtccgctcacccggggtggcctggggcttttaccttcatcagaatttcatttgaactttgccctgatgccaggcgatccatgtctgcatccaccctctatgaaggccagcctcagacagggtgggactggagacaaaggtggtctcaccggggcgtaactgccctggtttgaggaaggagcagtgtttacaggattctcctaatgactgcccccacactggtcctctgaggacacacgtgcacctacctccagcgtttatgctctgtgagagccataacttctacgctctcttactctatcggcattaaaaatcctctgaactctgacagcgcttcctgtgtttcctggagtcggtgcttctcaccaccctgccctccaactgtctatccccatcttcctgatgagacctcagccaccttactctgggtgggacgtctgtttactctttctcacacagtgctctgaatagagcctcaagaactgctgattcactggcttcattaaacccaagtttgggactcaagagcaagttagtttttcattgaaaaatgacatgtgtctagcatttgcaagcactgcgtgggtacaaagtaatatactacataatccttcctcaaacgcaggaccaggcagggcaggaaggacttgaggcaggcaaccactgtgtgccaagtgagaggctgttctggctgaatttcacccccgtccttcccagcaacacattcctatgttgaagtcctaactcccagaatctctgagtgtgactctacttggggacagggcctttaaagaggtgattaagttaaaacaacatcattagggtggaccctcacccaatatgattggtgtccctataaggggagagcaggacacagacaggcagagagagaagactgtttgaggacacagggagaagacggccatctacaagccaatgagaaaggcctcagaaggaaccaaccctgctgacaccttggtctttcaacctccagaactgtgagacagcaaacttatgctgtttcatccacccagtctgtggcactttgttaaggcaaccctagcaaactaacacagcaacacacacagcatgtgcagaaagaattcggatgggggaagctcctgtgggctggggtcataaggtaaggctttgaaaaagccgcttcagtggggcctggaaggaccggcacaattcagggtatggagggactgggagacccctccacataggaagggcaggagaggtgcagaggaggactgagcacggtgtattctgccgagtagattctggcctctcaggtcctgattcatggaaaaggtagacattgatgtctgtgaggagggctggatggggtgggggagactgggcagggccttaaatgaccggttacaaagggcaggaacccacaggaccaacatggcacaggggagagagttctagactagggcaagggaagccctgtgggtctacacattagccttgaagctggcgggaatgcccttagcttctcagggcttctgttattcagttgcagaatgactacattgaactctttcagtggttatcaacttctctgtctgtagcagtagatcctgttttaaaacatcaaatctgaatggaacctcaagatatcaaatggatctaggtggggctcctattgaagtgggggagggagaagcctgaggtggaccccaaggcatctactcattagtgcaggcctccatacgacacatgtacccatgaactaggctgagggaaaaccaaccaaccagccgaccaaccagccaaccaaccagccaaccaatctgccttacatctttatctctgttgacatctgactgatatttaacatgccctctcaggatgaactccacaggcaaccttcccaagccaaaggctccataatcgattcctaggaagcaaaggttacagggtggggaaactggaatctcagcaagacaacctaacattggaatcgaaggtcaactgactagggcaagactgagacaaggtgaccagtaagaggttctgtggctaaccaagtctaggatctgtggcagtcagagcagttccttgtgggagttacgttccaggcacgacagcaggactgggctgggcagcagaggaggagatcacaatgactgattttcaagcccaggaggagcagggaatgagggaggcagaagagtgaaacagagaaccaccaccaacagccattcataacgtgctttatcttgctcaaggctggcatcttctcatctgacaggggttactgttttacccccactttccagctaagaagcccccctgagagctgaagtgttttccacaatcacacaggcaacaggtcccaaagctggtactcaaacccaagtctcctgccccaagccctgtgcactccgtccactagaggctgaggtaaagctggaccagcaaggagccgtccctccagccagcaggcacgcctggtgtgctctggcggggaagcggggctgggcaagtgctgctgtgtttattcctcattcgggtgatgacaaaggcgggaacatgcaagttctctaatggacggtaaacagaagaaagcagaggtctgagaactgaacgtcagggagcagtcaagatcccatcaggctgcccatgtatttcctcttaatatttgacaatgaaaagggtaattaggactcgcagcaaagcagccttgcaatggaatcacttaaactaggccgtgggttctttccacatggaaagggcatatggggtgtagaaccgtgagagtcacgctgagatccacacctttggaaagttgtctgatgtaataaaaaatgagagtagacatatatgttttgacgtaacacagatctaggaggtataaggtaaagattcttaatctaatgggcccagaaataaaattcaggacacccatgaactaggctgggggaaaaccaaccaacaaaccagccaaccccacatctttatctccactgacatctgactgatatttagccggccttctcagggtgaactcagcagcatcagcagtgcctgtaattttttcatcaatagaaatcacagatattaatagttttatatcacattcctgttgttgcacatacctagaattaccgttgacattcatcactactctaaagtgatggcagtgatcagacctatcaggagaccttgttattaaatcttaaaaaaaattacaatttaaagtaatattttgataactgtacctcatacttcttacggcaagaaaacaggtaatacaaataaaaacaaagtcaggaaaaatatacagaaaaaaattcaaaaggatttgaaaagtgaggaagcatagatatgcagatacatggtgatatggggatctgtgtcccaccaattctcatggtggaatcataatccctaatgttggaggctgggcctggtgggaggcgactgcatcatgggggtggatttctcatgaacggtttagtaccacccccctggtactgtcctcacagttgtgagtgagctctcgtgagacctggttgtttaaaagtgtgtaatacttcccctcttgctctcttgctcctgctcccaccatgtgagacgcctgctccccctttgccttctgcctgattggaagctccctgaggcctccccagaagcacaagttgccatgtttcctgttcggcctgcagaaccatgagccagttcaacctcttttcttataaattacccagtctcaggtattcccaggtatttgcactgctatagggcaaaaatggactaacacatacgaatatacagatatgcacgccataagggtctctgtgtcttccagagttgtgccacaaatgtgacttaaatttgcttgtgtccaaagtgcagggagttatatggacagttgctgagttcctgtttttggaggagaggaggaggccccaaatgtaaaatgttggagaggttaaagacacagtagcctgatgtcccttgggtttggtccttggaaggatgctgctgtacttgcactagggagtatttgtgaagtaataggaatggcagccagattacagggcccaggacagcaacaggagcaacttccaacccatcaggctgatgccccacccacctccaggtgccactcactccagttctaaacagtgcctggccacaccttgcaccactccacccttggggacatggagtagaagcctgagctgccgggggcttcctacagcaaaatcttctgagcttgagaaacgcaggcaaactggcaatgtcttgtgggtcaattaccaggcagttcctgaagacccagcaaaggtacttttgaagaagctgctgggtcatttctaggtacatagcacctctcagaagcaaaagaaaaatgctaagaagaattaacgcagttgttaggaagtgagtgagttaactaaggtctcaaggaaaacaggggtgagtcttccgatgccacggagagaaagggcaggctgctgtaggcagggaggctgttagcctcatttatcattcatgccccctggccctgggaactcaccatggaattccaacaaggagctggcactgaggtatttattgctttctttgcatgtcagcttgtcacacgtaacaattaatttgatgatcccaaattggacctgacaggaaacctctcgataatacaccatgcctagatttagcagagataaacactgctgttaatttctccagcagaggatgtgagtatcaacccagggctgctttcattaatttccatctcacacaatgtgggcccacctcatattggcattgctccctttagctgatagctgtggccagttttagaagtgtggtgtcctagggttgcctgccaatcatttcccattttcaaagtgatgagaacgtgacaggggacacagacattgagctccatcggtgaagaaacagcgggcagaatgaagctggataagccctgaaactgctggtaagaagataaaatgcgactaagagaaattgtgctttcaatgaacttttcaggaacacatctatcgtgcagagtaaactccttcgaagtctagatatctgtgggtagtaagaaaaaataatattttttctctccctccacccctatactaactgtgatggttagtactgagtgtcaacttgattggattgaaggatgcaatattgatcctggtgtgtctgtctgtgagggtgttgccaaaggagattaacatttgagtcagtgggctggagaaggcagactcacccttaattgggtgggcaccatctaatcagccatcagcaaatataaagcaggcagaaaaacatgaagcaagagactagcctagcctcccagcctacatctttctcccatgctggacgcttcctgccctcaaacattggactccaggactccaagttcttcagttttgagactcggacctggctctcctggctcctcaagcttgcagacagcctattctgggaacttgtgatcgtgtaagttaatacttaataaactcccctttatatgtatgtatctacctattagttctgtccctctagggaactctgaggaatacagattttggtaccaggagtggttgtagaggaacagaatattaaggatggagttctttcattggttttggggtttctggagttggttgcttaatatgattagaccccaaaatgctaaggactctgcttctaatagtatggagaatactgataagtcctaggcggaaactgtttagacttatgcaaaataaatgcatttggcactcctgattcaccgcttgtgagaagcaaggagttcactcactctatacataatacctttgaccatatgtggagaaccaaggaacataatgcagcttgttggttgctcccaagttcagtggacaaactgatgaaagaaaatgatgaactcagggattctgtctccgggcttcagaagcagatactgaacctcaaatctgctaagattgccctgagtgagagtcttacctcctgtagagaaagagctgaaattgtggaaaaacagacacaagcccttatgatgtgagtggctgacctgaaacaaaaggttcgtgcacagcctcgccaggtgtctactgttaaagtgagggcattgattggaaaagaatgggaccctgcaacttggaatggggacatttgggaggaccctgatgaagctgggcacactgagtttgtaaactctgatgaaccatttttgccagaaggaatttccctattcccagtagtggcaacatccccttcccgacccatgctgccaccagcctttgcacctctgtctgaggagataaaccctgcgctgcctgagggaacagtgatgacctcttctgaggcagttgccaggcaagataatgttgattctcctcagaatccaccccaatacctctgtttgctaattagataccaaggtggcaggggccaagtggcagcactcgaccatcaaaggcaaggtgggtgcagctacgacaatgaacggcagaggcaatgaggcaatcagaatagtctgactagtgtagagctatggcattggctaattaatcacagtgttcctagaagtgaaattgataggaagcttactgcattcctacttaatttatacaagcggaaagcttctaggtgaaatggataaaagactaatttgaattagaaaaacagaatcacggctcctcaatcaatttccagacttgagtcagtttacacacccagaaccccttgaatgaaggggaggctgggtccccttgaggaaggaccctactacattaccaacaatttatgcaacaaatctttctcccatctttccccaaggtgacctctggctttttaccagagtaactgtggattggggaaagggaaatgatcagacatttcagggactactggacactggctctgagctgacgttgattccaggggactcaaaacatcattgtggtcctcagttaaagtaggggcttatgaaggtcatgtcattaacggagctttagctcagatctgacttacagtgggtccagcgggtccctggactcatcctgtggtcaatcccccagtgccaggctgcataattggcataaacatacttagcaggtggcagaaccccaacattgactccctgactaatgaggtgagggctattatggtgggaaaggccaaatggaagccattagagttgtctctatctaggaaaatagtaaatcaaaaacaatattgcattcctggagggactgcggagtcagtgccaccatcaaggacttgaaagacgcaggggtggtgactcccatgacatccctgttcaactctcccatttggcctgtgcagaagacaggtggatcttggggaataacagtggattatcataagcttaacctagtggtgactctaagtgcagctgctgtgccagatgtagtttcattgcttgagcaaattaacacatctcctggtacctggtatgcagccattgacttggcaaatgcctttttctccatttctgtccataaggcccaccagaagcaatttgccttcatctggcaagaccagcaatacacatttactgtcctacctcaggggtatatcaactctctggctttgtgtcataatcttattcggagagaccttgattgctttttgcttctgcaagatatcacactggtccattacattgatgaccttatgctgattggatccagtgagcaggaagtagcaaacatattggacttactggtgaaaacatttgcacgccagagaatgaaaaatcaatccgactaaaattcagataccttctacctcagtaaaatttctaagggtccagtggtgtacagcctgtcaagatattccttctaaggtaaaggacaagttgctgcatttggcccctcctgcaaccaagaaagaggcacaatgcctagggggcctatttggattttggaggcaacacattcctcattttgatgtgttactctggtccatttatcaagtgacccgaaaggctgtcagctttgagtggggtccagaacaggagagggctctgcaacaggtccaggctgctatgcaagctgctctgtcacttgggccatatgacccagcagatccaacggtgctggagttgtcagtggcagataggggtgctgtttggagcctacagcagggccccataggctaatcacagcagaggccactaggattttggagcaaggccctgccatcttctgcagataactactctccttttgagagacagctcttggcctgttactgggctttggtggaaactgaacatttgactatgggtcatgaagtcaccatgtgacctgaactgcctaccatgaactgggtgctttctgacccatctatccataaagtgggtcatgcacagcagcattccatcatcgaatggaagtgatataaatgtgattgggcttgagcacgtcctgaaggcataagtaagttacatgaggaagtggctcaaatgcccatggtctccactcctgccaccctgccttctctcccacagcctgcactgatggcctcatgaggagttccctatgatcagttggcagaggaagagaagactagagcctggttcacagatggttctgcacaatatgcaggcaccacccaaaagtagacagctgcagcactacagcccctttctaggacatccctgaaggatgcagtgaagggaaatcttcccagtgggcagaacttccagcagtgcacctggttgtgtactttgcatggaaggagaaataatcaaatgtgtgattacatactgattcatgggctgcagccaatggtttggctggatggtcagggaggtcattccaagcggtctgattcaccgtttgtgagaagcaagtttattgactttatacataatacctttgaccatatggtctgaccaaggagaccatgggcatttgagccacttcctcatgtaacttacttgtgccttcaggacttcctcaagcccagtcatacttacatcacttccatttgatgatggaatgctgctgtgcatgacccactttatggcttgatgggtcagaaagcaccctggatggctagggacttcaaagaagcatgattggaaaattggtgacaaagaaatttggggaagaggtatgtggatggacttctctcagtggtcaaaaactgtgaagatatttgtatcccctgtgagtgctcaccaatgggtgacctcagcagaggaggattttaataatcaagtggatgcgatgacccgttctgtggacaccactcagcctctttccccagccacatgtcatcgcccaatgggcccatgaacaaagtggccatggtggcagggatggaggttacgcatgggctcagcaacatggacttccattcaccaaggctgacttggctacagccactgctgagtgcccaatttgccagcagcagagaccaacactgagccctcaatacggcaccattcctcggggtgatcagccagctacctagtgactagttgattataatggaccttttccatcatggaagatggcatcatggcagaaatttatcctcactggaatagacacttactctggatataggtttgcctatcctgcatgcaatgcttctgccaagactaccagccgtggactcgcggaatgccttatccactgtcatggtattccaaacagtattgcctctgaccaaggcacgcactttatgactaaagaagtctgacactgggctcatgctcatggaattcactggtcttaccatgttctccatcatcctgaagcagctggattgatagaacagtggagtggccttttgaagtcacaattacaacactaactaggtgacaatactttgtagggctggggcaaagttctccaaaaggctgtgtatgctctcagtcagcctccaatatatgttactgtttctcccacagccaggattcacgggtccaggaactaagaggtggaagtggaagtggcactactcaccatcacccctaatgatccactggcaaaatttttgcttcctgttcccacaacattatgttctgctggcctagaggtcttagttccaaagggaggaacgcggctaccaggagacacaacaatgattccattaaacttgaagttaagattgcctggacactttgggctcttattaccttaagtcaacagggtaagaagggagttacagtgttggctggggtgattgacccagactctctagatgaaatcagtctacaactccacaacagagataaggaagagtatgcatggaatacaggagatccattagggtgtctcttagtcttaccattgcctgtgattaaggtcgacgggaaactacaacagcccaacccaggcaggactacaaatggctcagacccctcaagaatgaagcagggaaaaaaccacaacctgctgaggtgcttgctgaaggcaaagggaatacagattgggtagaagaaggtagtcatcaataccagctacgaccatgtgaccagttccggctccagaaatggggactgtaattgtcatgagtatttcctctttcttttgctaaaaacatgtttgtgcatgtatacacttgtactaagaaaatatctttattgtatttccttttcctttattgtgtgacataagatttactgacttcatatcagcatttaagtattgctaatcttatgtaatagtatttgggttggggatcagtgcgtttctggtagtacaaaggatagttgtattatgttaggtgtaattatgatcttattgtatttgaagattatgtatgatctcaggaaatgtgtatgggttcaagttgacaagggatggacttgtggtggttaataatgagtgtcgacttgattggattgaaggatgcaatattgatcctgggtgcatctgtgagggtgttgtcaaaggagattaacatttgagtcagtgggctggagaaggcagatccacccttaatctggtgggcaccatctaatcagccatcaacaaatataaagcaggcagaaaaacatgaagcgagagactggcctcacctcccagcctacatctttctcccatgctggacgcttcctgccctcgaacatcggactccaagttcttcagttttgaggctcggacctagctcttcttgctcctcaagcttgcagacagcctactgtgggaccttgtaattgtgtaagttaatacttaataaactctctctctatatatatacacatacatatgcatacatatacatatacatgcatatatatacatatatacatatacatgcatatatatacatacatacatatatatacatatatacatatatatacatatatacacatatatacacacatatatatacatatatatatatgttcacgactgcaagtggtcagatgctggctgctataccctgcctggacccagatgccacagcaatgtcaccttaatgaaaactatatgggggaaaatgacaacatctaagtgacaacacttcacccaccaatagcaacgcccttctcacacccaccacccaacgactgatactcatgccaaatctttcttgaaattactattccccaccatcctttacagactgcacttaagaaggaaggagcccacagaaccgaatatcaatcacagaagctgcatagccagacattcagtgttcgatgtaccgaaaaatcctctttacacgtctttatgcttctggccactacagccgcaaagtccagccattagaagggacagccatctttcagagtcatgtcccttgatgaaatgtcaatgccaaagaaatatagacagatatgccttatgtattttgccatgtctcctccctcttgccatcacagtctcctctaaaagagtaagcaactaaaaaagaaaagctaaatgttcagtccctgtaaaacaccatttacaataacaaactcacactgatagaaaagggaagatactgtattaatagcacatcaggtcaaaaaattagaacataagaatgataaaaaccatggcaattaattcaacgccctatatatagtctatcctgtaaatataatttgatttgcacagagctcctcagctggctattagtacagcgatcagctcaggtcttctaggccagtccttgctttgcagcacgatgccttgtaagaacaattcagtggctacaaaaccttggaaatagtacttaactcctttgggtcatccaagcaaaactactctcgtgaagctcatttcattgggatattggggaaagaaatagcagagaagggatggaggcacataagaaacaatcattaagaagacccaggcaagaaacaaaacaattcttgagcattttaagtaaagaaaaaggcagcatgttacagtcactaattaacacatagccctttctgaggagagattctatcacaggctccaggccagatactaaagcaaaagaatgtgtgaaaccaaactcctacctcattaaagatctctggtctgagttggccctacatgttattatatgccattatcttcatcttcattacaatgctgagttgtgacaccttctatgttgacagagctcctaaggatacagaaggagagtcgcacatcttgctctgtatcttaggggactgtctgctatccaagtgtacttgcgggtgtctatttggaagattattgaagtaaatgccaaaatacaaacggtgcattgtttgggtgcagaaaaaaacatatagcaaaaaagtaaacctgtgggatgtgttcaaggcaccatacagcaaaggcaatccatttccttgtgctaccctcaaaatgttatacaataatttctggtaaaaactctaaattaaaacaatttaaaagcacagcacctctaatcctgtttaagcctgaaatgatttataaatacctacccaggaactactctgccaccaaaggaatgcagatggcctcagtgaggattaatccatctctggaaggttcttgaggactaacttatcctttcttattttctccagagtctagcaaggttccacctctataacagaaaccccatgaatatgggactgctgttaattcacgctgtgcttttagttcttttcaaagcttacagatattcatatttttccctcattttcttttctctataaaagtcccataagagaaagagacacatgcacaaatcttgcactacagatgaggaaacaggcaccaaaggttcatgatttaccaggggccacccaggagcaataggccagcaccccagggcccatcagcttagggctttcctagattaaatgctttacacacatttcaggtagaccaggggaggctggctcttgtggactatgtgtacctaaattgcttaagagtcataaatgtggtccaagattttcaaaaagtcataaccagcacatgaactaacagaccaaagactcagcctaggtggggtcaaactaaagctgcagaggaaacattcctcctttctggttctgtgtccctaatggatgagggctccagtgacttggagggaagagtgctggtgctccccagggcctctcaacccgggtgcgcagccatctggacagagtcaagctctgacaaacccaacagccgccagggggtgtagctctctactccccccaggaggagaaggtgggggttctgcagctgtgtgctgacttgagcttcttcctcccccctctccccttcaggctcccctctgacccaacaccccatgggcttggcctcgctaaggctgggaaagggctgcatttgtttctatctctgatcacatttggaatccctggcaaagtgaaaacaaaccttccattcttcagccgtgtttgttttgggcccatttggcaccacccttcccatttcaggcttattttttttccacttatcgtcatcatgaatttggtagaggtgagtcattggttttaaccctggctccagcttcctctcgtttgtacttttccagtctaatttcctttatttgcagcgccttgaaagtctccaatcgctagcctctgacatggttatgccgggtcctgagctcgggctgtctccagtcctgaggcgtgtgggctcctgcacgctgggccaggggtttctgagtggttgttgtgttcctggttctgaggctcctgcccacaagatccgaagactcaccagggcagctgctgaccttcaggtggaggcagggagcctctgcagaagccggtgccgctgcagagctgctccaacactgccgtggtgtcttataaagccacaaagcttgagttgacaattggggtagaaggaaaatcactgaaactcctctgtcttaaatgagcttgatggaaagcagtccctaataatacaatcctagtgctgaaaagatgtctctcaacttaaacatttgaagtaggattttaggctttcttctcaataatttccccacaactctttgggaaaaggtgactagttaacagagcagaaacggtgggcaggagactggaagtctttggagtcacacatttggattcacatcttatttgtcagttactttggtaatgaccttaggcatgccattagtctttctcagtagatatacctgaccacaaaagagagtcccaccacttaccttgtaggatgtgaagactaataagactaagtatgtaaagcacctggtctaaaggtagctgtatttgctgttatttggctattagacttcctgaatactgctgaattgcttaagtcatactggggacaatcttctaaacttctcattccccaaggaccgattaagttgagacataatcataaagtcaacaggacacatgacagatgctttcaaaatagattcaagtcccatggaaaaaaatgttcaattctgcctgttggacagttgtcatttatactctcttccgcctcccctctggagtccttataaatatggtggccaattaggaagttatcattactcacccacagtgaaagaataaactgttcatgaaccattttctccctttaacacagtgttcatacatttctgaaatgtgtaggcttcacttgcattgcagagactgggatggtgtgtgtgtctcagataagtgctgctcacagcgtggtggggaacaagcagcaccactaactctgggagctcatgagaaatagtctcaggcccaccccagccctgctgaggcagaatctgcattctgaccagattctcaggtgatctgcaagtgcattcaagtttgggaggctccttggtcacacagaggaggcagaggtgtgacggtgaaggtgccggccccggcccaggaggcggggttctgactgctcttcagcccctgccacttcagcttagctgagggacaacaggcgagtcatatcaccctccaagcttaccctcgttacatccaaaattgtgaagggcctgaggttttatgtcacttgtcagctaatacgtcagcctgccactgtgtgtgcatgtgtgtggaaaagtgtgtgtgtgtgtgagtatgagtgttcacaacagaaggtgcaagacctctgagtcagagagagcagaaagaacgacatcttagcactagtttgctaagtgccagtccccacagtgatgtgacatggtgagggccaagtgtcacttatgcatgtagtggaatcatcacagaagagaagccccagaattagggaacgctgaccttgtacagggctgctggtgaccttccctctccactgtcgagagggagagacagagacttagcttgatcctggaatgtaagcaactgttttagggaagtggaagggaaacttctgtaagctgtattgtcctaaaatgtctccttatacgaacattattaacttggctgtaaatgtctttgctcagaggacctggactgtgcagaaacatgacatgtccataggaactgtctctcaatgtgcccatgtgtcaggagaatgggtggctggcacacagcaggcaacagtacctggccactgccccgggggagcttgtagtctgagaaccacccacaatggaaccacagtgtcatgagaggggaagtcccaggtgcctgtgggaacgcacaggggtcagcacaccctgatgaaggcagggctgtcaggaaagggttcctggggctggcttccaagctgagacttgacgtttggattggctggttctgagtgccaggcaggaagccctgacagtcggccgtgagagggtggtggggatggggcctgctgccttgctcctgatgctcaagggcccgacttcattctgagggtttagatgggggggactggggagagggagaaatacatgttgattccctggttctggcttggacaactcaatatccaagttatgagagcctagtaacaagatggaaaggggagcagagtttgagggacgaaaatggtgtgctgtatgtaggcaatctgctatgtttctgggagtataaattgagatatccaatctatgcagtcatcccttggcatccatgggagagtggttccagcacccctgtggataccacaatcccacagatgctcacatccctgatataaaatagtgtagtatgtgcatataaccttcacacatcctcccatatactttaaatcatctccagttacttacaattcctgatacgatgtaaatgctatgtaaatagctgttatcctgtattgtttggggaacagtgacaagaaaaaaaagtctgtacctgttcagtacagatgcaatcatccatttttttcctgaatattttcagttcacagttgggtgactctgccgtgggttgaacccttggatgcagaacccacagatacagaaggctgactgtctatgattaacaggcaaagaaaagaacatgaaggcggttgtaacttacttttttttcctggatatcagaaagtgaaatgctatttttttgtatttatttactaatatttgtttacaaatatttattcttttgagaattatttgttcatcttcttttgaattcactgggaatttgatgtgtttatgactgatttatatgaacttcccattcattttcagtctgtattaggttttcagctatcactgctactttttagaaaccttaagtgtggagttacttaaaatcctgggggaaagatttagactgagcccaaaggataggccaaaaagacaaaaaagaagacctctgatggaccaagactatgttcttttgccctattttcagagcttcagggaaattaaatataaacggatgtatggacaagtcaattctgagtttaagaaattaaagcagtgctactaattgataattttactgatttgttaatgttcttgagaaaacttgaccttccagtaagtccaagtaaacagatacaatcaccaaactcctgggttcaaattaatcacacactaggaaaaacatgtcttgccttagatacaactttcgatcacgaccacagcactggacagggggctgaggggctaacccacgaagaaggtctggagagatacccctacgtggcacccttgtgtcaaagtgtgaatgaattggggggagagatgcggagaggaagaggcagggggagagggccagtcagccccatccccagaatcaatgacatcatttattctgcttttttcaaaatgaacattgatgctgttcccccaaccagtacagattcaccatatttccacctatcgaaattctatgtgctcttttaggttcaaagagtatcaactttctcatgttaattaaacagcatgttaattgacaacatccatgttgttaattgtcctagtttttttctcaacccacggaacttatttaatattgcagggtatcaacaacccttttcccacaaagagtgtaggtttcaaaaatgtcaaaacaattccctcatgcccactttccactgaagccaggtatagctgaaagttaaccttagctacagaggtcatgctctgctgttctgtaggtaggaatgttagataaatgcaatgaattcatgctcttataatcaaacaaactttataccccaccaccatctttgaaaataggcacccatatcagaacatgtgtatttctactccatcatcttagcttccctccccttcatttcctacctcccacgatgctcccccaaaaagtaaacagcaattacttctcttaatttagattggccaagattgccctaaatttcattatcactctgaaactgctacaaaggaatgctcaacagatgtcatttataatcttctttattcctgacttagataaattcaaagtgatctagttagaggttttgtcaaattcttggaataccaaagatgtcccctattttccagtgttctttcttcggttgtccctacctagaatgccagagcaactacagccaaccacattctgactagcacaccaaacactcttgatcgtgcctagtttgcaggatccttagcctcaggcttgcccatacatcctgaagccatgtccacagagatgctactccagttccccttaacagaaaattcatccttacggcgaccccaagttaacagtgaagcagaagtgctcagacatccaggaactgccagagcctgcctggcgagctccagcatgcacttgtgggcccacgaggaccctgcctgcacagctgtgtcctgggacagctaccctagcatctgtcttcatttcctctttccacatgcattctgcagaaggccttggctaccattaatggtggttacgaaaattcaatcaggctgtcctcacaggcggttttctcaggagataaagacccttcactgccccttgccttctgtgctttctttgcagcattgctaagtctacttgccacagctcatcttcagctgtccatgtgcttatcatctgttgttcccagtggcatggctgccctgtgagaagagggattttgttttgctcactaatgtgtccccactgtgtagagtacctggcacagacgaggcacttacagacatcaggggaataagcaaatgcccacgtgcagcgagtggatgctcagatgtgcgtgccagggaaaacagctaagggctgctgctgaaaaaattatgaggacacgaaaccctgtcctatacaaatctactacaagagtgggggactgagagccccggtgggggggaatctttctctactgagagccctggtcgagaagaatttttctctactgagaaccctggttggggcaatctttctgtactgagagaccgggtcggggggaatctttctctattgagagccctggtagggggaatctttctgtactgagagcccgggtcagggggaatctttctgtactgagagcccgggtcggggggaatctttctctattgagagccctggtaggggggaatctttctctactgagagccctggtgggggggaatctttctctattgagagccctagtgagggggaatctttctgtactgagagccctggtggggggaatctttctctactgagagccctggtagggggaatccttctctattgagagccctggtggggggaatccttctctattgagagccctggtgggggggaaatctttctctactgagagccctggtggggggaatctttctctactgagagccctagtgagggggaatctttctctactgagagccctagtgagggggaatctttctgtactgagagccatggtggggggaatctttctctattgagagccctggtgggggggaatctttctgtactgagagccctggtggagggaatctttctctattgagagccctagtgggggggaatctttctggactgagagccctggtggggggaatctttctctactgagagccctagtgagggggaatctttctctactgagagccctagtgagggggaatctttctgtactgagagccctggtggggggaatctttctctattgagagccctagtgggggggaatctttctgtactgagagccctggtggggggaatctttctctattgagagccctggtggggagaatctttctctactgagagccctgcgggtggaggaaagggaggaatctctccatggctttggctggtgccagttttacctcagaccctggacctggattctgatctcttgctaccagctgcattggctttggatcccgagccctgtgtgagggttcctgaacctcactgcccaggctccaggtcctaacatctggctcagcagtgctccctgcacttcattccttttctgtaaagacctgggccacctgctcatccccactactccaggagacctccctagcctggcttctgcccggccacactgcctgtggtgctggtctttgtgcctgacttcccaacctccatgccactgtaaaccacatatctaaggcaatcttagcaatgtctgacttagggataggcaggtcacctgattctggccaatgagtttgctagggggcttctggcgaagctttacttgctcctaaaaagagatgaaagagaagatgcctgtttcttcctctcaatgccacttgtctgggtgtgaagcatggatctactatggccaaccctctgccagcctgtggaggcagctgctctaggaggagggcagagaggtggccctggaaaagccccaggcacccacctctcctgtggtcaaccccatcctgagacttcttcaaggagtcaatgtgtccttgctgcctgggcctgcagcctggctgcatgagatgcctctctccccaaccctgaagagtcctgatgtccctgaggagttcagccatggacctccagaaagtcctgtcaccacagtgagcttccgctttctcagtgatgacaatgtgcaggctgaacctagccatggttcccaattttcatgcctaaggacttcctttttattgaggtaacattcatagaacataaaatccattttaaccaccttaaattatacaatttagtggcttttaatacattcactatgttatgcaacccaccaccaccatctaattccagaactttcatcatcctcaaaagcaatcgatacccattaagctgtcactcaccattcccctttttctcctcagcccctggcaatcagtcatctgctgcctgtgtctatgcatttgcttattctggatatttcatataaatggccttgttgaatatgtggcctggtgtctggtttcttttatgtagcacaatgtttttaaagttcctccatgactgtatcattaatcagcacttcattctttgtatgacttaccatgttttgtttctccactcattggctgatgagcatttgggctgtttcaattttttggctattgtgaataatgatgggatgaacattcatgtacaagtttctgcttgagcacttgttttcagttctcttgagtgtatacctaggaagggaattgccaggtcacatggaaatgctgtttagctttttgagggtccatcaaactgcttaccacagcagcaagggccttgttttttgttttaaaaatatttttattatggttaaaacacttatcacaaaacttaccatcttaaccattttaagtgtacagcttagtagtgttaagtatatttacattgttgagaaacagatctccagatctttgtcatcttgcaaatctgatactctgtacacattaaacactaatccacatttccctttcccccagtccctggtaagcaccattctaactttctatgagtctgactactttagatactgcatatacatagaatcatgcagtacttttcctttggtagctggtttctttcactaggcataatgacctccaggttcccccatgacgtggcatatgacaggatttcccctttttaaggttgaataatattcctgcgtgtgtgtgtgtgtgtgtgtgtgtgtgtgtgtgtgtgtgtgtgtgtgtgtgtataccctacattttgtttctccattcatctgttgatgggcacgtgagttgcttccacctcctggctactgtgaacagtgctgctatgaacacaggagtacagatatctcttggtgaccctgctgctttcaattcttttgggtatatgcccagaagaggacgagggctaatttttaacacaaaaaactttgtggattgctacccaatatatgtttcacttttggtatctagatccttctggatctttagcaaaatctgacatctcacctctcaaggcctccatttaggagcacctggattaagtgatcctcaggttgtgtccaactctaaatctgctgattctatgagaatcccttgggtagaacaccacccttgatactccagcccgtattaattccacagtaatgactacagtcctgccttaggggatatgcactataaaaaatcaaagtaaacacctgccgagagagaagggaaggcccaacagaacatgtgaggataaagaattttcttccccaacatggctactactgcattcaccttttttcaccaactggaaaataagaagtaatcaagttaattgactattttatctttagagaatcaaagtccaagataattattactgattcagcaagtgttttctgagtgctatgccttctgagacaattgaagtcaacagggcttatctagataaaaagtacttaaaaacttcaggcctagtcattttaatgtaataaactcaataagggctcttactttcatgtggttattattacatatttcattctataaaatccaagcactggagagttgatttaaattcagttcatatgtttatgtagtaagaaaacactcctgataaatagtgcaacctttcaagtcacaccataaaaacaaaggagcctccgttccaagaggatgactgcagtgcagacacacagagcagagcctggaagggagaactgatagccccatttcctttcttccctccttccatcagatcaaaacagtcctgccggtgtagataggagtgtggcaatcttagaaggaggctgggacctgtggagggagagagagcaggaaggggccattcggaagctcataaatcacacctggtttccacatccgttatgtagccagagttgtacaaatactgtctcaaagcctattaccagaagccactggccctagaggaaagcctggccgcccgcactttctttcttatccccaaatctaaggagttcagccaggatctcggacatatgggtacccatatgctgtgccgctctgtggcgaggctttgattcactgcctgccagcctcaagcctttctctggcatccacctccaggacaggaggaatcaggctagattcactgggaatcctgacagtgctattaccctgtgttcctagggcgactctgagcaaaactccttaaaatactcacagcgtcatttctactgatcatgctaaaatacacatatccacaggtgttgggagaaatgtttaatttctattatatacaacaacaaaagtggtattgggccatgatgaattaatccatgattaaggcagtcccatgtgcttaagaaggcaattatttagctgggaaaatgagctaaacatgaagatatattctatttacatttattttttatctaaagaaacaaaatgaattaagctttgccactatttactatgtggcccccaggcagactgtccctcaccggcctcctggtcctgagagctcccagggaagccgtggggccgccacccaaaggcctccatgcccttcatctgctttcagtgtcttgcaacatacccatgactccatctggttaacggggtaatgagttcaattctctagtatcatcctcaatatatcccaagtgcctcaaactgtgctcagatgatgaatttagagtgaatttaagctaacttttacaaaatggacaagtagcttaaaaaaaattcctgaaaaaataacctctggaggccgaagttaatctcaatacaagcacaagtgaacataagcaaagggaagcgctcctgcctgtcgtcattggtctccatgttacaaataccaacaacctagtcacatgtgacaagaagcagctctccccaacaaaacctgaaattgcctggaagcccattagaaatttagatttacatcctgaatcattaacgagaaatcccatctcaagggtatctggaccttgagatgagctaatgatagtaccaagtcactagaaatagcaagacatttaaaatactgctgatttcatctttatcaaatatcttaccattcattttgtatatgtttcataacttatatagtggtaatgcagtgcacatgtatacttttaaaatgaatactcatatgctggggatgcatgcagaaaacatttttcttaattgatggagtgtgtgatcaaatttggggccacaccactgtacacagcatgcccttggtcaggaaaatgggctgctgcagtgctcagcctgagcaacagtaaacactggcataggggaagagagaatcatttgccatgtaagcatcatagttaataaattatcgtgctgtcattgctgttggaatgccaacagagccaggtactgccagctgacgcctagtagcacaaggtgctgcttgcttgttgtgggttgaatttacgtttcccccagaaacagaggttgagatcctaggctccagtacttaagggcatgaccttatctacaaacagggttgttgcagatgtaattagttaagaagaggtcatactggagaagggtaggcccctaatgcaataggacaggtgtctttataaaaaggggaagtttggtcacagacaggcacacagggagaacgtcaggcaaaggcagcagagtgaggctgccaccagccaagcactatcagaagctgcgagacaggcctgcgacagaccttccccagcgcctgcagagggagtgtggtcctgccaacaccttgatctcaagcttctggcctccacaactgtgagacgaaacatttctgtttttaaaccacccagtttgtgcaactgtgttatgggagcactaggaaaactaatgtgctgcttcttggtggagaggcagccagcctgcctggaagttctgcccactctaacctgggtggagatgagaatggctttgtcctaatggcagatctcgaagctgccattaggacagcctgcagcctctggagaggctgccagacgccaaccctccctgggcagcctcgcttgcacagatgtcatcctgcatggggcttcacacgcagcggatgctgccagcagactcggctgccgtcagggggtttgagggcttgtgcttgttctgtcaactttctgccgcccaagttgccacaggcaaaacgcttccttttaccactcccttgctggcacataaacggtgacacttcagcaatgccccattttgcctacaaacttggtctctgagtctcagtctgacaaacctgacaggaagaactgcccaacagcaacgggaatcttcctgattctccttcccagggcagatgggctatttgttactattttatgctgccatgaaatcaggcctgctttttattctgagggtcttgctgtaccttccttacagcttctccctggaagaggcctctcagtccataagcagtgacaaccagttaccccctcaaacagacactacatgtcactcagtgcctgggccatgttgcggctctgcctttggccagtgcagggctctgtggcccgtggcactccagcacctgggtcagctgctgctggcaagtggtgggccctgtctgccagcacagggcactcacaatattggagctgagccaggtacggtggctcacgcctgtaatcccaacactttgggaggctgaggcaggcgatcacctgaggtcaggagtttgagagcagcctggccaacatagtgatatcctgtctctactaaaaatacaataattagctgggcatggtggcatgtagcctgtaatcccagctactcgggaggctgaggcaggagaatcacttgaacctgggaggtagagcttgcagtgagctgagatcacgccactgcactccagcctgggcgacagagcaagactctgtctcaaaaaaaaaacaaaaacaaaaacaaaacaacaacaacaacaaaaaaaactggagctgagagctggccggtgctcagcatccctggtctactgaaatctccacacacatggtagagaacagggacacgcccctcttaaaaggcagctggcaactagcctggatataaaaggtgacattagaacttaagggtaatgttgaaattggttcaccaaacggcttaaagttcaaacatgcagatcatggctaaagataaaaattcccaggcatacatgcctgagatttaagctggcacattgctgggccatcttttaactgaagttttaaattttctatttattatcttaacaatgaacttgactgagagaaccattaaaaattgctatagatcaccatttggcatctgctacgggttgacttgtgtcctccaaaaaaggcatgctgaaatcctaactcccagtacttcagaatgtgagcttatttggaagtgggatctttattaatccagttaaaatgaagtcatcaggatgggtcctaatccaatatgaccagtgtccttatgaaaaggggaaatttggacacaaagacacacaaagaggaaagatgatgtagagacacagggagaaaccatgtaaaggcacaggactggagtgatgcatctacaagccaggggatgccagagattgcagaaaccaccagaagctaggggagcagcatggaacacatgcttcccacagctctcagaagcaaccaacctgccaacaccttgctttcagcattctggcctccagaactgagatgacaaatgtgttatttaaagccacccaggttgtggcattttgttaaggcagccctgggaaacaaatacagtatatctgcagtagttactgtttcaggcaagcatcatcagtgaatgctgaaagtagcaggcaaaagtttgatgagaaacacaatactcatagagttgcaaagtattcccccatgagatatgtatgaattacaaagggtaaaatagtaaattgatagtggagaaacttggcagatgccatcttaactgaacaatcaaagctggcatcaccggccatgagatggggagtgtcgtgtacctcctgatccaatgcatcaagaaggacaagacctcgcttctgtgcagcccctgccctgaaagcaggacctgaatccaatcatgaaggcacatcagaaaaattgaactgaggaaaatcctacaaaataaatgacctatactcttcaaacatgtcaaggtcatgaaagattttaaaaagctggataactgttctagattaaaggcgactaaagatatatcactaaatgaaggtataatcctggactgaaatttgtggcagtagtgggaaaatgggccaagtctgaagagtctgtagattagataacactactgtttcaatgttagtttcctgattttgataattatacagtacttgcttttagtaaacacacactaaagcattccagagtaaaagagctcttcagaagaaagttcgtataaacagacagatgtagatttagatatatgtgagcgttaagaaatgggaggagcagggctgggtgcagtggctcatgcctgtaatcccagcactttgggaggctgaggagggtggatcacaaggtcaggagatcgagaccatcctggctaacacgctgaaactctgtcactactaaaaatacaaaaaattagccgaacgtggtggcatgtgcctgtagtcccagctgctggggaggctgaggcaggagaatggcgtgaacctgggaggtggagcttgcagagagccgagatcgcactactgcattccagcctgggtgacagagcaagactctgaatcaaaaaaaaaaaaaaaaaaaaaaaaagaaagaaagaaatgggaggagcagcaagtgtggtgaaattttaccatatgaggaatatggtgaggggtagatgggatttttttagtactttttttttttggcaatttttctgtatgtctgaaattatttcaaaacaaaaagttttaaaaaatcaccacagatgtaataacagctatcacttaatacgtgactgagatggttgaggtgtttttatatgttgtctaattgaccagtgaattataatcacatgaggcaaatattatgattcccactggcactctaggcctcacccaggaccaagaagaggtccatcttggttggaaagggatgagggaactgaaaggctctcgcccacaaggctcagcacacacacagagcctgctgaagtccaatggcagggcaggaaaatagacacaccttccaggcattcatatcctaagccactacaagtgggaaggttataatcctaccttcaattaatttgatatttgtgaggtcttgaatctaacttaagcagcaatacagcccaggcccggttcaactataaatactaaattaactcacacacacacacacacacacacacacacacacgaatgggtttgaacagaaaaggcatgctgttttctggactgatgtaaatattatttacttcagcttctagtgttatttctgtctctgtcattcttttacacaccaggttttactttacttaaaaattaaaagaccctcgaagaagtgatgtgacccactgtaaagaaacaaacagttaacagaatgagggaccaagcctggatgttggactcatcagatgaagatttaaaataactgtgataaatatctgtgaaaagacaggaaatttcagcagagaaatggaagctatacatttttaaaagccaaatggaagtggaaatgaaaaacaggatatcaaagatgaattctttcactggacttattgccacactgggcacaagagaaaggagtcaggttcaaaagaaaccatctacactgaaataggagaggaaaaaagagtcggcggcagagaggagaaaaacagagcatccgaggcctgtgaacatatcaaatgttcactatgggtacaactagagtctcaaaaaaagaagagaaaaatgaagcaaggatatttttgaaaagacaatggccaacaatttttccaagctgatgacaccaaaccatagataaaaaatgctcagtgaatcccaagtaagatacatacaaagacaaccaaacttggtgcatcacaaacacactgttgaaaaacagaaataaagagaaaatcttgaaagtaaccataggtaaacagaaacattacatacagagaaaaatgacaagaattatggctgacttctcgctgtacacaatggaagccagaaaaaaatggaatgccgtgtttaacacattgaaagaaaaaatttttaactaggaattcaatatatagtgaaaacatctttcaaaagtaaaagcaaaacaaagacattttcagaaagacaaaacctggaagaattcatctccagcagacatttactatcacaaatattttcagaaagagaataaaacagacagaaacccagtgggaagaaataaaggacaccagacagaatgaacattagatgtgcataatgaatctttaaaagatatttcatatctatctttctttaaacatctttaaaaggctactattaaaaacaataacaatgtaagtggaagttgtagccagtggtgtgttggagctgacttacactggcatgtagagctgactgttcacatgtcttcacaagtctatgtttagtgatgtcatgttgttagtttaaaattggctgtagctgggtgtggtggttcacgcctgtaatcccagcactatgggaggctgaggtaggaggattgcttgagctcaagagtttgagaccagcctgggcaatgtggtgagacctggtctctacaaaaaaaatttaaaaatttgctgagcgtggtggtgtacacctctagtcctagctacttgcgaggcagaggtgggaggactgcttgagcccaggaggctgaggctgcagtaagccaggattatgctactgcaatccagcctgggtggcagagtgagaccctgtctcaaaaaaaagcaggtgcggtggggggctgtggtaggagtattcacaccataaaattagcaaatgctacaaatcgggcttttaaaattttttcttggagggccaggagataagtaatcaccagcacattattttttatagtattggtagaagtaaagtatatgacaaaacacaaagtgggtagagtggtaattagaagtatactgttgtaagtttcttaagttgtttatgaagtagtagactagtttctgaaggcagactaagttaaaatgagggttggcaaagcttttctataaagggcgagataataagttcagtccatcattactatttatttattccatttttgtaaacgtgcctacttgctaaaatttatttgtaaccccaaaatcaaacacacgtagcaccttcgtggtcattcacagacacaggcagagcagcgaaggctttttgtagtattttttgtgacaatcaacctgcattttcccagctgaggctgaaggtggtgctctgccttcttcccgttttcatactgtacacaatgtgcttctcatggcttccacggtaaagacactcttttcattttgttttgtaattaatagatatattggggaagatactttgagactacgcaaatatcctgttgactacgtaaatatcgtgtttttcctcaaacttttacccattaattctgacatccatcagtggatcttgtctataacaattactgtgctgtttgcctcctggtgatattctagttacctcctttcttatacattaagtaactggagttcttctacaaaaaagagctatccgttctcctggcttgttaattcaattatttatgtcagtatggactcatggatatttattttaccgtatgggttaaaatctaacactatcggccgggtgcggtggctcatgcctgtaatcccagcactttggcaggctaagacgggccaatcacaaggtcaggagttcaagaccagcctagccaacatggtgaaaccccgtctctactaaaaaaattagccagacgtggtggcaggtgcctgtaatcccagctactcgggaggctgaggcaggagaatcacttgaaaccggaagacagaggttgcagtgagctgagatcataccactgcactccagcatgggcaacaagagtgaaactccatctcaaaaacaaaaacaaaaaaatctaatactatcactttgttgcaaattattccagctaaggccataaggagattcttcaggtgggcttctataacattctgccctgccccaaacctttctggagaacttccttatgttctggcactacagtatattccaggctcatctagtatttttcctgtcctggcctggaatcaactacttctccaaggaaccgtggttcctctgactggggaatggtgtttagacaccacagtctgggccctagggatgcttatggctgcatgggcgtcagttctttaggccctctcagtgaacaaagctaggaaatacaggtatgacactaaccctctcatccatattcatttctgtatatctgtataggtatgtttgtatctaccatccatccatccatccatccatccatctatccattcagaaccatatgttcatacagatacttctagttcccatccaacagcaccaagttcatttcagtcttctccctttcctatttgtaacctctttctctgacagtgaggaactcggctctttgtttgttgaatcctagtattcacataaggcaatttcagaattgctaaaccatgccccttaagaagcctgtttactaactgaagtacaccatttatgcatagttttttattgtctttagccttatagtatccacttaaaaatgttgttttccaaagttaattaggtaactccctactcccttaaatatggttatatcaagcaattgcatttcccactcccttcaatccgtcagtgcttgtacgccattctgggtccctcccacctcttggttgatgtgaattgttggcttacttgtcaggtgtgtgaaacagtgccatggttctaggtcagaaccatgcaaaaagtcaagctcagggaagaattgttccttattccccatttctgtttcttccttctttccaccccttttccatccaccacttgtcagtgaccaaacccgttcttttctggtttacccctcctgttatccattcctttttaatatcttgtaccaagcccagatcatggcagaatgtcagcaaatgtttgacattaaactgttttctctagtgaaccctgactcctaaagtccattctatgtctgcagtctctcctttacataatgaaactggctactttatcttatgacactcgacaaaaggcttggaaaccaccagtttccttaattgggtcggctcgagatggaatcaagcagccacgcaggaaagtattagctaataataatgaagactattactcttcctggacatgaagaaccaccagtaactagaactcaggttgacggaaattctttggcagcattttcacattttggctatattttttttaacacagcatctcaaaacaacttggtagcataagaaattacgtttaagtctgtggaaagctacaagattaaagggaataagagttgcataaacaattgcaagaaaaataactagtaaaagttgcagggctttttttttcctgtcaacacagtaacatctttaatcttccacttgtcccttttctctgtaatcagtacttgattttccaattaatggggaaggaagccaccagagatgagtcagtaaatttaaaactagtcttgaatgtctggcaaggaaaagaaagttttgcaaatgtacatctatagctaagaaggaaactggcatttggtgttaggtactcattttcatatctgaacaacactgggatcaaaattaaagaatataaaactttaggatcagggtaatgtggataggaaagtcacatgctataagacatttccaagaggataattaagtgttttatacattctgcaagtaagtaggcttttccatacctgaagtaaaaccagcctagtcccctgaaaccttattgtaaagtgataattagaccacctactgacggtgaggctgcaaaagggtaggattatgggtttgaggagcgcagacaaggttatgggcaaccccagaatcagtaagtttcatttacagagagatcaggattgcaatctatgtggatccagggacttacgtgacatatcaggggcaagggcttccaaaccaagacagactcaaggctgaatcctggccaggccaatgaccgactacatatcattgggttggaaacctccctaagctttgctttcttcgtctctataatggacacagtaataccaacttataggtgcggtgagcactaaattcaacgtgaagcacttagcaggtgcccagcacaaaacaagagcccaatggctaagcaaagcctcgtggagcagcgtaaggaatccagaagctgccaccagcactggaatgctggcactgccacttacccaccgtgtgccctcggaaaagtcacttcactctcagagctcttgaagagggagtagtaattcagaatgggagtaatagccaataataaacagctctgagatagggatgataacaaactgagcagtagcacagatcaaatgaattaatatgaacagagcagttagaacagagccgagctcattgcactctgtaagaatgagtgatgatgatgattgattatgattattcaatcagtccaccagagaaatggggagtgggagtgcatggtggtaaaagtaaactattacacagagtaccaggcctcgtggagtgtgttagaaaaagctgttttggcaacttacatcaatagctaaagagtgtacacaggcttaccccgttctgtaaatgctgtgtcgagttgtttaacccacagcagtaaacagccaagccaaagtcaagaggacaagtgctaacacactcatcaggaatgtatcctagcaatttggctgcagggaacaacaacaacaaaagccttgctcatgtgctttgcaaaccataccctgcagtcggcctgcttcaaaatatctggttctctagagatagagaacaaatctttaaggtaaataagatgctacaatctacagcgctggggtgctcgatctttcctcttcaactgttcatcctctggcatatttatttaaattgatcatcttctagaaaagctgcatgtcaactcatgaaaaaaatcaacagaaagaaaactagtgggctgttctgtccttatttctaaacttgctaataaattactatctctcattgtattgacactgtgttaggtagggaactagctatctgtaccttattccacttaaactcaccaagaaaagcagtgtttcattaactttccaggaactttttttccaggcaaggcgatatctcttgccctctttcttccttggggaaacagatggttatgaagaagggcaatgacaccccaggtttcctagagggaaattactacaggcttacacactcttagcctcgattcccaactcaagaatgctcagaaaatggaaggcttcctcataacttgtacggaggcaaaacttaacctgaagtgacactagtccctaaatttaaaaaaattatctaattcggtttgaacatcacatatagattacaatatactgcctgagaccccactgggggtactatgtggtatatgcaaggttttattctcctagggggtactatgtggtatatgcaaggttttattctcctaaaagcagtaatatcctcctagactcccaaatttctccattctaaaatacgtcgggccgcaagtcctacagatatacaattgtgaacttacaggagagttgctgatgctgttacgttccaaacatagctttgtgaatacagtaagtgagaaaaataattctagcgttttttttttgtttttttttttttgagacaagagttttgttctgttgcccaggctggagtgcagtggcatgatcttggctcaatgcaacctccgcctcctgagttcagggggttctcctgcctcagcctcctgagtagctgggattacaggcacatgccaccacacctgactgatttttgtgtttttagtagagacggggtttccccatgttggccaggctggtctcgcacccctgacctcaagtgatccacccacctcggcctcccaaagtgctgggattactggcgtgagacaccgtgcccggacaattctagcattttctttaaactgccttcttttaaaccagaactgggactgaatctttacactgctaatctcatgatttaaaatggacaataatcactaataatcactcagaaatgtcacccaaaatgctgttcttccctcacgtggccgctccgtaactcatactgtatcaggttttatagacaatactcaatggggaaggccacttagaagcagacaggcagggttaccaagaacatgcaccacttcctcatgtgggtgcctactcttggcaactatccatttggaagcctagcccgctgagcactccatgagaactgggttgaacttcctgctacgttacctagcacggtgcatgatatgggcaagctgatatcctctttggggttctgtttccttgtacataaactggggagaataccacctactattcaggactgctggaatgaaatgaaataaaagcatgggcctaatccacaggaatcaaggttagcttctttccacagcctctttccccttccacaccctctcctcttctgactgagacatcatctggagacaggctgtataagtagagagcttagtgctttcttctacgtggacgagctcccgcagaggtgtgttagtggtgcctgtttgcgtattgcaaagtcgagagaaatggattcctttcaaggtccctgaacccaactggaaatctgaacctttaaggaaaataggtgttgagcaggggaggaggggtctgcaaggagacccctgtgcaggccccaggagggttggcagcagaggtatcatataaggacacccagtcactcataagggcatggccttgtaattctagatctggctgatgatccgagggaggaaatgcttcaaccattctgaaatcagaagttcttgccccagctacacagacagccaggtccacccctgaggttcaactagtgcggcaattctcaagggtctccatgtgatttcagtatggaagcctaagttgcaaactactgcccagaaattgttagtatttgtttctctggaatgacaacagaaacctggagtacaaaagactcacaggtgcaagaatttgcctacttcgtccactctggtggtccagccttgggaagagggtggctggcagctgtgtccaccatcagaaaaccaatgagccacaggaagctgctcctgcttggcttggcttgccctggcttccaggaagggaggcacactggctaaacccaggcacctgggcaggtggaggtaggtctctaactgtgcagacagacggggcaccagcccctgggtgtggggtggggaacagggtgggcgcgtggcaactgctcaggaaagaggacctctaggggctctattttctcccctgactgaaaacaaagccccctcctccctgattaggaagggaaaaatacacagaacagggccccacatagcccaggagttatcagaatcatagaacagagaacaaatgttaatgcttaaccgaatagggtttttggaaaacatgctcaagagtcgctagcatcatcccacctggggctttcccattcctggtcatccttgtctttctcttctttggtgtctcctgtatgtgggtgtttctgcacaattcgcattccaccagctttcactgaaatgaaaacagagagtgtgggattaatgtggaaatggggctgcctgtggatcagggggaccagctggaaaggttctggttgctcagtggccacaagtcagtctggagaatctggcaatgaaaatgattaactagggaaggtcagggttgtcggggtaaattcaaaatgatacagcactcaacataatctcttactacagatccactcagaaactttccaaggctcttgtttttctatctggtcacctttcaagtattttgtcagagcagcagtgtaacgagggcacaaactacacaaagagagtggctgctgctttcagttctccacagtctcaacacaagagctcacctcaaccctcccctgtgaaatttactttctcaaatatcgaagatgtttttgatggggtgatatggtgatgggtgacatgggacagctactgtgccttcacagagcccaggcaagtggcaacaaaacttctactgcagctttgcccaaactgtgctgtgaaaccctaccgctggcagatgttaacttagttttaaaaaacagctttatagatatgtaattcatgtagaatacaattcattcatttaaactgtataattcgatggttttgagtgcattcagaattgtacaaccattgccataatcaattttaggagattttcatcaccccaaacagaaaccccacagccatgaacagttaccctccattccacccctcccagctcctggaagccagtcacctggacttgcttatttcggacatgtgatataagtggaattataaactatgtggcctttggtgactggctccttgcacttagcgtgttttcaaggttcatccatgttacagcacgtgtaagtatctcattcctcttcttgtcaaatattctattgcatggatgtatcacattgtatctctccactcatcaattagacatttgcgttgtttctacttttttggctattatgaacaatgcagctgtgaagaacttacacgtaagtttttgtatggacatatgttttcatttccttgagtatataccgagaaatggaactgccaggccacatggtgcctctgaatttatccttctgaaaaccaccaagctgtcttccaaagcctccacactatttcacattcccaccagtgtgtgggttccaattctccacatgttcccgacacttactattgtgtgtctttttaattatagccatcctagtgggtgtgaagtggtctcttattgtggtttgatgtgcaattcctttatggctaatatgttaatactgtgttgtaaggggtcgggtaatctagcatctattaagagtgggaaatgccaggttgaacaaaattaaataggtttccccaagagagaccttcttggcccttagtgtgctacctgcatgaggaagacttacaggaggcatacagcttgccagctctccccagcctatctgaccacacaactttttttttttttttttttttggctataataccagttatcctccatcagggctacagtgttccatgaacagaatttggaaatgctggctggccctaaatccaaaaagccagcctcgcatggtagccaccagcatgtgtttggggtcggcacgttcctccacgccctcagctatgtggtctcagactagtgtctcagattctcaaagattccctgcttcatctgcagaaaggagataaacctcctcagactattaagaagagagaggcgttcgggagagtggggtgctggctagaaagcagggtcattttccttgtagtcattggccccccaggctctggatgtgggccttactgagctttacccttcaagtctctgagtctctgccacaagacggctaacatcacgatacagtcaacttgccacaccatgtcctctggcattttaaactgagtggaccctgccgagtcacgaaaacccaggccaactttctttatgctgctgatgaacgggaaggagaatgggagaggcagcctggggcttacatgcttcaggtgtactggtcttcaatttccctgggagacttggccagcccgactggagggagatggtgacgtttgctcccaggaccagcactgccccagcagctggctgttagaaaagggcaaaagagagcaaggaaaatgacgactatttcctctggcttgggtttagaactaaaatctccctgctgcccgcacctcttctcaacggagaggacattctacttggggcagaaggaaacagaatcctgttcagtaatcctctcaaaaatctgctctatatcccatcaattgatttttaatcactctatttttcattcctacagcttttgtctcaaattcaccaggtatttgatggggtcttattcttttcttgtgcgttcaattcctttatatatttaatcattttagttgtatatccaattatttgattttctgaagtcctctggagtctaatcctgctgtctgtttttgcctgtggattcttgctcttgtcctgggagacttggaggaggaatctgtcttcactgggctttaccagtaaggatctcatggggcctgtgatgcagacagcaaccctctggggagatgctacacgtgtttttgtcaggccaggagtataggtgtctgaaaatccttttcaaggcagatttctcagaagacaaattgccaaacagtacaaatacgaactgaactcatgtaaaagcaagcctttgtttacaaattctcaaggagacctctgtccccatgtggagcccagcctgacacagtccggcttcctggccctcctagggccactgggcaggtttccctcttccacctttccccaggggtgtggcctctgagcatccaaccttggctactccctgcctcctgtgggcccacctctcatgctaaaggtctgaatttcagttccttcttcgttttgggtttccaggaattcctttcacttcaaggtcaaattcttttaaaaaagcaaaaagccaaagacaaaacagaaaagacctaccatttgcaggcagctttttaatctaagattaaaaagatttcccagcctacgtagttggcctcccaatcagaaatggagactgaaaatacaattatctacctacaccttagggtcattttccactctcttgaaacacaggatctcagagttatgaatgtttcgggctcaaggaagagcttagaagaactgtcccactaaatattttttaaaaattcatttccctccctgctctatcccacctctttcccatgctcatcagaaattgatgaaagatgctattacgggctgaatagtgtccccccaaaattcataggttgaagtcctaactgacatacccttaaattgtaattgtatttggagagagggtcttaaaagacaattaagttaaaatgaggaattgaggtagggctctaatataatagaaatggtgtctctataagagaaagagacaccgggtcgtgcacacacaaagaaatggcctgcaaggaaacagcaagaaagtgccatctgcaagcccaggagagaggtctcaggagaaagcagagctgccaacaccttgatcttggacttcagcctcccaagctgggagaaataaatgtctatggtttaagccacccagtctgtggtattttgttaaggcaggccaaaccaacaatacagatgcccatttaaaaatgatctctgaatctttccaacttggcacacataaaacttttaaactgtaactcacagatgtgttcataaagtaaaaataaaaagagctgtgcaactaactataaagaaaactaatgatgaatgttaaggtgacatttgaaatgatcaagtcttctgaagctcctgcagggcagcctgtccgctcctctgctgaaataagcacacagtgtcaaggctcagtcacccagcattagcacttgcatttaatttagtttctaaaaacaattaacttcattaatccctctcagttatgtttggtgattaatgtagcaataaaaagtggcaataataacaataataactcaaagctgagacagattcattttaacttacaatactgccaaaaaatatgacagcacatatttattgtgattgttgtatcactgtctctagaactcttcatttgtaaaactacaaaagaagaattacttttgcagaaatctttgcagaattatttgcaaatcagtatttttaggagaaacagaaaaaccttagatttttgtcgtggtggttgttattcaaatgagagcttcaaatgtaaaaaataagcttcctcttagcagaagtgctgtgcagaggataagaacacagatgctggagccagaaccttgggatcaaatcccagttctgcctgtgtgtgtgtgtgtgtgcatgtgcctgtgcataagtgtgtgcacatgtgtgcatacgtatgtgcttgtgtgtgtggctgtgtgtgggcaagttgctgaagctctctgtgcctcagggtctgccacctatgaagaaagagtgaaaatgttcccctctcccagggccagctgaggattacatgagttaggacacatgaaatgcctccaacaggacctggcacacaggatgtgctcaactgttagctagtcttattaaatgggtttttaagttagcatttagtactcaagagaggcctctggagtcctcaaatcgttggtgcttttccagctcttcaccctctcttcacagcagttccttaaagagcgctgccctacgggttgctggggaatgaaggccatgccctgtaaagcacctgcccatcgtggtgctgaccaccaccaggacctccgtcattacatcaccacctgaggaagctttgggagaatcacagatccaacttctgctcctcatcaccactctgtggcaggcaccgctctaaccacttggagtccacgcatctttcactgcacagcagccccacggagtagatcctgaggcagggagaaggggaagccagcggccccaaatcgcacagctggcaagcggcaaactgggttccacccttaatcgtaggtaagcctttccttgatcagattccttccaggaagcagagcaccatggcttctgagagtaactcaaaggaacggcctacagacagggccaggttattacactacctagataagggaaggtgagtttgaaatgaaaagctctccacagagcagctgcctgcccaagtgggaaggggagtggaggaagctttacctacggtcacatctgggaggtaagcaaacaccaaggaggcaaatgactatgtgggaccctgggccaagcatccgtcctcaggtgtcaggatgcctggctgtaagatgcagtcactggtggcttgctatctgctagtgccaaatagcaaactagaaaatgctactgcgggaagaagaaaggggaaatactggaagagttccatgaaccagggagcaatttccagcagggagctaggaagggctgttaactcacacaaatgtcccaaaagcatccactgcaggtactggagtatgactcacaagtatatgctacctttgttcttgcctgagaagagctatggaaatgttattcaaagggaagctcttctacctaaaagaagtgacgaaaggttctgaggactgttccagtggaaggaacaaaacaaaacagaaaacaaccagtgctgcaggttatgattaaaccaaaggatctcaggtagagcaatgtagtggcaggtaagcaaaggggctggtgagattaggtgggtagaacttcccaatgcgaacagggcaagggactatggcctatcttagttaagaaaaatgactccaccaggagagaggagaatcactggcaagtggagactcacatctatggaagcccatgcacctgaaggtgggaaccctaaaaagtggagaggataaaggggtgagaggcggtaagaacgtatgcagagagtgggtactgacagtctggcccaataacagacataagttatagaagaccccaatgagaaccttgcccccagaccaagtggagcccttacaggagctttcaggtgtgcatagataaggtagaagtaatggtttgtgctaaaaaatgagctggagccccagatactttcctgaatttgcactctcgttggcttcatactgctattctgtgctcagaatcatagactgtgaaggtgagaaggctcttaaattacacggagcaaccctgttaaagaatgaagttcagagacatagtgggacccccctgggccaaacactccatcttccacagcagtgtgtgttccatccttgacatagtttctgacccaaaggacaaaatgagtactgactgggccaggatgggcaccttgccggacatctgactgggcccctttcaagctgggaggtacatggagcagctacatgtatatccttgagtgcagggaggctgattcaaaaagtttaggggaaagtaggatcggctgcctggaagtgctttggaaaagctgtcattgggaattggttgaggctaggactagtcaggtgtttgccagtctcactcccagcttccccgtagttggattgggggcatcaaactgggtcctgcccaatagtatggggaaaagtgactttggtgggcagcatcatgtcatcacgtccccccactctggaacctgtgagtgtgctgggctacacggccaggggaaatgagggttgtagatggaattaaggttgctcatcagctgactgtaagctgaggaagaagaagggaaactgctattctgtgcttagaatcatagactgaaggtgaggagattattctggattacccaggtgggcccatgtaatctcaagggtctctgaatgtgaaagagggaggcggaagagtcagggctctgagtgtgtgatgtgaggatgtgactggtcattgctgcctttgaagaagctttccttggcttgtggaggaaggcgccacgagccaaggaaagtgggcagcctctagaagctggaaaaggcaagaaaatgggattctccccgatcctccagaaggaaccagttgccctgtggatactttgattttagcccagtgagacccatcttggacttctcacctctagaactgtaacataataaaactgtgttgtttagaaccactaagtttattgtgatttggtacagcagccataggaaactgatgtgatgatgcataccacttgtgggccacaccatacggaccccagcacggcgacctacacttgtcccctcagcagcagccacacaatgaaaagctagtgttatacagcaaggggtgtctgggcctctgaattgctctttgttaagaagaccccacccaggagagaaataaacctggattagtttggccactgagaatttaggttgtttgttacaacaggaagtaccattctctatacctaatatagtactttatacaaaagtgaacattctctatagaaacaaaaaaaacttctgaagctgggaagggaaaagcagtcacaaaaccaagtaagaatgcacagggcactggccgaaatgaaaaggacactcacaaagacgttagaagtcacagataaccaaaaatggctagggaaggctgggtgcggtggctcatgcctggagtcccaacactttgggaggccaaggtgggcaggtcgcttgagcccaggagtttgagacctgactggacaacatagtaaaaccttgtgtctacacaaaatacacaaattagctggttgtggtggtgcacacctgtagtcccagctactcagcacactgaggcgagaagatctcttgagcccaggaggccaaggttgcagtgagccaagatcacgccactgcactcaagcctgagagagaccctgtctagacaagaacaacaaaaaaaggctagggaagaggtgaaatgccatgggccaccttgacagaaggcttctgaaaaaagatagtaactaaagggtcttgttttccttggcatgttgggaacaagggcagacctcttacctggaccattcaatttctggtcctgactggttgacactgggactatgcttagcaaatctgtgaccacagggttaatagaagacaaattagtcttctgtttctagcaatggataatctgaaagtctttctgcagggagataattcagggagaattacactagacttttgaaaggcatccttaactcatgtctgacgtatcaattagtgtaagagagaactaagttactctgaagttactaaaaaaagtaacatggcttgaaataaatataatcgtgcttatatttccatttaattcactttgagaggggatgtagagtctgcttttcaaagaaaaccacatgtaagattagtaacattcaaagctatcatgtagcagatttatgagaactctactgacacatggttttggctccactgggaaatggaggggaacagggccagcaaaatgtatttaacaaagagattttacacatctcactgccacagactcacaaagactggcagaaatgagtaatagcgaggcttataattaggtcctcttttctgctgtggaatgctatgactgctgttagatgaaacagaaagaatctcgctaattctaactctgctaatctgcatttgcaataactcatcaaacaagcactcaccccatttctctgcaaatattttgtagtcaagagcagtggtaaggtctcaaatcattaaggctggattacttctacagaggactgcagacgacagcacatttgccaggacatgatgcagtgccatccatcacttgtaaataacaatacctgtatttgcacagcacctttctctaacactcttcagaagcctttacaaactgcctcattcgtctcccaccttgggaggaggcacctggccagtgatggagtcgtctgtcgggctgctgaagttccaaaaggcaacagcctttccggccgctcccactaggtcactagctcaggggagttggcaacagacactccaaacaattgggtcaggttttttttttttagacgaaatattcgctcttcttgcccaggctggagtccagtggtgtgatcctggctcaccacaacctctgcctcccaggttcaagcgattttcctgcctcagcctacagagtagctgagattacaggcacccaccagcacacccgactaattttgtatttttggtagagacggggtttcaccatgttggccaggctagtcttgaactcctgagctcaggtgctctccccacctgggtctcccaaagtgctgggattataggcgtgagccacgacacccggctctgggtcaggtttttaaacggcactgtcctcggtatctcaatgttaagatgactggtgatttcatgagttaaacgtgccaagcgcttagaagtgtgtcagcacattgtgacactcaacaaacttcattagtgtttccaccagtctgctgcctgaaccggccaagaggaccacctgcatccctgcgcacagtacagagagctcagagttgaggaaggtgtgggcccggtttgctatgggggcagtgaggggtgagaagaggccctggggaaactctggagtgcttattgagtattttgtgccaccccgggaataaagagatcaagaagacccagccctggaagcaagaagacaggcagagaggcgaaggttagtgcacgaaggaaaacaaggggattgcggggaatgtacaggagatatgggccagacagcaacaaagagaagacacaaaagaacattaagatagtcactgtaagagaattttattatttctgattgagcattgaggcacaagtctgttatccaatttaagcacttaatgaaagcattctcaacatttttaaggcagtgattttgatttatgaactgtgctcttggctatccttgatgattatcctttagtgtagtgggccgccttttttttttttttttaaaaactatctacccttcagagctgcctactctctggcaatgccagactaaacaagaacaccagagcttcctgccagaaaaggttcacacatggtcctctgtaacatctaggaaagcgcatttgaggggtgctgttggcatctgaggggtgctgttggcatttgaggggtgctgttggcatttgaggggtgctgttggcatttgagggatgctgctggcatttgaggggtgctgctattgggcccctcctctaactatggtcttggagacagatgacagatggtgacagccacccgcaagagctcaccccgtaagtctaaaggggttgccctgaagttactagaggagtttacctgggggatgaacagtgctggtaccctgatgctgaagcgggacgtgagactcactgcagcaaacacagccccaccctgtgacttgccccgaggcccaaacctcgaatttcataaaggagaaaaactgagccccagtgaagcgtgaagtgatgtcttcaaacttagaacccaagctcactgctacactagcacaaataagctgcctcttccctcctcaggggtaaataaactacttactctgtaattcacaaagcctagctgtttactctgcaattcaaagaaaaccagagtccagcaaggaatttctcccagggagtgagtatgtacagtttatacctctgaccttaaaaatctccatatgggcactttggaaggctgaggtgggtggatcacctgaagtcaggagttcaagaccagcctggccaacatggcaaaatccggtctctactaaaaatacaaaaatcagccaggtgtggtggcaggcacctgtaaacccagctactcgggaggctgaggcaggagaatctcttgaacctagaaggcggaggttgcagtgagccaagatcgtgccactgcactcccaggtgacagagtgagactctgtttcaaaaaacaaaacaaaaaacttctttatgggtgtgtctctgtatgcaatttaattactgtactttggttctgtatcattccaacagatacgctttaatgtaacccatgtcctggggagtggagggccagagcaggtggctgctgcagttcctggaggcagccctgcccggggtggaaatcaaggcgctcctccccacagtggacagggacccgctgtggtggaatggaagtcagttatccttaaaagaaatcccatcaaaaaaaaaactccctttgaagtactttttttcttaaaaccaatgcaacacaaattcccccaaaaccattttccatcacagtggaatgattttctaaaaccccatgcctcttaagttctctggcatcagttagacatttttctttcccagtgccagttagttttgttgtagagagcctccgtcaccactgaaaaatattgcctactctggactgcaacatatttaaagaacggctcctattcattgtgctggtgcagagaattcccgccctatagcggaggacagcagagaaggataatgggaatcttttttttttttttttttttttttgagatggagtctcgctcgctttgtcgccaaggctggagtgctttggctcaatcttggctcactacaacttctgcctcccgggttcaagccattctcctgcctcggcctcctgaatagctgggattacaggcgcccgccaccatgcccagctaatttttctacttttagtagagatggggtttcaccatgttatccaggctagtcttgaactcctgacctcaagtgatccaccctccttggcctcccaaactgctggggttacaggcatgagccaccgcgcctggccaggaatctttattgtcaagaaaatggcgcaaatgtgccaccaaaagaagccatgtttctcaaagacttctgttcctacaagactgagtttatgacactaaggcgtgctattaagacctaaaagaacctcacgcatccatacattgaagtgacttggcttctgagacccaaggcctttgatcttctcaccagtgtccctccatatgggccgactgccactggaaaggagagtagaaacggaaacagacccgtctggacagaatccaaagtgcaaacaggaactgtgcccagagagaggaggaggtggcagaagcatgaaggctgcttagatccctatgttctaagaaagaccgctctttcctggctttaacttccttggctcagaagtttaggatttgctcaaaatcagaaaaagcaactttgggggaaaaaaaaaatctggatgtggaagaaactggcggtgaaagtcatattgagtgattaatgataaaaattatttccgctccttggttcttgagtcggtatgaaacgctggcagcctctaattaatcatcaccatgatattaacaccactgacttttcattgcttctgctactttctttctagacatctgtatcctctaagtaaatattatccgccaaaactttgttataagttgtgcaactgggttcgcccaaggcaccggagcctgcgcgcaatcgcacaggtacgcggccgcccgcggtcctcaggaagaaacgcttcgccgccgccggcaagcggggccgaagctccggcgggctcctcccgggcctgggcgcccgacctctccgcggcccgcgcccctcgggcgggcatcaaggcccggaacccgtctcagcgctcgccggggccctccccgcggagcccccgcccggcgcccccgggttcgagcccgcccccggcacccgcgcgtggagagagaggaaaagagtcagtaccggcgggcgggtgtccagctttagtctctagtttcccttcgggaggcgaagacatgacgcggcggggcttccgcggggccgaggcggcggcgcggttctcgggccgggcgggcgtgcgcgagtgagctcaggtgtgagcgccggggagcgagcgggcgggagaacgacgcgcgcgcgtggggcgccggggccgcgcgagccgggtgagtgccactgccgttaagggggcgcggccgccgcgcgccgacgtggcgcagccgag

SEQ ID NO: 794 - DNA, 230328 bp, Homo sapiens
cctccacaccgccttgcaagctgagggagccggctccggcctctgccagcccaggaaggggctcccacagtgcagcggcgggctgaaggactcctcaagtgccaccaaagtgggagcccaggcagaggaggcgccgagagcgagcgagggctgcctgccagcacgctgtcacgtctcagcaatagactgctcttgaggtaagcagtaagaataaaaaatgaaatcaagtcattttgcttagtgtactacaacaatagagaatattttctttttaatacaaaggttatttaattttccagagtaactctattgcatccagtggtgtaattctcaattcataaggatgaagagaagttacctgtgacctattacgtaatttataaacctcttcttacagagaatgatgtgtcttagaggaataaaagtgaggcattttattttcttcaaaattaaatattaacaattgtcttatactgatcatgggaaaagtaagctgctaccaccaattccaatctgtatgaggtacttttatttaagaattataactaatgattcaagaactaacttaagtcctattttatttacaatgattcctgaatgtaagaacacctactgcatttgctctgtatccatgtaggacctaattagaaagctgggctccatatagaaaaaccaatgaatattttttgattgataactagccaaaatgacagagttttccgtctgtaagcatacaaacatgcattttattttgaactttcattttgttataattctttatgattttatcggcaaaaccaacaaaataatacattgttcttaaaggaacacatgctaaaacagaggtacattatacatgtttaccaaaagtactgtagggttgtttttacattgaaaaatgcatttgtctgtatcctttggaaaatcaaactgatctaatataatttcattaagtctttaaacaaaaaatactttagaaatgtatgcaactaacaaagggaagaacattttatgctcatggataggaagaatcaatatcatgaaaatggccatattgcccaaggtaatttatagattcaatgccatccccatcaagctactgatgacttttttcacagaatgggaaaaaactactttaaagttcaaaaaagagcccacattgccaagacaatcctaagccaaaagagcaaagctggaggcatcacgctacctgacttcaaactatactgcaaggctacagtaagcaaaacacagatatagaccaatggaacagaacagagccctcagaaataataccacacatctacaaccatctgatctttgacaaacctgacaaaaacaagaaatggggaaacgattccctatttaataaatggtgcttggaaaactgcctagccatatgtagaaagctgaaactggatcccttccttacatcttatacaaaaattaattcaagatggattaaagacttaaatgttagaactaaaaccataaaaaccctagaagaaaacctaggcaataccattcaggacataggcttgggcaaggacttcatgtctaaaacaccaaaagcaatggcaacagaagccaaaattgacaaatgggatctaattaaactaaagagcttctgcatagcaaaagaaactaccatcagaatgaacaggcaacctacagaatgggagaaaattttggcaatctgtccatctgacaaaaggctaatatccagaatctacgaagaacttaaacaaatttacaagaaaaagtcaaccccattaaaaagtgggcaaagtatatgaacagacacttctcaaaagaatacatttatgcagccaacagacacatgaaaaaaatgctcatcatcactggccatcagagaaatgcaaatcaaaaccacaatgaggtaccatctcatgccagttagaatggtgatcattaaaaagtcaggaaacaacaggtgctggagaggatgtggagaaataggaacacttttacactgttggtgggactgtaaactagttcaacccttgtggaaggcagtgtggcgattcctcaaggatctagaactagaaataccatttgacccagccgtcccattactgagtatatacccaaactattacaaatcatgctgctataaagaaacatgcacaggtatgtttattgcggcactattcacaatagcaaagacttggaaccaatccaaatgtccatcaatgatagactggattaggaaaatgtggcacatatacaccatggaatactatgcagccataaaaaaggatgagttcatgtcctttgtaggggacatggatgaagctggaaaccatcattctgagcaaactatagcaaggacagaaaaccaaacaccacatgttctcactcataggtgggagttgaacaatgagaacacttggacacagggtggggaacatcacacactggggcctgtcatggggtgggaggaggggggagggatagcattaggaaaaatacctaatgtaaatgatgagttgatgggtgtagcacaccaacatggcacatgtatacatatgtaacaaacctgcacattgggcatatgtaccctagaacttaaactataatttaaaaaaaaagaaatgtatgcaacttcaaataaaacaagaacatttaattctgagttcatgtaacgatgttaatgctcaatgttttcacattttagtgaataaaaattttccttcaaaactgtaaaacaatttaaatttacatacacctctaacatttgtgaggctcagggaatgagtgtaagtgaagacatctacactatatgccaaaaatttaaggttataaatcaagctaagaaacaattaaataaaatatgcttgtcctcctaccttaacaaatgagacttcagtgttgaaattgaaaaatgtatgtaaagttatctgtgtatattacttctagacaactatcaaaaataattgaatgtaaatattaatgtccatagttgtactgatagccaagaatgtggtgaaggatgtaatttataagtcattttatatttatagtaagcataatttttctttgcctttccacataagcaataattaggttattaaatctaggctgttttcacatgttttcttctatctatatagcacatatataagtgcttagattacaatcgtattagaggtgtacaatattttcccaaaaaatataaatggaatgaaatatttttaaaaatataagaaacaatgtacgttattataaaagtcaatattcttataaaatacctaaattaatattaaaatgtaataaaataaaactaattttaaccattttaactaaatatcattgaatacttttgtaaaataaaactacaatttcacccccaaatgtctctctaattttcaacataagttattagcatcaagctttatgcattttacatataaaattatatatacatagatttcagagagtaataaattgttgaaaagtatgtatgttccttactccaattcttacacatgatgcattaatttttgaatagtgctacaactaaaattatagtaataaagagattcaagatacccatgttagcatttttagatgatactacttaaggaaatatatatttcattggtgcaatttcagtggaaggaaatgacaattattattatttttttcttccttcctaattgcttctgccactaatagcctcctcacactttgaatcaatatccatctctaaagtctatcggggcacaaaccacacaaattcacagaatctagacgagatcacaattttttttttgttttgaagacacaggacttcaaggacatgtaggaggagaaaaaaaaatactgtggggctgggacagtgtgaaacatgactgtttttcctttctttctttctttttttttttgagacagagtcttgctctgttgcccaggctggagtgcagtggtgtgatcttggctcactgcaacctccgcctctcggattcaagcgatactcctgcctaagcctcccaagtagctgggactacaggtgcgtgccaccacacctggctaattttttgttttttatatatttagtggagacgggagtttcaccatgttagccaggatgatctcgatcttctgacctcgtgatccgcccacctcagcctcccgtagtgctgggattacaggcgtgagccacggcgcctggccatgacatgtgtttttagggctaaagtcactctgcgtcagtgttgtatgttagacacctagtgagagactatgcttgataaatgcatttttttgagtttgtgatatattgaacccttgaaatcatgaaacccaaggcagaggtacctcttgcataggtttaagtaagtattaattacacgcatgttattgagcaaacgttgaacggagggacactggatttttactcaggtttctataggtgattaagattcactaacaaggtaaacaaagtataaagatatattagaaattttcttagtgtcttcaaaactagctttaatgggataagaactcactccagaaaacatagcattggcaagtcaagtttcaaaaatatgacactaaaaacattcaagctgagatccaaataagaaatgcaatctcatttacaataaccacaactagaataaaatacctaagaatacaactaaccaacggggtgaaatgtctctatgaggagaattacacacagcacaactgaaggaaataacaggtgacacaaataaattgaaaaacataccatgcttatggattggaagaatcaacgtcattaaaatggccatattgcccaaagcattttaaagattcagtgctattcctatgaaactaccaatgccattttttacagaattagagaaacaattctaaaattcacaaagaattgaataccccaaaatgaaaacatgagtacaaggaaattttctgtgtggaacagtggcatcaccagcagtaggaatttgagacccatctcaatcttggtcatgaaatcaaccagaacatgccaatatcaagggaaatgttctattcttagaaatgtttccactgacctgtttgcaaatatcttcttttttttcacaaatatgtttattgcagcattatatatatgtaatagtataaaaatgaaaaagtataaatatgtatcctatatgggtgacataatattttcctctacagatttccatacagaggttgcaaaccaaaaaatgtaacttgtataataaaatttttaatctttggaagtacctagatgttcccttggaagattccatgcccatctgacaaataattaaacagtttaatttttatcaattgtttaaatttttattttatttatacttgcaacactatttgaggatggtggcaatagcagtagaagtaacagctctgttttcaattctaagtggctttattctacattgttttctaaaacattctttcatctactaaatcatgaacatattctcatgtaaatacacacatacaaacaccgtttcctcctacatattaatatcccttttcactctctattctatcatgtatttgtgtgtgtgtgtctgtgtgtgttggtatgggtgtaattttcagtatccaaatgttttacatatgtataccttctgatgtgtgcttttgatggattgggggtgttaagttgtgtttttattctctttttggagtctttctgtttttagaatgccggctttttactccatattcttttatttgttttattagtaaattagtacatttgtgctggtacctagtgagaagaatctcttgaatgcatttagtttaattttatctttggaataacatggatttcccttttgcagcttaataaataacttgaattatgaagaatgttcttttacacatactagatgcaactactgctccatgagtggttttacagaagcatttcattatgtctgcaaacatctttacaattattgagacaccatctcccaaaaagcgctcttctgcctttgagtgtaagaagattggtagttttgcacactttgcaccatattttttatgtatatgccttttgtttgggggggatgataccatttttatgtgactcttaattagatacattatatgtagaaaattgtgtgtatattgctggccactttgtgtttctgacaaaccatagtaacttggaattgaatcatgaaagttttcagaagtctctaagtttttaacctgaaaaatctgtatgtaattctctcaaccataagcttccaaaaaatttaggttgtgttatcttctaaatttatgaaagcttgttcttcagtaacatttttgtctatgttattatccattactctttatttttctcgttttagtttgtgagtagaacagccgtgacatttattttcaatcctagtgtgaaattcctcgggcctctcaattagtactaactaaaaatgtgttttacttatcctctcaaaagttacagtaatggctaagaagctaaaccaacccatgttctccttggagtttgatgctaaaccagcaaagctgatattttcttgaacccccctttttttgacactattgactattcaagaccattccagtgaccaagatttcttgtttgtttttagatgacatttttataggtatgtttaaaatgagaatgtaaaatgtgtagatggaagattctctcttcctctcgttgattagccttcactttcttgtaaatattctttttctcaaaagcctgtgggaaatcacaggagatattttttattgcacatgtcacatgtgcatggtttaactcacaaatgtttgaggcatattatgacagcaaagttatatggcagaggacaagcaagtatatacaaaaattgagaaagtaaggatttttaacatgccacattgtgaaaatttacgtataggaggctagcgatgaccagtgatacactccaataggtagatttcaaatttatgagactattttgaacacattgttccaaggttgttcataagtacagcacatttgttcttctggaaggtaaatcttttgttatttaattcatggattagaaaaattgtttgaaaattctattactttttaaaattaaaaaatcaatcataattttatattccaatcctatctgaaattgagttagatcatttctgtattggttgctttttatgcatctattttttaaagtattttggaggcaatgaccttaacaacagattctagattactttgccattgttttccaattctcaaatcctaatcagtcaattgagagcaggagtcatacttcatctgcatttgtaacttgaacatataacaaaatggcctataaatatagaataggtaaaaagcaagtaagacaagcaatacttttgcttaattagaaatgttttttaaaaactttaagatatcctggaatggttcaaatactgattcactaatatattgcaatctagaaagataaaactcctagtgtgtttattctgtttcagttactaagacacatggtaaagaaattagttttagtaaattatcttttacaggggatattaagattgtgtgattatagagtgttttttttaagaagtaccaaatataactaaactttaaatatttaatcatattttgttcaatatcaatgtaaaatttatttaaatcttacattaaagttaaaagccatgttaaataaaatattatttatgaaaaacaattataatatactatgaaacatttgcttttaattcagctatgctaattattttttccattttaaaataaatataaatcattgtcatcataaaatagttttcagccaggtgtggtggctcacacctgttatcccagcactttgggaggcagaggtgaacagatgacttgagatcaggagttggagatcagtctggttaacatgatgaaaccccatctctactagcaatacaaatattagccaggtgcagtagcacacctctgtagtcccagttactcgggaggctggggtgggaggatcacttgggcctgggaggcagaggttgcagtgagctaagtaagattgcaccactatactccagcctggctgacataggagacattgtctaaaaaaaaaaaaatttttctcttaaaagttttatattatatataattaacataactattttttatatttatgggatacagtgtgatgtttctcttttttttcatttttactttttgtggggacatagttgatgtatatatgtatggggcacatgagatgtttttatataggcatgcaatgcacaataattacattatggaaaatgaggtaaccatcccatcaagtatgtatcttttgtcttacaagtaacccaattatactcttccagttattttttaaatgtacaattaaatgattgttgactatagtcaccctgttgtgctattaaatatacattctttctaacaatatttttttgtagccattaaccatcaccaccttcccaccaccccacacactacctttcccagattctggtaaccatcgttctactctctatatccatgagttcaattgtttggaattttaaatttcacaaataagtaagaacgtactatttctgtccttctgtgcctggcttattttacttaacataatgactttttgtcatatccacactgttgcaaatgacaggatctcattaattttatggctgaatagtactccaccgtgtgtaagtaccacattttctttatccattcatctgctgatggacactcaggttgcttccaaatcttagctattgtaaacaatgctgcaacaaacataggagtgaagatatcccttcaacatatggattttctttcttttggcttatatgctgagcagtgggattgctggatcatatgatagctctatttttattgttttgaagaacctccagactattctccatagtgattatactaatttacattcccaccagcagtgtacaagggttccttttctccacatactcaccaacatttgtgttattacctgtcttttggatataggccattttaactggggtgagataatatctcattgtagttttgatttgcatttttctgatgatcagtgatgttgatcaccttttcatatgcctgtttgccatttgtatgtcttttaataaatgtctattcaaatattttgcttatttttaaatcagatttttagattttttttctactcagttgtttgagctcctaatatgttctagttaagaatcctttgtcagatgagtaggttgcaaatattttataccattctgtgagttgtctttttactttgttaactgctttgtttgctatgcagaagcttttgtacttgatgtaatctcacttgtccatttttgctttggttcctgtacttgtggggtattactcagggcatttttgtccagattaatgtcctagagattttccccaatgttttcttcttgcagttgtatagtttgaggtcttagattcattttgatttgagggtttttttatattgcaaaagattctgtaggtatgctgcattatggtttatgcttttttcttttgtctactctgtgtattttcaaaaatagcctgtcttcaatctcactaattatttcttctgcttggtcaattctgttgttaaaagactctaattcattctttagtatgtctattgtactttttagcttgagaatttctgcttaattcttttaaattatttcaatctctttgttaaatttatctaatagaattctgaattttttctctgttttaccttgaattcctgtgagtttcctcaaaacagctattttgaattctctgcctgaaaggtcacatatctctgtctccaggattgatccctagtgccttttgttttttttttttttgacagagtctcgctctgttgcccaggctggagtgcagtggcgcaatcttggctcactgcaagcttcgcctcccaggttcacgccattctcctgccttagtctcccgagtagctgggactacaggtgcctgccaccatgcccggctaattttttgtatttttagtagagacagggtttcgccatgtaagccaggaaggtatcgatctcctgacctcgtgatctgccccctcggcctcccaaagtgctgggattataggcgtgagtgactgcgcccggcccctagtgccttttttagttcattttgtgatattatgctttcctggattgtcttgagacttgtagatattcctatgtgtctggacattgaagagttagatatttattgtagacttcgcagtctggttttttacctgtccttcttgggaagaatttccagatattcttaagaacttgagtgttgtagtctaagctgtatctttttttatggggaccccaagtccagtaattctgtggttcttgcagactcctggaatctaccatcatgatagtctttgataagatcaagaagaattctctgtattaccaggcagagactcttgttctcttcccttcctttctcccaaacaaacacagtaccactctctgttctgagctacctgaagctaagggtcaagtgacacaagtgcccctgtggccaccactattagggctgtgctgtgtcagactcgatgccaacacagcactgggtgtcactgaaggcctgctgtaaccactccttggctaccacctatactcactcaaggccctgggcttctacaatcagcaggtgacaaagacagctgggcccgtgtccttgcattcagggtggtgagtttccccagaacctgggtagatccagaggtgctttttgggagccaggagatagactcaaaaccatagaagtctgctttttcaaaggtacatggttgagctggcactcaaaccacaggatgcaatccttcatactctttattcccctttccaaaggcagaggagcctcacttcatggccactgccaccacagacccacagggagtactgccagactactggcaatgctcctgtaaggcccgtgggctcttcagtcatcctgtggtgaatgctgcctgcatggtctaggactcactctttagggaagtggtctcctctgtggcccagggctggatcagaaatgctgtcaaagagtgaaatcctggaactggggacccaatgagcttgcttggtgttctacacctctgtggctgagctggtacctgaggtgcaaatcaaagtccccttcacttttcctccacttttcgcaagcacaaagagtctcaccccatagtcactacagctgggaatgtgctgagtctcacctgaagtcagaaagtctcagagtctcactcaaggccttcaacatagtatctggttatcaccattcttcacacaattagaaaaaagctatttaaaaattcatgtggaaccgaaaaagggcccaaatagcccaggcagtcttaagcaaaaagaataaacctgggggcattatgctaccaaagttcaaaccataccacatggctacagtaaccaaaacagcatggcaatgttatgaaaacatgcacatagactaatgaaacggaataaagaacccagaaataagaccacccacctacatctgaacttcaacaaatctgacaaaaacaatcaatggggaaagaattccctattcaataaatggtgctgtgataactggttagccacatgcagaatattaatactggacccattatcttcttatactactccaagaaattatatgaattaatttaaaaaatctctatgtcatcatttttcataaatattatttattaggattattttcccctgttggaggattgtgatagcattaatacaattcaattgtttgtgatggatatctgcattttatcttaatggcataccttatcataattttaatgacatactttgttttttaaatttaatttgtgtcaatttttcatcattacacattatgaatgtgcttatgtttttaatctcttttttcctcaacttaatttctaaacaaaatcaatttagtaaacataaaacaaatttataaaacatttgaatataagcaaaaatgaaaataacatcacaattgctcattgaaaaagatttgtttaatctagaaataaaaatgatgtgctaacatttttgggaatatctatgtcattattatcaatgtctgtatcttacagcatcttgtttgtacatctatgtattaaagagcccaataatgcctatatatgtattaagtaatcatatttatgcatatgacaataatttgttttatgcaaacacacacaaacatatacacactcaaataaaatacaacataaaccacccttcaaaatgacaacaacctggttttcagtttgttttcaataatctttgaagagaaaatatattgcgatatatccatgcttagtaacttttattttgaaaccttttattgatagctttttaggacattttagagaacctggggaagatttcttttcagtacttcggaatcactcaataaaaattaatcaactgtgattaaatgataatgccattctgagcttagtgactgcaaaatagatgtgtaattaatgaggacaaacttctaatagacatcacaaaggtaagcagctatagaaaaagtctagacaccaggatattttagatttccttctaccctcagtcctgacactcaactttttatcccaatttctctactcccccttattttttactctcttcttcccttccctgttagttttttgtcagtctcatccagctcaacacccttgctaaatttttgaaaagtctatttcagctctttattgcctacatccccaacttaggatttcttctaatcatgatttagatctccattaatccccatttatcttgatttccaatgggcagagaattttacctttaaattattgagtgtaaacaaataaattatattactgagagatgtttggttggagatacatctggaatttttttttctgaatgtataaaagagaagaatagtttagaattataaacagagttaagagtaatttattcaattgaaacaatactgatacatcaacttttatttactttctgctgttatatttccagctatacatgttacaaatataacatacaattcctccccagagtgctaatagggaaataatatatacatatacaaaggcagctaataatattattggattatccaaatatgtatcaaattgacttgtgactttaaatgctataaaagtttagaatagggtaagagactactatacatttttttccttttcaatcacagttaaattggaacatattttagattatcataataccacctagagaggcataataaaaattatttcaagctctcaggtttgataaataatttgtatttcatcttccacagtttctcagaaactctgtcaaatagtgtttgaaaatcttgaaatgtcctataatcctagtactttgggaggccaaggcaggaggatcgctgggctcaggagttcaagactaacctgggcaacatagcaagatcctgtgtctactaaaaattaaaaaatttagtcacacatgatggtgcacacctgttgcctcacttacttgggaggctgaagttggaagatcgcttgagcccatgaggtcaaggctgcagtgagttcatgttgttgagcttattattagcctgcatatacactcccatggcagcatttttcatgaaattcttgtgcaagcgccatggtagctcaaaacagaatggttcactatctttggtataagtcatcctgtccactgtgagtcaatgcttctcctgcagtagatgctctttggtgaaaattaacatgtgttataaagattcttatatattttgccaactctcatgtgcccactcattcaccatagccaaaatttcctttagattaagatcccttggcatttttttctggcctctcttcccattgttccaaatcctgggattaagttactccatttaccagctgctattctggatttctacgatctccattgtcactaggatctataataacatcccctacatgagctgcagatagctgtcacctgaagaggatagttaggcactagtgagcatgtctatgctaccattgcctttttggtaacatatttcttactatattaattctatgaatgtcttctggatcctttcaagaaacagaagcatctgttgccttctccattattgtacacttaatttgtttgagcatgctgaattttttattctttcttcagaatcctgcaaagacattttggtatttccaacttgtttaatatgggacataatttttcccaaggttccaacagccagcccagtggcatgttagtattgctcccactggtaacacattttatcatggctaaaggaaatttcccaacgtcaaagagctctccattacttaacattaaattttacctcttggtctattgccctcaaggtctcctctcaagtatgctctctcagttcccgtaggtatgcatctatgaggtcctgaagctcccttggagaataattcccttcttagtgtggtcagaacattcctgattactacttgttctaattaactaaccctagatattggtattagctgagagctaaggtagggaaagtcttgaggagggcaaatacagtcttgtaagtcatctgccccggttgatgcctccaagaaaagcttcttggtagtccagctataattctctaacaaaggaaggagctcactcctatttgcccaaatttttcaggaaaatgtgatgtgttcattgctataggtttgacaaaatacagagatccacatcccaatttcagtgtcatactcttgtaaagaagactggctaaagataaaagtccacatttacctgaagctcttctactcatagaattagctatgataggtatgaggtctggttttcaacatgattgcaaacctggctagtggagatgattgtctctttaaatgttaatgtggaagcctactgacttttccaacatgccttataatggattatgctggcaatatcttttttatgttttaatggagctcagtaactattagcccatttcatagaccttatagtgtcaatttgcctgttttctccaggccatatccactgcagaagccagtgcatctccttcccctctactgcaccctgattccctcaggcaatctgttggtaatcagtatgctacggtatgccaggggcttccaactatctatttatcaacagcccccgtttatttgttgccatgttactggcaagcaatatacctcagaatctcatcctttttttgttttcgtttttttttgagacggagtttcgctctcgttgcccaggctggagtgcaatggcgcgatctcggctcaccgcaacctccgccccgtgggttcgagcaattctcctgcctcagcctctcaagtagctgggattacagtcatgcaccaccacgcccagctcattttgtattttttttagtagagtcgggctttctccatgtcgatcaggctagtcccgaactcccgacctcaggtgatccgcccaccttggcctcacaaagtgctgggattacaggcgtgagccaccacgcccggcagaatctcaatcttaattcttacaagatatgagttgtctaatgagacacctgcaaaagagttataaattaaaaattcatgttcaggagattaattaactgctcccaggagatactggtaaagtcctgaggaagggaggccaggggaggagtggaagccgagcaaggatgaaagttcaggcaaacacccacagaagcttcagctcgactacatgaaggaagtctggcatcaaaattacattcagaattataatgacacaaggcattctctaatgtgcaatgttcataaaattatatgcctccttaaatataaatattactatttattttatattacatgcaatttgatattttaaattgcatgacaatatgagtcttttcataaatgacacaatctaatagtattcaataattatattttaaaatatattaagcatttttcacattgtgcttattttttcttttaaaataaaatcattttttacaacacctctttgctttgaggatttctttattgttctttttaaggtgcaacaatttattattagaagagtgatacatttatagaaaatgggtctatttaatccaaggatcactagttcccctttaaatatcacattatatgcacatggacagagctaaagaaagatggaataaacaatgttagagttaacttgtagttacatttcattcaaaatgcattatttctgaatgtatggatttcccttcttttcacgtctctaacacttccttacttttataagatgttttcaaaacagcctcagaaaaataagagacagttgtacaaagatttttttaaaaaaaaaaaaaccctcaatttatgttattgtgcattgagactaaatgaagtgatatttcaaggaccaattactcgccttaataacaaccaagttttatttactgttaaagcaaaacaaaacacaaaaacacttagctcatatacttcatggctactatgataaaagacaataaggcatatggttccatctaaatctggaagttgtatactttccatagaaacttatataaaataatgcaataaattaataaggaaagtaacctattagtaatttggaaaataagtaaaatttgggatttattattattattattttgagatggagtcttgctcagttgcccagactggaatgcagtggcacagtctcagttcattgcaaccttaacctcccagtttcaagtgattcgcctgcctcagcctcctgagtagctgggattacaggtgcccaccaccacacctgtctcatttttgtatttttagtagagacagggtttcactatattggccaggctggtctctaattcctgacctcgtgatccgccctcctcagcctctcctcaaaatttgggaatttgtctgagcaagtagtactttagaattgttttttttctcatctaatgggtttctagtttatgaaattcaattcaaccttaaatgtcaaatatttaaattcttacttgttatattacataatgtatgcatcttgatattgtttgtacactagagactatgcaggcaaacttcattaatttgtagatgaggaaatttaagcacaaataatttaagtgacaatcatttgtgataattataaacaatgcctaagacaaaagccaattgaatgttagccccgtgatatcttcttgctgcttcacagtcacactagagcagcaggaagctctgtagcttgtacctctgatttgttaaagttataaaatgttagaaaatgtgttgttgcacaataagtaagacagatctcctaagaaaatttactctggctactaaaatatgaactatgatcttgcttcacgagaacgcttctgacagaattcttgaaagtattgctctcctgaagacaagtgctttagaaacacataattgtccccttcatgaaagtcaaaaccttcccttctatgaaccaacatacgtctctctctatctctttttcaagagagtgagtcactgtatgaaaacttaatctatacaagattcttacaaactggagtatttttaacctaactaaaattcagttttactttcatggtcagcctttccagagagcaacatgtatataaaaactgaactcacaattagaatgggcaactattatatggttaatagtctaaaaaggaaaagtattagaaaagtttttttttctttttatttagaggagacagcaaaatatttcttacataatccttcagagacaatgaaaagtaaaccaagaactcttaaatactaaagagatacaaaaaaaattaattcctctgggcaatatatcacatgtagtagattgtaacacaaaaatcaatgagacataaatgaatgtaaattccccatgagatttagaatattacgtcaaaatgcatgtatagatcatcatccacatgttacagaagcaccagcaccctaatttgtctttcaaaatatcataacaaaattataagtcaacatgtactacattttagatgcttaaatatttcaagacaaaattaacatttaatacatataacaaatgttagcaatttttaaccaggtagacaatgataaggtcatatatcaaatttaatgtaatggaaagtccattttataaagaatgaaatttgcaagtgtacagaaaaattattctctttttgaccattttagttgataaaaaggcactagaatataattttctaggaatacagtagaaagtaagatgaggtttcattatctaaaaaccatagaggctatgacaagcagtttaacaaaatcaataattgagatttttgttgaaatacattagagacttagaaaaaggaaaatgtaagatatatatgtataatcataatgtattcactttcttcacttagaaattcaatattttgcaaagaataatatatgctctcaacttcaattacatttattttgtaatgtctcagtacaatattatatatcttaaatgtactatggctttcaaaatatagcaaaagggatataagtttaatgagttaggaaaatgagctataaaaaagtgatgactaaatagaagaatttacaaggattgtaactatgagtgagaaggcttacacaataagatccatcaattacttcttccaggaaaactaagctttaattatggaatggcagaatacatcttcatttaaacttatttctcacatcagtgtttggttgggagaatgtttctgcatggatttttgtggcttctttattcctaaactagaaactagtgtaagcgcgtgtgtttttgtgtgtgtgtgttttaatcaagattatttgaagaaaagaatagtattacatctaaggagaaaactatgtcaaggagaggaaaattattaacaaaaacattggacacagaagaaaaaacaaaagaggaaagccatgtgtcaaaatttcacaagagcctattacaaaatataaagagactcagagtttcaagattatatgataattttcaaaactccattaaagacataggaaaatctattttctacagatggagtcaacttactctttaaatgaagtaaacatggaatagcaatttctgaaggcaggtcatagcaacttgagaatgaaattatgtgaactattacaaataattaattacatacattttatttctttttgttaaattgtatgagatttacaggttatatgaaacaactagctctatcaaattgatataaacaaaagttattcatgtaaaaacagttcaatgattttagcttttaatgtttaataatttttaactttgtaaaggaaacatttacattagaattttaaataggattcaaattatgtgaccactagtaattgctttatttctcagatgatctaaaattaattgaggggggtaagcccatacaatgtatatggatatgaggtaaaacattttgtattagttaccaatctaaaaaacattgccaaatgctaacaaacttttgcagtttagaatccacaaatataaaatctgaataataattctaaatacttgggtaacattgggagctctttattattcaaataaaataaaaactctttagagtgaatattgaatgagttcatttttgtaaaattggagtattcccaatgtattagttttcacattgctataaagaactacctgagactggataatttatgaagaaaagaggtttaattgactcacagttctgcaggattagcaggaagcatgactggaagacttcaggaaactgacaaggcagaaggtgaaggggaagcaaggccccttcttcacatggtggcaggagagagacagagagcaagtggggaagtgccacaaacttttaaaccatcagatctcctgagaactctatcacaagaacagcaagggggaagtttaccctcatgattcagtcacctcccatcacgaccctcctctaattttacatgagatttgggtgggtactgaaatctaaaccatatcacccaacatgcagtaagtgttttgataattcttttgctactgttataatactgggatatgagaaaagacatgtacatcatgaattccttgacttgtgtacagtgtccctagtttaataatcctgggaactggtaagtaaagcaaattcaactggtctctttgctcaagcttccttcagatatccatatttaattgttaatatccactgtaaatctttgaatggtatatgttatacatgtgcaatgcttatttcaatctagctatactttctttaaacatccaaaagccttttgatataggcacaacttaccttccacattgcacacagagtaaattcttaactatccaaatgctggttattagtctcagcaatggctttaaaagctttgaaacaaatgattagttaagaactctatgttcattattttagcaaaggtaaaaataatctaagtcatagccctgatgtaatctctgttattcttaaccagtgtaaagtagtagttatatatactttgttattttaatttgaaagacaatgatttatgatagcctcttcagtttgtgggatctcagtttacttcaaatctaaaccaagattgaaccaaatagcaaatggattttcataaataatgagagatttaaaaggtgtgatctagcaatggatacagaaaatagagtaatctagatgttgttcctgttctttttttattttttattttgttaaagacagcgtcttgctctgtcccccaggctggagtgcaatgttgttatcatagctcactgcaacctggaacccctagtctcaagagatcctccagcctcagcctccctggtaagtagaactacaagcaagtgccaccatacctaatttttctatttttttgtaaagatggagtcttgctatgttgtctaggctagcctgtaaatcctggccttaagggatcctcctgcctaggcctcccaaagtgctgagattacaggcatgccaccatgccaggcctgttcttgtccttaagtaggtccactgtaagtgattctgggcagacatttatctcactatagctgtcagctttagaaaaagtcacttaggtaactttgggctgtgaaaaattatataatcagttcaggaacccctttggttttctatcttgatttatttgtccatagcacttggattagaattgggtacttaaatcaattcaagaaaaatattaagaaagccattatctcattatacaacaaattaagccaggattgttggcatgtgcctacagtcccagctactcaggatgctgaagtgggaagactgtttgagcccaggagttcaaggctgtcgtgctcatgatcatgcctgtgaatagtcattgcactctagcctgggcagcatagtgagactctgcctctaaaaatataataataataataacataaattacttctataaaaatatatgataaaatgtgaatattgaattatgttttatatcagggatgtgtagggttcatttgctgtatcttcttcactttcaaaaccaatctcctatctttataatacaataatatatctttatgttaaatacaattggatatttttctaataaaggattaagcaaattaacagtaggaactttaaaaaaaagttaattctatgtgtgactcattttcatcaatacctgtctgtaattcaaaattattttaaaaacaacacaatattgtgttgattatattaataattgagcattcaattgagatgttccatattacttgttcctaaattgccaaaatctaatcaggaaaatgcaaacaatttgctttgtgttctgtttgtagatgttcgttgtttactggaaatatttggaatgtgggacaattcttattctaccttccttgatatttcttccccactcatttcttgtgattctattttcaataatcatctttctaacatatataagtctataacagtaagttttagagaaatgtagtaactatattgcatcatatgaagagagtctgtattctttttattatttatttaggaacctctagcccagagtgtaatcgatattaaattttttggtgagtgtataagtgagagcattaatcaatgaaacatataattttttatctaatggaatcacctagtgcttttttgttattcatttacatttctagttaaagccagtttatgtgtacatctttatactaaataccatcaattttttttctgtcattacacaatcagcatataaattgtatgaggattaaaaagtatttgattgactaaaaatgcaatcatatttaattgtgacttccctcaaaaggagtatgggtacctcacaaaactatgtatcaacccataatattctgttagtaaaaccacttattttaaaaaagaagtgctttgtcgtcaaaaacactgaaggctttcaacgacaatgaaaaaccatagattgtttacactttttgtcttaaagaacaaagtatgagaagccttttacattttgtttcttttaatacttgttttgaatgagcagatgaagtaatcaaaattatagagcagctctaccctgctacgctgctaagctgctatgctagctctacgctagcccctattactacaagtaacagctagacagacaatgtaataaattctgttgtcttactgtccttatacagacctgacctgagaaaatatcactctagtttcacacacatgtttcatctttttctatgtttgagaattgctctcactttgataagattcatggccatgaattgggactatagttggaacccccacagtgtcaagtgatctttttatttctcccttgcaagagttctatatgcccaaagttttcactttaaaacttcactaacttatctccaaagaataaaatcttgcttttcacttgatataaatggctctaccactcagatcacatataaaaggaataaaaagttttgtgctatctgtttgtctctattgtgataccatattggtttgcatggaggtcatgaaactctctgtgaccagaagaattctcaggttgagtgtggaagtgtgggcaaagagaggttttgccctcaaatccacaactttggcgtctagtccacctgtgttctccaggtcagcttcaccactgagatctgtactttgcaaggcacaggacttctcttaatataactgaatccttgattcccatttcatatgctacttctgttatccgtggttggaacttttaggaagagaaaggtatgattattagacaccctatctataagtgaccatgtcccttttattaaatgcaataagggcccaaagttaacatcatcttgttaaattaacaaaaacattccaataaataaagattgtgaatcccttttattgctgtcaaatgtataaatatttattactttaaatggaatataaatgacactagacattgactatcattcagaaaggtttccttgtgtttttgtttgttatttttacctttcctttaaggttttctagctcacagttgggagggggaaacatattacttgtgagactgcttgaggcacattaaagcattaagcagccattgggcaatcgagtcttagaaagctcccttgtgaacaaatgtgtataaaaaggggacaaagaattctgaatgatttcatgctgaaaaacatacagagtataagaaaataacttataaatctggggttttctacgacttatgactttttctcagaaaagagataactcatctggaattatttctgatttaattacttggacaaaaacaaggtacattttgtttcccattttaagggttcattagggtcctaccttgcaaaccccatgcagacagagagcaccctcttctgtcacttaattttagagccagtatacatttttctctgataccaatttaacaggattttgaaaagttcttggttatgaggcatcatgactaaaagtacttaactgacaaaatggccctgaatgaaaaccatggagtcctcaggagagtagggctgttttgggaaggtgtttttatcatcttagagattccgtttgatgttcaaaatggcttgtaaataccaccatggggtaagtgactgtaagtttctgcgtataaaaaagcccattcgtgacaactactgcttctacattaaatatatcactggctgtcgtatgaactgtgtcctcactgcagcaaatacagtagattctgcttctagtgtcaggaaattagaactctgagcattgatggtcatgcatttttatcttggatctatccataatacactggaaactgattttctcataacattgaatctacttatgtaggatccatcagtgactttttttctcatttgagaatttgcacttttgaaataatatctggttataagtactatgatgtgaatttatccagggaaattctaaaactagatttagagtatttgcacattggatcccctgttttttttctgatttaataagaattctactttagaatacatgaaaatatgtgtgtgtgtatatatgtatatatgtaaatatgtatatatctccgtgtgtatatatatgcatgtgtaaacatgtgtatgagtatacacatgtatatacttataagcatacgcatatatacttatacatatttacacatgcatatatatttacatgtttctatatgtgtaaatatgtatataagtatacatatatacttacatatacatacacacatatacttatatacatatttacatatatatgtttacatatttgtgtatatatgtaaatacgtatataattatacatacatattatatatacatacacatatacacacacatatatatttacacacatatatatacacacgcagattctcccaataaactactaaggatattttgtatttatctgtgtattcatttatctggcatttccctaaaatgggcttactggatgataataaaatgacacagaatttcaagtatacattttaaaatatatgcacaatacagcataatagagttaattcttcttgaattgaaagtttcaatgattgcttctcagactacaaatatttcttatatttcttacttttcatacttctgcattctcttgcttctcttctcattcatttacttttttatttgaatcattcttttttttacaatactcttttcctgacccaaaatatattatagaaaatatgtaggactgaactcaggtctactatttgtaccctgttattcaaaaatctcatttactcccatggctttgtcctatcactttacatttttctatctacatgtggcctttctcctgagttccattagttcagactgcttgcatgtaggatgtcttcatgttggatacccttcaatcaacttgaatccatctttgctccaaaagccatgatttctctggacttttcaattttaattttttttttttttgagacagggtctcactctatcacccaggctggagtgcagtggcatgatcatggcttactgcagccttgacctcccacactctagcgatcttcccaccttagcctcctaagtagctgggactacaggcatgcaccaccactcaattttcatttttgaaagggtaattttcccatatcccaagtttaaatttttatggctacctttgtctccctcctagctctcatttttctacctactcacatttctacttactaagttctttttattccctctgaaactagttcaatgcaggcccttaggacttggcaccaggaatttctattattcttctaaagccctctctgcctctttctttatttctgcaaagaaatttcaaaaacacattactggaactttactctacacgtttcgtttcctaagttctcactaccaaagctttcaagaacaacttccttcttgaaggtcccgcatcctgctgtgcttagaacagattagttcaatacttacactgttatacttctgccaggcttccaggtccctcaggcacctgtgtgactgaatccctggctcatctgaaagttgaccagagtactttataataggttaaatgcccatgttagcatgttttttcctcttatggagtcatgcttaattttggaaattcgttggtcactaaaaaaaaaaatagtaatatttattgtattttagtctatcattaaatgttgtttgttttattaggacttttctgatacctaacacatattcccatagtacatttcctaatacttctcattctcattcaaattatctgtttagccctggtctggactttctgtagaggtcagcgggatccatgtgacctttgcaatatatgtgattaggtaattgattttttttaaacaaatactcgtgcttagtacaatgctctgtattaggaatagaaaaattcataaatacagaattggtgctttctccatattttcaaactcttttttggcattatatatttcttatcttaccataagatattcttattctcttctctatttattttacaataaaatttcttctcattttattctttctttaactactgatttataaattagattttctctaatttaatgcatttgtttactcatacatcagtgaccgctgagtacagtatcacagtatcatattctaacattaagcttgattgatatcactatctcagattgtttttacaagcattactcattttaccttgaatacaatcttggaggtaaatgacataatactattataaccattttacatatggataaaatgaatagcacagtttcaaagcaaactgatgatttgacacacatggctggtattcttatcactcacattctgatttcttctgtgtgtatatgtgtgtaatgacttgctcattggtataaaatgttaactcttattatgatgatttttcctgtagtttgatcaaacaaactctttttgtcccccagagaataaaaacaagtcaataaccacacaaagattttcgttctcaagggcagcatatttcatttgcatgattcagaaaatgtttagtcttggcaggattttcttaacatcttgaacatgagatatgtgaataaaattttctgatattgttttaaaagtacacattttaaaattggtgctgagttgagatgaaaattgaatgcattgtgaattacccaaaaataataataactttggttaaagatacaatgtctaacactttgcctaattgaaatttaattcatctttaaatcaatcactaattagcctttatgttgcctagaaaataaaaagtgtttaaaaaaatattttcttcctgctaaggtgtagtatttcttaaagaatgtgtggtatttctcaaaacactcaactcactgaattttatttgtactctacatagaaaaacaaaattgaacactagtctgtatagaaaggtgttgcagacacccattcctgatgtggatatacaacatcaactgtttttcttccacctctgagtgatcattttatccagttctagacaataagatagatgtggaaatctgctgtgttttctccaatttttcatctttttctgcctcgtatatagacatgtttaaagccattggagctatgaattaacaagcatgtgggaaaaaacaaataaattgctctgcatccatcctgctaccacctctcaccatgtatttacataaaataagttcttatttaagttgctattaactgctttttaaaaaatgtatgcaacaataagcatttatagcagatattgaagggtaccactatatacagaaaaaatgttgttgtacatcaaaaatatggattcaacaaggaatattattataatgaataatctaaaaataagattgatgcctaattttagatatatacttacattttgtatcaaatgaaattgcaatgtaaagtaagatgtacgttttcagtggcatgagtttgaagtatttttgtttaacttttgaatattttttcttttttttaattatacttcaagttttagggtacatgtgcacaacgtgcaggtttgttacatatatatacatgtgccatgttggtgtgctgcacccattagctcgtcatttaacattaggtatatctcctaatgctaggaaagctcagaaaataactcagtatctctataagttttaacttaaaatattatagaagtgggacaaaatcctggtaaactatctctaggtaatgtagtaacatatggctagctatttaattgggtctaaactttatataaaattacagtctttgcagaaagttttggtataaattacataaaggcatcacctctgatttgctccaattggttttatatggtgtcttgacagcaaagagaaattatccatgattgatagaaactgggagataaagcatctacttgaaacattagaaagaacgaatataatcagtgtggcagaggaaaagctgaaagggagaaatgtttctcagtgactttattttcaatgttaaaaaatgcatgccactgtaatcccagcactttggaaggtcgaggcgggcggatcacgaggtcaacagattgagatcatcctggctaacctggtgaaatgcggtctctactaaaaatacaaaaaattagctgggcgtggtggcggatgcctgtagtcccagctacttgggaggctgaggcaggagaatggcgtgaacctgggaggcagagcttgcagtgagcagagatggcaccactgcactccagcctgggcaacagagcgagactccatctcaaaaaaaaaaaaaaagtatgccaaactttaagaagtaataatagtaaggtgtggaaggaaacataaatttaaaagtcagtagaaagttttggtgggaaaaagtttgcaagacatggaagtttgttataaacaaaaagagaaaattgacccacatatactttttttacttttttggttttacttaagcttttattttaggttcagggttacatgtgcatgtttgctatataggtaaatttcatatcgcaggggtttgttgtacatattatttcatcacccaggtaataagcatagtacctgacagatactatgatcctcactctccttcctcccttcactctcaaatagtctctagtgtctattgttcctttctttgtgtacagatgtactcagtgtttagctccctcctataagtaagaacatgagggatttggttttctgttcttgcataagtttgcttaggataatggcttccaacttcagccatgttgctgcaaatgtcatgatgttgttctttttatgactgtgtagcattccatggtgtaaatgtaccacatttttttctttaatccagtctaccactgatgggcatttaggttgattccatgtctttgcttttgtgaacagtgctgcaatgaacctacatgtgcatgtgtctttttggcagaatgatttatattcctttgagtatatacccaatattgggattgttgggtctagtgaaaactctgctttgagttctttgacaaatcaccacactgttatcacaatggctgagctaatttacatcccttcagccatgtataagctttctcttttctctgcaacctcaccagcatctgttactttttgatttttaatcatagccattctgactgttatgagatggtatctcactgtggttttgatttgcatttctctaatgatttagaatatgtgataatatttgaatatgtaacattagtttacatattataaatattacatgttatgtaaaattagaatatgcaatgtcagtaatgtttagaatatgtgataaccttttctagttacatatttctctgtcaacataaaaattaagaaaaatcatatttatattttgtggaagcatctttcccatttgaataagattttacaaaataaagtagatatataggcacacattttctgaattatatttactaagacttaactgaacaaactaatttcaatattacagcataaacctggaaaatatataaagtatgtgaatgctttaatttgtacattattggaagtatgtgaatatcatcaatattataggatttcaaaaaagagctgtggaatgtatacttttttcccagtacaattatagaagtttgataaaataccaaaaaacaaagccatttgaaggcattgaaaataaaagatcaacagatgttcaaaattccggaaagaagacaagcaaatgatgattatacccacatcagtcttctgttttcccccttgaggtatttgtcaattcacagaaggaataatttaggattagtagaaagtggatactttggtttgctggcaattgtgtaggtctgaggaggcaaaggttagggtttgaggctgccaaggagctgggttaaatgtgctgagagaaagaaaatcacagggagtgagcctcaaattccaagcgtaatttatcctgagtcactctgtggattccaaatctgaaacttttggaaaccagacataaacaacagagtctaaggtgctgagcagagatttcagcagttacatagtgctaagagacaggtctgaatttaaatgcatgccaatgatgtgagactgttacacatgttctgtttaacagtgtgtttctgatgagaacacagaaggtttaaactgttggagcaagagcatacctaaaatagacgagccttaacgatgtttgtataatttttcatacacaatgtctggtatacaagtaaaatttttataaaaagcaggaaaagaaacagtatcagaagacactgaatcacagagatgtgatgaaataatgaacaaattctggagatggttggtggtgatggttgcataacaatgagagaatgtatacttaatacttctgaactgtacacttaagggacattggatttctaacattgagtctgaaagaagagagaaaggagatagaagcaattttttctaattactacctgataattttctaaaactgataaaggatattaagctctgagcaaaaatcaaggttaaaaacatccccaccacaaaacaatcacaaaaacaacataaaccttagaaaatcagagttaagcttttgaaaaaagaagtaagaaacagaaatatagttacaaagacagagacacaattcagattaccttttagggatcaatgtaaggacagactgaaattctgaagagagttccaagaagcttgttgatagaatatagtggaatgatgtctttaaagtgctaaaagatagcaaatatcagtgtataatttaatatccagctaatatctttcaaaaatgggataaaaattaataggtgttcataaaaaacgttgtgatatttaatttttaatagtcctatactaaggggaaatactaaagagagttctttaaagtgaaaatatgtcatcgcagatggaattgtggaagaaaaaatcaaaccttctgagggcacataaatgtaaacaaatattaactagtgatgtacttgggagactgtatgtagaattaacgtacattataatgatatgtaatcaaatcaaaatcacaagataaaacttcgtatcaattaggctattaagaaaaaattaaaaataacaagtattggtgaggaaataacaaaattggaatccttgtgcattgttagtggggatgtaagatagtgcaactactgtaaaaaatagtacagcaattcctccaaaattaaacatgaaattaaaacatgatacaccaactccacttctgggcatatacccagaataaccaaaagcagggaatagaataaagatttgtacaccaatattcataggaacattatttataataggcaaaagatggaaacaactcccaagtgtccattcacagctaaataggtgaacaaagtgtggtatgtgcgtgcaatggactataatcaaatttgataggaattacattttgacacatgctaccacatgaatgaaccttgaagacatcatgctaagtgaaataagccagacagtcagaaaaggacaaatgttgtatgattccacttatatgaagtacatagactagtcaaattcatagggacaaaaagtagaagggagcttaccaggggtaaggggaactgggaatgggggattattttttaatgggtaaagagtttctgcttggtatgataaacggattctggaggtgatggtgatgatggttacaccacagttagactacttaatttttctgaactgtttacttaaaatagttaaaatgataaattttatgttatatgtatagtttatcttaattaaaaatagtatacaagaatggatttgggctattaaaatgttataagtttttttcagccaataagtggtgaaaatatgactttaaagaggatatcagcaagtcaaggttgtgtgtttaagttcagggtaaacactaaaataataataataatctataccataatcaagaaagtagaaggtacatttggctactgaaaataagtttgaactttgggaggccaaggcaggtggatcacttgagctcaggcatttgagatcagcctagacaacatggcaagacctgtctctactaaaaatacaaaaaatagccagatatggtgctttcttgttgtcccagctactcaggaggctgagggggaaggattgcttgagccccaggggcagaggttgcagtaagttgaggttgtgccactgcattacagcctgggtgacaaagtgagaacctgtctaaaaaaaaattagaaatccaaaattggttatgaatattaaagaaagaaagaagaaacaactagaaaacagaaaaagttgctgcacatatcatcccgtcatgcaggtattaagcccagcacccattaactgttctttctggtgctctccctctccctataccctggacaggccccagcgtgtgctgttttcccccatgtgtctgtgtgttcttattgttcagttcccacttataagtgagaacatgtggtgtttggttttctgttcctgcattagtttgctgcagattacctcttccagctccatccatgtccctgcaaaggacatgatctccttcctttttatggctgcatagtattccatggtgtataggtaacacatttttttatctagtctactgttgatggacatttgagtttattccatgtctttgctattgtgtgtagtgctgcagtaaacatatctgtgcatgtatctttataatagaatcatttacattactttgggtacagaccaagtgatgggatcgctgggtcaaatgatatttctgcctctatgtctttgtgcaatcatcacactgtcttccacaatgattgaattaatttacattcccatcaacagtgtaaaagtgttcttatttctccacaatcctgccagcatctgttgtttcttgactttttaataattgtcattctgactggcgtgagatagtatctcattgtggttttgatttgcatttctctaattatcagtgatgttgagctttttaaaaatatgtttgttgggtgcatgtatgtcttcttttgagaaatgtctgtttgtgacctttgcccacattttattgattttttttttctgcaagttccttgtaggctctggatattagacgtttgtctgatggatagcttgcaaaaccgttctccaattctgtaggttgcctattcactctgatgctagtttcttttgctatgcagaagttctttagtttaattagatcccatttctctagttttgcttttgttgcaattgcttttggcattttttgtcataaaatctttgcccctgcttatgtcttgaatggtattgcatagattttcttctagagtttttatagttttgggttatacatttaggtctttaatccatcttgagttaatttttgtataatgtgtaaggaagaggtccaagttcagttttctgcttatggctagccagttctcccggcaccatttattaaataggaaatcctttccccattgcttgtttttgtcagatttgtcaaagatcaggtggctgtatttgtgtggttttatttcgaagttctctgttctgttctactggtctatgtgcctgtcttcataccagtaccgtgctgttttagttactgtagcctcgtaatatagtttgaagttggttagcatgacaccttcagctgtgttctttttgcttaggattgtcttggcaattggggtcttttttggttttatataaattttaaaatagtttttttctaattttgtgaagaatgtcagtggcagtttaataggaatagcatttaatctataaattactttgagcagtatggctattttcacaacattgattctccctatccatgagaatggaatgtttttccatttgtttgtgtcctctctgatttccttgagcagtgatttgtagttcttgaagaggtccttctcttcccttgttagcggtattcttaggtattttattttctttttagcaattgtgaatgggagttcattcatgatttagctctctgtatacctgttgttggtgtatagaaatcttagcaatttttgcacattgattttgcatcttgagactttgctgaagttgtttatcaccttaagaagcttttgggctgaggtgtttgggctgtctagatatgggatcctgtcttctgcaaacaaaaataatttgacttctcctcttcctatttgaataccctttctttctttcttttacctgattgctctggccagaactttcaatattatgttaaatgagagtggtgagagagggcatccttgtcttgtgggggttttcaaggggaatgtttctagcttttgcccattcaatatgatgttggctgtgggtttgtcacatatggctcttattattttgaggtatgttccttcagtatctaatttattgagagattttaacataaatgggtgttgaattttattgaaggtcttctttgcatttattgtgataatcatgtagatttttgtttttatttctgtttacctgataaattacatttattgatttgcatatgttgaaccagccttgcatcctggggatgaagccaacttgatcatggtgaataagctttatgatgtgcctcttgatttggtttgacagtatttattgaggatttttgcataaatgttcatcagggatattggcctgaagtattctttttttgttgtatctctgccagatttcaatatcaggaagatgctggcctcataaggagagttagggaggagtcccttcttttcaattgtttggaatagtttcagaagaaatggtaatagcttctctttgtacctctcatagaatttagctgtaaatgtgtctggtcttgggcttttttggttagtaggctatttattaccacctcaatttcagaactcattattggtctatttagggattcattttctgattcagacttgggtgggcatatgtgtccagaaatttattcatttttttttagattttctagtttatgtgcataccggtgtttatagtattgtctgatggttgtttttatttctgtgaggtttgtggtgatattcctgtcatcatatctgattgtgtctatttcattctttccttttttttctttaaagtctagccagtggtatatttattttattaattttttttcaaaagaccacctcctggacttgtttttttaaagggtttttcgtgtctctatcttctttaattccactatcatcttagttatttcttgtcttctgctagttttgggatttgtttactcatgattctccagtttatttagttgtgatgttaggttgtcaatttgagatcattctacctttctgatgtgggcatttagtgctataaatttccctcctaacactgcttaggtgcatctgagaaattctggtatgatgtatgtttgttcttctatttttttttttttttttttgagacagagtctcgttctttcgcccaggctggactgcaatggcctatctcggctcactgcaagctccgcctcccgggttcacaccgttctcctgcctcagcctcccgagtagctgggactacaggcacccgccactgcgctcggctaattttttgtatttttagtagagacgggttttcaccgtgttagccaggatggtctcaatctcctgacctcatgatctgcccacctcagcctcccaaagcggtatctttgttctttttactttcaaaaaactttttatttctgtcttaatttcattatttccccaggagtcattcaggagcaggttgttcaatctccatatagttgtgtggttttgagtgtgtttctcaatcttgagttctaatttgattgtgctgtgatctgaaagactgcttgttatgattgttattttgcatttgctgaggagtgttttacttcctatgatgtaatcaattttacagtaagtgtcatatgacaatgagaagaatgtatattctgttgttttggagtggagagttttgtagatatctatcaggtccacttgatccagaactgagtttaggtcctgaatatctttgttaattttctgtctcaatgatttgtctaatactttcagttatgtgttaaagtctcccactattattttgtcagagtctaagtctctttatatgtctctacaaacttgctttatgaatgcaggtgctcctgtattgggtgcatatatatttaggatagatagatttgctttgtgaattgaaacctttaccattatgtaatgcccttctttgtcttttttgatctttgttggtttaaagtccactttgtcataaactaggattgcaaccctccctttttttgttttccatttgcttggtaaattttctaattgtctaattttctttgttttgagcctatgtgtgtctttgcatgtgagatgtgtctcttgaaggcagcatactgatggggcttgagtttttatctagcttgctattctgtgtcttttaattggggcatttagtccacttacattgaaagttaatattgttatgtatggatttgatcctgtcatcatgatgttagctagtcattttgcagacttgtttatgtagtcacctgatagtgttgctggtttgtatactttggtgtgtttttatagtggctggtaacagtttttcctttccatatttagaacttcgttaaggagctctttcaaggcaggcctggtgatgataaattttctcagcatttgcttgtctgaatagaatcttatttctcatttgcttatgaagtttagtttggccagatatgaaattctgggttggaaaatgttttctttaagaatattgaatattggccctcagtctcttctggcttttaggatttccactgagaagtccactggtagtctgatgggcttccctttgtaagtgacatggcctttctctctggctgctctaacatttttcctttcatttcgaccttggagaatctgacggttatgtgccttggggttgattttcttgtggagtatcttaatggagttctctgcgtttcctgaatttgattattggacggtgttgccaggttggagaagttctcctggatgatatcctgcagtatgtttttcaacttggttccattctccccatctttttcaggtaccctaataagtcataggttttgtcttttttacataattttatattttttggaggttttgttcattgctttttattcttttacctctattcttatctgcctgtcttatttccaaaatacagtcttcaagctctgagattcatttccctacttggtctatttatctattgatgcttgtgattgcattatgaagttcttgtgttgtgtttttcagctccatcaggttatttatgtttctctataaactgactattttggttatcagcacctgtaatgttttatcatgattcttagtttctttgcattgggttagaacgtgctgctttagctcagcaaagtttgttattactcatcttctgaagcctacttctgtcaattcgttcatctcagcctcagctgttctgtacccttgctagacaggtattgcaatcatttggagaagaagagacagtctggctttttgggttttcaacatttttgcattgattctttctcatctttgtggatttattgacctttgatctttgaggttgctgacctttgagtggagttttttgggggtcttttatgttgttgttattttttgtttttcttttaaatgtcaggctcctcttctttagggctgctacattttggtaggtgtccactctagaccctgtcaccttggatcctcctgcacgagaagttatcatcagtgaaggctccaaaacagcaaatatagcagcctgctccttcctctgggagctccatctaatagggggcactgacctcattccagctgagatgctcctgtagcaggtttttggacatccctattgggaggtctcacccagtgaggaggaacaggatcagggtcccacttaatgaagtagtcaggctgccccttggcagagcaggtgcgctgcactgcagggaagtccccttgtccagattgcccaaactttccagagccagcaggaaggaaagtctgtcagctgagctgcagatatggtggctgcccatccccatggtggctccatcccagggggagatcagagttctgtttataaaaccgtggctggagttgctgaaattcctgcagggagacccttctgggtaaggagggatggatcagggtcctacttaaagaagcagtctggctacaatctgccacagcagctgtgttgcactgtggggaattcctccctgtctggaccacccagtttccctggatctggcaggtcaaaaccaaggtttttaatattgcttttgatgtagacttttcgttttccaccgaccagtcttgattattataaaaatagttacttgctgtaatatattgtgccattgttaacatgaaatggttgatgattccccttttaccccctttatccccttggtgttgattagacaacattagaaatagtgacaaataagcaacttttacaaaatatcctgttttgttatagtgatgaatgtgagttagtttgacccaatagggaagctttgaagcacgtataggctgcagcttaatattttaccaatatttcaaactccaaacttttattttactccttgggtgtttctggaaatatgaaattacatatttgaatacctttgaaactttaacttacgatatatttagatactcagaatcttgagaatcgtctttctactcattgtaaggattaccatttgattttaactgcactcagtattgaaatgtgtagtgtgataacactgacaaaacaataggcaaaaataaaaatgcaacatggaggttcttctattttactttgatgttatgattaactgttgtatcttatgacaacgtactgtatgtgtaacagtggagaactattgtgaaaagtcaaattgtaaattgtactcatagtattgcttctatgagaatgaaactcacataaatgaattgcagtctttgcagttacaaccagtctaggagaggtgtttgaggagagtcttttagacagaaaaagcatcagcttatgtttatcaggagcctaagtatcagctactaagtgattcaactgcagtattgataagtcttaaatcaattaaaattatcatctctagtgttttggcttaaaggattacattttggaaacaggaagtgagtagattaaaaagaaataaacaaggttttctggcaaatatatttccatgaaagaaaattaagaatttgtgaaacacaaactaccaaccactgtatctctaaatctccatgaagagatgttggccaaaatccagactttgagtatacttctggtgaacattcaaaaggaagagaagaacatgctattggacactagagaaaggggtatcttcgctatgtgctggaagaaatcttagcaaaattgtttcccttagagccagttaatgtggaaagaagaaatttgttgtctacttaaggagatttccaaaataagggttgaagctatgggcctatgtatttttgttgcttataacaaaatttgagaggaaaaagagaaattgagggaagaacttgtaaagcaaaaaaaaaaaggaagggcttgaccattttggatattctcagcctctccagacagcaaagaatgctaacattttgaaaaggtttccaaataacttcaggaaaataaggtcaagaacaaaagccaggagtgtgactgaataaacttctgttaacatttcagaaagacagaaacatggacatggtactcagttacacaaaggactgttttaagagattaagagtgtgccttgcagacttctcaaccaaaccgcagaatttctaggaagcctatagactacgtccccagccttgtcagcagaagcccaagaaagaagagcttatcttaaaagcagtctgtgggtatggcttttttatgactgagtgagccacagggatatttttcatgagactcacaaagtatttgagagttatttcagcagacattaccagcttggatcaaaaaagacagagagagtacaaaatgaaagaatattgttttgtacccccaattctgctgacaaacagaaggcaagcaaaactactcagctgcaaatacttgtcagctttcatgaaaaagaaagagggcagaaccaacagcacagagagttgaacccagagtaactgagaactatatgcagcccttaaatcccaaccaagcaactctggacatttacccagctggatttcagcacggctattgattagtgactattttgtgccttcactttctccatttttgaataagaatgtctataactattatgctatgactgtgccaccattgtactccaagtttgaagggcaaataacttgttgggtttgctttccagattgtcagataaagattgttatatgcaaggagtctcatccacatgtggaagtaatttagattatgacttttggggttttgatcacatgttataataggattacagacttggggacttgaaagggaatgaatgtattttgcatataggaggaatgtgaattgagactctggagtgcaccccatgatgctcaacttaatagtgttcttactctttcttgattccctccctttaagtggaaatggaacctgtgacctgcttgtaacaaacagatcacaggaaaggtggtctgtgcaattacctcaacctgactgtattatgtaagattatagtggatcttgcaaggagatttttgtctttcccttggaggttttaagaagcaagctcttatactgtaagctgccacacaggaaggagccaaggacagcctgtggctgacagaaacgaacccaaaacttcaattcagcagctggcatggtctgatatttgcatcctcccgacatttatacgttaaaatcctaaactccaaagtgatagtgttaggaggtggggccttcgaggggttattatgtcataggagtaaagtagaattagtgcccttacaagagagacttcagacagatccctttctccttacatcacgtgagaacacagtgagaaggtgtcatctgtgaacgagaaagtgtgtccacaccagacaccaaatctattggcaagttgatcttgaccttcccagcctccagaattataagaaataaacttctattctttataagctacccagtttgtagtactatattatagcagcggaaagagactacgaaagcagcccatggaaactgagttctgtcaaaaaccatgtgagtttggaaatgtccccgtctctagtcaaacctcagatgagatcacaaccctaggcagtatctttattgcagctttgagagacctgaaacagaatacgcagataaattgttccaggactcctgattcactgaaactatgagataataagtgtattattttattatttagaaattatttttatagttttagtggcacaatttttttattgttattgttgttgttacatggatgaattgtatagtggcgaagcctgggatgttagtgcactcattattattcaagtagtgtacgttgtgcccaatacatagtttttcatccctcatccaagtcccaccctcctttgttttgagtcttcgatgtccattctatcactccgtatgtctttgtgtacccatagcttagctctcacttagaagtgagaacatgcagtatttgttttttgattcctgagctacttcacgtagagtaatggcttcaagttccatccaagttgctggaaaagacattatttcattctttgttatggctgaatagtattccatggtatgtaagtgtgtgtgtgtgtgtgagtgtatacatacatacatacataccatggaatactactcagccataacaaagaacgtatgtcacattttctttatccactcattactttttctttatcctctcattggtggtttgggcatttaggttgattacatttctttgcaattgtgaatcatgctgtaataaacttatggatgcacacttctttttgatatagtgacttttcctttgggtagatactcagtaatgggattactcaattgaaaggtagatctatttctagttctttgagaaattgccatactgatttccatagaggttgtactaactgtatgtgcaccagtagtgtataagcattcccttttcatcacttccatgtgaatatctattgttttttggctttttgataatggccattctggctggggtaagatggcatctcactgtgggtttaatttgcatttatctggtgttaacgatgttgagcattttttcatagtttttttgcccagttgtatatgttttttgagaaatttctattcatgtcatttgcccacattttaatgggattatttggtttttttcttgctgatttgtatgagttccttatagattctacatattagttgttggaggcataattttcaaatattttctcccattctataggttattaactctgatgattacttattttgctgtgcagaagctttttagtttaattaggtcccatttatttatttttatttttgttgcatttgcttttggagtcttagtcgtaaattctttgcttgggccagtctccagaacagatttcctaagttttcttctagacttgttatggtttcagaaattagatgtaagtacttaatctattttgagtcaacttctgtatatgatgagaggcagagatccagtttcagttcttctacaggtggtgatccaattttccagcaccatttattgaatagagtgtcctttacccaatttatgttttgtatgctctgttgaagatgagttggttgtaagtatttggctttatttctgggctcttctattttgttttgttggtctatgtttctacttttttattaataccatgctgttttgtttagtatagccttttaatataatttgaagtcaggtcatgtaatgcctccaactttgttctttttgcatagaattgctttggctatttggcctttgctttccataggaattttaggattctaattctgtgaaaagatgatgttgatacattgatagaaattgcattaaatttacagattgctttgggcaacgctgtcatttttacagtattgatccttacaatccatgaatatgtggtatatttccattcgtttctgtcacctataatttctttcagcagtgttttgtagttctctttgtagacgtgttttacctccttggttaagtattttcctaggtaatttttactttttgtagctattataaaagaaattgagttctttatttgattctcagcttggttgttgtcagtgtatagcaatgctactgatttgtgtatataaagattttgtaaactgaaactttatttatttatctgatctaggagtgtttgggaggattctttaggattttctagggttaagattttatcattggcaaacagcaatagtttaaattcctcttttccaatttggatgcctttactttctttctcttgcctgattgctctggctaagattttaatactatgttgaacagaagtggtaacagtggacttctttgtcttgttccagttaatagtggaaatggttttaacttttctccattcagtatgttggctgtgggtttgtcatatatgacttttagtattttgaggtatgtttttcatacttagtttgttgaaggtaaaaatcttcataaaaatcataaagagatgctggattttatgaactaatttttctatgtctattgagatgatcatatggtttttatttttaattttatttatgtggtgaatcagttttattgacatgagtatgttgaaccatccctgcatccatgggatgaaacccagttgatcatggtaaattcttttttgatgtgctgttggatttgctctgctagtatgttaatgagaacttttacacctatattcagcagagatattggtctgtaattttctttttgtttgtttgtttgttatatccccttctggctttggtatccagataataccagcttcatagaatgagttacggagaatcctctccttctcagttttttagaaaaatttcagtggaatcggtcctaattttactttgtgtataaacctcaaattttgcattctaaaattcaaattttagaatttggctgtgggtgcatctggccctgagattgttttgttggcaagtctttttttttttaattactggtttaatctcactacttgttattagtctgtaaagggtttctatttcttcctgattcaagctagagagtagaatgttttgaggacttttttcattcagtttagatattctactttgtgtgcataaaaatgttcatggtagtctcaaatgatcttttgtgtttctacagtgttggttgcaatgactccattttcatttcaaattgagcttatttgagtcttctctttcttttcttagataatttagctagtgatctatcaattttgtttatgttaaaaaaaacactaacttttgtttcagtgttcttttgtatttttgtttcaattttatttgattctgctgtgatccttgttatttcctttctttggttagctttgattttggttcattcctgtttctctagttctttgaggtgtgatcttacattgccagtttgtgatctttcagactttttgatataggtatgtagtgctataaactttccttttagtgttataagctttccttttagcactgcttttgctgtatctcagaggttttgataacttgtgtcacttttattatttattttttaaaattaaatttctttcttgatttcattgttcactcaaaaatcatttagaagcagtttgcttaattttcatgtatttgtttagttttgagggtattttatggaattgatttctagttttattccactgtggtctgagaagatgcttgatgtgatttaaatttttaaaaatttattgagacttgttttgtggcctattatgtggtctgttttggagtatgttccatgagcaaaatgtatattctgaagttttggtgtagaatgttctgcaaatatctgttaggtccatttgttctacagtgaagtttaagtccagtgtttatttgtagactttctgtctcaataatctgtctagttctatcagtggagtattaaagttcccactattactcggctgctatctctttttttagctctagtagtcattgttttatgaatttgggagctccgatgcatatatatttaacattatatatgttatatgttcttgctcaattgatccatcattatataaggaccttctttgtcttttttgtaaacgttgttgctttaatggatgttttacttgatagaaaaatagctactcctgctcacttttggtttccatttgcatgaactttgttttccactcctttaccttgagtctataagaatccttatgtgctaggtggtgcatctcctgaagatagcagatatttggtctgtaatttttatcctttctgccaatctgtattttttagtggagcatttagagcatttatattccacattaatattgagatatggggtattgtttctgtcatcataatgattgttatctagtgactttgttttcctcactgtgttgttattttataagccttgtgaattttatgctttcaggaggttctattctgctgcatgctggtaatttgtttcaagatttagaactccttttagcatttcctgtagggttggtctagtagtgacaaattcagtcagcctttatttgagacatactttatttctgtctcatttataaaatttgttttcttgaatacaaaattcttggctgacagtttttgtctttaaggagaatacagaaaagaccccaataccttctggcttgtagttttagctccctcagttctctgctgagaagtctgggttaatacgatacattttcctgtacaggttgccttgttcttttgtctcactcttaggattctttccttcacattgactttagatagcctgatgattataagccttagtaatattttttttcaatgattctcctaggagttctttgagcctcttatattttaatttctaaatttctagcaaggccaggcttataacatagcaacataatgaggaaaacaaagtcactaggtaataatcattattccagcaaggtcaggaagtattcttcaactattcccttaaatacgtttttcaaattttttcagtttttcttttccctcgggaacacctatgattcttaggtttggtttggccattttacataatcccatatttcttgaataatttgttcattaattcttttttctctatttttctgttactgggttaattcaaaagccttgtcatcaagctctgataatcttccttttacttggtctagcgtattgttaacactttccactgcattttgtagctttctaaatgtatcttttatttccagaaattctgattttttttttgaaatatctctttagcaaatttctctttcatattttgaattgatattttaactttatgttggttgtcacctttctattgtatttcattgagtaagtgaataatcaatcttttgaattcttcatgtgttatttcaaagatttcatcttggtttggattcaacagttagtgagaattagtgtgatctttggggatgttttaggacactattttttttaatattgccagaaatatttttctgatttctcctccatttgtgtagaatatttcttctaattatttttgaatttatttttaattcaacagtgtttttttaacttctttagttttttccccttaaggatgtgattttacttttattatttattgtcacttagcttggctcagggtgctttaagtggtgataattataccatttccatgattatagagaatcttagtgtgatgatttttcagatgctggttgtagtagcagtgtgctaggtgtgtgagcattgtctcctttgagactggaatggcagaatctcatgaatcttatctcgtcccccagtggtgtgcactttaaaaacattttccccaatattttattctctgtgttgaacagtttaggctttagccagtagaaagtacccatggatgaaaaaacagctgtggctataacaggttggtaaatgcaatacccaatggtggacaacagtcccagcattgacaaaggcagctggggaagcgctcattgaaatgcactgaggtattttcaggggtaagaaggggccatgacagctctccttccatgccagaaggaaagcagtatgcctccaagtcacactggcccagtcttccagctattcagatcagacaaatacctcttttcatttgccagaatgctgatgtaccctgtagaatgggattgtgactctcccccttgtgcaaatctgaacctaaaaggcactcgtcttgtgggaatgtagtcaccctgagtattccagaaaggctgtctatagatacacccctgcagagctcacatgggagaagccccagcagtgtcttcagtggtgggtgaggtggagaataaatctcattctccgaggtccttcataacctttagggctgcctgactgttgtgtgagagccacaaactttccctactgagcccagaactgcacctgtgcctctgttgaaagaaaatttccacaagaggaaagaaagttcagagacacagggcctgcagtctagtttcttttgtcctatggggtggtcccttaatgtcgtgcacttccccttctcctaagagtagcagcccctgagggctaggcaactgtgaattctcctgctccttagtgtctagccacccagtagggctgccatgttccagtgtggtgctatagaatatctgcatgggattcagctatgtgatttgttctctagtctcccagcatcaggtaccagcatcagttctgatgggggtaggagaaatacagattcttcaagattttttggttataaatagccttattgtgttggttatctcaaatgcaagctgttgtagtaatgtgcagattcaggacctcctggttatccaggatgatgcaggcaatgctaatagctacagtcatgcaaaagttttctcctaagtaagcactgttattgtgtctgcagatgttgtaatgggctgtgccagttggcttccagctgggaggtgatgctttccaaagagcaccagctgtgatggtaacagtgaaatttctgcttgtcttattttacacagtggaagtattctcgtgcctctggcaataagcaggtccatggagctctcaaaagtccctgtgtgttatattatgctaccagcgcaagtagaggagcaaagctgggtgggggtttagtcatgcaattctggctccccacatgtgggttggggaatgtgtgtttccagtcaaatcttatattgaaatgtaatcccaagtgttgaaggtggggcctggtgggagatgattggatcatgagggcaggtttctcatgaatggcttagtgctacctctgctggtactgtccttgcaatagtgtgtgagttcttgtgaaatctagtcatttaagtgtgtagcacctttcccctcactctcttgcttctgcttttatcatgtaacgtggctgcttcccctttgccttccaccatgattagaagttccctgaggccttcccagaaacagatgctgttatgcttcctgtatggcctgaaaaaccatgatcccactaaaccccttatctttataaattattcagtctcagtattttttttactgcaatgcaagaatggcccaatacagaaaattggtatcaggaatgtggcatttctgtaaagatacctgaaaatgtggaagcagttttggaactgggtaatgggaagaggctggaagagtttgcaagactcagaagaagagagaaaaatcagagaaactttggaacttcttagagactggttaaatggttgtaaccaaaattctgatagtgatacggacagtaaagcccaggctgatgaagtctcagatggaaatgagaaacttcttgtgaactagagcaaaagtcatacatgttataccttagcaaataacttggctgggttgtgctcatgtcctagggatacgtgaaagttttaacttgagaatgatgacctagagtatctaacaaagaacattgctaagcagtaaagtgttcaagaagtagtgtggctatttctaacagcctagctcagatgcaggagcaaataaatgtgttggaacttatatttaaaagggaagcagagtatctaagtttgaaaaatttgcagaatggccacatggtagaaaagaaaagcccattttcagtggaggaattcaagcaggctgcagaaatttgcataagcaaaaaggagccaagtgctaataatcaagacaatgggaaaaaggcctcaaaggcatttcagagaacttcccagcagccccttccatcacaagcccaaaatctaggagaactgaatggttttgtgggccaggcccaggactctgctgccctgcacaccctggggacactgctccctgtatcccagccactgtagctcaagctgtggttcaaaagggcccaggtacagcttggtgactgcttcagaggatgcaagccataaacatggtgagctccacatggtgttaagcctgtggctgcatagagtacaagagttaagaattgggtgcctccgcctagattccagaggaagtatggaaaagcctgagtgtttcaggcagaagcctgctgtaggggcagattcctcactctactagggcagtgaagaggaataatatggggttggagcccccacagagtccacaccggggcactgcctagtggagctgtgagaagagctccaccatcctccagactgtagaatgggagacccatcagcagcttgcaggcagtatgtggaaaagccaaatggattcagctataacctgtgaaggcagctgcaggggctgaaccctgccaagccacagaagcggagttgttcaaggccttgggagtccaccccttccatcagtgtggcctggatgcgagacatggaatcaaaggagattattttggagttttaagatttaatgactgccctgctgggtttcagactttcagagggcctgtagcccctctcgtgtggcccatgtctcccttttggaagaggagtattttcccacctatattcccattgtatcttgtaagtaactaacttgtttttgatattacaggctcataggcagaagagactagccttgtctcagatgagacttcggactttggtcttttgagttaatgctacaatgagttaacactttggagataattgggaaggcatgattgtattttgaaatgtgagacgagcacgacgcgtgggaggggacaagagtgggatgatatagtttggatgtgtgttcctgctcaaatttcatactgaaatgtaattcccaatgttataagtgaggcctggtgggaggtgattggatcatgggggcaggtttctcatgaatggtttagcaccatctcccttggtactgtcctcacaacagtgagcgagttcttgtgagatctggtcatttaaaactgtgtagcccctcctcactttgccctgttgctcctgatctcaccttgcgatgggcctgccccctcttcgccttccaccatgatgtttcctgaggcttccccagaagcagatgctgctgttatttctgtacaccctgcagaaccatgagccaattaaacctgttttctttataaattattccctctcaggtatttctttataacaatgctagaacagactaatacataggggcaagcagtgggactggtgggaatcagagggcagatctctggctgctcaggtcatgttcagggaggagtgcagctgcctgtcttacataaaacaacacacatgggagctgggtgcggtggctcacacctatagtctcagcactttgggaggctgaggcgggcagaacacttgaggtcaggagttcgataccagcctgaccaacatggtgaaacccagtctctactaaaattacagaaaattagccaggcatggtggcacatgcctgtatccctgttactcaggagactaaggcaggagaatcacttcaacatgggaggcagagattacagtgaaccgagatcacgccgctgcactccagcctgggtgacagagtgaaactccgtctctaaacaaatgagtaagaccagaaaagaatacacatggggagcaggcggcagtcagccccactcagctctcatgctcttgccaaggcaggtctcacacccacagtgttttgctagcagcagctagctagtttccaggtagtctgcacttggtactccaaactgccacctaccataagccctcccaactaagagaaaaacagtggctttcaggctgtgatcctcctggtccaccctcaaaggaggggtgcccggctgaggttatataggtggctatagcacacttcccgctcctctcttggttctggcccagggggttcatccccacttgagattattttgcaaacctcagttaggaacctctggaaacctgtaacaaccacctgagtgagctggcacacttccgtgaggtgtcctgtgaagtaggattaggatgattttcctacatctctgctggagtctgagagtacacacaaatgctgctccttcccacattctccctactgctcactaagtcagctccagcgctgaacagagtgaaggcatttccctgtggcctgggttgtcctgctgctcagtgggagtgtgtgtcatggaggcaatctctcccctctcacattctgaagactcacagttttctgcctcactcatggtgtaggttgctgcctgctgcttctttcataaagtctgtagttattttcagtttttctgttaagttcttctgttgtttcttgggaaaaaaaaatactcacagcatgaaactctgcacgatattttgtccttcgaagtggcggagccatgctaacaatgcccccaacccgccatctcggaaacagaattaaacaaacaaagaaaaaacaaatacgttgttgtaatctgaaatgttggtgggaatatgcatcaaagataaaattacaacaaatttaaagatcttaactggtttatatttttaattctagaattgttctaataggctgagcaaaggatgttattttatagacaataaagggctgagaaaagtaaatatagagaacaaaaagtgaattggttgattcaaagttacttttcttataaagattaaagcagaggaaactttcttatcacaccgactaaaactggcctgtttgcggatttggctagtatttatctttcttctaatttcctggacagtcagaagaatatcttttggtttggaggtgtacttcagcatgagtaattttgtactttttgggctgttggacctaacacaggagctcagtccaaaccaatggcctcctataaatgttatctaacataagttggctgggtgtggtggctgaagcctgtaatcccagcactttgggaggctgaggtgggcaaatcactcgaggtcaggagttcgagaccagtctggccaacatgatgaaaccctgtctctactaaaacaaacaaagaaaataaaaaaaaaaaaaaaaaaaaaaaagctgggcatggtggcacacacctgtaatcccagctactcaggaggctgaggcaggagaatctcttgaacccgggaagcagaggttgcagtgagccgagaattctccactgcactccagcctcggtgacagagtgaaacactgtctcaaaaaaaaatgttatttaacataaattatgcagcgatacataagtcacacacagatgctagtataactatacaatgacattatacttataagctatatggatgtggccactaattgttgttgtttactaacagccttaagcatcttaaatctctgagaaaatcatgctgatgataatgataatgtttatataacactgaatgtgttccagttattgttataacttttgtattaattattatgtcttatgtattaatttttgttttaattattgtaaagtctccattctataaacaaaaatattgagatgcaaagaagttgagaaatttccccaaagtcacatgacttgtgaattttgtgtcacttttttctacataatatttatccaatactttatctagtttagtggactgctcctattttttttacagtttttgcttcatcctgtcacatattctaagggataggttgagacatcatgagcaaatacctttaacgttaaatctgtgagtatgtgaatatttcagcctgaagttataggaggaaaagcaagaattattataccaaagcattgcagaaactcagaaaaggtggagaggaaattccagatatgtagtaattggttacagtaaatcccacgtatttgtctgttagtattggcagaattgttaaagccttgagtttgttcaacacaaaaggtacagaaggatattagatttgattgttagagtggagtggaagtgataacacaattaattgttaaaaattagccttttttgcattataaattctgcaagaatataaactatctcacagttggacaaaaaaagaaaaggttgcagaaagcacaccaaatgcactcttttgaagagcataatttgggctatatgttttgctttacccatgaagaaacagcacgtaagaaatacattatcctggaccaaccaggctttcggggatcacagatgtttgtctccatcacaattaaattttcagtgaataaaatacctgctggaatgtgtatttttcctgcctaggcttatgctaaccgtttatgattaataagcttcagaaaccgacgattgtggaatgaatatgacatttaacataacataagcctgaacgggagtcagtgacccagataacatcaatatgctgacactacatgccaatattttgctataaaactctttctttgacacatctaggttggtatgagatatcatctgtcctctacaggtggcctctaggcaaactgagaagaaaaatgtgtgcatatatacaggacatagtttcaccttctcattaatcatctaggaattgggtgaaacatttttgtaatggcagcgtgataaatggactgatttagattttagttaaaataataagtacaacacatttcagatgtatagaatatttttaaaggatacttccagaactacaaaccaactgtcacagatattaacgtgtttgacataaacttaatgtttttaatgaaaattttacacattcagtggactattgatgtcttccattctctctctctctccctcttaagaggtaattatgactttaaatctgtatgtgttctccttatccatatttttatacatttgatgtatttattggtatcaataaatacatttgcatttttatgacattataaaaatgatataatacatgaattgtttcatacttcctttattgactctatgctcttgttaattatctaaaatacatgtaaatatgtccatgtatttctagtttgtacttatgtctactttatcatttgtatggtatttctttccttattgtgatatgtatttcaatattcccctttcgaagatcacttatgcagtttctttttttgcctattaaaatatatctctgaaaaaaacccatcaacagttgtgtattctagtgataggtcttcagaactgaaattagtatacaagggagatgcgtatcttctattgtaccagataatataataataatattctaagtggttataacagatgacatggttagcagaaaactaatatcatttcattttctacatttagacaaaaactaaaaaaaaaaaccaaaaatttgaattgagccaatagaaattgtgaaatatatgttatatttgttccataatttcttttgatttattacaagtgacattaaacattttttcctatgtttattgtctgatttaggttaactttgagttaaccatccatctaattttccctttctgttgtgctgtctaaatgtatttatggatttaaaatatttatatatcttggatatataccactgatgattacatgtctgcaaatatagcttcatacgctctcacttatcttttaacttcatgcagttgtattttaccatgcaaaatttgaaagcattcattttatcaaaattctttattatttattaggttgggttgtctgtaacttgtgttattattctactgcaaataaaataactacattactgttatttatcctagatttttttctatttatttttatgtctttttatctatctggaatatatatattttttgtgcatggtgtatcattgaaatctaactgtatctctctatatatgtatacatgtgtgtacatatatacatatatatttatacactcacatatatacacatatgtctttttctaaaaaatggagatgtcttgctctagaattacatatcgtttagcttattatttattccattgattttataatgtcacttctattgcatggcaatatttatataatcattagcctgtagcttgtatctctatgctattccagttttcttttgtcaccttcagataataagccattaacatgacttactgtagtacaggtgcatttcttttagtattttctttcttcaacttttaaaatttagtttttataaaactctgttttgtatgagttttaaaaagaatgtaacaagtttatttacaaaatgtgtatatttactagtaatccacttagaaatagataaattgatagttttacctattccttatatatttcaaaaattaaatttagtttaatgtaataccttaatagaagaaaatatatcaaaatatgtttataaattcaaggtaaggatgaatccctagagcaagtcccaataagcaaaatctataaaattaaacttctaataagtttgattgtaacaaaaattaaataaaaagcaacaagcaactgcagtatgcttaaatattcttataacaaagtacaattttatacgtgattctgaaagaatccattttcaaatagatataatagacaaaggataagttgtcaaaaaatattgaaaaatgcctctaattgattagatcaggtcaaaaaagttgattaaaatattggaacaatatagacatgaaactgaaaataaatgaatatttgaaaagatactctaactcactaatcagggtagtgaagatttacccaaccaaaataccattcgttttggcaacctagaaaaatacattcattttgggctgggcctggtggctcacgtctgtaatgccagcactttgggaggacgaggcaggcgaatcacgaggtcaggagattgagaccatcctggctaacatggtgaaacgccgtctttactaaaaatacaaaaattagccgggcgtggtggcgcacgcctgtagtcccagctactcaggaggctgaggcaggagaaccgtttgaactcgggaggcaacggttccagtgagccgagattgtgccactgcactccagcctggtgacacagcgagactccatctcaaaaaaaaaaaaaaaaagcattttgtttggagttcagcttgtgtagctattttaagaagaaattagatatttgtaatgaattaaaaatctacatgactatttcctattaacttcacttcttgacaagtatcaaagagaaagatgtgcacataagcacaagtgacatacacaaggaaaacatatccaactttgttttcctagtggaaaataaaaacatttttattattcatctcaactatataacactttgcaagaatataatacagattggtttcctcttagcttttccctaagtcaacttttgcaaagaaacctcccagtcaggttacaaacccattcccttacctgctcctcttcctgagaaaaaacttcaaccatcatgacccaacattatcataaatgtctttccttcatttttttgcttctctttttttactgctgctaggtcagtgaggctggctgcattctcacatgtagtatacagaaaatatttctgagtgcttcctttgaaggtatgaacttttccacaaaagggagtcaaggcatacattttatcagatatccaaaccacgtcctcccaatttgctaaagaattgttgaccagcctgaccaacatggagaaaccccatctctactaaaaatacaaaattagccgggcatggtgacgcatgcctgcaatcccagctactcgggaggctgaggcaggagaatcgcttgaacctgggaggcggaggttgcggtgagcccagattgcaccattccactcctgggcaacaagagtgaactctgtctcaaaacaaacaaacaaacaaaacaaaaaacaaaacaaaacaaaacaaaaaacgaagtgtttactgtgttcttgatttcttgagcatgtgagccttagtaggcgcgaatgctttgcttgccctttaattatcagtttcctgtctttatacacaattagatccacaagaatatattccaaatatatatgtctaaattcagtttgatttactcacacacttttgaaaatagaattgaaagtagttgtcattgtatcacttaggtatcaactgcaggcagcaattctccataattcatcctggccaaaggcaagatcccctttcctcaacatgcccttatttattctgtggaggaatattcctgtgctcctccttttcagcaccattatcatttcacaatattttatctcttcttgattgtgagagtggcacagaaggcaagatacagcagggtattttttcagtattctggttctcccataatatttcaggcaatggcataattgtacttctggttctctttgagattggttttggctatgttgctagttttggctgatgggctggaagggaaagagagaaatgcaccacttctgggatgatgtatataatgctgaagtaagatcctctagaaatctctttgcctccgctatgtttcgtgaacaatgttctagattgttggctgatccataagcctgggtcctagaatgaggtcaaccacaatgtgagagcagagcctcagattacctttcaaaattatgatgtgagtgagaaataaacctctgatgtttaaagccactttagttgggtttagtttgttcatgtgtataaccctagcctatatattcttactgatacacagactatgcttttagttcacaatctcttgcttttaagttaaaacatactttaaaaattgtcacctcctttgaatgttttgtgacagtcttccaaatttctagattttgagacaatttgaaatcaaggtttctctagtaatttttctagttctggagtttaatttcacaacacttttgaacacactagattctatatgagttcattaagctctctccacaatttaaatgagtaaaaaaatcaattttgttgcttcaagaaccaggcatgaaaataaataaagggagaacaagtgacatcttgataggactttctacctgccaaatttctatcttgtaagtcatgcaaatgttccctttttttcaatcttcaaacttatcttgttgagctattattaacaacacctgtgtatgcattctcacacaaacattcatacacacacacacatacgcactcatagcttaacttattaagaagatttaggtaggacatgtcagcatctcagcaaactttgtcactaatgctcccttttaatccaggaagtcatggtttctgctaagtttaaaaactgactgtataactcattaatactcttccaaatatatctgcatatttacatttctgaaacttaaaagcaaataatttatcccttagtttaggcttgcattctccatcagcttttcattgagaaaataagttctgattttggaattggaaatgcaggttaggacattaaaggcaacaagtcaatgatgacagcattaaggaaagtgaggttttattcctttttaatctgcagttaacacattgagcactaactctgtgaatgggcctaaaatatgctgtcttttctaaaactctctcaccatttaccccaggaggtaggtattgtcaacccatctcacagatgagggacttgagacttggagcttaagaagtctcaggatcaatgaggtggccaatccaggtctcgaatacaagacgtgctcactgtagggcccaccctctgtcccttatactatgctgcacacattgttctctttttgttgacactctttatgggcttttctggtggtctaggtcatgagacctaatcaagaccaacatagacaacaacaaaaaacttagatcgtcatctcccaagagaacaaagtgtcaatttttgagtccttccaataaaatggtgaacagaaaaaaaataaaaacacagaagagaatcactacacctgctacataattgaagattttaagtactgagggtttttgttccctgctatgaaataattagtttatttaaacacaaagatacagaatacttatctggaaataaaaaaataaaatactttgataataacctggagtgaatcctttcttgagtgattcccctgaaatctagcaattacagtttgagttttctgttaattttctcaatgggacaagacaagagttcaatagaaataaaatttctaatcttaggcagttctttgtgacttatgagatatcatgatccccaaagtttttaaaggaaaacaaatacctatgattgagcaaaaactatttttaaagccttcaaggcaaaaccaatacgtgttcatggttacatggtagagagcctgtcagagagtgtttaatgaagagctaaagagttctgtgtcttggttagagggcatgcgatcttttcttacatgattatgatctcatgtgctgtgactttattttgttttgtggatatcctaatcataaaatatatagccatttgttatttttctggagtcatgtagtgcattacaaatcataggatctcaacaaggagaagttgagataccaatagcctgaaatatttacagtatgtataaaaaacacattttagaagttgaggtataaagtattgtccatataataatgaaagtatatggataaaaggagtcatgcaatactttcaagtgctaaacaccttctagactaaatagtagaaactaaatagattctacaaagtgagttctgaactggatgcattttctgaacttgcagcacatggagcaaatataagggaatttagcaaagtaagtaagaatttcacaatgcagggccttagaaggtagagcaaaaggttaaaattttactctgacatttttgggaaatcatcaccatagtgtcaacatctaattgcctctgcttgtatgtggtaacaagagaagaaggagggaaataaattaagttcaataaattatggttaaattttaaaataaaaactttggacaaattcaatttaatagagtttatttgagcaaggaaaagaaaaacgattcaggaatcaggtagctcttagaatcacagtagattcagatagactctggagcaactgtgcagctggaaaaaatttataaactgaaaaagataagtgatgacggaaagtggaagcgaagtacagaaactgccggactggttacatctttgcatttgccttatttgaacatggtttgaagagttgaccgtggatgagtggttgacatctgactactgggataggcttaaacacagctattgttatcaaagcataccattaagctctgttttcagattgcctacctactaagttagaatacaggttatccataatgactcacgtatttaagtacagaggctctctcaggccaggtttaattcgatttaccataaggtgcagtgagtcagacagtgtgatgacacattgggttagtggtaatgggagtgaagtaaagtgatcagataaacttaggatatagttttgactttaaaatggcgtgatttgctggttgcatgaatgtgaaatattgagaaatacagaggaatcgaattgtctcctatattttagtgtaaactattgagcaatgtagttttatgcagaatgacaaggaaagcagagggggagaatacatactacgggcagagagcaggaagtcaagtatttggttttggaaatgatacttttgagatgactatgacatatttaagtgctaatgtccatgagtttgtttaatgtttaaatcagggatgcagaacaggaacaagataccagcgttattgacaaaaggcctaggaaggagggaatagacattgaattagaaaagcagagggctcaggactaaaaacgccaatactgagaggtcatttataaagagaaaagtcaataatttaaagaagagaagattccaaggaggaaaagcagaacactttttctttgttaggaagttagagaaggagattgcttcaagaaagcaacagggaactggtccaaattatgtcacattttataaatacattatttataaaaacaagtaaacagaatcattttcactctgcactttcttaaagttttactgtatgtattagtccattttcatgctgctgataaagacatacccaagactggataatttataaagaaaacaaaggttaatggactcacagttccacatggctggggaggcctcacaatcatggcggaagagcaagggatgtcatcttacatggcggcaggcaagacagcatgagagccaagtgaaagaagaaacctcttataaaactatcagatctcgtgagacttattcactaccgagagaacagtatggaggaaaccgcccctatgattctgttgtctcctaccgggtcccacacaacacatgggaattatgggagctaaattcaagctgagatttgggtggggatgcagccaaaccatatcagtgtattaataaaaggtatactaatatatgtatgttaatatactgttttactattttctaaataaaaatttagaatgtagcttcaaaatttttcaacatgttgtacagtagaggaattctatatcttggccatatatgcttcattctgaaggaagtgtttgttagcataaagaaattcataaagatatatttattttaggttggagaataaagtgatgcaatcatgttgataagtaccaaaatgcacttaagaaaagttggaatacatttctgattttaggagaaaaaaactactaaccaataagaaatagacactttaaaaccataatgtagggtaactatgttcatacaatatatacaacaatataggtatgtatatttataatatagtgaactatattctcaaaaaaagttgagaaactaatgggggaaagatatatctattggttaacaattagaagactcaatcaaggagaatacctgaattctgtattactgcagtattcgttatatattcaatcaacactttaaatccaaaagaaaacttcaatcaatttacttatatctgtctaaactgtatttattactcagtctgcatcctaacatgtcactcagagaacacagcaatagtatactaactggcaattttcttcagccttgctcctccccaatttattagctgtacttcaggtagaattatgtaaaaacacaaattggatcatgccatttctacatgcttcacctttcattgaaggtagaattcatacttagtattcgaatttacaaagccctaggtgatatctaccctgtctactcataaaacctcatcttgcatcatcttgctttcttcttggtactcagtctcttctctacatcttttaagtcatttcaacttctcaaatttttaaatacaattttcgcttttatgcataccacttattctgcaagcaggtcctccattctttgcacacacagacattttgcctgagtgtatgctacctgcctgtcatgcctatgtttgtttttattgtttctggaaaggtacttaagaactgttaattatgagttatatttgcctttttatattctgcttcacatataactttgtgcttcccctatcattacataaccatggcttgtcattattacctgctaatttttccatatctcaatgaaactacaaagtttattggaagagataccatgatagcattcttccttgaatgcttgagtttagtggaggacttttctcatatgatgattaaataaagaaataaataagtaaaacacattgtctatggaattataaaaaataatactaagtatgcattttgtgaataaaatattgaagaatagactttaatatccttatttgaaataagtgcgattgtcaacacaagtctcagagctctcaaatctattagggaataataaaaaaatgaaaatatgatttttcaatgaaagaacacatgatataaagaacagtaattaaataaagaatataaataaatcaagattgttagggtaatggatacactaaatttagaaaaaataaaattgaatggattttctggagcagagacaagagcaattcaagaaaagcagccataaatctaagaaaagaccgtgcagatttcgttcaaggagcacaaacaagtgagtctctaaaaaattccaagaaaaaatgaagaagaaaaataaagcaagatgtggaggggggagatcaagtggtcccttgttgatgtggtcagggttgacatttcatttgagtttaactgaaagttactacctactcgtgagcaggtcggaatcatgatgtaatttttatttttaaaaagatcacttgggatgatgtgagaagataacacagagcaaagagttggaccaattaggaccaacctgtcattactaaaatgttgatagtttgctgagcatgttttcatgagaaaggacgtttgatttaaaaaaacaaacaaaaaaccatactgcactaaaagattaaatttggcatgctttaaactttacacctgagggaagtacttcaccctaaatctggccctgataaaacgcagcagttttaatgatagaccacataatctaagctgattaaaaaggaacttgaggatgttagtgtatgagtgacagtgagaatgcggtaggacctttctctctgtctgcccttaacattttttccttcatttcaaccttggtgaatctgacgattatgtgtcttggggttgctcttctcgaggagtatctttgtggtgttccctgtatttcctgaatttgagtgtttgcctgttttgttaggttggggaggttctcctggataatatcctgaagagtgttttccaacttggttccattctctccatcactttcaggtacaccaatcaaatgtaggtttggtcttttcacatagtcccatatttcttggaggctttgttcctttctttcttttttctctaatcttcatgctttatttcattaagctgatcttcagtctctgatatcctttcttccacttgatcgattcagctattgatacttatgtatgcttcatgaagttctgctgtttttcagctcaatcagttcatttatgttcttctgtaaactggttattctagctacgcagccacaaaaaaggatgagttcatgtcctttgcagcaaactaacacaggaacagaaaaccaaacaccgcatgttctcacgcataagtgggagttgaacaatgagaacacacagacacagggaggggaacatcatacactggggcctgtcgggaggtggggggctgggggaaggatagcattaggagaaatacctaatgtagatgacgtgttgatgggtgcagcaaaccgccatggcacgtgtatacctatgtaacaaacctgcgtgttctgcatgtgtgtcccagaacttaaagtataatttttaaaaaattaaaaataaataaataaataaaatttaaagagtgaaaaaaatagattgaatctaaatgatgtggttgtgattatttaacatctttcttcctcttaaatttttgcaatgacatgtattatttatataaacaaatttttcagtgtactagtaaattaatttacttgattcattaaaaatgcatttttttctaaaaattaatataatcatttaacaataccagggtaatgacaaattgaataattctttcagtatattttttcataagttgttcactagaggtgaattaattcagagatcgatatcttagttccagatctatttccacttatttagccatctaggtgtcatataaaacaatgaaagtaaaattgacaaagatcccacctgaatgagtgctttcctaaacttaataagtttacaagtcacctgaggatcttatcaaaatgaaaaactgatttattagatctgggaatgggcctgaaattctacacttcttacagccaaccttgacccaatgctgttggcttatgaaccacacttttattaccatgtcgcaagataaaaattcttctgagatcctactctggatttggagacaatgtgtttagttctaaaggaacaggtgaaagttaacagataaatttgaccaaacaaattatatcaaacattcatctgctaagctgaaagtagtctaaattttgctataattttatgcacaggagatagtgctatgtcctggacaccccttctgcatcacttataaataattggcctcaattttctcttttattccaagcagtccagtgactagtttcatacaccttcctttcatctccaacgtgaattatggcagcactttgccacaggaggattttgtgctctttgcttccatattaaaggattctctgttaatgcagtgtgagcttctgagggagactgttctgcaccatacttatgaatcaacagagttaaagctctagagggtgaagttttctagacaataaggaacaagagccagtaaacaaatagttttcccattctgtcttgcggtcatggatccaaccaatagtcacccatagcagtgggtcaaattgaagatgcatcctttattgtattctctttcgttcttgcttctttcctccaattcttattcccacctctgggcccacagttgtcaataaaaagacttgtaaacaaggctttgcctctgtactgctttccgttgagcccaggctaagaggttaaatgatttagtttgtccaggataaaaagattacttatctagattacttccctacatgaacagggaagatcaatatttctaaggaaattgtgtccagattaaagagtattgctttatatagtaaatccttttaaacacatgccacctttagttagttacaaaataaaaaaaaaagttgattagaattacactatttccttagacttttggttttggtggcattttaaatttaaagctccttactacttgtgactcttaaccgccctgactttgagaaaaaatttctctacctaacatctttgaacattttagtttgcatttgctttgaggtttattttatattttctggcatcaaactatcccattttcttattatgctgagtcccattagcatttcactttaatttattatgtttgatagcattaatattctttttttcattgacttgttttgattgtaaatttagttatactgtaggtgtaataaaagaaacaaatacaaaaacgaagaaaaaataacattactgaataatgtttatatctagttagtatacactgataggcatctcctttatattgatacctgtgcaaaatgaaaccttttatattttcttgataaaatagctagaatcttcttcagagttatttcctgcttttgttttatttttatatgcttccattacccttgtatacaaattatttcctggattgccagttccttgttaacaattttccagatgactgattaagaagtttctacaggtttgaagttgcatcagacttttcatgcaattggctaccaccttgtgatttccatgtactgctgacacaagatatttcttgccattagtctgtttttccccttagttgtataccagactttgcataggtcatctgtttaaatctataaaataaaatgtgaaatgtagcatctcaataacttttcccagctttcattaagtagcatcattcatcatctataatggcatcattttaagtactaaaacgcaacatattcaaacaatgaacacatgaataaaaacaagaaatgatttatttgaaaataaactctattaaaagcatgcagttaaaatgtttagcataaacattatgaccactgcataatcataaacttttactgaaataagtaactataggtactaaactaaattaaattcagtttactcatatatactcactctgatatttttaaatattattctggacttggttatatattctgtccttaatgttgagaatggcacaaacctaggcatcaacaattatctttagctaccctatgtttttatagggtatttaaaaactctatccatatttatcttctaagtgatttaattcaggatctgaacttagttgcctgatgaccaagaaactaatttatcatacccttaatattattgtaggattggtgatctgaattcctcataacagctagaaagtctcacctaaaattagcgtattaacaaaattctcaatacgaggaaatatcaagaaaattaagaaaatcacagaattagggcatgcattttacatatgtcaaaagaaaatgaagagatgggattacatgaaagaataagaaagtaaagaaccatatatgtggaagtttaacaataatgtgtagatagaaaaagggataaaattgattaagtgaaacaatatttattacaattaaaataattgtagatggaataagttctagtcttgaaaaatataagagaaagtttaaattatttagagaattctcaaaaaacacaattcaaataccgaagtgtttaaaatatgttaaaaatgttaaatgaaatagaaagcacatttaacagcttgagaaaacatctaacaggattcctagaatgagacactagaggaaattgtgaagaaactggcatttgaagggataataaaaggaggtactttcttagtgataattattcaggtgtgaagaaaataatgaatcctcagaaacaatgagttctgaatacaaagagaaaatataaaaataaatccatatctagagggcaggaaaatgtggaatactaaaaatgaagaaaacttggttaaaaatactgaaggaaaacatggtgttgtcctccaaaatgaataacagactaacagttcacttggtattagggaaaatacagtacaaaatagaagtataagtgctgaagggaaactgtgctatattacgtatccctactcagctaagccatcagaaaaacccttctagacattggcttagacaaagagtccatgggcaagaacccaaaagcaaatgcaaccaaaacaaagataaatagatgggatttaattgaactaaaatgcttctgcatagcagaagaaataatcagcagagaaaataaacaacccccagagtgggagaaaatattaccaactatgcattccacaaaaaactaatatccagattctgcaaggaacttgaacaaatcagcaagaaaaaaaataatcccatcaaaaagtgggctaagctcacacgtgggggtagcttactgcctggggtactacccttgcccatgcctctagctacaaaacaattcaattgttgtttttgtaaataaaatctcagctagctctgccaactgccaaaagaaaaaaagaaaaagtgggctaaggacatgaatagacagaccattctcaaaagatatacaaatggccaagaaacttgctcagcatcacctgttattagagaaatgcaaatcaaaaccacagtttgatacccccttactcctgcaagaatggccatgataaaaaaaaatagatgttggcatgaatgtggtgaaaaacgaacactttgacactgctggtgggaatgtaaaccagtacaaccactatggaaagtagtatgaatactccttaagaaactaatagtataactaccatttgactcagcaatcccactactgagtatctacccagaggaaaataagtcgttatatgaaaagggcacttgtacacacacttatagcagtacaatttgcattgcaaaaatatggaaccagcctaaatgcccattgataaataagtggttacatacatacatagtgaatgtgacatcaagaagacacaaaaggaaaatgtcaatatcaattatatattggttaggaaggattcatagacatataaaaaagaaagactaatggaatattttaacattaactatatatatatttataaattttattgaggtataatattcataaactaaaactttcttaaagatacaccccattacaagatatatagtatttatagaatcataaaaattcctcttgttttccttccagtaaatatttccccaaaatataaccactctgacttctacaaacacagagtaggcttgcctgtgtttgaaattaatatcataatatggtagattatactatttttatctgaattctcttgtagatcattgtaactgtcagattcattcatgtgttgcagtactgtggtagcacattcatattcattcttttgtagtaatgcacaatataaaaagcacaaattacttcctataatgttgagaaatatttgggtaattcatgtgttcattgtgaataaaactgttgttcttttaccattttagccatcatttgtgattttcaaaatttttaatgaagtttaaataatcaaatcttttagcatgtcaatacttttgttaactgctaataaatatttgtcttcttgaaagttgaagagatattcttctccattttcttctcaaaactttatcattgtactcaacattttggtctactattcattttaaattgataactctgtgtagtgtaaggtagtaatttagataattttttcccaaagtaggaatctaatttaagcattttttaaagcatttactcactgcaccactaaatttcaggagcaaatctgtcataatcaggtgatattatttgtgtggtatgattgtgtttctagattctccactaaattttattgatatttatacttgtttgtatcaatagcatttttaaattgtactgttattttatatgagttcttatctgatactatattctgcaacattgttatccttcaggactgctttcagtttttaagtcccttgcatttttattgcatcatcttatcaataactgccaaaaggaaaaaaaatcagttaagattttaatggagttttgcaccaaaagcaatggcaacaaaagccaaatttgacaaatgggatctaattaaactaaagagattctgcacagcaaaagaaaccaccatcagagtgaacattcaaaaatgacttcatcagatgaagtgtttcctcaatatgccagcagtcaacattataattaataataatattgtaagctttgaccctgttagttcaaggacataatgaagacttacatttctgagttataataaacattgtattaaatgtcctaaccagttcaataagaagtgaatagaaataaaaggcaatcatttttggaaagaacaacataaaattttcgtcgtttgcagactattagttttctaccaagaaaatgcaaaagaaagcactaattatcatttagatttaataagtgaatttgttaaaagtctttggatacaagacaattatataaaagtcaagttcgtacctagtaacaaccaataaaaattagaaagtttaaattattccaatttaaatagcatgcaatatatttaagaaaacagtaataaacagaataagttgtacaagtcttctcagaaaactggaagtattacttttgtacatattagttatactgatttttaaatactgtctatgataactctaaaatatggatcatcctatggcctcttctttacttgtactaaaaggaagaagtccttctcagatatgaagcagaagtctcaaaaattaaaagatttttctaagaaattccaacataaaatgggtagggaaaaaatgttcaaatcttttgatataaagcaaaacaaacgaaatagataattatcaataagataaaagtttaaattggcagcatacttcttatcaaaaaccctggctgtctgtagaaacacaagccaaactttcaacatctttattacacatacaattctatttatagcaaaaatgcactttcaatacatgtctgcatgtgtgtttgtgtatgtgtgtgagacagagagaaagccagagggatagagagagagaaggaaacagattagcatattatccaaagttttgtggatccagtcaaatttggacttgtcaaaattaaacacacactctctcagacacagaaacacacacattaaataacagtgcataaagatggaaattgtagttgttaatatatttggttaacaaaatttaaacacatcataatattctatgttgataagggtgtgttgaactcaggaaatctcaacttgataagcatttgagaaatacaagttgttaaatatatatttataaatataaataaatatatatttttatatatatataataaatatatatatgtttgattacacctttcttttacccaagttccatttgcttagaaattaatcttattgaaatagtcatatgttctaatcatttgatcaactctcttcattcatagctatccatcaaaaacatgccatccatatctgattcaatggtcaaaatacagacatggttttggatggtgtattgtgtatattttactaataagtatagggagaataaaagcaaatctgtaatattaagtagtagtaaacaagaagaaactaatctaactaggaagtagtagagatttagctaaagtgacagtcttaggtggagacctaaattaaagagtcattttggccatgtaataatagcatgttaacatgtggtgacggggtgggagaaagaaggcatgagtggcttatctcaggtccagaagaagcagggtggctgggtgtgaggggctatgagagagaatgatatggtttggctatgtccccacccaaatctcatcttgaattgtagctcccacaattcccatgtgttatgagagaaacctggtgggagattattgaatcatggggcagtttgtcccacattgttctcatgggagtgaataagtctcaccccatctgatagtttcccctttcgcttggctctcattctctcttgcctgctaccatgtaagacatggctttcaccttccgccatgattgtgaggcctccccagccacgtggaacatgaacacgagtccattaaacctctctttcttttcttttctcttttctttctctctctgtctctgtctctctctctttctttctttctctttctctctttctttctttctttctctttctttctctctctctctctctctctccctctccctctctctccctctctctctctctctctctttctttctttctgacggagtctcgctctgtcacctaagctggagcgcagtggcaccatctaggctcactgcaacctctgcctcccgggttcaagtgattctcttgcctcagtctcccaagtaactgggactacaggtgcccgccaccacacctggctaattttttgtatttttagtagagataggtttcaccgtgttagccaggatggtctccatctcctgacttcgtgatccacccgtcttggcctcctgaagtgctaagattacaggcgtgagccaccgtgcccggccgaaacctctttttctttaaaaattacccagtctgaggtatatctttataaacagcgtcaaaactggctaatacagagaataatggaagctgacgctagacagcaggcatggaaaggaaagtaatgcctggtcaccatcacaaagagttctattagtttcccagggctgctaaagcaaaattctacaaactggctagcttgcataagcagaaatagttctatgtgctagatttctgaaattaagctgcttgcagggtttgtttctactggaaactttgaggaaaatctattctatgtcctgccctttgcttctggagattgcagtcaatccttggcacgtagatgcatggctcaaaattctgtctctctcttcacatggcctctctgtgtgtccctttgtgcctctctttccaaatttatctcttataaggacatcagtcattggattaagacacatattgcacataaccaatacatgattacaactatacaaacccaaattccaacatacccttttgggagacaacattcaatgggatatcctgcatgagttttaagtcagaaagtaattttcaaatatttatattatttatttagagctgaattgtattgagctggaacagaaaagcaagactgaaagaaaaaaggccaactagattacttctgaggtaaatgatagaattggagaaaataaaataaggtagataagtagaagtgtagaaaagaagaaaaagttaagatatatttggagatgaaattcaaaggactttctttaaagagattaagagagtaaggaaattaaggaataataacatatgtatctatgtatatataactatgttgtttactgcacagtctttagcataatgtgattactattaatatagatgtctatccacagaagaatagttaaatttattagtatatagtccaactagagaatactgcgcactctctgaaaagaacaaaatgtcctacagataatggcataaacatagcatatcttccatattagttactagctgataaaagaaaaataaaatggacataaaatataatatttatatacatgtgtattttaattaaaggacatcattagaaaatcttaacaatgctttcttttgagtatggaactggattaagaaaaaaagagaaggctttgaaatttctatttacattatttctttattttgtcggcatgttaaatgatgtatacgtgtattatgcttggaataacaaacagatgctgcttttgttatttttataacatgatcatttacccaactttatggtttaaccctaaagagttcaattcagtatatttcttaattccataaaattataccatgtgattcattttacttgatttaacaaataaaaatataaatacattgtaattcatttttggtaaaccatttcacaaaagtgtggggaaattaatttgggaattactctcctcattgaaaaatatctcatttgctaaaataagacagtaaaacagtacagtttaaatatttataaaaataggaaagtttggcaaaaagagaggagtacacacctgtgactactgagttgctgtgaaaatttcatttcctgatacaaaattgtctaaagcacttggcttttgttcagtcacaatccaaagaacaaaaccagccaagttttatataacgaacatctagttccctagagccttgtatcagaaaacctacacaactttttgaattttctagttaaatttgcaataaagttgttaaatgtttttgggtatatagccctcaaattcttaatttgcttcatacattgcattggggttaaaattcatagtgtcaaaatcagctcctttcttacatgtggtataaaattctgtctgatgtttgtctgtctagctcctatcctatctaacacctatcttacttgactagatcctttataggtaccaataattacattatatttttaaggaaattttaaattcactgaaaagagctgaaagaaggacaaaagcagaaagggagaaatatattattttacattgaggacatattttgaaatgctttaattagtatgcagcaggaaggtataataacagctgtaacttccttgattggtgaaatgtcactccataatacaagtttatttacttttcaattattaattgaagagtcttatcattatttcatcctattactgatgaaaccaattactaaacctattactaaaaccaatactaatctaacatcaaactgatggtgaattctataaccttatttgtggttccaaatcttcaccttttaaaattttattttgcatcgtggccacttcctttctccttatacccaggacagtcatggaaattatttcatttctaggcctatgataggaaacataaattttattaaacaagaatgtccaaaagtacttagaaagtttcatgttattgatctcagtgatgattacatggttgttatcatgttgtgaaaaatttctgctgcaatatatttatgatttaagctttatttttcatatgtgttgtgtatcaataaaatctttacagaacgttatcatccaattaaacaccttatgaaattagaaaatcacacaagactgatggattaagatttaagggtgaaaatcacaggaaggcttgatgatttgaagctttcttttccctattgtatttgttatctgagacactgagaattgagacttagccaaggcagttggtctatgctggaatagaagaatgagcagagtatatggctttctgtcttccaaaaattcactaatatttttctctagataggaaaccattttatctttacaactttcttgtgaatttattatcttgatatatcattcttgatatttcaatgatgtttctagatcattgtaattgctgcatatctactaagttttctatttctttaggttcatttgtatcttattcttgaaaattttctattagaattgtgtattttactccttagagtgttttctcttaaacttaaaaaaggtgttctttagttctttagcttatctttcagggccttttcattttacccacttaccaatttctatgcttatttttcttgttggttattatattaatacaatttaattccacaaattagacactaatattttatcatttgtaacaaacaatacttttccaccataaaatcacagtttttcttatgattcatagtctgtctaataaatggcataatgtgaagacaaacattcccctaagtccttttgggtccttaaaataatttatataaatgtcatatcgttatagaaaatatgacatcagattttttcaaagtctttaaatatcttcttatatgttacttttctcatttttatacttgattctacatgagttattggaaattaccaaatatcttgtgtactgcaagttcatcatctaggattgaaacaaatgttggggcttatagatatactgtttacaagagtgtgtgtgtttgcatgtgtgcacgcttgtatgtgagtgtgtgtttaagcctcattttcatcggcaattatagaaacatttttcagtgagaggcttaaggtgtttttctgcatttaatccacagaaatgtttttcttcttacttggtaacttatagaattgctagtatttctgtctaaggggaggatggaaaataaacatagaatcatcagtgtgttctacatgattgtactgctggtatgtctaccttataaaaatgagagacaaatttagcttctggctctgagtgtgcgtagagttcagaataacatttctattaaaatatcttcaaaattgaacaaaatattggaaacatttttcttatatcagacaataggcagtgtagggctacgattcttaagagacaggaagctaacaaagtaagctcaacattttccccagacattttggccaaggacagttctacacagtagctaaaggaggagggactggaataaaaaccagcaatcttgctgagtggagcagacagaacacaaagttaagggaaaagaagaaaatgcggagaagaagtgttccaaaaatcttcgtaagtttggccttgagcctttggcatgcatagagtgaaattctacaagggaagactaagaaaatgttcctggaaaataattatgagggagttataattcagacaattcccagagctcatggatggcaacaaacctttgcgccctcactagctggagaatagaaggtggactaaatacaagcaatattgagtagagaccactatgcttgaaaaaataaattaatataaaataaaatattatctcttaaaaaataagacatttaaaatttattgtctttcctatggcctttgccagtttttgaaattaacgtgccagctttcataaagttggagaaatatttgtttattattgagaacatttttccaaaaataatttttatttctggaatttttaaattattcatacacaaaattttctgcaactgtacattttaaagccatatttttttcttcaacttttattttaaacaaatttacttttaaaattcttggctggccatggtggctcacgaatgtaatctcagcactttgaaatgccaaggtgggagtattgcttgaacttaggagttcataaccagcctgggcaacagaatgagacctcatctcttacaaaaattaaaaaataaaataaaattctagtatgtggcttcaatatgttcactctaattacattaagtaaaagatgagaatatgcccacatttatgctttcttctttaaaagtttccctttctaaataaccacacaagagatcattttccccacatgttaacatgctctaagatataagtctaaactgttatagtctaaattgcatttgtataatctctctctgaaaatattgactgatttctgctttaaaattattatcataattatcatgtcatgtattatcaccaaattcatttgatggtatcaccaaattcatttggtgataatcattctttttaaatagttaaaccattcttttagtcgtaattcaaaaaagatacttgcacacacatgtttatagcagcacaattcacaatagcaaaatcgtggaaccaactccaatgcccattgatcaacaagtggataaaaaaactgtgatatatatatatgatggaatactactcagccataaaaaggtatgaactaacagcatttacaatgacctggatgagattagagactattattctaagtgaaataactcagtaatggaaaagcaaacattgtatgttctctctaacatatgagacttaagctatgaggacccaaaggcataagaatgatacaatatactttggggaagagtgggagggggggcgaggcataaaagtcaacaagtatggttcagtgtataccggtcaggtgatgggtgcaccaggatctcacagatctccactaaagaagttactcatgtaaccaaatatcacctgtataccaataacttaaggaaaaataaaattttaaaaagaattttatataccaagtaaacccaggaaaaaaaggtaatagtactttttttttttgggcagaaaaaaaacccgaaaacactcttttaaaataactaaaccattcttcttaaatagttgttacattgtgagaaagaggtgatgaataattatagcatatctcattctgtgcacatttgcaaagctgttgcttttgatcctaaggatgataccttacttttatctttagttttttttctgattctgctgagatgtgtgcatttgttctttttcatgttaatttgagaaaagttttaattccccgtagtgagggtgaaattataacaaacactcatgtatattctaactagaattaaaaataacattaaaatttaacatgtttaactaaatctgctttaataaaaattacaaattttacagacacagtcaaaatagttttaaaaattcttcccacattctgttccactccctttcacactctcccaagcatcactattcttaacttaggctgtttatttctaaatgttgttaatattaaattctattccttatatattcattaataatagatacgtatatcttatatacaagtgtttttattaaatttacattgaacctgtggtatttaaagtataatctggtgacttgtttcttgatcaacacttgacattgaaaatctatccatataaaattgccagttcattaatttcaactgttgtatgacattaatgataatgcgatttattcattcattctcctagggatggctatttttgttacttctgaattctactacaaaagagtgctgcaataaaaatctttgaacaagttctaatgccgttcaactggaattgaagttttcaatcgttggatatgtcaaaatttaatcagattgtatattgctcaattactttcaaattatgtacaccaagtcattcttgctctggcaaaataagaatattttcattaatatatcattcaacttgaaattgcccagcttttccttctcatttccccccagtcaaatgagttgaattaatactgtctaaaaatatatattcatttgcttacctgttagtatttgttccatgtattaagaagctttgctagtatatgaaaatatatgtattaccatgtcttgtgaattagtacttttatcattttgaaatgtttgttttcatttctgctgaccgttctaacctgggtatctattttgactggtttttaatgtaactactaacatctttttatgttcagcactttttcacaattttactttcaatgtctttatttttaaaatgtatcttctgtagacagtgtacaggtggtcttgttttattgtaaatcaagtgacaatctctatttcataattgacatatttaatccatatatatttaatttaattgttgttattttgagacttaatatccagttttactattttggcccatttatttttggtttattttagatgtcttgccttatcttagattgattgatatttttagtatttaattacatttcttttataaatgtaatttcttgaatatttgtttttattttagcaattgctctgggaatataaaaatcatctttaaaatctatttagagttaatggtactactttatgcagtaggtaaaaacatttcactagcacaatttcatttgcaggcacctaaccttctgtgatagtattgtcttatattgttatatttatgagatacaatcactacagtaaaatactattttctattcattgtgccatcttataaataaacagatgaataaacagatatttttgaacaacctttgcttgccaagataaagtaacgggccagaatttcctttccaatagaaatcaaaaaacaaaagtttgaataacataaatgtcaacgttttcaacatccacaagacaccaggcatagaggggcagtgattcctgatagatggagaacaagcaagatgaatctgaaagggtttcttcaacttattgcctttcagcaagtttctagaccgcagcattgggaagagaacttagagagagccctgaagactcctgggttgaagagatggagctaagattccaggaagaccatggcaactagatctagtatagagtatccataacttttgggatatactgtctcccctcccatgggcatttgaaagattactgattgatatattcatgtgataaaagcacctggaagaattaaaggtaacaaaagcacctggaagaattaaaggtaacaacacccagggctatacaggatatggaatacttcttgtttccaatatcaagtctagaaaacctctttaattatgtaccgttggtagaatatttagaagattccgattgcagttgtgagcaacaagtaagccttagacgaagcacagatcaaatcacacctaaaaattttaaaagcaggatgaacagtgatcaagtaacttaacttcatgccagagaaaagcaaaagtatctatcatttatctatatctatctatctaatgtatatatctacacacacacgtatatatgcacacaaacatatttattactcaacaagataaaattcaccacctgtgacaagcaatcaaactttacaaggcaggcaaagaagctggaaaatatgatccatgccaatgaatcaataacaatctgttgaaacagtccttcaaatgacacagatgtgagaagtggaaaacaaagaatttaaaagttattataattcattttttatgtcctcaaattaaagagtcattttcattagaaataaacaagaataaaactaggaaaaaattacaatatttgaaataaataaactgcatagggcaaatgcagattcaacattgcaaaaaaaaaagattaatgaatatgaacacatagcagaagacaaggggaaacaatacaaaacaaaaaagtagagaatcaggggaaaacattattaaatataatgaaaaataattggcatatccaaagggagaataagaaaaaacaattggagaaatgacaactgaaaatttccccgatttgaagaatattgtaaatgcttagatccaagcagtttaatgaaccgtaagcacagaaggaggaggaagaggaggaggaggacagtgaaaaggacagggtgacaattacaccaagagggatgatataatttttcaaatccagtgataaaaaaatcttaaagaaaattgatgatggaagacacatttgtaagatactgtgaaataaaaaaagaatgttagcagattatgcatcaaaagcaatggaagtgagaagaaggtagagcaacactttcaactcatagaaaaaagggaaagaaaaagtctattttagatatctgtatccaggaaatattatattttaaaataagaattaaaaaaaggatttgttcagatttacaaaactttgttctgacgacaacaaaaaggattcaccacccgcagacccacagtgtgggaaatgtcaacggaagctcttcaggtggaaggcaaatgatataagattaattcagatttccataaagaaatgaagagcacaggaaaagagaacagtgtagatacatgcataagaatgttttccaaacatttaaatatctttatgacttaacttactttttaagcaaaagtaatattatcgattaactatactcattatagccttagaaaaacaagacctacaaatgtaaacatagacatacacaacttagtacagtaactgtttgtaaagagatacctcactttgcaaatacgtactaaaaattcctttaaataaattattttattttattattacctttaatacttttctacaaataagaatacttaaagattagaatctcaaaataataatctctcttgctgtcagtaataagcaacatatgtaatctcctaaattatccttaaagtcaaagtggaaaatatagtttttgtaaatttttgctaaacactagactattcagtaatttaactcatttaccaaaatattatgtttatagttatctttgattttactatagagtatttatttttttaaaattttattttaggttcagggcaatatgtgcaggtgtgttatataggtaaactcgtgcatgggggtttgttctacagattattttgtcaccctcgtactaagcctagtacccaatagttaattttttggatcccctctctcctcccacactctagcctcaagcacgccccattgtctgttattcccctctttgtggccatctgttattattgagctcccacttgtaagtgagaacatgcagtatttggttttctgttcctgagttagtttgctaagaataatggtctccagctctatccatgttgctgcaaaggacatggtcttgttcctttttatgactgcatagtattccatggtatatatgtaccacattttatttatccagtgtaccattgatgggcatttaggttgatttcatatctttgctattgttaatattgctgctgatcattagagaaatgcaaatgaaaaccacaatgagataccatctcacatcagttagaatggctattattaaaaagtcgaaaaacaacagatgctggtgaggctgcagagaaaagggaacacttatatcctgttggttggaatgcaaattaaatcaactattgtggaaagtagtgtgactgttcctcaaataagcattcttatttgtagaaaagatctagaagcagaaatagcatttgacccaataatcccattactgagtatataaccaaaggaatataaatcattttgtcataaagatacatgcatgtgtatgttcattgcaacactgtaaggcattttaattttcattctgacttgtctcttgatctcctctatattaagtcattttttccttcactaattaaaaatttcataagtcaactgtgttaacagtgatttacagtttttttctttgaggcacacattgcccatatttctcacacttattcttttctcaacactatcactaatattatttttcctaaaatgaatttttttacatcacttttccccatcaaaggttttttggagtctttttctaagaaagtattataatctggtcccaactcaatgagttgtcatacaaagtgcattgagcgaatctaaccacaataggtgcttaatacatccacttaaacaactttattccctgccactccacctcatatgtcatttattccaaacatggtgagctcttcataattatccgagtataactcaaggtcatcccttctaacagtttcatgctttttcacctattattttctgtcttcactcctactttgatcttttcaatagcatcagaagaagtgctcatggccttcctaattaggcatagttatcaccatctctcgactccctagtcctttgcttgaacaaaaccaaaactgtggtttattggaccttgctagttgcattttcaaccctaaaatcattgtacatgcttaggaataagtcatttctgaaattatggcatgagaataacaaagaatgttatttacggaactcagtagatcctggttagcctttagaagtgatcccagtgggctcctttataaaatatatttttatccattaaatattgacatccctacatctggcattgcaaactacacaactgcaagagaaatatggtcctgtcagtgaaaacaaaaaatgactttaagatgtaattttgataggttttggtacacgaaggtgtcatgtggcaggcatttagaaagtcttttcattgatattttactaaaaatttgaatagcttataaacgactttagatagtgtttttcctaagacattttttagagcatgttttagaaagagcggatggataatcctccaacccaggtgacgcacaagggcccaggagatcacaagagttacaggaaaacaggatgtgaagagatgcctcaggtgtgtttgaattgtaaacacttcagcattatttaggagcactctaatccacccttctcagagaattgctgacacacttcaggttaaccctaaatcctatttttagcttattgagaaatgtaacttccagatgtgcttttggttatgccaaaattttgcagtgaacatattttcaggcggtaaaattgcagaaacgtgactaacattttaaatgtcaaacaaagttctgtcatgagtgcattgattttttaaaagtctcatagtactaaaagtcttatatcaaaaccaagtcccttttgaaacccatattctcaggccacactctgttccccagttagtgactttcactgctttatttttacctgtatattttaaacaatatgtttataatttaattccttatggtacccactttagacgatatgcatttatttattggcctttagtggttgaaggatccatcttgtttacacagccatttctcacctttactttcctcatccatctaaaattcagccctatcacaatatttggtttcacgttattattgcatgcataattgttaccgggggtccttgctcccagagatcccaagatggcagcgggccgcttccaaaatggtggcaggccgcttccaagtggtggcaagcctcgtatactctgacctggggttcttggcctcacggattccaaggaatggaatcttgggccatgcagtgagtgttatagctctattagaagctgtgggtcatggaagagaaccgtggaacccagtgactagtgttcagctcgattaggacgaacccaggcacttagccgtgcaggaacaatggcaagcctttagcccgatcaggagcggcaattggcgccttgctggatcatgagcacagtggacaccctggtggatccggagggatggaactcagcagcgggtctgcgacggcggaaaacagcagtggtggacagccagcaaaactcagcttgagctgtaacaagcacagaccagaagagagcgcagttgcaagatttaatagagtgaaaaaagagctcccatacaaagggagggaacccaaagagggtagccgttgctggctccaatgcctgggtttatatcccgatcattgtccctcctgctgtgctctcaggcaataaatgattggctatttctttacctcctgtttttgcctaattagctttttagtgagctctctttactacctaattggttgggtgtgagctaagttgcaagcccgtgtttaaaggtagatgcggtcaccttcccagctaggcttagggcttcttagtcggcctagaaaatccacctagtcctgtctctcattatcatgttctgtttgaccatgtggtctgctatgattgttcctttattttacaacttatattttttacttaaattaataataactttgatttttgatgtttcttttgttagtttaacatttatctgctgctaaaatactttgcaagaattgataaccacttagaaattactgtccaaatgaaacagctccgttgtttggggtatattcactcgttcttggtttgggtagagaaagaattcaggacatggacacacatgaggatttaggagcagacgaggagtggatttaggagtggaaagtttaatggaaaataataggagagagagaaaaagcttccctgtgctgagaaagagggttgcccaaaagagggcctccagtttgcggaggaaggcagactgttttgtatagagactagaggaggaggtaattggtttacatagggtccaggggattggtttgacccagtgttccatctacatagcaagcgaaaagattggccctctaaccctaatcttttattatgcaaatgtggcctccattcagccgcggccctgatgcctgtatatgtggttttgagagctgacaacatgctagcagccctcgctcgctcttggtgcctcctcggcctcggcgtccactctggctgcgcttgagaagcccttcagcccaccgctgcactgtgggagccttctctgggctggctgaggctggagccggctccctctgcttgcagggaggtgtggagggagaggtgcgggcgggaaccgggggtgtgtgcggtgctcatggtccagtgtgagttcccagtgggcccaggcttggcaggccctgcacttggagtgggcggccagcgccgccagccctgggcagtgaggggcttagcacccaggccagcagctgcagaaggtgcaccgggtcccccagcactgctggcctgcccatgccatgctcgaattctcgctgggcctcagttgcatccccgtgtggcagggctcaggacctgcagcccgccatgcccaagccccccactgtggtgggctcctgcgtggcctgagcctccctgatgggcgccgccccctgctccgtggcacccggtcccatctaccacccaagagctgaggagtgcaggtgcgtggtgtgggactggcgggccgctctgcccacagccctggcacaggatccactaggcgaagccagctggcgtcctgagttgggtggggacttggagaacttttatgtctaggtagaggattgtaaatgcaccaatcagcactctgtgtctagctcaaggtttgtaaatgcaccaatcagtgctctgtgtctagctaatctagtggggacttggagaacttttgtgtctagctaaaggattgtaaatgcaccaatcagcactctgtgtctagctcaaggtttgtaaatgcaccaatcagcaccctgtcaaaacggaccaatcagctcttggtaaaatggaccaatcagctctctgtaaaatggaccaattagatctctgtaaaatgggccaatcagcaggatgtgggtggagtcagataagggaataaaagcaggctgccagctccagcagcggcaacctgctcgggtcctcttgtactgtgtagaaaccttgttctttcggtcttttgcaataaatcttgcggctgctcactctttgggtccgcactgcgtttgtgagctgtaacatttaccgcgaaggtctgcagcttcactcctgaagccagtgagatcacggacccaccagaaggaagaaactccaaacgcggccgaacatcagaaggaacaaactctggacacaccatctttaagaactgtaacactcaccgcacgtgtccgcggcttcattcttgaagtcagtgagaccaagaacccaccaattccggacagttttacctggaggctgccatgatactggtaagtgttgtgacaagaaagagagggcggaagatgccatattgaatgtacctggcttccaggtatagctgccagcatttacatataaaggctcctagtttgcatatctatgcctgtcttctcaggctgctttctgttagggaagaaacggtttgggggctgatttttattaaaggaaaattccacaagaactttcaccctttctagctgcctaagaattatttcttaactcctgtattacaagtatttaaacattttaaatgatctgtcagtgctggttggttttgtttcatgatttgtggcaagtctttcaccacagtcacacccttttcaatataacgtgctcaccagagctggcatttgctgttatgatccttggctggatgttctgtttcatggattgcatatcttttttatttacaaccttatttcactggtgcatattctctggtagcttcctgctggctgtggttgtgcataaaaggaagaactgaatactagctatcatgggccaagttatgtctatacagcagcttaaatgggctgtaccctgtagcattccgaggacaggcctgaattctgagaagggaaagtggtaaaagtattgtccagtcctttttaagttggtggctgagcttggtaaggtgtgtttttaaaagacctttagtccattctacttttcttgaagatggaggaccgtaagggatataaaggtttcactgaatactaagagcctgaaaaactgcttggctgatttgactaataaaggctcgtctgttatcagactgtattgaggtgggaaggctaaattgaggaattatatctgacagaacagaagaaatgactgcggtggccttctcagaccctgtaggaaaggcctctacctatccagtgaaagtatctacctagactaagaggtattttagttatctgactcagggcatgttgagtaaagctaatttgctagtcctgggtggggcaaatcctcgagcttgatgtgtagggaagggagggggcctgaataatccctgaggagtagtagaatagcagatggaacactgagaagttatttccttgaggatagagttccacgatggaaaggaaatgagatgttctaagaggtgggctagtggcttgtactatagcataacctgcctttgctggtgtgtggctattaggcctggtggaaccgccatcaataaatcaagcgtgatcagggtgaggaacaggaaagagggaaatttggggaaatggggtgaatgtcaggtggatcagagagatacagtcatgggggtcaggtgtggtatcaggaataacgtgggaggccggattgaagtctgggccaggaacaacggtaattgtcggggactcaacaaaagagtgagtatagctgaaggagccgggaagcggaaagtgtatgcgtcaggtatgaggaagaaaatagattttggaagttatgagaactgtagagagtgagttgagcatagtttgtgattttgagggcctctaaaagtattaaagcagtggcagccgctgcacgcagacatgagggctaggctaaaacagtaaggtcaagttgtttggacagaaaggctacagggtgtggtcctggctcttgtgtaagaattctgaccacgctaaccatgcctaggaaggaaaggagttgttgttttgtagaaggtgcttgggtttgagagatcggtcaggcgcgattggcagggagagcacgtgtgtttttatgagaattataccgagataggtaacagatgaggaagaaatttgggcttgattgaagtaatgggggctgtctgtgaagctttgtggcagtacagcctaggtaatttgctgagcttgatgggtgtcagggtcagtccaagtgaaagtgaacagaggctgggattaagggtgcaaaggaatagtaaagaaagcatgtttgagatctagaacagaataatgggttgtagaggcaggtattgaggataggagagtatatgggtttggcaccatggggtggataggcaaaacaatttggttgataaggcgcagatcctgaactaacttgtaagacttgtctggttttaggacgggtaaaatgggggaattgtaaggagagtttatagactttaaaaggccctgctgtagcaggcgagtgataacaggctttaatctttttaaagcgtgctgtgggatgggatattggcgttgagtggggtaagggtgattaggttttaatgagatggtaaggggtgcatgatcggtcgccaaggagggagtagaggtatcttatacttgtgggttaaggtggggggatacaagaggaggacgcaaaggaggctttggataggaaagaagggcggcaatgagatatagctgtagtccgggaatagtcagggaagcagataatttagttaaagtgtctcagcctaataagggaactgggcaggtggggataactaaaaaggagtgcttaaaagagtattgtctaagttggcacagagttggggagttttaagaggtttagaagcctggccgtcaatacccacaacagttatggaggcaagggaaacaggcccttgaaaagaaggtaatgtggagtgggtagcctccgtattgattaagaaggggatgggctcaccttccactgtgagagttacccgaagctcggcgtccgtgatggtctagggggcttccgaggcgatcgggcagtgtcagtcttcagccgctaagccgagaagatctgggaaggagtcagtcagagagccttgggccagagttccaggggctctgggagtggctaccaggtgagttgaacagtccaattttcagtggggtctcacacagatgggacgcggcttaggaggaatcctgtgctgtgggcattccttggcccagtggccagatttccggcaggtgtagcaagctcctgtgggaggaggttctggaggaatgcctggccgctgcggttcaggcgtttggaagttcttgtgtgctggagatgtggctggggtttgtctcacagtggaggcaaggaattgcaacttttttctattgtcgtacaccttgaaggcgaggttaattaaatcctgttgcggggtttgaaggccggaatttaatttttggagttttatttaatgtcgggagcagattgggtaataaaatgtattttgagaataagactgccttttgaccttttagggtctagggctgtaaagtgtctcagggttgctgccaaacaagtcatgaactgggctggatttttatatttgatgaaaaagagcctaaatgctatctgatttcggataaagaaaaaggagcattaaccttgactatgcctttagctccagccacctttttaagagtaaattgctgggcaggagggggagggctagtcacggaacgaaactgtaagccggaccaggtgtgaggaggggaggcgataaaaagattatagggtggaggagcagaggctgaggaagaattgggacctagctcggcctggcgagaagcagcctgggaggaagggagaggtcagatgggtctgtagaaaaggaagattagaaagactcagggacgcttggggttggtactgaggggacaggtgggaggtaaagaaggaagatttgggacgagttgcactgggcacagagactaggaagggactgatgtgtaaaaggatgcctggacgtcaggcacctcagaccatttgcctattttacgacaagaattatttagatcttgcaggatggaaaaattcaaagtgccattttctggctatttggaactactgttgagtttgtattggggtcaagaggcactgcagaagaaaataaggcatttaggttttaggtcaggtaagagttgatgaggttttaagtttttgagaacacaggccaagggagtagaaggaggaatagagggtggaaggttgcctatagtgaaggaagcaagcctagagaaaaaagaacccccgaacccctcccctccgtttctctactctctcaccttccagaaaagtgggaaaaggggttggggcacagagataagaggttggggcacagaaataaggggtaggggcacggaaataaggggttggggtgcagagataagaggttggggtgtggaaataagggattggggcacagagatataagaggttggggcgcagaaataagggattggggcgcagagatacgaggttggggtacttgcccctctagaaaagcgggacttgccgctaagagtgaaggagaaggggttgaggggtacttgcccctcccccagaaaagcagagaaggggtagagacaaggagagaaggggttggggtacttgccccttccccagaaaagcgggacttgccactaagggcgaaggaccaaggcaggcatccctgcgtggcctgacacctttgaaacgtggatgaataatcaggcgtccctgcaatgattaaacaccaagggaaggctgccttcccagtccgtgaccggcgctggagttttgggtccacggataaaatgtgtctcctttgtctctcccagaaaacgaaaggaattgaaattaagagaagggagagactgaagagtggaaaggagaaagtggttgaggtacagtgagagaggttggagaagacagtaagaagaggccgcttacctgatttaaaattggtgagatgttccttgggctggtcggtctgaggacctgaggtcgtaggtggatctttctcacagagcaaagaacaggaggacgggattgatctcccaagggaggtcccccgatccgagtcacggcaccaaatttcatgcgtgtccgtgtgaagagaccaccaaacaggcttcgtgtgagcaacatggctgtttattccacctgggtgcaggcaggctgagtccgaaaagagagtcagcaaaggaagatggggtggggccgtttgataggatttgggtaggtaaaggaaaattacagtcaaaggggggttgttctttggcgggcaggagtgggggtcgaaaggtgctcagtgggagtctttttgagccaggatgagccaggaaaaggactttcacaaggtaatgtcatcacttaaggcaaggaccggccatttacacttcttttgtggtggaatgtcatcagttaaggtggggcagggcgtattcacttcttttgtgattcttcagttacttcaggccatctgggcatatacgtgcaagtcacaggggatgcgatggcttggcttgggctcagaggcctgacaataagtatgattcactaaaatatattaataagctggactttattaaaattgaaattttctgctctgtaaaagaaactgtaaagagaataaaaaggcacgtcacagagtaggagaaaatatttgcaaaagaaatatctgacaaatgacagttcttaaaaatatacaaagaactcataaaacccaacagtaagaaaaggagtcatccaagtataaaatggggtagaaatctttacaaacatctcatcagaaagatatacagatggaaaatgagcatatgacaaaatagttaacatcatatattattggaaaagccaatatcggtagggcgtggtagggtcagatgttggtctttgaatctcacaggcttaacaaagaagagaccctttttaacttaggctgcctttacaacagagatcaggggcttctgctaattgcagccaaccagaggcccaggctgctttttcaacaggcttccacttctctagagcagtagaaatgggaagagggtatggccaacttcacattggcttttaaagccctgataaaaacgtagcacaccttattttcatgcacatttctttgaacaacgtgaagcaagggaaatatttggggaaactgtaatacagataaaagctatactccacctcagtgaagttcatttgacaccaccagcgtcatgacactaatcagaccgccaaagacagaacttttattttgatgatttcctttccctatttcctttcatgcatcgccctccttcttcaatgccatatgcagagaatgacattagctcgtctccctgatcatgaggacatccagtctttcatgggcaacagacagcacataccacactcagtttatttcatctctcttttctaataccagagtttagtttatttcatctcttttctaataccagagtttaacaaccgaggacattttcccttgcacataccgcatcagtgataatctgttactacttccctatttttatgagctttaataacaaatacaatcatgatcacattaaaagatcattgatatgcagtaagatgacatgtgttgatcagaccttgcctttcatgatgaacatgtctctaaattgccggaactgttcctgtaatcacttgttccaccaaagcgtctttcctgggatctgaatgggaatgtgggtgggcatcagctctcctagtgaatagctccacaccactaatgggcctaatttacagactttattcaggctgctgagtgtgtctccaggaatttccccagaatcctggaatgtcatgtgcccctctaaaaactagtggaagtcatgtccttattgaagaaagcattcaattctattatcaagctatgtataaaaatgccaaaagtcttttatgtggcatttataactcctcattagcatgatctttctaatatttggaaatcctcaaagctgcatcagagcttacctaattttaaacttgatgggtgagtagattattttagacagagtcaaaaaccttttttactgtcaatttcactatcatttattgattattctcagtaatatggaacttgctaaaaatgttcacaatttagtggatacttttcacaatgaataatgcaaatccattctaagaatcatgatcaagttatccaatgttagacattttgaaacattccttcatatagtctggaaaaacatctagtacatgtaagaagatgaggatatcattttctttaatatttagtacgtttgaaatgtgcttgaaattcaaaagcaaaaatgaaccaatatctcactccagtgagagcctagatttaaaataacacatacagatttttaataacataagtattgtataatcttaaaatgtctagcaacgtgatacttgcagaacttcctgtttttcaaaagaacagggctgagcttttctattgatacttaaggctgcatgatagcccttcagagtgtagagtagtatagaagattgctgaaacctgtagcttactccattttaacataagcctctttgaagttaacatttccttttattttcattacatatgattgagatattaattttgatttattttaaaactagtttctttaataaattctcagcccctactgtatggtcatgatgagaaagactttgagtgtccataggcaatattcagtcattacattatatgacagtatttcccagaacacaccgtattttgtgtaataatgaaatagaagtggagtttagttatttttattgtgatcacattttctgtaggaaccatttgtctttgtttagataggagtcttctgccttccaatttgtgaacgtttttcatagatggttcaaaatccctgggattttgccaatctagaacttgtagtgtatttatgccacacatatgaatttaggcaccacattgaaatgtaccagagctttatcaactccatttataatatttatttccatccatttgttcatttacttgaagatcatttttcccaacccagtgctttgggtgacagagaagtaaactttctttgtacttccctagatcagagaatagtgtttcttagtcatctttaagaaaaaggaccacttccttctaaacttctattttgcaaaagctaaggttaattctccttatcgtctttactttctgccccatgcctctgaggagagactcttccctattctctgccctgctctctgaactccaaaaattcacctgtttggatgacatccaggctctttcttaccttctgtcttctttttgtgtctgggcagtatgaagccctatcacactgaaaggagagagaagcgaggtcagtgtggttggttggagcctggggtcccctctgcttggtcacctacctcctggtggctgcatctgctgcagagtagctcagctcccataaggtgggcctcccgacggccctctgtatttccagttcagatagcacagcctttcttctgcccatcgggcatagggttactatcagcccatcttatagcccaggaatcacccccatctcatgtgatttcccagtcaccttcctgtatctataaaatctgcctttttagtaaaatcttctcacagtgtcttaatctgactatgctgttttctgcttgactgtgactgattatcagtcacagaataaagtttagaatcctgttaattcctcatgtctgtagtttatcaatacagaagtgcatttgttccttatttggttttatctggccaagcatttctctatctcttcctctccctcctccacccttgtgtatatatgtgtgggggatgggatgggggtgtatgtctatgtgtatatgtttctgtgtgtggtgttgtgggagaatgaggccaattcctaccatcatactgacagaaatttactaccattatatacaatctaaacttggattctacttctggaaacataactctgggacagtgcctgaaatgtgactttacaattttcttcagagacttaaataatgcaggaaagcagaaatactggaaagaagcaaagaggtatctctggatgagttccattataccaatagtgattcaatagtaggaagatttactttgtggtttactaatcaaatttacaatgcaaaatgatccctcacattaatagtcattaacatataagctaggcatttttttttgtctgaagctttgtttttttaattaaatacatgttgaactgtgcttgcaactaaaaaaaaaaaaaatcagagaaagacaaccacatcagctggattcctgagtgccagtggcaacatgagaggctggagcttagaaaaagaggctgtctcatatttttcctgaccaagagcacatagagcacaatcagagtccatgtgtcaagggctactttagataagtaataagaacaagttaagtggccaaggcaggcagatgcttgagcccaggagttggagaccatcctgggcaacacgatgaaaccgcatctctacaaaaatgtagtcaggcttggtgattcacagctgtagctccagctacttaggaggctgcggtgggagggtcacttgagcctgggagtttgaggcagcagtgagctgtgatcacatcactgtgctccagcctgggagaaagagtgagatcctgtctccaaattataaaaataaaaataaaagatcatggccaaatctatcttaaaatttgagaattgaccaattccaaggtgggaaatgagattactcagaacacttattaaaattgttaaatattagccaccactgtcttctggcttgtagggtttctgcagagagatccactgttagtctgatgggctttcctttgtgggtaacccgacatttctctctgtctgcccttaacattttttccttcatttcaaccttagtgaatctgataattattatgtgtcttggggttgcttttctcaaggagtatctttgtggtgttctctgtatttcctgaatttgaatgttggcctgtcttgttaggctggggaagttcttctggataatattctgaagagttttttccaacttggttccattcttcctgtcactttcaggtatagcaatcaaatgtaggtttgggcttttcccgtagtcccatatttcttggagtctttgttcattcctttttattctttattctctaatcttgtcttcatgctttatttcattaagttgatcttcaatctctgatagcctttcttccgcttgattgattcagctattgatacttgtgtattctttacaaagttctcatgttgtgtttttcagctccatcacgtcatttatgttcttctctaaactggttattctagttagcagttcctctaagctttcttgaaggttcttagcttccttgcattgggttagaacaggatcctttagctcagaagagtttattacccaccctctgaagcctacttttgtcaattcttcaaattcattctccatccagctttgttcttttactggagaggagttgcgatcctttggaggaggagaggcattctggttattgcaattttcagcccgtttgtattggtttttcctcatcttgtggatttatctacctttggtctttgatgttggtgtcctttggatggggtttgtgtgtggacatcctttttgttaatgttgatgctattcctttctgtttgttagttttccttctaacgtttaggcccctctgctgcaggtgtgctggtaattgctagaagttcactccagaccctgttttcctgggtatcgccagcagaggctacagaacagcaaagattgctgcccgttccttcctctgaaagcttagtcacagagggccatctgccagatgccagccagagctctcctgtatgaggtatctgtcaacccctgctgggaggtgtctcaaggtcaggaggcacaggggtcagggacacacttgaggcagtctgtctcttagcagagctctagaactgtgctgggagatccgctgctctcttcagagccaacaggcaggaacatttaagtctgctgaaactgcacccacagccggcccttccctcaggtgctctgtcccagggagacggggcgttttatctataagcccctgactggaactcctgcctttctttcagagatgctctgcccagagaggagaaatctagagaggcagtctggctacagtggctttgcggagctggagtgggctctgccaagttcaaacttcccagttgctttgtttacagttgaggggaaaactgcctactcaagcctcagtaatggtggacgcccctcccctcaccaagctcgagcgtcccagttcaacctcacactgctgtgttggccgcaaaaatttcaagccagtagatcttagcttgctgggctccatgggggtgggacccactgagctagaccacttggctccctggcttcagccccctttccaggggagtgaaaggttctgtcttgctggcatttcaggtaccaccagggtaagaaaaaaaaactcctgcagctagcttggtgtctttccaaatgaccatccagttttgtgcttgaaaccctgggccctggtggcataggcaccctagggaatctcctggtctgtagattgtaaagaatgtgggaaaagcctagtatctgagccggagtgcactgttcctcactgcacagtctctcacggcttcccttggctaggggagggagctccccaactccttgggcttcctgggtaaggccacgccccaccctgcttaggctctccctccgtgggctgcacccactgtctaaccagtcccagtgagacgagctgggcacctcagttggaaatgcagaagtcacctgccttgtgcattgatctcgctgggagctgcagaatggagcttttcttatttggccatctttggtcacctccaatattaatgattatgattcaacatgggattttggtggggacacacatccgaactatttcagaaagcaaatcaaattataaaaagaaatatatgtaagatcaacttgttaaataatataaattgaaatacataacatatttgtaaaaataattttaaaatagcagactcaggattcgtgtggcatttaaaataattaaaacattgtaggactagacatgtttatagcctgtgtttaaaaagtaagtcatccaacaaagaaaaaaataaaaaaacttaatgaagtcctttagtatttgtgctagatggtgtaaaattatatataatctgtagtcatcatcattattctgaagatggcatgcaaaaatcgatatgaagatttccatttgataagaaaaatatattctaaaataatcaagagaatagatacaactttttgtcgtgagaataagattctgaattttttacagttgtagaggttgtaatgtacaaaaagtctgtgcttcatatccctcaggtatgacaagttaaaaattatgtgagaatggaagatacactttataaactagcaagctcataattgttagagtactcatgcagagcttaaattcttgtggacttgtactgttggggaaatgagtcctaaaaatgtctgaactctcatttgaagatataattttgtgattttatgcctatgctaatgacttctcattaggtagtatacatataatttttatttaaaatataatgaagtgtgattttatatcagttaaatagttaatatataagcagtaagtagtttggaattgtgtaacagaaaagtcaactgaaacttttgcaagcataattgattggttcattaaatgaattttttatataaaatagatattagaaagattgaaaagtggccaaagggcctttgtgattctactttgtaatataaaggatggtttcttactacggttggtgtccttgcaggagtgggaatatcattgtaatattcaacccaacatgcttcctcagaaagtccagctagattttaatgatgctttctgaagttcttccaaaaacaaaaaataataaggaaccttctttcccaaaagatacaaacatgcctatcctcatatatcactgacctgaatggaccacagtcttttctagtaaaagactgcagcaagagttatgaaactgttataagaccaacaggtttgtaggactgctgcacagcaacagatcaatacgctgagacagcagaacttgcagcagagaaagagtttaatgatcacagggcactgagcgagggatggaaggagatcctcaaatccatcccgtcttctggttttgggattttgaggggatcgtggagggcaaggaactggaaatttggggtcattgattggtatggctattgggatgcggaaactgcattttatgttgagtcagctatttgtaggatctttcagacccgctagcattagtagtttcactggtatgcagaacctaaaagaatatctcaaaaggaaaagttaatatttcttaatattcaagttgttatctatagagcagttaaggcaattataatcttgtaacagggtctatgtgattctgaggcaataagcaagcaactatgagggagtaagtcagagagtgtattagtctgttctcacactgccataaaaaactacctgagactgggtgatttatgatgaaaagaggtttaattgactcacaattctataggctgtacagaaaccatgggtaagaggcctcaggaaacttacaatcagggaagaaggcaaaggggaagcaagcatgtcttaccatagcaaagcaggaggggagagcagggagggaattgccacacacctctacaccatcagatctcacaagaactcactattatgactgataacaggaagggggaagggatccctcatgatccaatcacctcccaccagttccctctcccaacacatggggattacaattcaagatgagatttgggtggggacacacagccaaaccatatcagagagcaagatgacccaatgattaatgcttaatatgctgcaagtttggtttattttcatttctcccctcttttttcctgattaatttcataaagtttatagggatggttttgaattttttccaattagtttcatcacactttagtcatgaaatgaatgtggaatcatgtgatcctacaactcatgtagtgcatgaggaaatagtggacatttgaataaaccagggttctgtttcaagggatgaaagagaaaggaagagttgattttggaaaagttacaaaaaaaattacacggtgtaaaacaaaaaatattagcttgtttaaataatgcatctgacataaaacattttgctgcacttatgagatactgttactgttagaaattttaatgtgaaatattataatagagtatcattgatactaatataaaatacttcaaaaattataaaaataattacatttttggacagccaaattagtggtagtcacctcattgtgaagttctccataaatcttgtcaaatcttctgacacattttgtagatcatattaaactatgccaaaagtcatggcttcagaaaaacttcaaggaagggaaccctacatactttaataaactggtgaattgaaaaatctatttctagcagagaaaacagttgagatcatgctgcaagtcttcgtggggagcaagaagatgaaaacaaagtaccaaaacaaaagaagcaaacaagtaaaacaacacagaaacaaaaaccaaaacaaaacatgtatggaagagagaacgtgacattgagggcatagagtgcacagacacaagtgaggtagtcttgggcaaaagatgcttctgaaggagaagcaagtgaaagggaagctggtggaggtgaactttgaaagcagctggcaaaggaaaaagaaacagaaaaggagagcacaggattctgagaaacaagacttgggccaagggaatagagtgagccttaaatatacttcattctagatctaagattccagtaaaacaggaaaaagggtgaaaactaagatataaatattgaacatactgtcgcaatagaaataatgcaactaaaaccacgggagggaaacaaagtggggaagagaaacagcacattaatggtagaagcagtagatggaaatcaaaaacatcattgccactaacacaaggataataaaagggtaaatacagaaacagggggttaagtgttccaaaaaacatataagcacaaaggtaaccactagaacaaaaatataaacatttttagattccaaaagaatttacaaagaacaaaagacagcacccagtacaaaaaataaagcagggcgaacataatatattacacatagtaataattataacagaataataagacagagaatacatcaaactgacctatcccatcaataaaaaaattataaaattagccagttatttacaaaaaatatttttaatttaacttacaaagatttgtttactgtatataagacacaatgcattaacacaaggtaattcaggtggctaaaaataaagagattgacaaaagaataccagataaatgaaaataaaaagaaagcagaatttgtgtttttaataataaacatcttaaaatgcatgccaaaataactgaaggagccaagggaagactgcgtttcagtgttaaataatgaatcacagtaaagatgtaaaccagtatacacaagcagcagataagacagaaactttgtaaagcagaaacaatagtagattcaaggaaccatagatagaaataaacttataaaagtaaaataaataaaaagtcaccactgtcagcataatactgataaaactgacaatatgcaagacctaactgcatcatgaataaagtcattggtaaatacagatatcaaactatataccctaataatagagaatataaattatttttatgcacttagaacatttatttttttaattttatgaagagaacagcaataaatgccatagagtagaaatattttttaaagtttccaataataatacattaaaaccagatatctgatagtaactgcaaagccaaaggccattttaactgaaaattaaatagaaatattatattcaatacctcttgcttaaaattggtatataaaaaatgtaatgaaagaatcataatcataccatattactacatgttgtgtatctaaaacagtgaaatgcctaggtttatgcctgaagcacatataatcaaaaatttaaaaaattaaatccaatctcaacacagcaaaaaagtacaaggacagaaatcatataaaatcagaaattataagaacaaaaacagatgaaattactaattataagtcctctttttgattaaataataaaacaacctactatctaacataataaagatggaataaaaatctagaaaaattaagatgtgacaaagaaataactattgcaacaaattacattagcaaacaacagattttgcaatctttatctaaataaattgaaaacaaaaaatagaagtatataatttatcaaatttgagcccatataaagtctaaaacttcaaatatatcgatttctatagatgaagagaaatagttattaacagattatactgtataaaagcaataattctggctagtttaatcttcaaaaaccacataggcttagtactcaatgaattattccagagcatatagaatgaagaaaaatgtccaaattatttttatgactaaagggtaacatttatacctaattttgaaattttagcttcctagagccgctttcataaaattccataacctgaggaacgtaaagaacagacatttattgtcttacagttctggaaactggaagtcccaatttaaggactcagcagagccatgctccctctgaaaccttaggggaatttttcctagcatcataagaaaagcagtcatggttttctttgcactaaagtgcgagatacaaataaagacaatttgcactcatcaattaaagttaattcaaaagaacattctgaatcattttatataatacatatttataattataaattattttaaatatataaaatatgtattttatataatacatatttataattaaataattaaacaatttataattaacttattcaaataaatttaaataattaatttatttaaataatttatttaaattaaataaatttaaataattgaatgatttatttaaattaaataattcaaaaatatttaaagagtattgatataaaataaaacatatttgaaagttctatcaggattctaacagtctctgcttagttataaatcaatcaagcattttgaaaatattcaatatataattcaagtaccaagaagatataagaaaaaatatttctatggttgtagacttatgatcaaatttgtggcaaactgtacatctactaaatgagaaaataaattagaggacataaatttgaaaactgataaatatttcagtatgtcaaataaaactatctttctgatttacctaaaatgtagaattcaaagcttaggatatggtgtattgggttttgtttatcttgaagttttggaaaaagcagcatctgaaataatatatcaaaatttattatcagtgtgcaatggattaaatattgtattcatgtatagagagtgaccataagatgtgaggtacaaagtctagagttgtggtcaaatacttagaaaaattatggaaagttatatttacctctgtgttagtctatttatctgtacgtaattaaaagatataaattaattatcgcattatcttattgttatattggatattttgtaatcttcatcaaagaagataaagattttaataacacatttgaaaagttgggacttaaaattataaaacatagacagtatctgtagcttgaatggaattgtgtctggatggatacataaatcaagctgacattttagcaagtctcagatattcattgttacagaaatagagattcgaaactatttggatatttgacaaaaaagccatacgttttatcttaatatattacattatgacagagatgcaaatagtcatttaatggtacaataaatatttgattaatccaaactggcaaatttattggagcaaaagagtgattccataatttagattgagatattgaataaaaaatatatatatataatgaatcagtataataggctagtatgcataaagagttaaatttcttctgatttgaagtatgtataaagcacctagttagcctatttttagagtagctgtaaggtgttcaggcattactaactttgcagagatgacattagaagacagaaaaaaagagctggtatgattttcacttaataagaagcttaattattccttgtagctcaagcttgaacaaatggttgtattagttctgcatagcatatgatgaattttgattgtgaccttacttacaagtgaatacttttctctaatagagaatataacttattttatctaaacattgtatatttattattcactgtaaacttttgtgataatggaaatgcaaacaaaacaccccctgtagaagttattgatgttgtacttagaaaagtatagtatgatatgtactatttgattggccgtgtgattttataatatatagtataagcatatatatcttgaattcttaatatttttgttctatcatcatacacggacagtactatgctttattttaaaaaacaatatttatgtgtatttaagtattacatttacaataactattcgttatcccctataaatataagactttgcatttataagatctatattgcatcatataataacaaaataaataaaatgtatatactaatgcatatataaaaatatatacatatacataagctaacatataaacatatcctcatgactagatacactctattggaagattttaaaatggaaattaagtttttaaaaattattttgaactgaatctttcggggcagaggagtctgtaccctctaagcacaatttatcctttgtgttacaacaattcaattacactcttataattattttaaaaggcacaattaaattattattgactatattcattcattgtgatatcaaatattaggtcattctttctttctatttttttaacctattaatcatcccattaatcatgagtttgagtttttgacattgtgttgtaagcccttctcacccaaaggcttaagtgtattacatatgtattccccaacttttaaattaccaaacatagatagatttcctccatagacaaagccattattctgacttttctggtaataatttctttgctttattcagaatttcataacctgtcatatatttatagtttggggaaaatgaccacaaatttagtggcttaaaataacaccccttcattatttcacagttctattgacaagaagcagggcaagatgtgcctgaattagctgttcatggtatatcacaaagttgaaatcaaggtgctggccaggttgagttctggttcagaagctctaggataaagtctgcttccaagatcctgtagattattggtattatctagttccttgctggttgtcagctggaagtagatctcagctctgagaagctgttctcaggtccttttcaggcaacctcctccatcttcaagccagcaactgcttgtggaattctacttatgtttcacatttttctgccttccttccctgcaacaaatcctttaaaataaactatgctattaaagagataaatccctttaaaagaaactatgctataaaagagataatgttattagattaggattatgcaaataatcttcctattttagggtcaactctgccctttagcataatctaatcacaaaagtgttatacatcatattcagagttccagggaatatgcagaatggtgtataccaagtggggaggaaaatcttgtgggcagtcataaaattttgcctatcacattgcttatgtattattcttccctaaatattgcataaagttttctggtcttgagttttacataaattgtatcaaactgaatttatgctggtacttatacatttttcctgcagtcttaggtttgtgagaattctttttgatactgaaattgcactagtttattagctattgttgcaatataatactcaatggtataaaaatatgaaaaactaatttgtcctttctcctagtgataaaaatctggtttgattccaatttggagcaattaagtataaagctaacataagtattcatgtatgcatatcttgacatatatatataccagagttctttaagaatatacatttagaaacagtttttggaccccattttgtcaccttttcaaatttcttcataataacaaaccattttcaaaagtgtttcagccaattaatacatcaaaaatcagtttatgaatttctgtgtttttacaactctgccaacacgtggttgtggtggcccttcaaaaacaaaaatgtgtttgctaattaggtgaatatgtaaatgtatctgtaatggtcaatatcaagtgtcaacttgattggattgaaagaggaaaagtgttgttcctgggtgtgtctgtgagggtgttgctagaagagattaacatttgagtcagtggactgggagaggcagacccaccctcaatgtgggcgggcgtgatccaattggttacaggtacagctagcagcaggtggaagaaggtggtataagctggctggctgagtcttctggctttcatctttccctggtgatggatgcttcctgcccttgagcattagacttcaggttctttagcttttaactattggacttagaccagtggcttgccatgggccacaagctgaaggctacactatcggcttccctacttttgaggttttgggacttggactgagccactactggtttccttgctcctcagcttgcagatggcctatcgtgggacttcacctcctgatgatgtgagtcagttccccctaataaactccctttcatatatatgtgtgtgtgtgtgtttgtatatatatttatgtgtgtgtatatatacacacacacacacacacatacatacatatgtatatgtattctattggttttgtccctctcgagaaccctgactcatacagtatctcattatggtttgaattcactgttctattattaataatgagattttaagtatctttaatttttttggttatctgtctttactaattttgaagttcttatattttacttactgatttctaaaatctttcacctcccctactgcacccttatcccacttattcaaaatgcacattgcaaaaatttactcaggcttgtctttaatgtttttcctttttaagtcctaaatttgcatggaatatatggatagagatagtaatagaaattcaatttcatgatgttttccacataggataccagttttactcaaatagcaacatgaaaggaaagagagaaaaatataaaagcatcttaaataatttctatgacaaaaataacaataatcaaaactaaataaaccttagtaatgaagtgtcatccatattattgcaaatgagataaaaatgagagagacatgtaaatattggggtcagaaaattcatgttacatgtatttcaagtgtgtaaagcaaggattagcaaactgtggcctctgtgtcaaatgtttctgtacgtaagattttattggaacatagtcacatccatctactctcctgttgtgtatagttacttttatgttgcaatgacagagttaggtagttgtaacagagaatgcgtggtttccaaaatctaaaatattttctatctgccactttacaaaagaagtttgccaatcccttgtctaaagaataatgtagagtgctatgaataagcactactttttgtgtatgaaatgtaaaataaaagatattttatataaaagttatataaaagttattttgaaacattttatagccataggataactactgagccttttacagaatatgtattacaaagcctgatttatatacttctgccattttttattgttatgtaataaagttactctttagtacccactaattaagctttagggtcaaaatccatccctattaggtctatatggtgttccacaagctcacagggtgagtccctcctttacttgcttatgcgtttgcctgttacacctatttttattcattctaaaggatagatcctctccttaaaagaccagaaaccatgatacttgatgtataaaatcttttctttttaaccgtcctttaattatgtcatttcccaagtaatacactttttatgttcattccactaattttttcttgtaaaaggttcatcttgaattgttcacattttcatcacttatgtgcctgtggattaaacatcatctcaatagattatgttaggcaactgattactaagcagttattcaataaacatctttgttaaaggcattatgtgaataactggtcaccctttgttaaaagcattatgtgaataactggttaagcaaaaaatagactgttacctttgttaaagtcatctttgttaagggcattatgccaataaccagttaagcaaaaaaaaaaaaaaaaaatagactactctaatactggtttcaaaacagcctgaatttgctcatgagtgttaacagtttcttcgtagttttccctgggtaaagacaggaacaattgaatgtaatttggattccctaaacccagcttggcttaacaactttttattttatgcttttaattgacatataataattttacatatttatggggtacatagtgatgttttaaaaaaataatatattatgatcagattatagaaattagcatatccattttctcaaatatttaccatgtttttgtattaggaacattcaatatcttccttgtaactttttaaaaaaggattagatctattattacatatattgtgtgatggttaattttatgtgtcaacttgcctgggctaaaggatgtccagaaagctggtaaaacattatttctgggtctgtctgtggaggtgtttccagaagactatatacaatgtattacatggtttatagttcaagcgttttatcccttccaatgttgagatgcatatagctttttccttctggaattaattccaaaaaaattaaggaatagtatacatatctttgggtacactaggttttgcaacaaccttcttttcccctgctgtctttcaaagttatcttcataataaatcaaatgtctgcacacatgtagacttaaaaaaagttttttttttgctggctctatcctgaaatgttctattcttttgctgataccccactgtgtcaaatattgtagtttataatatccttggtatttgatagagtaaacacctgcatttttcttcttcagtattgtgttgattaatcttagttctttgcatttcattatatttaaaatcagcctgatgatttacacaaaaacgaaaactattttattgatattttattgtttcaacagtttgaagagaatttacatctttaaaatatatcctataagttctatcaatatacttttgtagttgtgcattgcttaatatccaaatgtttgaatatacacaaattgtctttgtattatttattcttagcttgattttgctgtgttctggtaatatgatctaaatgtctaataactataaaatgactaatttatttgcctttaaactacttttctgtctattcgacccaatcatggtttgtatgttgtgctttcttcatttcttgatcttttattagattattagagtacctttatcattttattttccctattactatttgtttaattattgggggagggtgctatcctagagattgtagaatgtaagcctgacttaataaagtctaaaattaatctgtgctttaacagcttatcaggcagttctttttccatcttttacactcaacatgccatattacagtcatggtcatatatttttattttgtatgcattttaaacttaacaatgtattttaattatgtttactacatcaatgtctatttacatatataaacatatttatcttttatattgttctttttacctatctgagttttcatttttctacctgggatacattttatcagtctgaatattcccatttttttagctctactctgacaaattatgttattatttatcctaatttatctttatgttgtcttcatttttaatgtatatttttcctgtgaacagacttctcagctggcagtcaatttagctcaacagtttaaatatattgcctccttgtcttcttttatataaaatttttatatactctgtaataaataagctatctgtgaagttgcttttttgcattatgatatcacttttttatgaattaaatattttttgtctcttttttccagcattttaacatttgatatgcctagatggttttttactttactttttaaaaaaagctttgctttaggtttatattgctttctgcatttgtgatttagatgattttatcacatgaaaataatcgtcagaattcttgcttggttagttctcaacaactcctcttatttcataatcagcaaaacctgtggcaaagtggatcttaataattttaatcttaaagcctctggcatttctttcatagataaaagctctgctgtccttctctaacttgattttcttccacatttatgttcagatttttaaatttattctgaggttgagagataatccaaaacaatgaaagctgttatttctagaacaataatacaaataaagttttagagataatcaatagtaatttttttctaaaatatcctagaatctcaaaaagttcaatacataagttactaaagcataattattctgaataattgttgtaaagtaacacctggctttaaaagaaaatctgcttacaaatatgcctattattttcttaaatatagaattatggcgagaattacggttaccaattcgactatgagaagcttcataatatagtatcttcataaaaacgcacacacaaaaatgtttggaatgtaaggaattccctttatagttattagcctaatatagtttgcatctattgtgtattagtgtatactagataaggtagcatagtatatataaatatacagttaatagcatatataatttgaaggatgaatttgtgataaaatatatagctatttactctttcatatatatttcaagtaacttcatcgggatcctaaaacaaattgcagttgttaacatttgagaaggatgacgttgctcttactgatcaattttgtgagactaatattatttaataaaatttgttccgttgaggaatgttaatgtgcgtgccctcaatgtagaagcattaagaactttcttgtggtggtgcttttttttttttgagacagggtctcgccctgttgcccaggctggagtgcaatgatgtgatctcagctcacggcaacctccgcctcccaggttcaagcgattctcctgcctcagcctcctgaatagctgggactacaggcacccgccaccacgcctgactatcacggtgcttttaatcaataaaggactgtagttgatgaacatattttttagttcctttacaccttgggtgggataacctaaggtgtaagggaactaaagacatgcggtacatgtcttaaactgtcttccgatggcaccttcagaatatctctctaggaacttgttttgcttcactttctcatttcctcacttccctgttaaagtttccacggatcccattccaaacgaaacacacgtgaagtccaaccctgttttcagagtctacccaaattgacagaacggcctttcttgttccctttgtttattcagcattatcttcctaatcctcaggcactggcttcccgaatgtgtcattcctctcaatatgcctttcacttgggtcattctttatgtcgtcccatcctgtgccatgactttatcccttttctgttgagactctaatttacatcttccgtctcttcccctctctcggaaccctagacacacgcatctactgctcactcaccatttccatttgcaaacctaaaaaaattattcaacttactgtgtccaaatttaagccttacttcctctatcacccacttatccttctgggtcctaatttttttcttttctgggtaatgtcaactacatttttgtggcttattcattacaaattatttagagccattatttactcctgtctttcaaaaaaatgtttggctgagctgatagggtcatctctgcttttgaaatgcagatgaaatctgaccacttattttatacttctgcccttgtcaaaactaccatatttagattccaatatatttttcttatttcctgccttgccactctaggacagatacagtcatcttgtaaaaattatgtcagaccatggtacttttctgttcaaacctccatggactctttgtcactcatgttaagatataaatatcctactttggtttatatttcttgacatgatctggcctctccacccactttgaacatcttctgtcactggcctcgtcactcactccatgcaagcctgtggccttcccatggtgtctgcagcacatcaatactgctctttcctctaagcaattgcttttgcttttctctacacctggaagactattccaaaaaatggctccatgatttcttctctactttattttcttgctctctgtaaatgtctatctgagagttgccggaaaactctatggtaaaatgatgttcctgtatcattcgttatttccataccctgcttactttgcttcataaaattgattccaatctgatattgttttatgtgtgtgtagtgtgtctgtacttctgtgttgttttatttttttctcctccattagagtataagtactatggtggcagcaatattgtctgttgtgtcaggtattgtatcaccagtgcctggtttatagcatttgtttaataaatacctgtctaacaaatgagaatgtggatggatgattttgctgcagtataagttaaaagacagtggaacaatttttataggctaccaaaagcaaaaaaaatttagtactaagttgaacaagtagaaggactctgaaatggttttgttcttatacaattgaagaaatcaaaaagttcttttatgatattttctataatatttctaattaattcatacatctcctctagcacattgtaaaataattaaaatgcaagaacaaaagggaaatacatacgttgtccaaaagatcaccaggatggttaagtattaatagtaaaatggagagctttattggtgatgttggtttgcaaaatgggaagagacaacaatctctggtgtgtgccaaaggtgctctctctcagaaaaggggaaaggcaggtagttttatgcctcacagggtctgtttcacacaacagagtcatacatattcaccaagtttggggagaaatttatagatatttatgagatagttgagcacatgagcagtgggttaaatgtatatgtaatatacaacccatgctcactttggggtaagatttcaacattaaaattaggtagaatttggctctttaggtcaaaaggtgaacaataggacacaaagacagttcgtgtgcagtctatataagctggctgaaactgacttaaagtctgcagttccttattaggaaagaatatttgtaaagcccttcctctgtccagtcagagttgtagtggtctgggttgtaaatcagtgttaagaggtgtctttacatttgcttgaaagctctttttcttacagagtttagcaagaatgagatttttcttacagccaaaggaatttagagctttgccatgccagccaattcctgaaccgtcaactcatagcaaactttttttccttaaccttggggtccattttagttgataaagttatgtctattttgttctttcagatcacacatacatatccaaatttatgacatgaattattattcacctcctatcgttattagcttgtgtatatcctttacttatgaccctggactgagagccaagtattcatccataattactagattggtagtagctagatgagttataatttgttttggttatttttttctgtgattattttatgtaaatttgcatatgttatacaaaaatgtgtatgtgtgtgtgcatgtgtaggtgtgtgtgtacatgcctatctgaatttcttttgggaaaaaatgtttctagtttttagaaaaaatttagaagtcaatgtataaaaacccttaagaaaacctatggatatctgattcgaagcacatacttgttctgtagatatacagcttgtaaaacataattaaaagcaagatgaacatatggatatatatttatgtatatatatattatgtatatatatttatgggactggaaaaaggcctgatgtgcaatgggtaagaaaggactgagacagtgaatcttttggttctgggtctggaagaaagcaaggaaggtgagttgtttcctgttcaagagtctgagactaagtttgctccatggaaaacgtgaaacttcagctaaggtaaacacaggaacagatggttgtctcgttcatgtagaatctgacaacactgttttcctctgctacctgaggacatagctccgttgaagtgtattgcctaaggaagataaaaggcagagacaaagtcttcaaaacaggaattgagtaagcacacacgggcagagtgattggatttgtgacgtcaggcgctgactcaacgatacggcctttgggctcccagtgaatagaatcctcaggatatcagacaagagttgggaaaagacgacaagataaaagagactaaaaacatatacagaaatgcacacaagataaaactttaaaccagaattacatgaagaaatataagaatcagaagttggattcactgtcggcaaaataaaaacattctcacatttacagagacacagagagcatagctatccacagtcatacactcaccaaaaatattattaatttatttcattaggcagaatatgcaagcaagtgtaaagaacaataatgggcaaatcaattcattaatgcgtataataagtcacggactttaaaaacattaacaaattttctttgtaattttaaaaacaaatgaacaatgtggactctataaaaagaaatatgtacagagctcagggttttttggtgctaaagtatactaagatatataaagaacagggtagagattctgagacattttaaacttctagaaaatatagcaaaatataaattttaaagagacatatagacactattggaagaaactatgcttcacagcttctaaaccatcagaaataatgcgtcagagggaagtgtatttaaaaaattgccttgagctaggcacagtggctcacacctgtaatcccagcactttgggaggccaaggcaggcggatcatgaggtcaggagttcaaaaccagcatggctaacatggtgaaaccctgtctaaaaatacaaaaattagctgagcatggtagcacacacctgtaatcctagctactcaggaagctgaggcaggagaattgcttgaacctgggagacagaggttgcaatgagccgagattgcgcccctgcactccagcctgggcaacagagcgagattccgtctcagaaaaaataaataaataaaaagttgcttttgggaaattacataatagaagaaataagaacatggaaatttagattcctgcaagacaaaagaaaataaggaagaacacacagctattcctccttgctaccctccacacaaacaacaaacaaaccatagaaaaaatcacatacttcatcacactgacaggtcaataaaaagaagaatcttataaatcagtacagaatagctccttacaaacatcttagtaactacaaaagaaaagacagtaatttacagtggagaaagctggcagacacttttctagcgagtgatcatggttaaaatcacagctaatgagacacgtcaataccacgtgccagctgatctaaggcaccgcaaagaacacagcatcaactctgtgatgttcctgcaaatattatgtgacttaaattaaatcatgagggatgattagaaagacctaattgaatggacattccagaagatagcatcctcctatctgcaactcactgccaaatgattctagagaagaaaaaaagagagagaagggaagatacgtagaggacataaaaatgacagagggggagagagacagagagaaaggaatagagaaacagaaaaaataagagtttgagagatattaaaaaatggtaaaatactttgcatatgcaagaagtgggggaaaggtatacagaaaaattacaagaatttgtaaatttttgtaatttttgtaatttgtaaaaattacaaattcttgtaatttttctgtaagtgtaaaattaaataaaaataaaaaattttaatcataaaacattagagattaataatgttttacttttctattttaattcataaataataattgtatatatttgtggggtacactataaaaataagtatttgaggtgatggatttgttagtaattattaattttttaaaactcatttagtaacatacttagactaggagtttcgtgtttgttttaatgagctggttttggggaaatatagcataaaatgagaagaaattcgataatgtataaatgagaagaaattagataatttataaaatggaaaatacaaaaaacaaaaccactaatatttcaacaagaatgtaaaataatgagggacttctaggcattaatatatgctcaaaatgtaaaatcataattcacagtagaacaagaataattttataaataacatattattgatagaatttaacctgtttaaatgtttttcaaccaaatggaaaatgaatgggaaggaagccaatacataacataaaaaggcaaagttaaaaacataaaagaggaattttgaaagattcctgagatagggaagaatccagaatccaatgtggagcagcttgtcactatgaaaattaaagaggaatcctgggactgataatccagatgatatggatgtctgtgtgcgatcttcaatatgcctattttgagataatggcatttggacttgccaatagaagattttgagttgagagtcctctccatgcagttggtagttgaaaccaatggaaaaaaaaaaaaaaaaacaacacagagaatgtgcatcagatttggccaagagtgagtccaggacagaatacatgagagtaccattatttaaaagaaagccagagaataaccactctgaaagtgggacagagtgggaattggcagacacttgtgtgagggatcctggaaagaacagaaagcaatggactgttttaacactgggcacagtggctcacgcctgtaatcccagcactttgggaggctgaagcaggtggatcacttgaggtcaggagttcaagacccttggccaacatggcaaaactctgtctctattaaaaatacaaaaactagctgggtgtggtgataggtgcttgtaatcccagctactcgggaggatgaggcaaggagaattgcttgaacccaggaggtagagcttgcaatgggcctagatcatgccactgaacttcagcctgggcaacagagccagactctgtcccctccctaccacacacacacaaaaataaaaaataaattaaaaaaaagaaagcaatggactgttttaagaagatactgatttagatttaaaatgcatttgataatgttctaatgttatctgttgaggcttgctaccattacaaggccaaagctcattgacttgtgaaggcaaaagccagattgactactattctagtaaatgcatggaatgagataagttttcatgcttctctgcatgtgggccatatacatatatgtgtgtgtgcatgtgtgtacatttgtggtacctaaacagaaactatacaatagtgttggaatgtaaatagagtatgtaatgttaaaaacaattagattggtttatttttagtttaaatttattttttctctatataaaacctgttataatatagaacctggcacatacaataacaagtaactgaaattagtcgctttgtgaaaatgtgttattattcagtgactttttacattattaaataactgacgttgctaagacatatatatgtatatatgtatataaatacatatatgtgtatatgtatataaatacatgtatgtgtatatgtatataaatacatgtatgtgtatatgtatataaatacatgtatgtgtatatgtatataaatacatgtatgtgtatatgtatataaatacatgtatgtgtatatgtatataaatacatgtatgtgtatatgtatataaatacatgtatgtatatacatgtatgtatatatatgtattatatatatgtatataaaattaactttgtggccttctggctctaatttttacattaaaagtaaattcatataattatgttacagcccccagagttttttgtcgtgcactcatagataactaatgggctttatccagcttacagttattttagcatgttttcaagagagcaggcttattatctatctttacttttattccacgtaggcatgcttttgcaatctctacagttactccaatattttagacttatagggaaaatgtaaacaaaccaaagcttaatttttcctcaacttgaaattacactgccaccaaaccttgttattctaccctcaagagaattactagatcatatcccttcaatttatatattctaggaaaaataaacatatgtctactttagcctatctttcctgaatttctctacatctctttgccaagatttcatacaaaatagttttctctatcttttgttttattacttcttgcctccaaaagaaacagcaatcacaaacactatgcctagagagtattaaaaagtgtcaaatcatcagctttccattgtcctatttttacaaagcagaactccatgtggaaagagagcatgtcaagcacactacattaccatgtgatttaacatgacaaattgaatagatctgatatgggtaatggaaacattgatggacctttaaatacagtgctcaggttatgtttctattcataaaactcatgctctccggatgcatcctgaaacactctagtggcttaagatgctagagttaagaaatagtaaatgccattttaaggagagagaaacttttcacccatttaaataatgggaaggtgaaaggtttgtttcatcagtcacagttcagtaatgtccgtcttcattgttgagtcaatatgtacttcacgtccagtccctgaaggaaagagaaacaaatcaaaacactactctgacatcagaacatatttatgaagaactctttctataaacttttgtcaattttccatattaaccataatgctgccagatgattacatctttcattgaaacataacaaaaactttacatttgggattcagggtggtattatttatttttggagggctttgtagagtcaggctatcaggtgccagttgacgttttttattaatctggatagcatgatattagttcagaaggcaatttccatttttaaggttatgtctcagaaaactgtaaaagggattttagcatgatgaaaactttgactattttctcatgagagtctatcaaactgtaatttcaggttgaattttaagataatatcagatgtgtggattgtgctttaacaatcagtaaagtgccacaggatctcaggtgtattttatgaagaactttgaacctgacaagccacaagttaccctagtcagaaatattccctctaaagaatccccagggatattatactctaggagtataaaaatataaagctgggcttggcatatatttagctagagaagaagtttgaagtctttctgaatctactcaaactcctgtcacatggccatgtcattcactttttgtgattatctcacatctctgacttctgtctttgatgctgtttattttgatcttgtcttttgtcttctggtgagtgtccccacactgtgtcatggcttccttatgttagttcttgtcaagaagataggaaatgatatttcagtgcaaggcactgaggatatgtgtaatgtatttggaaagttttgacatcaaaatagtacttttagaatcacattaaataattcaattaaaaaagaaaagttaagccaataagataaaactggtgactatgacaatcatcagtgtggcaaatttggcactcattataattagcaataatattcactaaattttaaatgccatttcttaaatttcaattttgataataaataattatagtaaaaacagcatggaatttctgggatactcttgctaatcagtcaacgttcaacttcaagaaatgctaactaaatttaaaaagaaaaaaatttaattcatctccttcatggtgatcttcctaatttatatatgttttccttctgttcatctttatttttgaacaattaatatttaatctctccattattgtctccaagaacctttctgactgctcaactctttcagtggtattccttttatttagttccttggaccctctttaaattttatttcttttattcattctttcttatcaattcgtttgctaaatatgctaaggtaattcaatggggaaatggcattaatttcaagaagtttatagaaagtactaaatgtcaatatgaggaaaaaatgaacctaaaaactcagtttatgccataaacaaagattaaagtggatcatagacttaaccattcaaacttatacataaaagtcctagaaaacaatatagaagaaaatttctataatttggggagaaagtaaagatttcttaaatagaagagctaaagcaggaacaaataaagatacaataaatgaatcaatatattgtcttcaccctataggcatcattaagagaataaaaagataatacacaaattgggaagttattttatattccatgtatctgttaaaaacgggtatatagactatatacagaactatttaaatcaaacacaaattattacaaataagacataaaagcaaaatggacaaactatttgagcagacatttcactaaagaatgtttatgaatggctaacaaatacataatcccattagtcatcagataaatgcaaatttaaactgctactggatactaatgcatactccttataatgactataagtaaataataaaaatatcaagagttgccaaggatgtggagcaaccaattttatatggctggtgggaaaaatatttcaactacgttgacaagcaatttggcaatttttaaaaatgaagttaatgcagctgggcgtggtggctcacgcctgtaatcccagcactttgggaggtcgaggtgggcagatccatgaggtcagcagatcgagaccatcctggctaacacagtgaaaccccgtttctactaaaaatacaaaaaatgagcctggcgaggtggcaggcgcctgtagtcccagctactcgggaggcggaggcaggagaatggcgtgaacctgcgaggcggagcttgcagtgagcctagatcacgccactgcactccagcctggtgacagagcgagactccatctcaaaaaaaaaaaaaaaaaaaaaaaaagaagttaatgctggtttcacttccaggtatttgcccaagagaaattaaaatttagtttatacaaattgtttcaaatgaatattcgtagtaattgtattcctaaatacaaaaatttggaaacagctcacatgtcaattaacaggtaaatagaaaaacaaatttggatatattttgtaaagtgtaatacttctcatgcatataaatgaataaaatgttgatacgcacatgatatgtccacctcaaaacactttgttgagcaaaaacaagccagtcaaaagtgtgcatgctgtgtgactccatttgactcctcctcaccacaagatcggatatgtcccacagaaagacttcaccttcatctctgatctcaaaatgagaaggcacgtggatgagatccaagcaaagctaagcagactcaaccacagtgggaagagcacagctgccgctgcagacggggcataagaagcaaatcttttgaagaagttactgagattgagatttttgttatcgcagcaaacctgataagcacaggaaaatacaaaagacccagaagaaaatggatacaatttcaagagtgatttctttaagtttatgggaaaaggtatgatctcatacacaatgcctatgtctgtgtagaatataatccaatgtaaactggaacacatggaaaaaaaataaattacataaaataattgtatttataaatatgtatggacatgcagtaagaaaccctgacatgtacatttacacctttcaaaaaatgggctggaaagtttatttaaattacttgaaacatccatccttcagtaatggagaaatcacaatgacaaattccttctatgtgtctcttttgaaaatttaattacctttttgttaatatattatttgattatctagaaaacttgattaaatttcttaatataaagttacactcttctctatgatagtagatgttattttaatttgtattttgtgtagtaaacagattcctaagaaatatatttaagaccaatctcttaaaatcatactacagatagatatttgagggtggtttggagatcactataattagccttaacatatatctacaattaaactccatcctcttacactatgcatatcctcaatctccaagttatgcccatctcttaaataagtcccagaatttctatttttcatgttgactaactcttaaatttattcagttcttctaatttatagcatacagctttatgtattttttctttatttcatttccttgtgatctgttttctcactactataaaaatagtgcttgtaaaataagaatcaggatatatctttaacataatcagtaatgtcctataaattccaaaatacctactttagtgtttaagtaattcatgatctggttcctgtctaaatttgcagaagaacctttaattttacttcagtacatgttctataatctgaccatatatactaacatgtactgaattgttatttgagccaaactgtcttctaagaactttgcagatattagtacatttaagaatctcaacaattctatgggatagaaagtctgggagcagtctgtctccgaaaccaccatgatctaacaagacttgagggtcactgcaaacacggtcttacaactttttactaactttataaatttggtatttcccctatcttgaatgccccctctccctgtatataaatagaaattcatttttttcaaaatctattaaaatccttgcattttgttaaattgttaacattttaatttaattcttaaaaaaatgtaaaaccaaaatttagtgtttaattcactgcctccttccttcagtagagaatacattctttgagtattggcatgttttaccaaactttaatcttcactgaatatcacatagatgtgttttgtacatgctgactgaataaataaaccaaatttatgcattagtactgaaaatcataagccaaaacatttgacacagctttgtcaagaggacaattgggacagaaaggtctggagtttataaggaatcaacataatgtggctgtcttcattgagcactccatcccacaaaggatcgttctgaaggtcatgtcttacattataaatatttttcattcaatacatagagataagtatgtagctttgggaacatagggaggtttcatcctctctctctctctctccccctctctccctctctccctctctccctctcttcaaattaaaatatgtatctctccagtccattctccacttctgcagcatcatgtttttattattcatctgaatgggtttgactttatccagtattcagtaatccttgattgtcttctagtttgatcatagagaaactgtctgatgctgaattctatgcaatttcttaaaacaacttgataatcagtcataggttttaatttaaaagtctatgtaaatcttccctgctctgcaatgtttaaaaacatttagtaactacagagaaacatatatactatccaaacaacttcatgataatattgaaaggccatttacattgcgtttttatttttttcctttttctcaaaaccttaaaaactaaaacctggttaaagtgcaaatatccatttctctgtgagtatactggtatagtattataattagatatcaaaaaggtttagttatacttttgtcaaaatcctggtagttttttttttttttggaaaaggaatgtaaaatataattacctactcccaatacagataatatatgcacatctaaaacatacatgtgcacatacacccataatcatgcacagacatacctatgcacattaaaaggtaaatttaaattttaagctggtatagttctgcaaaaggttgtctaagtttttctctgtgcattctgttatctcaagcgaatatatccgtttaagttggccacttacgatggcatatttcttccattacatatcctgtgtagacaagtaaaaatgcaaatgcttcttctataattatgaatttcaatcaaatctccttttttaggtattaatttttctacagtgaattatgaagtcccaattactcatattgcccttactacatacattagtcccacattacacaaacataaataatattataataaactactaaacaaatttcattatagtaaaatccatgattaaatcaaataccagtaactacatattataaaaatagggcgtttatgtatcttgtagcccttcttgactatgagctgatcaaaagtggaaatttattttatttactttttttttcaaacccagtaccaattctttgccttccataaaagatgatagttacttaatgatgacttttgataaagtgtagtttagtaaatcgtacattcattagaattttgtgaaaattgcttaaggaatcaggaatcaaaaaagatttattatcaccttagaaaagctatttaatgattgaagcttcatgttcctcctctgtaaagaacaaaaataatattaactgtgattaaattacctaatgaatattgataggttttagagatgtgacataaaatttttgcatattattgatatcaataaaactatgatgctaaaaacattgctaactcacagctatagacaggaagggttctaaatttctctgtaggacatttgcaaatacaatttttgttattttaattcattgaaacagaagactagaaacctgtttgtttctggtttctttcaactctgtggattttgagttttaattttgtaaagcaaagtcaaagattacttactctgatttgattttcagttcatttgtagaaaatgcatttttcaatgaaaacaattattttgaaatattaaaattagtatatccaataaaatgaaaagaacagaatctaaaaatatttttaaaatatgtatcatctacctaaattgctatgagtactctaagttctatacaattttgcttagaaagctgtacttcaattttctttatcaccttttttttttttttttttttagacatggggtctttgctctgttgctcaggctggagtacagtgccacaatcatagctcatttcagcctcagactcctgggctcaagcattcctcccacctcagcctcccaagtggatgggactacaggcatgtgcctccacacctgtcttgtacttaaattttaagttaaattgagttaaatttaataactagataatttcaattatacaatcatcactacatttgcaaatacatcttttctacagtatttaaaattatctgttttaaataatacagacgattttttcttcttaatcctccagagtaatatattgcataatacatttaaatataattggcctgaaatttttaaatttcttctgatggaaaagatatgtaactaacttaaatatttccagcagaaatatgacaaagactattgcaataatcttatccagattttgcatagttatgttttaaaaatctgaggtaaatttaggaatattttgatttattttttcctttactttcaaatatatcagctttattttcatatgtaatcagagtgctttgagagctcatatcttcaggtgacgataataccttaattctgaggcttgctaaaatacaatatactttgctcactaggagaaaccactcttagtagcatcatattttttcttatggatactttcctccctttcaatatcttggaatatttaaatggctcttacgtctaccagtagtagtagtggaaatcagaagtgatcaaaattcttgttatattttgagggctgggtaaaagaatttgctaatgggctgaacatgggatatgtaaaaaagagaagtgttttgaatgaatctaaggccctattaaataaagagatgagatgtcaagtctttatatataaaaataatgcaagaagaacaatttaggaactgggaagaacaggatatgtataatcatgatgtcatctttcatagagaaaaatactttttcatgtctactagagatagaatgaaaatacttcatagaggattgtttaataattttataaaatgttcaagggatgtcaagtaagttatttttatggaactggaattcaggaaaaacatctggttggtctggtctatacattttgaaatcattagcagttaggtgatactgaaaattctgagactcgattagacaacttacaaagtgagtatagataaagaagagaagaatcattagagaaggtcctgtgagggtaaaaagatggggagaaaatggaaaagaagactaaaagggtagttataatctggagaataacaaaggagaatgtgttctgctgctatgcaaatgaaacgttgatttagaagagaaaaatccaactgtattaaatgaaattgaatagtcaaatacaaccttctcctacttccgatttcagctgctcacttctatggtcataccttagccttgtcattaataatacggaaatccttcaattatctaaatattatctccctttttcatgccaacttctcagtttccaccttattgcttctattatcccaatttaactttccttcaatgatactaggactcataagccattagttttatcacctatttaatgtatcacagtctcatattcctttatataacattgattatgtggttaatcttataattattcccctaccaataccaacttccctgtcctaccttgtgtattgctacattgtatctctggttgaattcaactatatgcctgtctcatgcttgtgccctcagtgctgaacatggctggagaggcacaaaggacagcagagacacttggctgtcactcctcactggtcagttacttcacaacatatgcagaccgcttagggcccagaatttgtgcattgccttaggaaattcactctcctttctcctgaagatatgtaacaagatctgtcatatgtcttaatcctacattgccttctcttcctacttaattgggaaataatgataagctttcttctgtgttcaatgagaaactaggaaacaagaaagccatagtattatccagtgtcaccaaagttaaacaggtttcttccagagtataagccactgaacttctcttttttatttttatttattttttttagagcattaactttagaaagcttgtactagtaaatcctttctctgcccatttgagatgtaaatcttttttaaaagcctctaaccagttccaaacccaggaatgtctttctcaaggacctgggatccatctcttggaaatgtaatcatcagggaagatagagcccctacctcccagcctctgtgggagaagagaagcctaatttcagcaggggtggcttgctccaagctgttaaactactccctgtcacgaggatagaagaaaatttacttatcttttttggcaaagctaatggagaaacgtgaggggcctggtgatggttattactacatctctgaagctaggaactattggaacgcagatgcccaagtcagaagctcaaattctctctccaggactgccaccacacatttctgaagggccactacaagtcagaaaaaatatataaaaaagagtaggaaaagtcattttctctcagattgggagtcagatctctcaatctgaaggtaagtcagttgaagagagaacctgagaaatgtgatcttcaggcttaccactgtggggcgcatagcatgctagaaaaaagtaagtatgaggtttagaagtggagaaatatacactttccaaaatagcctctggatatttagtatttaaccacatttaaatgtacccttctatgcataaataaacttctgtaccagaagagcaaaaacattatgcatctacgtaacaggaagcaactgtctttgtgaaaaaacaaggacacacttaacttgccctccaaagttgagacaaaatacctcaagagaccctgtgttcatttctggttatgttaaatacccctcctcttctagttcgttcctcatataacctgcatattctgtaacataaagggaaattacagaaatgatcacaatcgttgatatatacggcgcgattgtgtaatttgtctttgaacgcttttgagagtgaaaggatataataactactcctggataacaagcagtaactagcaattttctgggcaaacaggtatctgtactgcactctttatataaaatcattttaaaatgggaaagaaaaatttgattatatgtttaagtttattacaaatatgaaaggaaatttacatagaattgactatttttatataaatggccatatttgatctttatcacttttctcttccattatgttgtattattctcagcaagtacatcagtaaattgttacttacataatggggcaattcaaattttagttttgcaggatatgagacattgttgctattagatttataaggttactgtaatcctaagagtactaaagatccctcaagaggatgccctgagttccagacagattctttatgtgcatttctcctgataaacacatttaattataccagggtttacaggaatcccttaatttcctgttggctcagtatcaaaatggtcaaatattacattataaccgtaaagaatcattgtgagctttgaaataaatctttctttggaattaaaatatcaaaaccactaaaattcaaaatattagggaaagatttaaatgaaggtactgttacgtataataacataaggcattcccacttagattttaatttcatgtattctggctttgagaaaagccatgccaaatgttgctctctaacttaaataattgattatgttcttggggtaacaactgaaatttctgcatttcacatagctgcaaaatgattttcttgttagaaagcaatgttgtataggacaggataagagtgaattgcaggaattctgagaagatggtggcaatatagatggaaatgtttaatcttcccggacaaagcaactggaataataattaaaaaaaactacacggacaacatttgcaacaaacgaacaaacaactaggtctgtttcagttatatattgctgcaaaacaaatcaccttacatataaatgccttaaaacacactttgtattatccctcacaacttcacaggtcaaaaatttggggagggctcaagttagtaattccactgtatgttgcattgactgaggtctcttagtgatattcgactggcagctggtctgatctgaagggccaaacacatcatcccttacatacctgtgaccttaaaaggaagggctgaaatactgaggtcagcttgaactatcagttagttgacctactcaaggactgtccttcatattatcaaaagggagaaagatttcctatgtgatagctccaggcttacagatgagcattgcaagagaaagaaaataaaagctagtagtgtcttgaggaatggtatggtgtcatttgcaccatctgctgtttatttgtctgaacactcatgaggacctcccgagttcaaggtacagagcatagacctcatcttttgacagaaaaaaaaatgttaagaagtgacagccatatttaatctgccacactaggtgacaacacatgctaataaatgccaaaatatgagcaggtaagaataaaacaaaaccaagacaattattgcattgttacgttaaaagaaacaggaaaggcagaagtgcttgtgatgtcccagagaaagagaacccccaaagtgctgttgcagtgtcactggaaattttggaagcagaaattgggaaggcaaactgcagactggaacaaaactcctactcttctcccctaatttagctcctcttaagaaagaggagattcttctctctaaaaggcaccaccaccattcttgtttctctttctgcctcccatcaatcaactcgcacacatcccatttgttctaccttcaaagtacatccaaagtctgactgcctcccttcaccttccattatttcacacctctgatttcaatacatttcgtatttaccttcccagcttcttcctttgactttttattacagaccacactcaactcctaaagtgtttgtcaataatcctttcaaaacacaattcagatctggattttgtagtaagcaggattaatattcctttgaaaggcaaatcaggtatttcttcattaccctgctgaaaactcttccagtacctcccatcatccttagtaaatgcatctcttgaatatgaatggcctctaagccctatcaaatctggttcctttcagtcctccaggactcttcctgtactgttctctcctgagctcactgggataaaacatagagctcctgctgcttctagagcctgcctcacctgagcccatccaaggccactatgctttgctgttccagctggctggaatctcttctctcctatgtgcacctggttctttcctcaacattttcaagtattatctcaaatgttactttgtcagtatatgaatctttggctaccctaattacatttgtaatccccttctggcccagcaattcctaattttacttttaagtaatttagcatggtatgtattcaacttattttgtttattttctaacgtttcacactaaaatgtaaacaccatgaagtcagggctacaggaatttagtaatcttaagtaatttagcatggtatgtattcaacttattttgtttattttctaacatttcacactaaaatgtaaacaccatgaagtcagggctacaggaatttagtaatcttaagtaatttagcatggtatgtattcaacttattgtgtttattttctaacatttcacactaaagtgtaaacaccatgaagtcagggctacaggaatttttatgttttgctcatcactccaagtacagtgactggaatagcatctggtacatcagagataacgttgagtaaacttgtggagggatgaatcaattaatgaatggcaagaccccactgtaatcgtaataacattaggggatatctacttctcatttcatatatttccaagaatctgtttagaagtaaacagattctgtttagaagtaaaaattctaaacagattcttggaaatacatgaaatgagaagtagatatcccctaatgttattacgattacagtgggttcttctcattcattaattgattcattcctccacgccaggcacggtggctcatgcctgtaatcccagcactttgggaggcagaggcgggcggatcacgaggtcaggagatcgagaccatcctggctaacacggtgaaacccagtctctactaaaaatacaaaaaattagccaggcgtggtggcaggtgcctgtagtcccagctactcgggaagctgaggcaggagaatcgcttgaatcgggaggcgaatgttgcagtgagccgagatcacgccactgcactccagcctgggcgacagagcgagactccatctttttaaaaaaaaaaaaaaaaaaaaaaagaacttttagcaatagttgttctcagttttgaactttcatgataatgtagaattattttctaagaagaatgttttaatcattgtaattcatatctatagtctgcaaaattttcaactaacccttgtgagctcaaaatatctgagacaggtcttaaagatgtacccgtgacagtcctgatggcatgtgcccaaggcagtcagggtacagcttgcttttatacattttggggagacataatgcatcaatcaatacatgtaacatttacattggtttgatctggaagagagaaggaggatggcttccaggtcataggtacatttaaacgttttctgattagcaactggttgaaagagttattatcagtagaaagaaatatctgggttcaggagattgagaccatcctggccaacatggtgaaactctgtctctactaaaatacaaaaaattagctgggtgtggtggcacaagcctgtagtcccagctactcaggaggctgaaacagggaaatcccttgaacccgggaggcggaggttgcagtgagccgagatcgtgcaactgcactccagcctggtgacaaagcaagactccatctcaaaaaaaaaaagtctgggttataatgaggtgttgggggcacttaggttttgccatgcagatgaagcccccactagcaggctttagagagaaaagactgtcatgtttcttatcagacttaaggtctgtgttgatgttaatgctgtctgggtgtaatgaggcatgtctgaccctcacttcctgacatgacctgaaccagtctttcaggttaaattttagagtaccctggctgaggtccattcagatggctgcagggggctttcggtttttatttttggttttcaccttacatgaagcatagaatttgatgtatttagggatggtatgttacagatatgttactaatattactgatttttctgggttttatgaaaccatgatgaccagttgctgccattttaaaagcctaggaaagtgaccataattcagagagtttccaatttatgttatctccaaattttgctgatatattgttggttatacataggcaaagttaaaacattcgttcagaaataaccattgtcattatttattgagtgtttgttcactgaatagtctgacattttccttcatagaaaagtagtgatttgccatcttgctcaagcataactttgctttgtgattttgtgacaatttagcttaaaagttactgagttttaattaggctaatagcttaaaattattgttttgattactatataaatttattcaaaactactatagtatcctgattaaaaagaagagattctgattgaaaagattggaaaagaaagtcaaatatcaaaactttttgtaattttaattgtttttagtttttgtaggtactgattaaataccaaaacttgtagcaccaatactcatatttaaatttacatttatgcatgtaatacagtctaatttcttgcctagtccaggttcctaagttgattcttggtaatgaagtcaactttttctaggtatactctctaatggaaatcattaaatacccttaataggagtgtatgtatatgtgtgtgtgtgtgtgtgtgtgtgtgtgcccatgcatgtgtgtgtacatgtatttcatgtgaatgatttttcaaaatgtgcaatcagattttattaataagcacttcatattaaaacaatgtattttgataaaacaatgcatttaatcatgaataaaagtgttctttctacacctttaatacatgactgcacatactaacatttgcttcctaatttttataatatttgaaaccagaaagggttaccatttttaagaaaatgaaaactgtaaccctcaattgtctcttaatatttatgtatagcttcaaattaagaaactgaggattttcgtcatgctttcatggattttggaagctggtcattcttgctcagtttgccctttgatagttagtagaactgcaaatttaagtaagtcatttgcatttatgtatattgaggttttccattataaaaagggcataattgtaaaaagtgaaaaaatgtatatcaagaacttggcaaagtatgtggtaaaaataaacacacaataaatagtgacaacagttatttttgagtgaatgttttaacttctagttggagggtgtttatcaattgtatattctttttttttttttttgcattttacacctgtgtgacttttattttattttatttttagttccaggatacatgtgcaggatgtgcaagtttgctacatgggtaaatatgtgccatggcagtttgctgcatctattaacccattacctaggtattaagcccggtaagcattttttttttcctgatgctctccctccccatccccaccactgacagaccccagtgtgtgttgttcccctctctgtatccacgtattctcattgttcagctcccacctataagtgagaacatgtggtgtttggttttctgttcctgtgttagtttgctgaggataatggcttccagctccatctatgtccctgcaaaagttgaagtgtgcaataagaccatacattgtgctgtgaaatatattttatatttttaaatactttaatatatgcattgttttatatagtttcaaattatctaaatgcattccttgtttgatttgccaataattgagaacaagcaaatgaggcaaattaatatcttttgaagttgagtgaagtaatagaactccatagagacttaattctaatatgactataaaaatatattttactaagaattatttagttttcttacaatgatgtaaagaagaaaaacaattaagtttgatctaaaaacaaccattagtgctccaaacccaaaatagtagtaaaaataacagttattattgtattgttattataaaagaaatatcaaattcaggatgcactcaaattcgataaagtagagccccctatttatatgttctagagaagagtaaaatgttattaaactcaatggagcatttctgaaaggtgtagactaacaactatcaaccagataaaattttgcttgccacagggcatttggaaatatctaaagactttttcgattgtcaactaagagtgggagttctactgtgatctagcagatggagtccagggctgttgctcagcatcctacaattacaggataacctctcacaacaaagaattattctacaaaatttaatactgtcaaggttcctgatgtatagaaacttgaaaagaacatgaaattttaaaaaagaaacctgttgaactgctatgagaaggacatagccagtgctactcaagacctgaaatatccaaaagccaaagcaagccaatgttgtaggcagtgcatgggagaagttgctgttgttgatgttcctcttgtcctttttacacacgatctttgaaagcatccatagcatcctcaggtctggcattttctaaatggcgagactcctgaaagagaggacactttcccaatagagcaggtttcataggttaagcgaattctgaaccctgctgtggcctaaagtgaaaatgcctgattagaagagtgtgtcacagccatgcttaatctcactagatcatcccagtgtgagcattccatggttgatagaaaagatgacaattaagatgatgaaatatataaaataggaatgaaaagggattattttgagatatctcagacactaactcaaagtttagagtgcaaatagtttatgtggaagttaatcccaggattcactagaaggaaaatcgataaagtgtgactacaaagccagtaaccgcagaacacctgaagctaaattcttctacagaacactatcccacaagtaagagcatatgccatagagctatctctaaatagagaatcaaggcactgaagttttggtatatgaatactcataagtcaatggatgagggctgctctattgggaatattttgctgtacagggggaaatcttcctatagtcactttgccttattgatccttgtttcctttggaatcatgctggaaggtaaccactggtatgttgcagctggcctgtatggctgtgagggagggctaactgtgcatctcttcccagttcagtggtcaggggcatcatataggtggcttcaaataaatcctaaagaatttgcaccaaggaaaacaaggtaagaaaatcagatattggaaaattttttgcgatgtctttttctcagtgagttggttgttagacctttatcagcacagcacagctcccacttccacagtctttcctatagacagccaaattcactgcctggagaaaaggcacagcctggtcagcatacatttgctagatccattctcggttgcctctgactattttttctttaaacactatatttactgtatagcagtcttataatacaatacatgaaccaatattgtacaatattttatattgaaccagaatgaaccaataatacaataaatgaaccaattaatgagacaatattgctgtcaaacagcaccttttaccatgcatatcaaatctaataaatttcccttatggaatatcagaaagaaattaattgttgatctttctttgtatcagctgtttaataattcatcacaataataaaattacaagttaatgcttcagtataccatgaaggagaaaatactaatcaggaaataccattatcttttccagaatattataaaaacagttctaacattttttaactgtcatgtttaggtgaaataaagcttaagtagaagaaataatctattggtatgtaacataactgagtttgaaaatcgttcacctttaataagcaataagagccctgtggtgtcttctttaattcctttaaataatttatcatttgaatctcccctgcctggaagttatatagggtaagttactacatatttttttcttcatcatgccctttagcttataactacatcaaagatagttctgagctgctccgaaaaaatgcctcctcttcaacatgcatgccgttattttaaaagatgttatgaaacaacatggcttatttgaaaagaccacaggatttattttaagatgtcaaaatagcacattcaacattggctttgatttttatttctttatttaacatggttttgatatagtaagcatattaatttggtccacttaaaaatttataagtgtttttctatgcaaagcaatgaaataatcagaaaactgaatatcaaagtatggttgaaaatgcctgtgacagccaaacctcagtctcacaagtattcatgagtattattaatactcttcaatttgtgatatataaaaatgagatctttagtgaatgagaaaattttcattttggttttagtgtttcacttaacattgattaaaaagtaaataaaatatttcataggccaagtgcagatcttaaatgggagtataaatcaactatcattctagatgttatattactatttcattgtccttacccaattcattatgccttttcatcaaagcttaaataaaattaaactgacactttcagttgaataatgtggcatagaagttgaacgttagaatgatttcttttaacattttccctcttgtcatttattttaactactggcatttccccaatccaactctcttgaaaatttccagtgaatgcccatgtttgtgattaagttaatttacttagtaggcagaaattcttcctagaagataagcagagaatataacaaaatcaagaaaaataatttatgtattaataatctgataccttacaaatgttgtgataaatgtgcacatttttataatccttaattgtagtttatgtttgaacactccaaaatatcaaccactgtaacactgcaaagtattaggcactgaaatgagataaggaatttttcactaaaattgtatttaatttaaatacatataacttaacaaactttatatttaaaagtaacatttttatcttgtaaaatttgtcttcaaatattattttctttaaatatatgatcagtaatttagaaagcattttcatataatgatatgtctttatttacagatattaaaatagttgatgaccaataacattacaaaattatcttttgctatccaaattttcattatcaccatatttgctttttctctgaggatatgcaaaaaagtatgcaaaattcattgtctgaaaaattcatcctaactaattttcaagtgaatatgaatgaaaatgtttagttttgttcgagttcgagaaactataggagatagtgtgtcatatcccaactgtgtgtatgagaggagcacctcttgtgctcagtaaatgttgcttaaatgtgtttgttgtccctcttatcttcccttttcttactatgaccttgtttctgggtcctcaagtttactctactaggcatttggaacacaaccactctaaaaattttagattctgaattctatgataagtgaggaaagttgatgggcctccctccaagcctaatcctcctcgtgagagtaagcttggatgcacgtttcatccactctcccaagagactgcactctatatttaattcaatttaatatgaatggttatgttgtggcaaatttgtttaaaaattactttagtaaaataagcaataagcaacaattatcacttgctgacacatgcatcatctctgtgaatagaatagaaggagaataatttaataagccatacattaattggataaactgctaacggatcatgagaatataatcttaaattggcgtgaatattatactatgttctctattcctccagaaataccaacttgttaatatgaattcttgatcaaatgcctatatgactatactaaaatgaaaaatcccacttaactttcaaagttatctatttgatttatctataagaagtctggttgagggacaaaaaaaactaacactgtattattcttgcagtacttcttttacttttacttctgtgttatgtttcacaagctctcaactggtctagtggtttgtactgtatcaacttagccaagcttcaagattataccgtttagttaaacagcaggtagtcaatatgccaaaactttaggtatgtacaagaacaaattaaggtgtaccatgaactatctattaaaagagagagagagagcgattgttcagtaaatggttttcctgtatatttttctagctatgatatatttctgattcattagggataaaccaacttttctggagttgcatactgttaccaaaacaccaggggtttgatctgggtcctgctgttcactgcacagaaacccaatgactgagatgatgagtgttgccagagaagaaggctttaattgagtgctatagccaaggggggagctcagtctcaaatccatctccctgactgactaaagctaggggtttatatagtagggaagaaatgtaacaatatgtaagaaaccaggagctagggaggggcaaacaaatcatgatgaatgagtggtctggcatctcattttctggatacggtgatctgttgagtttcagcctttgctagtatttttgagcggcctaaaggaaagaactatgttaaaacaaacataaatttcaagctttaagaccagaagggttaatttatatgtttatttaaaaaaagaaaaactatctatgggactagtgggttggtttcagtactaagcttcaagacacccatttgcatatagaaatacacatatgtgcatacatgtatttctatacatatattcatttataagtctatatgtcaactttttaaatgaattatccaataaaataatttaatgagcattattgatggcagtggcagcccatctggagcagctgctgccatgatgcctcctgcagtgggagaggtgtggccagggccgaacgctccacagagccagcgggagctgggaacagttggaagccctgctcccttctgagtcggtagggtgggaacttcatgctacatggccacagctgtggttgcccagcgatggctttggacccaggcatccctgttctcttgtgggatgagagcaggcaggagccctgtgctcctgggcactgctgcagctgtgggcctgggagtctctttgctctcaggagccagggatacccctacaggcttacaactgcctgctcctgctgcctggcctctctttactctcagtgctcagtttgatcttggagaaaagttgaggccgagcctaggcactgttgcaacccacccaagtatgtgcactcagggcagtgctgacaagagagccccctcctgacttggtaccctccagaatttgggtcctaatgaacatgggaaggaggccaatgagggagctgtaggcagttgggtgctggcctacaggcacccctcagcacaaacaacctgggtgccatggatgaaggtaggaggcagacaggctcctgggtggaaagtggcaggtccctggtgaagtcacactcaggccagataccacctgaagcctggaggatgggctgattaaccagaataggaacttacggtgctttttctaggcccacccatgaaccaatcagcatgcacatccatccctctgaagcccataaaaaccttagactcagccagacttgaggagatgatgggacagccagctgcagagtggacctacccaatacagggtctcctctctgctaagagttgaacactcattgggacaccctggctgctgagaggagctacccactgtgagtctcctctgagcagttctattgcttgataaagctcctcttcatcttgctcaccctccacttgtccacccacttcattcttcctggaagtgggacaagaaatggggacccaccacatggtggagctgaaagagctgtaacacaaacaaagttcaaacaagcttcttgctcaccacattgccagagacaaggagagaagagagaaggagagaagtgctgtggcccttttgggatcccagacctaggagcttcccagacagggctatgataccctctttggggcttggcagttcctggcatctccaagcttctgggtaccaccgcattccctagtgctagctgtggaagctgtttgaggtatgcctggtccagctagtcttgaagggagctcacacctatgctagcacctggagctgaccaacccactgcagccaaaatgcctggctgtgtgtggtggctggacctcatgctcactcacacacaccactctctgcttgtctcacctttggtggcatgggatccagggtggcagtgtgagctgaatgcggcctaccaggctgagtgagtccagcaggcccaagcaaaactcaggcaaaggtgccacactgtccacagaggcttcctactggtgaagtgacatctcaaggatcctgtaacattatatttataagacttttctcaaaatattaacagtatttcaaataatattatttaaatatatgcctaaccatttaaaaataccatttaatctaacctcttaatggcgagagcccgggaggcagagcttgcagtgagctgagatcatgccactgccctccagcctgggtgacagagcgagactctgtctcaaaaaaaaaaaaaagaaaaaattctgaatgcagaggttatgattacccattttatagatatttataaatatttacagatatttaacaaattgaaagatttattcaaagtacagctcagtggtgtgccaaggtctatctctaatatgattttcattgatttttcacttgaattatagcttaaataaatactctttcttttcaatgcctagaattaaataaaatctatctagagattacgtatatgtatatataattgtaaaacaatattatacataattccatataaatatatgtaaatatatttatacaatgtatgtatagatagcattcagccacagtatcatttaaaagccttctgtattctgctctacaaattaatttattcttttaaatcttatgttatttaaatgaatcctaaggaccaacctagacctcagatttttaaggatacatctttatcttcaccagttctaatagttcctcagctgtagtcaaaatgatgatctttcctatatagaagattttaaatagatattaaattcttcaccccctactctcaacattattggtttctaaattaagtcagtgctacttgtgtacttcacgcaggacagcattatttggttatcagtcattcatacccttattgcttggagaaaacaaaaaacaataaataaaaccacagttttgagggtgataagaatatcccatgcttctttcccagatactcggtttctaagcatggtttgcaaacggatatggccatgaaacctggttatcacctttaaagtgaaatctggtggggttacaataaagttaagatcaacccaaagaaaaaccctttttgctcacccttcacactctttgaatttaggaatgagatacgaagttgaataaagaggctgtataatgaaactcaaggacaacacacaaaaaatggctaaaaagagctattgactgatgaatttgagggtatgctatttgactctctggcagtaggataaataaatctgtttctttagctaccattagttgaacattctggggttcaccattgatataattctaaagtgcataaacaaatattattacacctgtatgtgtgtgattgatgaaaccagtgctaattaatatagcattgtaattgtccacttaagaggaaaaagtcagtcagactgctcataacatatattatactcttaaatatgagagaagagcttgtaaatatatggaagaaataaagtatatgccattttcaatcataattttaaagaaaacaagtgtagtaacactgatatttgaagaaatagacttgaaaaaaatattactagaaataaggagaggtatttgatattaaaagtataaattcaagaaaaaagtatcacagcataaatgtgtatgcactgaataacatgggctaaaatatataaaacaacttagttataagatgaataagttctagcgacctaatctacagcataatgactatagttaatatattgtacattgaaatttactaaaaaagtaatcttaattattcttagtacatgcacacacaaaagtaactatgtgaggtgatggtttatgttaatttagcttgattgtggtaatcatttcatcatgtttatatttcaaaatatctcattatacaccttaaatatataaaattttaatttgccaattatacatcaataaagctaaaaatatgtaacaaacattcaagataaaaggagtaatatgtaaatttattatcatatttggcaattttgactcaccactctcagtgactgagagagcacaatggaaaggcaattagaatacagaagatttaaacaataagattattcactgtaacttaattgatattataggacatcacaaacaatagaaatcagttccagtaaaatatgacattacatcttggccatttaggattgtgcttgtcaatggataattaggcacatataaaatgattttgtgttgtttgggggtggctaatactgattattaaagagtaataatgttgctattacaaaataaatttcttcagtcatacttgttgttttcctaagaaaatgtctagatctttgaggaatttcctcctaaggatagatttgtagaagcatttattttttgcgtcctactacacaagttagagggtgcacacacactcatctctaggacagtggagataccctcttaactgctgtgtgacatggacttgacctatctgtaaattgacatttttttttcacactcacaaaagtttctcgttaaaattcagtgaacgaagtgcaacgtgggttggattctgcatcagagaaaggacactaattgaaaaacagataatatctgaaaaaatgtatttccttaataaaatcagttgagatgtttatctttggctattggttgttttagcatatgctatggtatgaatgattgtcccctccaaaactcatgttgaaacttaatgtggcagtgttgagaggtggagcctttaagagatgattgggtcatgagggctctgccatgattggatgaatgggttaattcattaatggattaatgggttatcacgggagtgggactgttgactttataggaagaggaaggaaatctgagctagcaggctcagtgccaccttaggactctgcagagagtctttaccaaacgagggaccaggtccagtctcttcactgtggacttcgcctccagaactgtaaacaattccttttgttttttgcaaattatccagttttaggtattctgttataagaaacaaaaatggactaagaatataatcatatatgaacctgtttcatttcttctaatagattgtgagtccttgaaggacaaatatcataacataaacatttatataattaactcactgattttaaaacttttgagtgtctaccatatccttgctacaaagattatgtattgataaacaaaacacatgctgcatgtattccatagtcttttgggtggggatacgtattaagaaaacataaataaatacattgttaaaatatacaaagaaggatgattacaagttttatgagaaagaaagttatagtacaattggggctcaaagagatactgtctgagtaaataaaatttaatcagagatttgaatattagtaatacttttccaagaaaacttcaattgagaaggttatgagaatgatggagatttttctgagaaaaagaataatatgcataaagtttcagatttgagaaagatgtcataacaaataactaaagtaaaaccaaagtggttagagagcagagctgaaggaagagactgatgtcaactgaagcaagataatttaataagggatacctcaaaatgcaggctttagattctatcctcagaaacaaggtgaaagaggttgacaataccaattgctttataacattacttatgatgcttttcttgtaaatacatatgataaactaagaaaaacagaagtggccgggtgtggtggctcacccctgtaatcccagtactttgggaggccgaggcaggtggatcacgaagtcaggagatagagaccatcctggctaacatggtgaaaccccgtctctactaaaaatacaaaaaattagcagggcgtggtggcgggcgcctatagtcccagctactagggaggctgagataggagaatggcatgaacccgggaggcagagtttgcagtgagccgagatcgcaccactgcactccagcttgggtgacagagcgagactctgtctcaaaacaataataataataaataaaataataataaaaaaaagaaaaacagaagtgaggagacaagtagtaggattttggaccaaaaaaaaaaaaaaagatgcccatttgaactagactgaaagagaaggaatttagaggtatgagaagaatttatatatatttggggaaaaattaacaggattcaggatttagtgattaattgaatggagatgttgaagaagtgtcaacaaaggattttaggtttctagaatagatcattttccttaaatggagcagtacatatttgaggtggggatcaaaaagtaaattttactaatgtttgctttatgatatttgttacatataaatgtaaccatcaacatacgagtacggtccacaaaagaaagtctagaattaaagatatacaactgaaagccaccataatataaaagttacttagtgtcataactcacttgctttactctctgtataacctcaacaaatagttcatgattgagtctctttctaacacacactcctgaatgccattatagcataaatcaatctgaatgtttatggttgttttgaaaaagcagtacatgaaatccctgataggagacaagatatgcatgagatatttttatataaactgcattgtcataaaagtccttagactttcatttgtgtaagcagcatttgaagaaggctgctttaagttgaatggtatttgggaataaatctgaattacattttaatacaaaccataaaaccaacaataggaaaaaagtactttgggcttcacagaaattatctgtaaagataaacggacaatgaaaggtttttaaaaaatcttaatgaagtactttttttcatattgtgatatgactaagagtgattgcaatgttttaacaaccaccaaatgaggttagatatgtatgattctaaagagaacaggagaaacatagggctttattgcatatataaatattacttttaagtgttctgtttgagattgcttgaatttttgagatgaaatgcaactcacatctctatatatgaagtgctatacaaaatagaaatgaagatatataaactgacagtaacctttattatattagaatatacattcccagctgaagtttgttgactactctcaattttttttttttttttttttttttttttttttgagaaggagtctctcactgttgcccaggctggagtgcagtgttgagatctagctcactgcaacctcctcctcctgggttcaagcgattctcctgcctcagcctcccgagtagctgggattacaggtgcctgccaccacacccggctaattttcttttctttcgttttttttgtttgttttttaatttttagtagagacggggtttcaccatgttggtcaggctggtcttgaactcctgacctcgtgatctggctgtgtcggcctcccaaagtgctgggattacaggtggctaccctcaatcttaagctatcacatttgcttagtaaatgtccacatgttaccaaatactttttttttttttttttttttttttttttgagacaggatctgttctgtcgcataggctggagtgcaacggcacgatcatgatggcatctacctcctgggatcaagtgattctcccatctcagccttccgattagctgggattatagacgcatgccaccatgctgagctaatttttaaattttttgtagagaccctggctggtctcaagctcctgggctcaagcaatcctttcaccttggcctcccaaagttctgagattcaggtgtgagtcaccatgcctgacatacctcatacttttattcggaaggtcataaaacatgcagatatattctttttcagtgatttaaaataatctaatattttaagaggcacaacagttaaaatgcatactttagagaattaacattaaagtcttaaatattaataatcaagttttagttatgtaaaactgattcttctttgtattttcatggttaatattaatttgagtgaagtacactttgagaaatagtaggtattttgagttgaaaagaggcaaagagttaatttactattgaatatttttaaatttttttttgatttttctttagaatgtttttttcctctgtataatcttactaaaactccaaaataaaattttcccaagctgagcggatctggttagtgagatgaaagagaagcatattaaggtcccactaaaaaaatagagatttgccaaaaagggctgaaaaaactctatattagtcttatcagtccatatttggatgagaaaagtaaatctagctaagttattcaagtttgcaggattatatttctgtccaggactccatataaaactatttctgtctaggactctataaaacttcctacaatggcaggtaataacttttattcataatgttgacaagatcatttctgtggcaagatttgtcatttatatttgcatagtatgtaatttatataacctgttatgaattgccaagtttaattgatatactttttgacatgacaaaaataatgaaaaatgataataatggacttttccccattctaacagagactattgggaagaagggatcaacttgctcaaatgtcctatagtaatattcccacccaggtcagcatgcttttggttctgcctagcagaaagactatggggagttcttatgcaggatgcactttatttgtctacatttcttattgaaaaacaaactgtaatttataaattatggagcatgaatgattagagagtggataccattctagtatatgatataaataacacaacactgaacagaaaagttctgaaacaaaaagatctctttttataggtgaacaaggtgtcccacatgtagttctcataagtcacctcatgtattaaacctgaaactaaaaattatcttaatgtgggaacaaatttataattttggagatctgcatttgatgaccttaagagagtatttcaataacaaaatattattttccctgagcctggtaccttcatatattctttgaattttttagtacagtttggattttaaatgtctgattcatctgagactgattgtacagttcaacactttatattttcatgagcattataatttgttatagtttccattttatcgctttttaaaatttactgtattaaatatgttttcttatatagaaatcagttttgataaatgaatttttgacttcatttttagctcttttggagttcatttttgtaactatcatgtttatgctatacaacttaagatagcatatgttggcacaccattatgtgcaatgatgaaattagtatattattttggagttatctttagagaggatcaatctcccttaacagttggtaaggagcccttccaaacatctctccagtaagttgtctccagctgaactgcaaacactgaataagataaaaataaaaattcatagtgatcacagcaagactctatcaatcattatatctttcctatgtaagttaaaaaaagtcgctgtttttagattttgctcagtgttttcttaatcaagcttccatgcaatatatcacaggctaattttatactcaaataatattcttaaagcaattaactttgaattttctccatatttttatgtttttaaatattatgatgtaaaattatttggaggatccaatacatatcattaagaattatgtttgtcaggcaataacaaagaatgttaccccaacaaataacagcagtttaaaaacttggattgttattttctcataaaaatcttgagtttggcagtctaagggctcattatgctgtctctgttccaagacattctcaaagattgaaactcttgctacctttctgctcaaatatatgcctcaaagatggtctccattctcaagatcaactcgtgttccagtaggtgcttcaggtctggtcatcataaatatattttgaccagcatggagaatgaaataacaaattaaaaaaagaaaactatactgcacttttttctatggaaaatgttagactctgacactttacatatttgcttacatctcattgattaaccaacaaaacatgagcccatggaaataacctaatacaagacagaactggaaaaatgagggattacacaacagtataccctagcaaggattctggaaacaggctctatttaaaacttggctttgccattactaactctgaattttggcaaattgagctgtccttaacttcctcaactattaaatggaaatataataatagtctcatctcctatttttgtgagcattaaatttagtaatatatttagcagacttagaacagtggttatacactatgaaatctttagcaatactattattattacttattctggaaaactaagtgatagctacaagttggggatcccattaaaatgaagaaggggaaatggaattaggaaactaattggtattctcttcacccagggtatgataaaattataaaagaaaagtaatctgtaacatttatagcagtgttttcatttatatcaaaatgaagtttgacaaaatatacaatttcacagatattaaacctgtttctgaatgacttttagaaaaagaatgaaattaaggcagaaatcaatattttttgatactaataaaacagatacagcataccagaatctctgggacacagctaaggcagggttaaggagaacgtttatagggctaaacacctatatcaagaagtgatataggtcaagtgatatagctcaagtgataacttgagttctttctagagctcaaattaacaacataatatcacacttagaggaactagaaaaataagagcaaagaacaaatcaagcccaaaacgagcagaagaaaaataatcaaaatcaatgctcagcataaaggacttgacatgcaaaaattcatacaaaaatcaactaaagcaaaagttagttttttgaaagaataacactggtaaactgctacttagaccaataaaaaagagaaggtcaaataaatacaatcagatagcacaaaggtgacattaccaccgaccccacagaaatataaaccaccccactacagactattacaaatgcctgtatgcaaacaaactagaaaacatagaagaaatggataaattcttggaaacatacaaccttccaagattgaatcaggaagaagttgaataatacctgaacagaccagtaaggagttctgcagttgaatcagtatttaaagacctgccaacgaggaaaagctctgtaccaggtgggttcacagcctaattttaccagatgcataaaaaagagctggcaccagttctactgaaactattccagaaaaattgaggagttactcctctctaactcattctgtgaggtcagcatcattctgacaccaaaatctggcagagacacagtgaaaaaagaaaattttaggccaatattcctgatgaaaacaaaagcaaattcctcaacaaaatattagcaaactgaatctggcagcacaaaaaacctaatacattatgatcatgtaggctttactcttgggacacaaatttggttaaccgtatacaaataaataaatgtgattaatcacagaaacggacctaaaaccaaaaccacatgatcatctcaacagatgcagaaaaggctttttataaaatccaacaatgcttcatgttataaaccctcaacaagctatattttaagggaacatacctcaaaataataagaaccatctatgaaaaacccaccgccaacattacactaagtggaaaagctggaatattcctcttgagaagtagaacaagacaaggatgcccactcttaccactcctattcaacagagtactggaagtcctagccagagtaatcaagcaagagaaaaaattaaaaggcatcctaatacaaagagtggaagtcaagttatctctctttccagacaatatgattctatacctagaaaaccccatagtctctgccctccaacattgataaataacttcagcaaagtcccagggaaaaaaaaaatcagtgtacaaaaatcagtagtatttttatacactaataacatccaaactgagagccaactcaagaacacagtcttattcctaatagccacaaaaagaatataatactgaggaatacagataaccagggaaggaaagatgtctataacaagaattgcaaaacactgctgagaaatcagagatgacacaaacaaatagaaaaacattccatgttcacttagaggaagaatcaatattattaaaatggtcatagtgcccaaaataatttacagatttaatgctatccttctcaaactaccaatgacatttttcacaagtttagattaaaaaaacttctaaaatgtatacagaataaaaaataaagagcaataagggacaaggcaattctaagcaaaaagagctaagctgggggcatcatgttacctaacttcaaactatactataaggctacagtaatcaaaacagcatggtatttgtacaagaacagacatatataccaatggaacaggtaagagaaaccagaaataaagttgcacacctacaaccatctgatattcaacaaagttaacaataaaaagcaatggggaaattactccctagtcaataagtggtgctaggataaccgctatctatatacagaagaataaaactgagccccttcctttcaccaaatatgaaaactaacttaagatggattaaagacttaaaagcaaaacttaaaactacaaaagtccccaaagaaaagctattaaataccattctaaacataggaactggcaaagatttcatgatgaaaagtccaaaagcaattgctaaaacaataaaagagccacccaattgagaagtgggacttaattaaactaaagagcttctgcacagtaaaagaaactatgaactgagcaaacagcctacctaagaatgggagaaaatatttgcaaaatatgcatctgacaaagtctgatatacaggatctataagtagcttaatcaacaagaaaacacactactaaaaaatgggcaaaggacattaacatacacttcagaaagaacatatgcatgcagtcaagaaggatataaaaaaactcaacatcactaatcatcagagaaatgccatcaaaatcacgatgagatgctttaaaaagtgctaaatgaaagtactaccactcagaatggctattattacaaactcaaaaaagaacagatgctagtgaggttgcagggtaaaaggaatgtatacacactgctaaaggaaaataaattagttcagccattgtggaaagcagtttgaaaatttctcaaagaactgaaaaactaccatttgacccagcaataccattactgggtatataccctagggatataaattgtccttccataaagacacatgcaattgtatcttcattgtagcacttttcacattagaaaaggcctggaatcaacctagatgcccatcagtggtggactgaatcaagaaaatgtggcacatatacaccatggaatactaggcagccataaaaatacttaaatcatgtcatttgtagcaacatggaggtagctggatggcatttatcctaagcaaagcaacacaacaacagaaaaccaaatactagaatgttcttccttttaagtgggagctaaatattgagtatacatggacacaaagatgggaacaacagacatggggtcctacttgagggtggaggctgggaggagagtgaggatcaaaaaactacctatcaggtactatgcctactacctaggtgatgaaatcatttgcacactaaactctagtgacatacaatttacccacataacaaacctgcacatgtatcccctgaacctaaactgaaagctggaagaggaaaagaaaatggagtttgagctcatgtgtctctttcctttgaatgtgccactccagttagaaatgaaggtagattattaaaatattatattaaaaatagctttggttataaatataagagaatttcagtaacgtgctatcaataaaattcaaaagaagaatcagtttttcatgttaaaattttaggtgttttaatttcaaaaactggaaacaagcagatgtatcaaaatattttacttttgagaggtaggagcagtgggagttagaagcagggccttgataaccacattcttgtatgaaagaagcagaaagagacaaactcttaaagctagtccattaaagtgtagagtcagcattcttgagaagccatgttctgagtcagtgatgctgagaaacataaggacacaaacctgcttggttgatgccatgagccagctcagtgactgcatctacaatatcttgatggcattacaggagtagcagcctgtctttgctagaagagaatttggtgacgcaaagagacccaatggctgtgtgcatctccaacaattggaattataattcaacatgagatttgaacaggaacacaaatttgaatcatattattctgcccctggcccctcccaaatctcatgtccttctcacattgcaaaatccaatcatgccttcccaatagtccccgaaactcttaactcattccaacattaactcaaaagtccaaagtctcatcagagacaaggctagtcttttccacctatgagtatgtaaaatcaaaaccaagttggttacttcaaagatacaatggggatacaggcatttgctaaatactctcattacaaaagggagaatttgggcaaaatgaaagggctatatgccccatgtaagtccaaaacttagcagggcagttgttaggtattaaagttccaaaaagtatcttttgacttcatgtcctacatccagtgcacgttggtgtgaggtgtgggtccccaaggcctcgggcagctctgccactatggctttgcagagttcagaccctgaagtgggtttgaaggactggcattgagtgcctgcagcttttccaggctcagggtccaagctatcagtggatctaccattctggggtgtggaggacagttcccctcttctcacagttccactaggcagtgccctagtggagatgttgtgtggcagcttcaaccccacatttcccctccatactgtcttaatagcggttctccataagggctccgcccctgcagcaggcttcttcttggacatccaggcttgtcaatacatcctcttaaatctaggcagaggctcccaagccttaactcttgcactctgagcacccacaggcataacaccatgtggaagttgccaaggcttatggcttgcatcctcaggagcagtggcccaagatatgtctctattgattttatccatgggtggagttggactggctgggatgcagggagtaggacagtgggtccctgggcctgacccatgaaaccattctgtcctactaggccttcagatctgtgatgggaaggctgccaggaaggtttctgaaatgccttcaaggccttccattgtcctggctattagcacctgccttccatttagttatgcaactttctgcagcctgaatgaattcctcctccaaaatgggcttttcttttctaccacatggccaggctgcaaactttataaacttttacactctgcttctctttgaaatataagttccaatatcaggtcatttctttgttcatgcatatgagatagacagaaacaaagtcatctcttgaagactttgctgcttaaaaatttcttccaccagatacactaaattatcacacacaagttaaaagttgcacagatccctagggcagagacacaatccaaccaagttcttcactaaggcattacaaaagtgacctttgctccagttcccaataggttcctcatctccatctgagatctcctcagcctggccatgtctgtccatatcactattaacattttggtcacaaccattcaacatgtctctaggaagttccaaagtttatctcacctttctgtcttcttctgagctctccacactgttccaagctttgcccattacctagtccctaagccacttccacattatcagatatttttatagcaatgtctcactccttggtaccaattttctttattagtctgtttttgcactgttataaagaaatatctgagactggctaatttataaagaaaagatgtttaattggctcatgattctgcaggctgtacaggaagcatagtggtttctccttccggggggacctcaggaaatttacaattatgacaaaaggcaaacagacaacagacatgtcttacatagccagaacagaagcaagagaaaaaaggaggaggtgccacacacttttaaattttatttatttatttatttatttattttttgaggcagagtctcactctattgcccagactggagtgcagtggtgcaatctcagctcattgcagcctctgcctcagcttcccaagtagttgagattagaggcactcaccaccacgcctggctgatttttgtatttttagtagagattgggtttcaccatgttgaccaggctggtcttgaactgttgacttcaggtgatccacccacctcggcctcccaaagtgttgggattacagatgtgagccactatgaccggtcgaggtgccacacacttttaaataaccagatctcaaaagtactcactcactatcacaagaccagcatgaaggagaaaatctgccctgatgatccaatcacttcccctcaggacccatctctaacactggggattacaagtcaacatgagtaatccccatgttggggggacacagatccaaaccatatcagtgtcctaaagtggattggaaaaagtttcagaaaacccagtgatggcgatcaatgatctatcttatagtgagccttgacgtgtgacaggctttttacaaaaatccttgtagtatataacaggatgatactaccatgagaataaatttagtaaaacatagtattattgatatataagatacaccatttaatattaaaattgtgatttcttatattttgtacaacattatcaatgttttaatcctcattaattagtatatttaaatttagtactaatgcaatgtttctgcatgttttagtggtttatcttaataatagttttatacacgatgaaacatcaattgtgacatactacctatgttagaagtcttagataggaggtagttctctgaaagtgttctttaaaatgttagtaaacttcctagaaaatcaagaattttttttttgtaatttcctttaaccagtgaaaaggcgattttggccttgtttacaaaatgcgtaaaacagatttcatacgttataacttatatttggattgattcagtttcctcacttttctttcaatttatttttaatcagtttatatttattttcagatagaagaacaatctcactgagcattagtttaataacctattaattaccttattaaaatacttgtatccgtagtcccagctactcaaaaggctgaggcagggggtttagttgagcccaggaatttgaggccaatgtggaaaatgtagcaagattctatcactaaaaataaataaatacacaagtaaatttcatcgtaacaattcttctgccatttatgtagcttgcctttagagtctttcaatgttcttctctgaaatgtatttctatgtgcttgactatatcttcccgtaataatgtcaacttctgatatggcacagattagataggctttgcgaaaaaggctggaatagtaaagtttatttacttttttgtgtgtagatttgtgttatccatctctttttaaattttatttaacttttattttaggttgaagggtacatgtgcaggcatctcttggtgcatttacagctgtgccattttaaagatgccattccttagtgcagctacataattcatatggacaaaaagatgtgatttttagaggaagagtgcttgcactccttattttttcctgtcttttcaaaaaaaagaccagatgtcccagagcaaaacacactagggaattattttttaccctctgctagcatggaaatatttagtgctagagtcaagagaactgacagttattttataatttgcaagaggagcaaagagcatacttcaagtagaaaatatatatgacacacataaataatgaattccctttatgcattttttcttttattaggttcttagcttcgaccaagtagcaggtgagtaaatcatgatggataggccccaaatctcatattccccagagtagtttaaggaggagaaattttcaaacatagagaagattcttcataagaatagtataaatcccttttctcagggagcttgttatacgtacagtgtcctgttagtcctgcaagtgggcttctggattgttggtggcacccttagtttctgtccaactctagaacattataggccatcgggagagttcaaggtactcttacttctcatccccaagtagtggtggggattggaattctcagcgtggtgcatgggtttttacatttcaggcttctacctgatgtctactgacttcctctgtatctttcaatcttatctagaaaggaggttcttctccacaaattaaggagaccccctcaggcccttcctctgcacgcagtacaagattccacccaggacctctccctagaagatgtacctctttgtcttttcaccttcggtcttcaaacatggagcagatgcaataagatttgaaaaaagaaacctggacctgtagctctgtgccttagcaaaatggtcctgtgttcaagagcaaaaatttctgtaagcaagacctatagaatgaagacttctgccctgtctgtggttagtgcaagtttcacaccaggaaaatgaagttacccttacaaagttacccttacgatgacaacatatgatccaggacaggttgactagagcagggagttttccatgggagaggttggagctagagttcagcatggtttctgtgtgaatgtgtgtttctatatgtgtgcaggggcagatgtacttgaaggtgcatctgaatctgtgttacaataatagataaattattgagaacttgaaatcttaggccattgtcaaaaattacttcaaaaatagcatcttaagaaagcaagattggtatacacaaggaagcagggaatgagatgaaagacaataattagcttaagagggcatatctttacatctggagaattctctaatttcaaaactgaaaatacaattgaaaccaaatactgtgagtagtgttctataggaaaattagcagaatcttcactatggtgataaaattcttcaggccaaggaagcagtcaccttaaaattggtagggtaaatctgagaggtctttgactttctgcgttgagctttttgtggctccacagcatccaagcatgaggtgcttttgctcatgccatgttgagatagtgtcaggtcaccatggaatagtgcattggaggaggtgggttccaggaagactctggaagacagatgtccagtaacattagtctgtctcatcttttgtgtgtgagaggatgaaactccaatcttatttaaccactttttaaccagtgaactttaacaaaaattcacaaaataattaggggagaaaaaaacatacatggtaaaggatacaaggagaagattcacaacaaattcacaacagcaagaagacagaagtagtagtataaactagtttcattttcaaattttctaacaagcaaataagtatatatagaagtgataagataaatcaaatgttaactacatagatactataagcacgtaaattagagcttgcaataaatattaaattgtaaggcgtttatatcatgtaatatacattatactattataatgatatacatgtgatagattttagcaattggattgtcaagctttataaaattttgttcaaaatctgtgttgactaacttattaggtcctcagcaattctataatttacttgcttttggaaagaaaactgaatagaccatctgaagtccaatttgatgataaaatcaaatcattgcaaaattatcgattcaacaattaagaaataatctaatacatttcaaaattatacttatatggctctacctaactggctgtacaaaaatatacagtcatatttagaaataatatccattataaaacataaattagggatctatgatcaagcaacaagcatataatctctgaatttaaaattgaaggcatattattgaggatagacagacttggtttttctggaatgggagtagataattttaatgtccaaatccctaccctatttctatgttgcaactgatgccacaaaaaggaaatcttgtcagtatatcataccaatggagccaacacagttgatactatgagtgcactgattaatagattttaatacttattgctatacatgaatttaaattttattcttaagaagagcatgaagatttagcctgacctaccatcacctaggaaggcattattgctaaaaagaaataatgtgaactttatattatggattttcaaacatgctaaaacattaccttaaattaatatgaacatctttctgtttttcaagatccaaaagcaaagtattttattatcaataaaatactttgtttttgtagtaaaaaataacattttattcttttagtcagcaattctcaagataaacattatatatttgattttgtttttcatttaaatatttgcaagctcacagaaaataaacctaatttctgggtaaatgtaaatttttcttcctcaaaaattacattatgtggagatagactcagtaatcagatagccgcaagcccctgaccatgaataatcatagcacctcacttttacctctcttgaaaattaaaaaaaaaataactccacctatgtatagttaccttattttgggggcttctacctctgttagtggcaatataatgaattatttggatagtgttgccttacatttcattttgtaaatgaaacactgatacaacattttatacagttttctgacagaggtaaattgcaattaaaaaatgaagcttttattacagtgacaatttttcacactgatggaattaagtgtgtgccaacattacaattaaatttcttattttcaggaatttcaaatcaatacattaaatatgacttattctagcacttggcaaataatattttaggcaataaagaaattaatcagaatagttttacaaagacattgaagaagtaggattagagactcaaataatggaatggaaaatgtgtacagcagttctaaagtaatttatatgtgcatataatttaaaatgaagtaacatgtgcttaataaaatcatcatgcacccttagacctatgtcctaaagctattcaaaagtgtaataaagcaaaagccaaagcaacatttcatgtataatagcctagaaaattaaaaatgtattcctttattaaataagcaagtaatgtagatatatttatacaaaataataatgatttcagttttattatctagagatttctgaatctgattcttgtccctaaaattccagtgaccacagatgtatctatatagagctaaaagtataatattatcttttaaaactattaaggaaaaatactttaaataaagataactatacagtctggagaaaaataaaaacaaaaacctgaatgtagtgtaggatgaagaaatgcagtcagattctaaaaggaagtgaacatttgcaagaacagaatggcagaagctaaatttcttgtctttagcatcttatagctggaaggcatgctgcagttcaccatatacagcagctaaaactctgatagaatgcccacaaaagaagccaaagggagagatagggacaaccacagatgctgcaaaatgtgtgtaagtatctaggagggctgtaccatgggaaagagagtcagagacagatagacatgtgttctactcataaaccctgcaacagcctctggctcatccctgagccacttatgcataggacaaagtcaaaggagctcagtataggataaaatgcctcaactctaagattctatccaagagatagcatttccagattaaacccagctgacttatttgttgctgaaacaagcaaacaaatgagaatctcaacactatctagtggactacaacagaattcaaatagcacatagcgtagcattcacaaagcataggatacaatttaaaattaccagacttggaagaaacagagaaatgtgtcactttctcaagagaaaggcagcagataataactctgaaataactgagatgttggatgtatcacactaagattttttttacgcatgaattttcattatgtttaatgtaaagaaagaatgtttgctataaatgaaaagttaaaagaatatccataggagattggaacaaataaacacaaatgaaaagaaaattctggaatagtggaaatatatctgaaataaaaaatgcattgatggatagcacagcgaggattgtaatagcttgctatggctgtcgtagtaaagtgtcacgatgttggtggcttacacaacagaaattttttttcttacagttctgaagcccagaaatccacgattaagggttgtcaggtatagttccttctgaagggtatgaggaagaatttgtttcatgcctcttccttagtgtcttagtcagcttgggctacattaacaaattaccatagactgggtggcttaaacaacacatgtatttctcacagtctggaagctgggaagtccaagatcaatgtgctggcatattgtatcctcacataatagtgagcagagagatgaagcaaactctctcaggcctttccttctaagagcactaatcctattcctagggcctcaccctcatgatctaattacctcccaaagtccctacctctaaatgctgtcacatggaggatagtctttaacatatgaattttagggggataaaaacatttggttcatagcaccttgcttctgggagttgctggcaatgcttgacattccttagcttgagaaaacattttcccaatctctgcttaattccatatgccattcttctcctgtgtgtctgtgtccaaaatctccctttatataagaacactaatcatattggagtaaagtccaagagaatgacctcattttacattaactaattacctctgcagtgaccctattcccaaataaggttcttagatgctagggtttagtacatataaatttcaggggaaacaattcaaaaagaacaaattaattaaaaaagaattaatttatctttatgttactcaataacaaaaagaaattaatgaaaattttctggaaaaatagacaaaatgatttaaaaaaagaatacacaaaagaacatcccctcatgaaatctttggggagtattcaaagatctaacaagaatgtaacaagaatccacaggagagaagagaaaaagcaaatgtggctttaaacaaaggatttgaagaaatcgtgactgataatttcacaaaaatggtgtggggcaagaatttacggttttatgaataagagtgcaccacaagaaaaataaagtcaaattaaggtaggcaagatgataaaaaacaaagatgtaaaattttgaaagtagccagattaaaagagcacattactgaagaacaagaaattgaataactgatgacttctaatcataaacagtaatgccattgaccaatatttttaacatgtgaaaagaaaaaaattaccaatagagaattctatatccaataaaaacacctttcaataataaaagtggaatgaaaatatatatcctcatatgtaatcatattataaaacataagaaaattctaatatacttccagaatgtgctataatattgtcatatttcatataggtagcaggaattacattactatgaacactaaagatccaaataaaataattaacaaactgttctttacaattgcacattaaacacttataaaaattgagattgagaaccatgttgaatacaaattgcaaaggatgatcataattcaatgttccccagccacattgaattaagctgtacattaataacacaggtttaactaaaagcatcattacatagacattataatatatttataaataatctatatgtcttaaaagaatgcaaaagagaaagaaaatatttcaaaatgaataaaaacataccacattttattgtgtttcactttactatgcttcacagatattacattttttacaaattcaaagtttgtggcaatcctgcatcaagcaagtctatcagtgccatttttttttcaacagcctgtgaaggtagctacactaaaaagcagattttcaatgtagacacaacagccttctattgggagaagataccatctagaaatttcatagcttgagagaagaaatgaatgcctggcttcaaaggacaggctaattctcttgttaggggctaatgcagctggtgactttaagttgaagtcaaatctcatttatcgttctgaaaattctaggacccttaacaagtatgctagttatctgcctgtgatttataaatggaacaacaaagtctgaatgagaggacatctgtacagcaatgcttactgaatattttaaaccgtgttgagacctactgttcagagaaaaaaagatttcttcactatattacttctcattgaaaatgcaactggtcatccaagagctctgatggagatttacgaagagaataatgtgttttcatgtctgttaacacaacatccattccgcagcccatgggtcaaggtgtcatttcaactttcaagtctcattatttaagatacacattttgtaaggctataggtgccatatatagtgattcttctgatggatctgtgcaaaggaaatggaaaatcttctgtaaaagattcaacattctagatgccattaagaacattcatgattcatgggaggtcaaatttcaacattaacaggagcttgcgaaaaattcactctaaccctcatgaatgattttgaggggtttaagactttagtggagaaagtaagttacagatgtggtgaaaatagcaagagaactagaattaaaaggggaacctaaggatgttactgaattgcttcagtctcatgataaaaattgtatggatgatgagttgtttctcatggatgagaaaagaaagagattttctgaggtaaagtccactcctgctgaagacgctttgtatgtttttgaaatgacaacagatgaattggaatattacataaacttgtttgataaaccagcaggatttgagagtattgactccaattttaaatgaggttctactgtgggtaaaatgctatcaaaccgcaatatatgctacacagaaacttttcatgaaaagagtcaatcaatgtggcaaattttattggcatcttattttaagaaatcgacacagcagaccgggcgtggtagctcacgcctgtaatcacagaactttgggaggccgaggctggaggatcacctgaggtcagggatttgagaccagcctggccaacgtggtgaaattccctctctactaaaaattcaaaaaagtagccgggcatggtggcgtgtgcctgtagtctcacctactgaggaggctgaggcacaagaatcccttgaacccaggaggtaacagttaaagtgagccaagattgtgacactgcactccagcgtgggtgacagagtgaaactccatctcaaaaaagaaaaaaataaatcgacacagctaccccaaccttcagcaatcaccaccccgattagtcagcagccatcaacattagacaagatcctctaccagcaaaaagattatgacttgctgaaggctcagatcattagcatttttagcaacaatgtatttttcaattaaggtacatacaggtttttaaatataatgctatcgtatgctaagtagactacagtatagtgtaaacttacctttcatatgaatggagaaataaaagttgtgtgactggctttatttcagtatttgctttgttgtggtagtctggactaaacctgcaatatctccgaggtttgcctgtaatagtgaaagtacaaccatatattaaaatttgtaggatatattaaaatctgttaagttatgcttgtagagaaattcataggcataatacatagaatctcatatgtatatataacacatttattttggacaaataggtaagaaaaaaataaaaatacaaatccaataatcttacattagtaaaatggaataataaaatcaaattcaaactatggtgctagaaaaagtaattactataaaaggaatactattaataaaaaataccaatttttggcttacttatttatcatcatttccttacccttttcattttcccctacccatgctcatcttccctttcacctctgttacctgccagaacagagatgttcaaggaggcagagcagtgagtaggtgagggtgccatgtacaggcattggcttgcctgggtgcctaggacataaagtggggacgggagacaacacggttatctcagacaaaggagatatctgagtaattgaagactccattgcagtgagcaaacaaattacgtgatttaagatgattatctatcaatcaagcaatcctctctctttctctctctattcacctatctacttatctatcatctatctattttcccacagtcctttcagagaaagcgtttacacatgaaaagtccaaagactggaaagtactctcagatgttctgttagaactgcagtaggtattatctttacaaatgtatcagtaataactgttaggtatttaaataattgtatataaataaagatgcagaaatatttatgcatataaaatacatacatataaaatacataatagttatacatcttcgtctctgtgtattttcatttctatgtgattatgcatacctccatacccctaggtctgtccacagggaaagccaggcagattgacgcctttaagcaataggtgcaacagagggtccatagcttgctctccaaattccaaattccttgggtccaaattatttgggtcaagggacccaaggcttcttgaaggaataggtgaatccaagactgaggcacatgaatcctagacatcaggtacataataagtggaaaacattacgttggaaagaaagcaaatgctctaaaaatgatgtaaataggtttttgaaaacgatacgaacaaacaaaaactcagaaaatagtttgacagggctctcactgcccaaatctagtacaaactgagcataaacaaaatgaatgaatataattaacaaaaagggagaggccgggcatggtggctcacacctgtaatcccagcactttggcagaccgaggtgggtggatcacaaagtcaggggttcgagatcagcctggccaacgtggcgaaaccgcgtctctacaaaaatacaaaaattgggtgcagtggcaggcacctataatcccagctactcaggaggctgaggcaggataattacttgaaccctggaggcagaggttgcagtgagccgaggtggcgcaattgcattccagcctgtgagaaagagtgaaactccatttcaaaaaaaaaaaaaaaaaaaaaaagggagaaattgcagaaaaaacttaatgaaattcaacaatgattcattaaaaaatcttctagcaagttagtaatttaaggaattcctttaatctgacagaatattaaaaatctgaagtttatatcaatctcaattacaaataacattgaatgttgtttaattatattttattataatcagagatcctcagtgtaccacagtagtatgaaaaaaaggctaatatagtaaaatcaaattatttttactgcatataacatcagaataaacggagtacagaaaggcgacatattcttgatacatatatctgagaaaggactcttatcctgaacatgcaagagtacctgcaactaaagaaaaaagagataacccgatgaaaaaattagaaaaattcatgaacagagatgttacaaaggagctacaccaaggaccaataacatgagaaaagtttcataaagttattgattggcagagaaatgcgatttaaaaccaaattatggcaccctgtggctaaaattattttttaattgagtatttgtgaaaatgtggagtaacaggaagtcttcaatacacattcagctgtcggaatgcagattgacaaaatcgatttttgcagtatttcctgaagttgtgcatatgcgttcattaccacacaggaattccactctgaattacaggttcttatatttccaccaaagatagttgttgttgttgttgttgttgttgttttgttttttgtttttgctttctttttttttttttttttttgagacggagtctcgctctgtagcctaggctggagtgcagtggcaccatctcagctcactgcaacctctgcctcccgggttcaagcaattctcctgcctcagcctcccaactagctgggactacaggcgcatgctgccatgtccagctaattttttgtattttagtatagacagggtttcactgtgttgctcaggctggtcttgaattcctgagctaaggcaatccacccattttggcctcccagtgctagaattacaggtgtgaaccaccacacccagcccagggatagtttttaacacatacttatataatgatatttacaagtccatatatatttttatgtgtatgagtgtgtgtgtatgggtgtgtgtgtgcatgtgtatgggtgtgtgtgtacacaaataagacaatttaaaatcagtcctctattatttctgatcttttgctgtcatatataatgctccaatcagtggtcttttattaaaatactatacctgtccttaaatgaaaaggttagagagatgcttctcaacttacaatggaactgcacctggataaacccattgtaaattaaagttaagtcaaaaatgcatttaatacacctaatctactaaacattacagcctagtttagcctatgttaaatgtgctcagaacacttacattagcctatggtatgggcaaaattatctggcaacactccactgtctggaagctggggcctactgaatgcgtatgactttcacaccattgcaaagctgaaaaactataattgagaactgactgtgtgtgtatacatatatgtacgtataatttttagattttgataaaaatacatttaaattttagtcttctgaaggatgaatagaatctgcttggattttattgtattaccagttttttaaaggagtttttttgttttttgtttttttgtttgtttgtttttagtgtgagtatagaaaaatattatactgtgatctcacagcaaactataatttcctgaagggtgaagatggtgctaggtcaaaaaatagacaaaacaggaaataaaatgtggtttaggtaaaccatattatacagtgaaataaaaccatatcacctggcttttaatcacactgtccccagtttacttgtgtgagtttctatttattcttggcctaattccccttttctctaaaattaaaggatggactcgtgaactgtgaaatgttccaataatagttcatccagaatggtttctattttctacctatcatcgcaacatgtagacaacactgaagaaaatctgctttgatagaaggcaatatgggccaaccacaaaacttgcagtgtttgctcccattgcatccccagtgtctgcagacccagctctttctagatgatctctggtaaacagctagagtttccaaggatgcagtttgaaaagccctgctctagaaagtatatcacgaatgttttgagatctaagaggctatgttattcttcccatagcaaaacaatttttaagatattctctaatagtttgtccttccacttctcaagataattatttgtgaccaccacaactaaagactgagtacataaatgcttgttttgaagcttatacccaacttagtttgctacatctgactttgagtggtttgagagttcaagaaggccttgggttcaattgcaatgacattttactatcaaatattcaaatgatggtgtttgcactaaaattttgtagtttcagctacaatcccatgcagtagtcagttttgcacgtttaattgaataccttgtatgagtcatttagatgcaacttcttgcaaataagctttgattttgagtaagagaagactaaaatatatgtaaagcaccatggtaatgcatggcagagagaaatcaagtggagacagctctgtgattgcacaccaatgttttgatttgtaggaaaataaatcaaaatataagaaagcatagtgtattaaattttctacctaccaccatatttcattattatacattgttttaatgtatcaaaatatcacatgtacctcctaaatacacacaactattatgtaccaataaaaataattgaacaaacaaacaaaaaagatatagtgtactataaatacttgtcattttattaaaaaccttttctggtcgcctaggatgctatttgaagtgctcttcactcggctataatacgaagaaagtgcacattgatttacattcttcctggctatgctctatgggtaataatttagatagttattatgttcttatattcatagagttttatgatttataattagtgcatttattatactctcttacttcatggaaggcagttagattcattagatcaaataaagttatccttgtgaatctaagggaagactaacttttccctacagatcaaaactgtatttgtaagttttaatccaaattgcatgtgattatggtacacattttacaattttaaattcactttatatggttaaaatatacatatggtaaaaattgaaatgttagtaaagaaaaatatatagagacaatagtgaaaacatttcctattcccctaaatatttatttacattattcatagttgatgaaatactgttacaacatttacccttaccatataaaatcttgagtcacattgaatagattataactcagatgaaatagaaatagtattttattatagtattctgttactaatagtattctattagtataactaatgattatactaacctagaagcaacaataaaattgaatggatcctatactaatttccagataattatatcaagtaaaatttataaataagacaaagagtatttaaaattcacaaaataacaaatgcaaggtatcaaggacacagttccaaataatcaggaattaaaattaatatttttaaatgaaattacttgatcaactttattttgaataaacaagagaaaactttttttgtactggtgaaattccttttctgtatcccaggccaatttctgtatttccttttttcctgagaagaaccactgttttgaattcacaatgtgccatcagagctattttatattttcacaagtgtagccaagattttggggaaaaagcaagctactattctgagcagttttctggttaagcattaatacattggcaatattaggttaaaataaaatattaaaattttatatttttattgcttgaatgtatgcatgcacacatgtatgtatataatgtatacacacatatgtacatatatgtatagcatatgttatgcattatgttgatcagtgtgcatagattttatgtctttatacatacatataatcacttaggtgcatggcacatagacatatacagagctcaatttattttagctagtattattttgtcacacatgtttaaatagtgtagcttttaaataaacatggcagatgttgatctgaaacttgatttattttctccctctcgctatttctctctctctctctctctctctctttgtttgtctctctctttctttgttaatcatgccattatgtctttcccattcatggaactttcacttttttataaagtttagaatcagtttaccttgttccatgaaaaggatcttttgtttaaatgtgattgcattgcatttatagattattttgttcaatatctgtgtgtatggtggaactttttttaacgtgttagtaacatttagctatttttctgtaaatagcttacatatcttcagagaaaaatattatgaaataccttcagtacaaatgttttataatatttgccattcctattaatatatgaaacttgaaccctcagattgtgaattgtacacatataacataaactgttaggataattactccagtaaaatattttttcccaaaaaagacctctctttgcatagtgatctgtctcattattacagaactgacactgtctttacagattctttccacactagaataaaatggtacctttcctagttttctgttatttcagaaaatgaggaaatgaatcctggatgaaaacggccttcacattttgctcaattcttcctctgcagaggtgacacttgatagttcactttctgacttgactcacaactaacagtctgtattatagcactgacacctacaaatttacaatggcctttcttacatgttttgaaaataagagcagaataatgctagtaaaaatatgtaggaaaatctaagttccaggttgttccataccaaacactttaatgcatatttaaagtatcaaatatccaattatttctacaagttaagatttgttttggtgtcttggcttcaggcatgccctaagcaggtgcttgggtttgctatcagtggattcatcagtactggcaaagctaggcaagtgtgacattatgtgactaatatgaggctgatagatcccctgtcacaaggagatgttcacaaaggattggtcttgaactggatggctcatcagatgttgattaagattatgaatgttctgttacattctgaagagtctaatgagagtcatcgaatgcagttgcattcatttagagtagttgagcagatgaatatcatctaattattatatatctttctgatcacatggcttgctggggttgaaaaagagaaagacgtggcttgaggatttctttgatatgttttattattatttttctgcaagcaattttaatatatttaattcacatatgtattatatgtacattattgcataaaatattttgtatggcccacacaattgttgattgaccactgacattttggctatttcagaaaaattactactgaaactgtgattccaactcagtgtaattgttaaagtagaaaagattttttcttgaccatgttcttcttcagttactaataaactaggtatgacttgcccttggcaagatttgctctgtctgattggacatagtcgctatacgtgatttttaatttcttttatgaaggacatggcagggattctgaaagattaatgttgtcaaattgaagtctgaatgcccccaggaaaatatgccaagcaaaacatatgcatggcaagtttcctgaaatcactggtttttaaaaatgtatattttagttataatccaaacagatatgatacagtgaaaactttaattagtattaatgtaaacaccagacagcaaaaaaaaaaaaaaaaaaaaaaaatcacacataagactgttctctgcaacttacacttcagagtaagtaaggatatctgcacagcttcttcacagagaagcagtgaacatgcttctctggaaacatttgaggaacactttttttttttttttttttttggagacggagtcttgctctgtcgcccaggctggagtgcagcggtgcgatctcggctcactgcaagctccgcctcccgggttcacgccattctcctgcctcagcctaccgagtagctgggactacaggcgcccgccaccacgcctggctaattttttttgtatttttagtagagagggggttttaccgtgttagccagtctggtgtcgatctcctgacctcgtgatctgcctgccttggcctcccaaagtgctgggattacaggcatgaggaacacttttctaaaatgcaaaaatacgtacagtaaaagtatcagttctactctttaagatgttatttacaaagggtaaaattcataaatcttaaggggacaacttaataaatgtttacacccaagtaatcacccaaaacaagctgtagaacataaatgtgtacttcgtctcattatctcaacaaaatatttagagatatatccatgctgttgcatattttatttgatatgtctactaaataatcaggaggatttttattgcttacacaatatcccattgtatgaagatgccacatttcttttccattgtctttttcctaggtaggaggttgtttgtaacttttagttggcatgaataaatctattgtggacatttttgtgaacatattcactaatttttcttaagaatatacctaaaagtgggatttcagtgtgataaggtaactttaaatgtagcacttaattcaaagattaaaaatggttttctgaaatgttttaaaaattttacacttacacaagctatttgtgagattaatattttcctcgatttctctgcgtgttgccattctatttcttaataaaatccttgcaattaatataagatgaaaggtactcattttaataaatagttttattaaattatgacaaaactagacaattgtgtaactacaaacacgatcaagagaatactaacactacccattctagctttatggtaaactatcagttactacaagtataacaactttgtatttttctattttgtagtaatggttgttgcattttgtcacaagtgttgaaataattggttgttttccttttttagtctgttgatatagtaaattacaaccctgctaaaattaactacatttttataagaaaataagaattgactcattttatgtaataaaaatgaaggactataattctaaatagtaataaagtgaagatagcaaaatatttcagagtgaattaaagtatgctgaattatttgtcttgttattgaagacactatggtgactacagacatttagatattaatataagtcaaggttaaataaatttaataaaagcagaatattcaaaaagtaaattaaaaatataccttcaaattacataagaatgaatgataaacaagataatttaacaatttaacacaaaaattacaattttacaagataatttaacaatttaacagaaaaattaaaatttgataaagtttaaaattaaaattttaagagcattaagattttaaggaaattttgaagtaatttcagttatttattttgtgccttttatgtttattcaaaccttggagcattttatttccactgaaagtatcagatttttataaaactgtcagagtgaaattattgattttctgagataagaaatagtgtcacaaaatttgagcttattttagttacccttttatcttttgaaaagacattattatttttatgtacatgtatatctaattcattgcacaaatccttacctcttaaataatacaattaatgatggctttttctataagtgttagcaatctttctatgtccttagtgacaatatttaaatatatttcattcgtattaattttcatattttactagttttgaatttcatttgtttcacatgcacatatttttatataaagtgcaaaatgcagataatttgcaaatattcaactaatatgattatatatattataaaaaacaaagcagcataaaaggcatgattgatgaccacaatgacataacaaaagttgtatgacttggatgtcatgagagaccccaacatagctcttaactgatttactctacctctttaacagtttatcagtagcataaggagttagaaatctaaagaaaatgaatgaacattaaaactgaaggatagaaaatagaaaaaaattttatttgaatctttgaataattattgaagagtaaaaatatgatctagacagtattttatgtaattaacatgacagtgattatatctaaattctcacatcacttttagctaatatattagagaatttagagacttgaataaatgtactttctttttaatatctaaacagttttgaaagatcttcccaaaagttctctttttacttaacaaatagttaaaatgtattttaaatgctttgagtcaatattttctttttaaatattatattaaaattaatgtacaataaattctaccaagtgtaaaatgtgatgagtttgacatacacatatgtccctgtatatgtatatgcccatatatgtatatatccatgaaaccatcaccacaattgaattaataaaatagaaagtatcctgttgaccctctgtaatctatcccttccttatatccctaccattctcagacaaacaggaatttgctctctgtcgctatagatgacgataatttcctgtttttagctattataaacaaagctgctatcaacattagtgtttaagtctgtgagaactcattttgatatctcataggtaaacacttaggtgataaacttgataaaggtaaatacttaggctgaactgtatgacaagtatatgattgactttttaagtaattgacaaggtgcttttcatgataattgtatcattttacattttcaccagcagtgtttgagtgtccattttttaatcatattcactaataactgttataattactctttttaaatttttagccattctaatggtatataaaagtacctaaaggtgcttttcattttcattttttcctaaagatttgttgatttgagcctctttccatgtgcttgttttccatacatacagttgttgaagtgtctattcatattctttgcgcattttttgttgagttgattatttctaattagtaaataataaaactctaaaactctttataaaacaatattttggaggatccatattttacaatttttttctccgtctgtaatttgctcttttattttttaaatgatgtcttcttataaagagcaaaattgttgactttaatgtggatgaactttaatttctttttttatttagtaattaatgagttttggattctatttaagatattgttgacaaattcaaggttgtctgcaggctgaggagcaaggaagcccgtagtgactcagtccagagtcccaaaacctcaaaagtagggaagctaacagggcagccttcagtttgtggccaaaggcccaaaagcccctgacaaaccactggtctaagtccaagagtccaaaggccgaagaacctagagtctgatgtctaagggcaggaagtatccagcatgggagaaagatgaaagcaagaaacctcagcaagccagcttatcccaccttcttcccctgctttgttccagccgcactggtagccaactggatgctgtctacccacaatggtggcgggtcttcctctcccagtccactgactcaaatgttaatttcctctggcaacaccctcacagacacacccagaaacaatactttaccagttacctaggcatccttcaatcccattaagttgacacctactcctaaccatcacatcacatcaatgatttttaaggatcacatattttaaataaaactctgctcataggctcaaatgcaaacttatttcggtcaaaatattgattcatcttttaatatcatattaattagttatctttttcacataaagtaattgcttaataaatgttgaataaatgaatgcaagaaatatatatgaattaatgaaatatgttgataataacaataccattgcttttaatgaagaggaaaaaagggataaaattatgataggagtaagaggcaagaaaaaatgagcatgattttgaaacaaagtggggaaaataagggaagataaatatataaatttagatataatagttcacagagctctttaaggagatgcccaaatagacatctgcctccatccagtcacaggtgccaacttgcatttgaaatgtattacaaatttgtatcattacaaatccaattgatagcactgagaatataatccaaaattatttgaaaatagtttttcaaaaaaatgtattcctacaagaggagaaccaaaatcatatacaactttatctgacatttccatattagaaacaaatccggaaagtttctgtcaaaaagctttacatttgaataagaaaagatttttaaaattatctcgatgaaaccaattaatgatggcaaattttataagcctattgctataattaaggaatatgtttgctgtgcaagctgctagtctctgagtagttgaagttgacctagatctttgtgatactcaaaactggcgcaattcttgtgtgaagtgctaaattcaacattgctggtagaatataatagcttagtcatctgtcacaaattcactcatatgtggctattattagaaaccactgattcgcctaggtgtaagtcaagaggtaatttgatacatgataggctgtgatgggatgtgagagaatcaattttcattttggagcaaatggaataaatctgcacctgcaggtgacatggaggtcacaacctcatcctaggaacgcatagtaagccacagatgttcatagctttacaatttctagatttgattactgtaattcactgagtctacaaactggaactactcagtgacttctgcttgtatgggatgaagtggatcaataatttaaaattggctattgatggtaacacttcaaatatgatttcatacacattgtctctacttcagtgacacttcaccatcatttctaaaggccaagtacaggaacctgtaataatatggttgaaatactctgtgaaccttcaaataaaatagaacaaggcagcaaagctttcctttaatcacatactttactgcatatcagatagtgatacaggcatatagaagcaggcacaaatgtttagctcatttcataattagaatgactctgttattttgcccttattgcttccatgttaagattaggattttaaaactgaataataacaataatagtaagaaaatgccattgcaaagttggagatgattgactttaaaatcaaactcaagaatcttgtcaagagtatgggtacatgcaatttttattattctggctatagtttcagttctttgaaatcatagggttttaaaaatgttccttttcctattacagttaatatatcaatgtaaacttttatttatctcctttatgccattttatattacagaatgtgttatgtaatatttagcacaataaatatattttaagtaaacagaaaaaacatttatatgtgaattagaactggaaaatatttgttcttcaaagacaagtaaaattttggatagaagccgcattcaaatggtaattcttttcctgaaaaccatgagtcaactatcattgctaccattataattaaaacactttacttctttttctatgagagaaataatttgaaaatactagagaaagtaattactgggtatatatccaaaagaaaataaatcgttctaccaaaagacatatgcactcatatgttaattgcagcactattcataatagcaaagagatggaatcaacctaggtgctcatcagtcgtggattagataaagctaatgtatcacatatacatcatggaatactacacagtcataagaagtggaatcaggccctctgcagcaacatggacgcaagtggagatcattatcctaagtgaattaacacaggaacagaaagaaatgcctcatgttcccacttacaaatgggagctaaatgttgagtacacattgatataaagatggcaacagcaggcactggagactaaagaagaacagacgagggaggcaagggttgaagaacaatggttggacacaaaactcactacatgttgatgggatcattcgcactccaaacctcaatgtcactcaatacagccatgaaacaaacctgcacaggtacccccctgaactaaaataaaagttgaaatcataataaataaataaataaagtttctctgttatgtttaaaatacataaaaggcatggaaaagaatatggaagaaaagaaaacagaagtagttctcattgtcttagatatctgtcatcttttttgtattgttccatagatcatcttcaaaataatagagattatttggtgattacttaggcaggcctataatgagagtttttgggggatagggagtaagtcagaatggacaagatatgggttggacaaagaaggctagacatagacatgcttccaggagttagatatttcttttccaaatggagatagagaatttgaccattaatatttgaattcacccatatctatgggcaagcaaaaagaagtgaacttgtagacatttattgtcaggctgaataacttcagggttgttctacgtgatgggtcacttttgcagagggtgccaggccatggtcaggtttatggaaaaaagggtcaactcctgggaggtggaggaggcatgtgctagacagattgttcagtgctatagggacaggttgtcataagcaaaaacagaaacaagattataatgactggatcaatatagtggtcattaataaaatctttcagcttgatggaaaagcaaatgcacagcctagaaactaattctgggaattttctgacttgtaggtgtgaggctaagaatcatcttcataccttaattacaattggatcagttatctggggggataaatcagttatctgtaggataaattactttatagcctaatatttaggggacttaagagaagactgggacaaaaaacttttagtattaatttttaatagggaattctaatgaaattacactccatcatattatgggtgtctaaatttgcctttgaaatctatctagagatgaaaataaggagaaaaaagagggaaagattaaacagtgttatttatggcaaatgcttgacaggcaggagattaatctaggacatttgaatggcccttttatcttatcaacaaaaacatgaggtgaggtcaacaattcctttcttgctctggtaagactgagactcagtaaatttaagtaacctgactacatcacatttacagggatgttgtattcactatatgaaccaaggtttgcctgacaagctctgtctgaggagaaaattcaggagctttcagacacattaacacttctgatgtgccgtttctcaatgtatgcttttttccaacactactgatccatgctagattgacttttaaaaatgcgtgtgagctggatttatcacatggaagtgctttccaattttctgcaaaacatgagcagtagaattaagtagtggcaaaaaaactttttgagagctaaggggactgagcagtgttaataaataaatggggcttttctcttcttttgtggctagagaaacaactttcagatacaacattgaattatatcctccaaactacagaaagagataatgtatgttgtatatcaactaatttttaatagctaagatggatttaatatgtcagtatcatagacatatatgtataaattataactatttttaatattatttactgagattctattagaaaagcatatgatggctaatttggacatttagaaaagttttataaataggccgggcgccgtggctcacgcctgtaatcccagcactttgggaggccaaggtgggtggatcacaagatcaggagatggagaccatcctggtgaacacggtgaaaccctgtctctactaaaaatacaaaaaattagccgggcgtggtggtggacgcctgtagtcccagctacttgggaagctgaggcaggaggatggcgtgaaaccgggaggcggagcttgcagtgagccgagatcgcgccactgcactccagtctgggcgacagagtgaaactccatctcaaaaaaaaaaaaaaaagttttataagtaaataataaaaatagcataatgttgctacctaaaccagtagtcagcaggctatagtctgctaggcaaacccagctgtagcctgtttgtataaataaattttattggaacacagacatgcccatttgtttatgttctgtgtatacctattttcacgctactgtggtagaattgggtgcagactacaccagctggcctgcaaaacctaaaatactggttggctcgccctttatagaaagagtgcctgttcctaacccagaggataatactttttacaattgactctattattttgctgtttccctgtgcattgtatatgattccaattaacaggcagataattattgaagatagctataaaatgagaaaatctataatctttgtccaacattctagttatttttaacatatttgtgagaagatgtagataataggagaattttctatttaacctgtagttccattcatttatctaacacataatgtttgcataaatggtaccaaggtctgtgctaggtgctgggactactgtaactcagttttggaagtttttaatttgacatacttattagacatccaagtggagttatacagtgtgcaattaggtaaacgagttttgaatttaaatcggaggttctggaagaagagtatttttattatattacctcctattccctccattggtgagagagggattcccacgctattgttacatggatggccaaggagcaacagtcaacatggggaagatgagctagacatcagtgtattagtcacctaaattcagcttaggggaggagacccaagtagaaaggagatctactttgggccaattacagggaagcccaggaattattcccataaaattaatgataacttatgctatctttatcttcctggatatgaataagaaatatataatcgctctatttttaacagtcaagtagttaacaaatctacacatagagtacctgtgaccaagaagacacatagggaaacaaaattgaaactgatcatgttgagaacctcgatgtattcctaaagttttgcttgagacacagcatttcaatgtagacagtgatagggttcctttattggttaagcccatttttaattctattttgtgttactcacagatacaagagttatggaaaagctgcactcttctacttccaaagtttaacttcttcacagaagtcagtttcagagttgagaaaagcaaatacttgctacatattttgaggaacaataagtattgaagttgcaaacaggttctatggatatttgtcaacagaagatagctgatcacaaatgcgcagagaggtagaaaaatgacacaatgaccaccctaccctctgagtcagcaaattgttttctcagtacatttctactctggtccttgtttaataaaacctctttctccttacagctgcgtgcagtaatatttattatttaaagttcttgtcttcaccttaacaatcttagtttctgctttaaaataatctcttaaatattcatagggattgcacatgtttttcagctgccaataattattatttactatacactgtatagatctaaattttatgcagattattcagacaatttttaaaataatagattctgtccttcttgtgacagaaaagtaatttcttaccaatgataataaaagattttttgtgtatttgctacagttaagtttttttagatattcctgctttaagaactctaaattatttggaatttgcttttataaataatgtgaagttgagatatggcatattttttcttctaagttcataacttagagttctaacttctttttctggctgatttgaaaatggtgcatttttaatatggtaaaaacctccatatgcctgtgtatttcttccatattttatattattatatttatctgttcattctcccttatgagaaaaaatgtcacctttaactactatgggtttttagcacatataggatacaatataattaagcacatttaaaaatattttttaaattctcacttattttttctcatgaaatttaaaattgatttgccaattttctttcaatttccttaagtgtatacataattttggcctgtctcctatggtttgtatcactacttatcctattttaaaattgtaaaacttttgtggttttcttaatatggactttcctaatttcttacgaagtttatttctacataatttaaagttttataacttttgtgactgggatttgtttttcattgcatttcctaaatagtaatttctgttacatagtcaagctattgatttttgtttctctatgtaaagagtgccttactaatatccagatattctaatgactttcctagggttttcaaagcagataaaccttatataatataatgcttttgttccaatatgtataactcaagccaaagcttgaaaaaatgatttttaaaagcagctatgaatgtgactatttacatctaactatatttctgcatatgtcttaaatattgatatttattttgactttcatacttctaaacatattcaataaatatcattttgattcatttatctgagctttttttagttttatcctctacatcacatttggcaaaaataatgtgattttttttttcattttaagaatttacatgataaaatattaaaatgctttctagtagtgaaacctcctgagtgttactgacatctaccaatcccattcctgccttatcgcttcttttgggcagtcatgttctcgacttgttaatattttcttaacattttttaatcaaaatgcatcgataaattttacacactatttgtcctttttctttccattttatctagtggcaacagaattctgtacaatgcaaactgtggaacatatttgctaatactaagggctttgtatttatacagtgctgtattttaatcccagctatgtcattttctagcttgatcgtattaggtaatgtgttttaatctacatttttctgtttcttcatgttataaatagggaacccaatagtgtttggtgatgattaaatgaggtaagagaaaaggcaagccaaccagctatcccaaaggctggaacctcaacattagtcaataaatatcagtcatgaaataatggtacaaatcttgtctcttaatttgtcatttcttatgtttagatggtattttctaagttgataggttgttaataatgaaaatactcatactttttcttggacattttgaggggtcctcttttccaagtgtagaccaaacaagaaagctacaatatttcaggtacccatcagcttgttagaaagaaataatcacaattggtataattgctttctctattggaaagtttattttccctgatctatagcatctgtcgattagcttgagtagtgcctctattcattacttgtcatgatgttatttgccgtatcaagcaacatgagacatttaactctcccaacccgatttggctaccatggctagccctactttttattattatttattatatacatttaaggtatacaacatgatgttttaatatatgtgcatatatttcgtgaaatgattactacagtcaaagaaattaacattccgttatctcacatagttaccattttgtgtgtgtgtgtgtgataaaaataccgaaaatatattattttattgaatttccggtatataatctaatattgcatagtattataatattattatataacaggcatatgcccactctggagcctagacatgcttcctagagatgcttcaaggaacacagtaatccccaattctgaagcaatctttgcattctgagaaactgattttgctggcaaatcttccattgacttcctttatattcagaaagtcatgcattaggttgagctgccttcaattttacagatatataataactgtacatgtttgtgaagtacatgtgatttttaatacatgcaatgtgtaatgattaaattggggtaattaaagtatccatcacctcaaacatttatcagttctttgtgttgggcacatttcaaatattctattttgaaatatgcaataaattgttaactgtagtcatcccgctgtcccatcaaacacaagaagatattccttctatctaactgtatttttgtaccccttaaccagcctcttttcattgctccccagttctgggttctgttaacccaccattctactctctacttccacgaaatcaatttttttagttcttgcatatgaataagaacatgtgatatttgtctttctgtgcctggtttatttcacttaacataatgacctccagttccatccatgtctctgcaaattacaggatttcattcttttttataacatgccttccttttttattccatttgcagtatttatgagattttttctttaatgactgtccccatttcctttttaaaaatactgttgtaagttactttgtcttatatattctatctgtgatttcaacagattggtggataattaatacatgttccatccttatcttactgagagtcatctttatctttgagccaacaaatactccttcctcttttattattacaattattaggtcatgatgtgattcctcagagtcagcaataaagaaaactaagtaacacctgagattacagcatctgctgtacccaatttaatttctccttcataacaatttagggagaagtctatcatattttagaatagttagagaacagctgctgaaaaaaaatctgcctgtcaaagttatatcctgatgttaaattagcctgttacctgattgttgtcttctggtcctgaaaaaccataaagactatgccagcaactcacttagaagcagcacacatgtacatattacagcccatcatcataattagtggaggaaaagataacacaaagtgaatgctatataaatatatctaaaggcatttatggaatggtgggtaacaatataaactagtaaaatatatttataatataaatatttctaaatatataaggcacaagttcagccatagaatcataacattgtagtagtatgcagagaagacatgcaaaaaagaaagctgattgacgttttgatatgtgtgtatgtgtataaacaggtaaatataccatatatatgtatatttaagaattttcaggaaatatgtggttattggtacccacacaggtaggtagcctcagctacctaccaaacatttaatattaatgttaaagaagttatagaatacatatatatgtgttttacatatgtgtttgtaataaaatgtctataacgtgttttaccataattcaatgcatatttaaattaattaagagtactaaactgtgctcagatttcatgcagtatcaacagaagttctgccttagaggcctacagactcttacttagttccatggcacgttgagtgtgtgggattcccttagaatgatttccctttaatggaaatgaatattaaatatattggaatgacctatttgcaaatactccttcactgattaaactaaaatattttctttaacatttggcaaatccatcagctttcttttttgttgttacataagttcaacaccaaaatctgttttagagttagttaccccgaatttgatttaatacacatcaggcataaactttcattggttgttcatttatgtgtttattacttattctacctgttgttctcatttttacaaagtagtttatgccattcagggattttctgttttgtactaaagctctaagtagcagcttgttagagagagtgtggagtaaaaccttccttcactccatatccttccagttacctgagcagtttattttggagaccttcttctccaattcaaaaaccctatgaaaattgtgttattttcataacctgtgcaaataactactcttctaattggtgattttcatacataaaaatccattatggatttttatgtatgaaatccattgtgaatttttatgtataaaattcaccaattagaagagtagttatttgcacagattatgtgattggtaaggaatgaattaccgaaaattattaaccaaatttggggacaaattcagaagggaaaaacatcaaaggcaaaaaaattacaagggaaaagtctgatgtttcatggtcatgaatatcacaagagaaaaataatacttcaaggttttgtataagaaccattttccaagggaaagagcacaaagtacttattcctaaaacttgatctcttttttctcccgtacctagaatcatagaacaggagaccttgcctgtatattctaaacttcattccgtacaaattgtgtaacacatttcatcatactgactttttcctgtgttaaaaacctgccaagatgcttctcacttcaggatattttcattcaattcaaaaaccattttcctggtctttcacaaagctggcttctctcatgagccaagattcacagctaggtccatttcccagaaaggccttccccaaacacattatgttaaatgtcttaatatactccatgacagctagtattcattttactttgaaaaattatattcatttatttgcttttcttttttctttttttattatactttaagttttagggtacatgtgcacaacatgcaggttagttacatatgtatacatgtgccatgttggtatttgcttttctttagagttcatctctgatagaatggagacaagcagggaaaacatttctcttattcctgattttggcagatgcctgaaggacatggtactgaatgcatatgtgttgaataaatagatggataaatgcaaaggagaatgatgtcaagacaaagtgtttgtgaggaaaaggtagtagctacaaattttgtcagcaaagtaaattaatccaatgtagataaacttacttttattcaaatataatatgaattcagaatagaacacaaatttctcggctgcccacaattttacagaatgaacacttctatataaccagcatacagtttaacaggtagaatattatgcttctattcatgcctgttttagtcattacactctcccaaagttaatgtctagtattatttagcatatattagattagttttaaaatttataaaagtagaaccatatagcttgcatctttagtctctgctcttttattccatataatctttttgatgatagtgttagtctgtttctcattgctataaaggagtacctgaggctcgctaattataaataaaacaggtttatttggctcacagttttacaggctgtacaaaaagcataatgctggttcctggtcaggacctcaggaagcttttactcatggtagaaggcaaaacgggagcaggcatgccacatggtgagagagatagcaagagagatgtcaggctcttttaaatgaccagctctcatgtggactaacataagaactcactctcccactggaggccaccaagccattcatgagagatccacccccatgactcaaacccctcacactagtcccacctccaacatcgggcgtcacatttcaacatgcagtttagaagggacaaataatccaaaccctattactttcttccatatcgctgtgtattgtagtagtagtttcattgctgttggtgtctggcatctccttgcaagaatttaatataatttattattcattctactgttggaaaacatttgagagttttttccacttgatgtgattactaggtgggacagctatgaaaaattttgtgtatatatatttttgtacatgtatgtaagcatttctcttgagtataactttaggaatatactaacttgtccataatagattcttatgttcaattttttaagtacaagtttccaaaacagatgtactgctttgtagtctaacaagaggtataatgtttctggtgttttgacatcactgccccacttagtgcattcaaaaacagtaaaatttagcaccatatcatatgtgatatagtttggatagttgtccccattcaaatcccatgttgaattgtaatccttaatgctggaggtggggcttggtgggaggtgtttggatcatgggggcagatccctcatgacttggtgctgtcccttcatggcttggtgctgtcccctcatggcttggtgctgtctttgcaatcgtgaagagttttcctgagatctggtcatttaaaagtgtgtagcaccggccgggcgccgtggttcacgcctgtaatcccagcactttgggaggccgaggcgggtggatcacgaggtcaagagatcgagaccgtcctggtcaacatggtgcaaccctgtctgtgctaaaaaaacaaaaattagctgggcgtggtggcatgcacctgtagtcccagctatttgggaggttgaggcaggagaatcccttgaatctgggaggcagaggtttcagtgagccgagattgcaccgctgcactccagcctgggtgacggagcaagacttcatctctaaataaataaataaatacatacatacataaaataaataaattgtatagcacctccccaccccattccctccctctattgctcctgctttcgccatgtggtgtgcctgctcctccgccaccttccatgagtaaacgctccctgagctctccccagaagcagatgccagcatgatgcctcctgtacagcctgcataactgtgagccaaataaacttcgtttcttataaatttataaatgacctagtctcaggtattgcttaatagcaatccaagaatggcctaatatgtttaatcaataggtttattgaatatttcaaaattcttctttgaaaagtgtctattcaagatttttccacattttaaaaatagggctgtctatccttttcttattgatctgtaggagctctttacacattctggataaaaattcttatataattattgcaaacatctacttgtatcttttgatgattagagtcttcttatttattggttcattcatttatactcttatttatttatggattttaatgtgaactacatgcagtcatgagttggatgtaacatttacaggatcctgccctagtttggctaatgacattttgcttaagcaaacttgatgaaatcaactcttcatggactacaaaaagttatttaactataaacattcctagaccatgagatggaatagaaaaatacagtatttagaagagttgactgtctacaaatcctttataatacccttcctaagaatcactattagtattttaaatcttcttaatagtttaacaattgtgattttccaattgtgaacccaaatatgacattgaaacacaatagagtatgaagctatcaaagccacatttaatgtctagttttaccaactgcatcaaaacactttatggctgcatattactgctattactatcattactgccactgatattacagtcatttctgtatggccagctgcactgtgcatacgagctcctcaatggatatacttcatttttaaatcaaggtctacgatcaaaatatctgaatagagaaaataaacaaatagaatgtaaatcctctacatcacttttaaactctaagatagtttacttgtacatgttacaggccagaggagactgttttctccaatgaaattctatgtatggtagtaattaattccaatggaaaaatctactggtaaatggccaaatcattcttaattgaaaatgatgtcaatattaaattatttgtatgaagaccaatgcaccagaagaattactgacccttaaaagttcttagcttaaaagataaatagattccttctgactgaagcaagtttctcaacagtgactaggaagacaggacagggtttccctcatgaaataaaggcatttacaaagactgaggcatatcatcagacctctattagtttactcttttattcagcattttttaaagtttgtaacacactaggaattgttctgagttagactgaagtacaaaatgaagtctcaaaaatagacgtggatgtgagacatgcaaaaggagaaagtgcattcaatttcggcaataacagtaatgtgtgggcaaatccatagtgggtgagtttgtgattgactagatattacctttgcttatcaagcctgcgtttgagaaaacaaaaatatttccagcttttacttgtagaagcaatttttttttttcaggaaaaatacatagctaagtaaggtgcttaaattaaattagttactactgatctgtttggaaagaggcaaacactgactcttccataagcaattatttgttaattttagaattagtgtttagatgaaaagtgttgttgaatgttaaaatgagtacaattagagcatttgtttcagaaatgtcaaaattctgagaatatttaaaacatttaattatgagctgagatggacatacctaacataaggcacacattgctagtatcctttatgtaaaagtgcatacaaatataagccaaatagagaaatactaatattaaagtcattttggaaaataaactaacacctattgattatgaaagctgatttacaagaattgtaagaatcctgaaacataaatgtcaattgcagattcaaagcacactagcaggaaggaggaaacaacccagcttgtctctctggaggggctcaaccttctcaagtacaactgcccaattttccctttcttctgaaataaggtcgcttctggttttgaagtaagaaaacaaaaatgtgcgcagaactttgttctcagaagagggaattttggtttggatcttgctatagtttgaatgtgtcaccaaaagtttgtgtgtttaaaacttaatccccaatgcaacagttctgagaggtgagatgttgtaaaggtgatgaaaattctgttcttatgaatggattgctgccactatctcggaagtgggttcctgataaaagaatgagtctggccatcttcccttctttctctgtctgttatactctcttgcttttctgcatttcatcatgggatgacacagcataaaggtacttaccagaggtggtccatcaatcttggacttcccagcctctagaaccatgatccaaataaatttatgttctttatatattagccagtctcaggtattatcctatagcagcacaaaatgaactaagacagttcttcctacttttatattacaatatgcatgcagagagaaaaatatctgcctagctctctttcatactccagccggatatgctctgttaaaccgtgacttacaagtatacttacccatttagacagactgaatatgtcctgctaaatatatttttgtcaagataaaaactctctagtatcacacacttagcaaatattattagcatttacaaataggtccatcttttgagtttgtcattgcctacagagtcccctaggaaggtgcacactactatatcttccctaatttataaaagaagatggggccgggcgcggcggctcacgcctgtaatcccagcactttggaaggctgaggcgggcagatcacaaggtcaggagatcgagaccatcctggctaacacggtgaaaccccgtctctactaaaaatacaaaaaattagccgggcatggtggtgggcgcctgtagtcccagctactcgggaggctgaggcaggagaatggcatgaaccctggggggcggagcctgcagtgagccgagatcgcgtcaccgcactccagcctgggcgacaagagctagactccgtctcaaaaaaaaaaaaaaaaaaaaagaaggtggtcaaaactttagtcagcatgttggaaaaaaaatcttactcattatgaagtaatagcaaattacaacaatagttttctaataccaactattaaatcaatcatttttgttttgttttttattatgaccccatttcagatatcgtgtaatgctggaaaactattttacaatttggataagcattcttaaaaattctcctaagatttaacctggtgattttactcctagaatgttatcaaagataattatcagtaaatttgtgaataatgacaaaagagtccaacatgatcttaacattaatgtgtcacaaattaaagatggctaagtatatggtgcttttatctaaaactaaatttttctaccatttgaaatgttttggagacttactgacccaagggtatgctcatggcataacttgtagcaagaccctttaaaagtcttatagctttgagtcagtagttcatctaacctgaaagctatctaattaaatatagaaacatcgaaatatactaaaatatctcaaattatgtattcagtagaaataatgtgtcaaacagttgtagaatagtaatataaaattgctaattccatacatgataatagaatacagttattatagttgttatgaaaaattacagtaatattagatgcttataataaggttaacattttaaaagtatacaaaagtacacataagataattaagtaaaatacatttaagataaaattacatgacatctttataaaaattgtattttagagaaaaatggatgattttctagataaatgtaaattaccaaatgtcatctctttgtaacagtaatatcatcataattattattacattgtagaagatatcccaagctttctgtacaacatcttagttaatctacataataggtttgttattataaaataaggtgacattagtgtcaaagaaccttttatcaccatctttggaaagtgaaagaaatgaaatcatacattgcctatgtgtttcttattgttaaaataaaatacaggttcttttacagaagctcataaaagagtgacagtaatacacatactaaatgattatgtaaattctactattaaaataaatcagcttccaaccaatttcaataagcttgtaaattatttgaggtaggattttcctttctttttgtgtcaggtttataaaaattacttaatcagcacaaggaaagatcaatgtatatccttagaaaagttttattttatttgtttcacaaacaggcaatttgtaaaatatgaatccaaaaataaacgtggatttaatgtataaaaggtagtaaaaatatatttaaaataccaactttccatcaaatcttatatattgtcctttaaatacaagaaatgagtaaagacatctatctatctagataagtagatgtataatgtgattctattttagataaatcactctgtacattcaaacaagaacataaatgtttttttacatgtgtcagctcttaaaacctgtttgtgtacaaggcttgaaaaaatacgatcataataaataagaccaaaactttcataacaatattcaaaacactcagattttaatctgaaatcactcatcaccaagaacgagttttctcaaactgaatgagaaaagacagtaagtggatgcccacaataataaagacattagaagtatttggctaagactctatagcagacatcataaatatgctttaatactgaatcacacatttgaaataaatgaaaacataattatactaaataaataaggattctgaaaaaagtaaaacatgaaggataaaaattaaactttgaggactgaataatatcatgacaaacgctaataataaaataacacttagtggaaagtctcaatagcatgaaatactgaacataaaaaataatcagtgaccttggaaatagaactacaggttgtccctgatttacaatgatttgacttacaattttttttactttaccatggcatgaaagtgatacacattcactacaccccttgacttacaatgaggttacgtccaaataaatctactataggttgaaagtattatgttaatttatgttattttcaactaataatgggtttatcagaatgtaattccatcataagtcaaggaacatttgcttagaaattatcccacctgaatagtagagaagaaacacgctaaataaaaatgaatagaaactcagatatatgtgagactatagcaaaataataagtatttgtgtaaatgaagtcctttaagaaaagaaaaaaaaaaggatggttctgaataaagattttttaaaatggctgaaaaatttccaaattttgcaaaagacataaaacaacacattcaacaaattcagattgacacctgtgatggttaatattgcccgtcaacttgattgattgaaagatgcaaagtattgttcctgggtgtgtctgtgagggtgttgccaaaggaggttaacctttgagtcagtggactgggagaggctgactcaccctcaatgtgggtcagcactatctaatcagctaccagcatgacctgaataaagcacgcagaaaaaagtgaaataaaacttgctgagtcttccagccttcatctttctcccatgatggatcctcctgccctcgaacatcagactccaagttcttcaacttttgaactcttggacgtacactaatgatttgccaggggtcctcgggcctttggccacagactgaagcctgcactgtcagcttccctacttttgaagttttgggacttgggctggcttccttgctcttcagcttgaagacggcctattatggaacttcaccttgtggtcatgtgagtcaattctaataaactccccttcatatatacatctatcctattagttctgtccctttagagaaccctgactaatataacacctcaaaatttcaaaattcaaggaaggaaataagctccaaaaaggatagtttcagaacaatctgtgctgcaccatactcaaacttctgaaatctaaagacaacagaaaaaaatcttggcacatcagtgtgatgtgaatgatgatgaccttcaaagatgtccacattctaatccttagaacctgtgaatatcttaccttatataataaaaggtgctttgcagatgtaattaagaatatcgactggggaatttcatacaggattatctggatgtacccaatataatcaaaaatatctatacgagagagaggctggaaagtcagaatcatgaatggaagtataatgatgaaagcagatgtgggagcaataccaattctgggaagggctcaagtgccaaggaacatgggcagtttctgggaatctggaaaggacaagtacacagatttttccccaacagatcctttagaagaaacacagattttgtaaactactttggctttctgacctccaatattgtaaaatacgcatttgtgttgttctttgccattgaatttatggtaattttttatggcagcaattgaaaactaatgtaagaggaggaagaagaacactgtaatatgggtaaaggcaagagactgtccttcttgatctttttaaagtatgtttgactatggaaaccaaaattatagccctgtcttatacaaaataatacacatagtaatattctagataaaaataaatgctaaaaatagtttaagaaacccacaggaaggcaaaaaaaaaacaacctaaatacactcaagaaaatacagaagcagaaaatcaaacaaaaagaaaaaattgcagattgatgtcttaaaatataagtgaatatattaaacataaatgatctaggcatacaaattaaaaggcagaaacgggcagagtggactacataaaaatgatcagtgtatgtcttgtttataagacactcattttaaacaaatcaatactttataaaagaagagcaatgcccaaatacatatcgtttcactgaataattctacaaagatttaaaaaaaaaaaaaccaattctacacaatttattacagaaagcaaaaacacttacaactcatttgtgagtttagtattatcctgatattaaaaccaggctatgacagcacaagaaagaaaactgtagatcaatattccacatgaaaatagatactgatatcttcaacaaaataagatcagaaaaaaattcagaaatatattaaaaattgtacaccatgaccaagggggatttatttctatgggagcaaagctatatcaataatttttaaaggacaatttaattcattatattaacagagttacaaagaaatattacacaatcatagcattaagtgtagaaaaagtaattgacaatatcattcatgaaaatcttctagcaaaatataaataaggaaggcctttttcgaattgataaataatatgtacaaaaacatcctacaggtagctttatattcaatggagaaagacttaatgggagaaacactgaatgcattttccctgagattgtaaacaagacaatggggtcatctctcaatattctcaatcaattcaattctagaagctctaaagacttcaatatggccaaataaataaataaatgaagggcacgcatgctgcaattgaagataaaaaaaagtcccgatttgccgatgacataattgtctccactgaaactctcaactaatatacaaaaacctcctaaaataaattaggtcatcaaggacacaagatacaagcaggatacaaaataaacatccaaaaataatttgtatttctatatgccagcaataatcacatagatactaaaattaaaaattttataccatcttcagttgttcgcacacacgaagaaatgttttgttgtaaatgaaatatgtagaagacttgtgtattataaagatgtgcaatggttatgaaaagatcaaagaagatttaaataaagagagacatatactatgttcatgaattggaagacagcacatgaaagatgttaattctccataattatatacaggtataaccaaattcatatcagaatatcattaagatttttatagatataatgaacattattctaaaattggtataaaaaagcaaaagacctgaagaattaaaataatattgaaaattatgaatataaaaagaggaatcagtctatccatttttagactcactatatacctacagtaatcaagtttgtgtgatattgatggaggaatcaatacatagatcaacaaaacagaatagagaactcagaaatagacctatatgaatatgcccaattgagttttgacaaaagtgcaaaagcaaaatcataaaggaaacataacctttgcaacaaatgttctaacattcgttatagcaattggacatgtctcaaactttataaaaagattaactccaaatggattacagacagagtgggagaaatagagagatgttggtcaaaagatatgtttcacttatgtgatgtgaaaactttatagagatctaatatacagaatagtgactatagttattaatactgtgttgactattttaactgtgctaagagagtagatcttaagtgttctcaccacacacacctgctaaaaggttactatgtgaggtgaccaagatgaatatgttagttttctgtagtagccattactcaatgtacatgtatatcaaaacatcatgctgtacaccttaaatttatgcttttattttaaaagtgattgcagacaaatgtaaaatgtgaaaaataaaacttttgaaaattaggagaaagatatttgagatctagagctgggtaaataattcttttgctgtgcagaagctcatgtcctgcacatgtaccccttaacttaaagtaaaagttggggaaaagaaagaattcttataaaaggcacaaaaatcaaagaaaactttgataagtcagacttcattaagaacatcgaaatatattttcactgtgaatgaacctttgaagagggataaaagacaagctgcaggctggaaaaaaacaatttcaaattacatagctatctagattttacagagaagtctcaaaaggcaacaggaggaaaatgagaaatcaaatgaaaaaattggcaaaggacgtgaagaaccattttaataaagaaggtgtatggatagcaaataagcacatgaaaagatattccttatcattagccaccaaggcaaggcaaattaaaaccgcaatgaactattactacagacatatcagaaatgcaaaatttaaaaacaaaatcaaaccaaaccaaaaaatgtggcaacaccacatgttgatgaacatgcaaagaagtgcaatcactcacacactgatgactgaaatacaaaatggttcagccaccctgaaaaacaatttaaaatttctcaaaaatctgaacatatcactaccatatgaaccacagtttgattaccatttgccaacaataattgacatttatccaagaaaaatgaaaacgtatattcacagaaaacttgcgcataaataattatagaagctttatttggaaataactcagatgtttttcaatggataaatagaaaccccacaaaaccatggtatatcaatatcatagaatatctcccaacaagggagaaaaaaccactctttataaatataagaatcttgatgaattttcagaggaattatagtaataaaagccaatcccaaaagatatattttatgatacaatttatatataattagcaaaatgaaactagagaaataacagattagtagttgctaggagttaaagggggtgaaaatggaaggaaagtgctcgtagatataagagtagcataaaggatgctgtagcgatggaagtgttcggtatcttgtctgtattttatgtcaaaatccagattaaaatatagttctatagttttacaagatgcaatcattagagtagatctaataaaaggtacatagtacttctgtattattttttacaacagcatggaaatcagtaattttcttaaaatagaaaaaataattaaaaacattaaaatcttgtttgctttttaatttggtatttacaaccatatttctctagtatttacaactctatttctaaaccaaaagtatgtagagctatttttaaattttcatgtttgaaatatatttatactataccatatgaggatttacctttattaaaatgtgtttatagtcacacatataaacacataaactcaccgtcttcatcagtattctcagcctaaagttcacagcaactcatggttaaatcattattcactcatttcaattatttaatataaaaatatttttatgatcaagccatgttataattattattcctctgtaatcaaactatttccttttccccgatattaattattttggacatttagttctgtcatgaattgagaatgtttggctacataagacataaagaatttgtggaaatctagcatgcatgctgtggaggcaaaacaactgtaatagaagggtagtaaatatggataacagaatggtgatgtaggacctagagatggtaggaagtaagtgaaaagcagggagattgtggcctgagatatgaatgtatcaggaaatgaccacagagagactagtcatctgcctcttgccaaacatttcatgtacaatgctgaaagtgtatattgacaaaagtccttactgaagtgaagctaatcagaagaaaggcttcttatcgccaatattaggctgaaaatcatctttctctctgtctctctctctttctttctttcttttttttttggacggagtttcgctctttcacccaggcagaagtgcaatggcaggatctcggctccttgcaacttcagcctccccggttcaagtgattctcctgcctcagcctcctgaataactgggattacagtgccggccaccacacccagctaatttttgtatttttattagagacagggtttcgccatgttggccaggctggtctaaaactcctgacctcaggtgatccacccaccgcggcctcccaaagtgctaggattacaggagggaaccaccgctccaggcctaaaattcatatttgtaaatcactttgttaatattggacactaaggagattgcaatacagacacttacctcttctgaactgacattcatggtaatacacgcaacatttaccttggtagttattcttgttatatagtgggaggtaaggctttatcctagacagccttttaagttagaaatgacaaactatatcaataaattatattgcaagaaaatcaacaggaccagatggcagtcattcaaacattctgcagactctttaaaattaattcactgagctaaagataaaaatatgtataatccatcattgacaacagctatcctgcctaaagactggacatcagccaatcttcaacgtctatgctgccacaaaagtaactaacataagaagcatatataaaaacatttgaaagagattctatggtttcatataataaagtaagcttacatccatttttctgaaaattgtcttaggaaatatagtttgtctatattttctataaagtcacatatttatgtagataaatagataatgtgagttgtaatatgataaaattaggcttcatgtaaatgcaaaatcatttggctaacctaattatccaggatagtagaggattggtatgttaaaaggtagacttaaacttggtatagtttggataccatctctaagaacaagctgtgttagcttaacaggcatgagattttctaggatttctaagtatactgtgacaatactgagggtaaaggatttttctagagaatgcttgtcagcaaacctgttcttttgtgaaagcggtggacccagagcataatttaaagatgtattaatatgggatattatctgactcttttttagaaacaaaagttataaagagaatctgtatatttctccaagtagtatcaatggttttcacaaatatgagaattgttttgcacttgcaaaaatcctatttgccatacaacaaataatcatagaaatcatattccctcatgtccacaggtcatgttcataatcaaaggaaaggagttacacaggaataagtcactggggatcacttcagcactctgaaaaccacaaagtttactttgtttctaatatgcatttactctttgaaaagcatagtaaatttatgtgattgcaaagtaaaaacaaaactttcttgatcccactctccaattttaagttctaataaaaacagttaaaactgtaaaacaaagaaatacataaaggtaggagaaagtaaaattattctttacattataatgtcaactaacatgtggaagaaatgacagttaaactcattgtaataagattttgatatgtatcaatggatgttcaaacattagatgaatgtttgttgaaaacaggatcaaaattgctccccgtaaatgacttatcaaattctaagggaaggaaggaaactgtgtgtgggaaaatctgatggtcacttccacaccaaggttaccagcatcaatgatggcgtgcactgataccaggtgttccttgatgtatcattttacactgaaaaggatacagcttcaagtatattatattcctgccaaaaattaattacctggatctagttaggataaaatatgcaagcaaacacaacttgtgggaccttctataaagctcttggcctctacaattcagaaatatcaatgtgaaaggctgaaaaacagttccagaataaagtatgctaaaggaacattaacattgaaagtaaaatacatttttgtgttggaactggagttgaataaaaattgctatgaaggaggttttaaaggtaattaataaaagttaaacatgaatttgatgagaattataagtattgcatccatgtaaattacgtgaatttgataaatgccttgtagtttcataagagaatgttctcctagttcctaggatattcatactaaagaatttaagggtgaaggatcatgttatccaacacttaattttggatgtttcaacataaatattaataatcctaataatatgtatatatttattgataagtaggaataaataaggaaatgttagaaatctgtaaatctaagcaaagtttaatccatttttattgtactattcttacagtttttatttaggtttgataattttcaaaatagaaatcaaataataaaagtctgtttaaaagatttaaaatattcccaaaacacaattggttcctttccagttgaaataagagctattttaaccccttctggaaaatattaattgaaaaaatagtgagaaacttacactgagaaccctagaaaaatgtatgttgacatataagggaacaaaattagagaaaaagagaaaacaaaagcaaaggaagataagtgcaattggagtacacacaataattatgttatttttgtttaaaaacaaatttgtccctttgtactattaatctcatatcaatacaacagattttataagcagagcagtgaatatatttcaatggaaatcacatatacgacagttttatatgcactttggacaaactctgccccaaagataaaatatagcatctgtttcactatgcattgaggaaatgcagaacaaatttaaaaatgaggcaaagtattatattctgccaatctatttaatcactgcttcttttggtctttattttttaaagttaaaaataagctgttcacatgtggacatggagacacaagaaaaatgtacgttatgtcgacatatgtatgcttagtcacattttggagcatgcgcactgttgctacaagaagtaaattgcatcattattggtaaaagtcaacgaaaaacattcaatttaaaataaatgccgggctctgggatttcttcaccaaaatttttaataattatttctattgttagtaaaaatttactaaaacactaaaaaagagtattaataatagaaatattctagtatctcagatatatttatactaatgatattactaatgagattacatttgctataaagtcacactgtactacaacaaatagagcaaaaatccctccctcatagtaagtagaaaaacctattgttcttgtccagatgagcaccctgtttcaggtatgcaagtctgttgcttaaaacactgaagagacgatgtccaggggttgttgacccagtgatggtgttggtgtttcagagtcaaaccttgatgctatgcggtagcttttactctttggctactctttagcatatagcagtattctttcatccccttcctcccttccctctttttcttccttacttcctttcctcctttccttcttctcccctccttctcatttgaccatatccatttggccacagtgagctgtcagttaaactaacactagatgacacacagtgaccttgctttgatgtctctttgattgctggcttttggctgagatacttttcatacaacttttcgtgtgacttcaccagcagcctagctcagggtaaaaatgttccaatagagcaagagcagaaactacatgtcctcttgaagtcacggcttagaacttacaatttgtcatttctgccttattgtatttctcaaagcaagtaacatggccatcccagatttaaatgatggcaaaaaagacttgatgggagagactacaaagtattttctgccatctgtaacctggtataatgcctcttctacagtggatgctacctggcgagtgtggagactttcacccatcatgtccctttccactaatgcattcaaatgcttctttcttaggcttctttgtttctaattgtctacttgctccttccaggactctgataataaattgataattacttttaaaaagctaagccacactcagttcctagaattccaggaatatccctacctcaggccacttctccttcctcacaaatttcatggccagaaacactggtcaaagtcatgtgtactaggagcattttggggccacctagattggggcagtgtgtccattctggtagcacacaatcatatcaagttgatgtctccatagaacagaactgtaatttttccctctgacatctgctgctcttaaggatcctctcgcaaggctacagaatgagataaattaaataaactgttcctcagagggcatatatgtaatacatgaatactccagacttgatcagacttgaagccaaaaccactgctatttcattgggctatggagtactatggttcccactcaactttaggactggctgggctgaaaatttccagtttatgatgagcaataccagttgtagagtcttttaatggcctttgtttaggtatgctgtctactatggcaagcatgcctggagctgctttttatatcatggagagctttttacatcatgtagactctatatactgctacttaacagagagcagtggttcatgatggagctttggttcatctgatattaataagttggccctgtagccaacatccctaggaaaacctctttatgtttttgacccttctatcaatattcttatgaaacaattctgatatttccactaaagtgttaagtatagatattatatataatatttattatatacatacacatatatatctatttatatacacacacaaatacagagagggagaagaagagggtgaaggagagaagaagagaaaaagaaagacaaagagaaagagaagtagggagaaagacataaactttaaagagccatcctagaagtgttttaggactatctccaggtgtcctgttcagaactttatatcctaagttatctgagttatgggagcatgctcccacatcaatatttttatattattttactttagggatatgttctagaagagtttcattctttattatcaagatccactttttgcattttctctgattcttggtccacatttgccaagccctgaagttattttggtggggcaggaacactttctccaattggttcagctagttcatccttccataattaattatggaggtacaattcaaacagattttggtgagataaaatatcatcgtgtgagacagacacttcatctgagagcttcatgtacttttcagtctgccattcctaacagagaagacagagttatttcttctagcccagaggtggacagttggaaactgctcatgagttatgagaatgttaagagtggtaagaccaagggaaatttggcgactgggggacctaaagtgcatccacccaaacgccagcataccaggtcccagggtttcctcacttacctctcagggaccccattctagcataaaacatatccttgtgattcacatttaaccttttttctataactcttatactcacaaaatcagtggctggaattcttatcagtgcagtttttttcctggctccaggagatgagcgcctttgtcacggaggtgttctagctttcacaccaagccatgagtttgtggttacctaacataagcctattatttccttccttcacagtatttgtggtccttagctacaatcaaaaactctgcaatacttaaaattacttttttgcatctcaagcactatggatattacataggtccgtaaatgcttccagttgtatgctgtacatctcagttcacaatatgtaatagtcttcagaattgtaatgctatatatgacatgtcaaggagtgtcaccaccctatctaaaagcagcaatgagtccctgactgccatctggccagcataatagtcaatgtcacaatcccattccgaagatctgcttcctaggacaataccagttgtcttagttgagattcccctaaagatacccacaaagttttaattacaagtagcttatttaaaaggtaatcccaagaatcactggcacagaatagggaagagtaagggagaaaccagtggccatgcagtagactgtacattgtcaataaattactttcatgagtacttggagcttaatcccaccaaagaattctgaaagccagtgtagaagcacctgcctaagaatgagcccactggaggatttactcattaagtgttttcactcattgtttgagggctactggagaaaagtctgggaataatagtcattatttcctcaccatttcagtctggtatggactgaactgtgtctctctaaattcatatgttgaaaccttaatctcccatgtgactatctggagatagagtttttcagaaataattaaagttaaatgaggttgtaaaggtggagccctaatccaatagtattattggtcttataaaaaataggaagagagaaagagcttgttctttctctccaccatgcgaggacacagcaagagggtggtggtctgcaagccaggaagagagcccttacccgaaatcaagctctatttggactttgcagtctctagcactatgagaaaataattcataattgagtcacctagtctatgagatttggctgattaagacacaggtctactacgcatgaagggcaaaaagatatcttttgtcagaggttgactgtgggaaattggacaagggtgacaagaacgttaagggcaagtgtgacaaagactatgggatattagtgtggtactgacagcctctgttacaactatcataggaaaattgtatacattcatggatattttacttcaagcatcttatacatgtaaggatggcgtttactcaaaaaaatgatgttttatggggataggtgctcactgtctaccacaagatttcaacaagtacagagaggtcttgttaggcttagcattagctgaaccttttgcataatatgacaaacagtttgataatgttaacaatttagatactaaaataattagtactgaacctatttaaatatacagtaggataataaggatagatagttttaatgatccaatcattgtttaaaattgcaaaatcaattagtgttttttatttgacaagacactctgttttcctattgagtagtgtgatttataataatataaactattgattatatgttttagtcattctaagtaattaagacccaggaattgtaatagaaatctaattcattgttttcttattcaaattaagagcccactttattataacaaaccatgctgataaactggtacactcatgctgtaaattatactacattatggaatctgcaaaacacacttccatggacctatacctcttcccaagtattatctatactttataccaattattttctgatatttagatctgaagacctaatttgattcagtttccatttctagaaaaaatgctttatacctgaacatgtgaaatttcaacaaaacctacccactattcactggtccttgttttatggatgattaccccactcatgactattgcctacaatctatatttcaaaaaggcttgaaaatagtgacattcaaattatatcatgccttattcacttattaactaaaattatttgttttttagatttaataatctgatccatttgggatttatctgggatatactgtgagaaattgatatagttctttttcccaaatgactagcaaggtatctcaaatattccttattgtaaaacctaatttttcttcatttttttgaggtaatgtctttttatactctaaattttgaaatgtagtagtgttcacttatggaatttctgttctgttccattggtctgctttcttgtaggccaatatgacaatcttttaaatgtagagacgtcataatactattccatacctggtagattagcacaccataattgctcttacattttaggaaatttgttactctccttgactgtttgtgattccaactataattaataatcagcttgcttccgaacaaaacttgatggtatttttagtggtaatgcattatatttataaattaacttttgggcaactgataactttatgatattttctttctgtgcaaggatataataggtcttcaagtataatagtgagccttgataaattttttatggttttctagattaggaatatttcccattaagcttatgactaagattttgtctgctcatttttttaagttaaataattttgtttttgagcagatttaattttacagaaaaattgactaggaaatattgacacttcccctatgtcttatcatgaccttcagtttctcctattttgtcttacatcagtctggcatatttgttataaataatgaattcatattgatatgtcattgttaaagtttatagtttacattagaattcactcgctgtgtcatacataatgtaagttttgacaaataaataatggtatttgcccaccattacataatcctcaaaatagtttcattgttctgaatattccctgtgctttatctatgcatccctttttccttccaaaattttggaaaccactgtttgttttactccccatggtgttgccttttccagaatgccacataggtggaatcacataatgtgtagtcttttcagactggtttcttccacttagaaacctgcatttaagtttcctccatgtcttttcatggcttgatagatcatttctttttattatggaataatatttcatttcctatatgcactaccatctgtttattcatacacttattgaaggaacatattccttgcttctaagttttggtaattgtgagtaaagttgccaaggagcaccatttgtggtcatatggaaagaatatgtttagttttttaaaagcctatcaacagccttccaaaatgactgtgccatttagcattcctcccatcattccttgttgctctgcatacttgctacttttggtgctgtcagtgctttagattttagcctttctacctgataggtgtgtagtaatatctcattttatttttaattttttgcttttgtcttgtttccattaaaactaatagccacttcttgctttgtctatatatgttttattggttttatgttaattttacctaaagtatttatctaacatcactttcattatttttttagaatattttggtggtcaagatgtataattatgctgtctaactagattattttacctctccttttgaatttattttgcctctagttgttttctctcctctagtcagtttgtactgaccagtatagtcataatgttaaataagcagaggacccagaaggcatcattagtcattacttttatgataagtacaaagtgtatagttgtatatacacatggactacgtattttaatgtattttttataatttttttcttatttgtcttgttcttgattgaagcatttatgtatgcatacatatatgcttcataataaggaagtagctccccattcttatctgaataagtaagttatatttatttagattattcaaaggcatgataaaacagaaaattccaaattacttttatctaagaaatataatatttatccccaaacctgcaacaaaaaaattagtgacaaacagtattttaaacaatcaatcatgtaaatatatttactagagtattagggaaaatgattacaagacaacatttagacataatatgttataatcacttgagttttaatgcaggaattcaaaagattttaggaaatcataattcaattcataatagtataggagctgaggagaataaattaaattgataatctacgagatacagaaaagtatctgaacttaatttacacttctgaaatcacttaattttgcttatatctggtccttctactttgtttggctttgctgctgttttctgacactggtgtttatagttatatagtattatgttgatatatgtgtctaatactataatattcctctgatacctgattttgctgaattccttagattgtagtttattagctttgcattatcattacactttaaaaaattataatttacctaatttttttctttgaatcaagggtatttaatatagcatctttattggtgcttatatattttaaatttttgcagcaagtagcattttgattttgttattaatttatcctatttttatccacaaaatttatttatattatttctttacatttcttgtgttgttcttttcagtcaagctgttagaaaacttttgtgaatcttccaagtatattccaaatatagtggttatttttgtaacacacaaattttcatctgaaagtatattgttttaagcaacaaatcaaattttagtgcgagtacagcattccttcccccgcaaaaaaaaactctactccagaaaaagaacaaagagaaagaaactcatataaaatactaagtaatcaaagcagcacatataaaaagtctttcctttttgaatttgtctttatttctccttgaatcttttgctgtttcatctttatatcagttgtcgctatgtactgtggattgtagccttttgcattataaagtatccagttttgtctcttcattcttttgatcagatttctacctttacatataaaggcataactcagagatactgggggtttcatggtagaccactgcaataaagcacatttcaaaaaaaagggaatcacatcattttttaaattttgtagtgtatacaaagttatatttaaagaacattgtaatctattaagtatgcaattgcattatatatcaaattatttacataccttaattaaaaatactttattgccaaaaatagtaatgatcatctgagccttgaaggagtcatatatttttttttttgctggtggagagttttgcatcgatgttgatggctactaactgatcagcctggtggttgttgaagattgggatggctatgaaatcaggaatgatttttctgtaacatgcaatgctgtttgacagcattttaaccacagtagaacttctttcaaaatttcagtcaatcacctcaaaccctggtggctactttacaaataagtttgtggaatattcaaaatcctttattgacctttcaacaacgttcacagaatcttccccaggattggatttcatctcaagaaatcattttcttttctgtccataagaaacaactcttcatccattcaagctttatcatcatattgcaccaattcagtcacatctttaggtttcatgtttaattctagctatctttcatatgactaatctgacacatctgtagttgtttcctccaatgaagtcttgaacccctcaaagtcattcattagggttggaatcaactctttgtcccagatccatcagaagcatcactatttatctcagctatagctttgcaaaatgtatttcttaaataataagacttgaaagttgaaattacttcttcatccactggctgcagaatggatgttgtattagtaggcatgaaagcaatattaacctccatgtacatctccatgagagctcttgggtgactaggtacattgtcaataagcagtaaaattttgaagggaatctttttcttttttctttttgcctgagaggtaggtctctgcagtgggtttataatactcagtaaaccatattgtaaagagatgtgctgtcatccaggcttttatttttttccatttatatagcatatcagagtagaattcgcatcactgttttccctaggatttttaaagtggtcagtgagtattggtttcaacataaagtcatagctacattagttcctatcaaaagaatcagtctgtcctttgaagtttttaagccaagcattggcttctctctagctatgaaagtcctagatggcatctccttctgatataaggcagttttgtctacattaaaaaatcttgttagtgtagtcacctgcatcagtgatgttaactagatcttttggataagctgctgcagcttctccagcaacacttgctgcttcatcttgcacattatgttatgaagatgacctctctccttacacctcatgaaccaacctctgctaccttccaacttgtttcctacagcttcctcacctctcttaggcttcaataaattgaagagagttagcatcttgcctggaattaggttttggctaaacagagtgttgtgtctggtttgatagtccattgagaacactcaaacttactctacatcagcataaggctgtttcagttacttatcattcatgtgttcactggagtcacacttttaatttccttcaagaacttttcctttgttttcactgcttggctaactgtcaggtataagagacctagctttcagtctgtctctgcttctgtcctatcttagctttcaacatgccttcctcaataagctcaatcatttctatcttttgatttaaaatgaggggcatgtgactcttcctatcagttgaatagttagagcccactgtaggtctattaattggcctaatttcaatattcttctgtttcaggaactagggaggcctgagtagaaatagagagatgagggagagagctgtcagtgggggagcagaaaataaacatgtattgattgagttcaccatcttatataggtagaatttttggtgcccccaaaccattacaatagtaacatcctaacaagaatacagcaaaaaaaactaacataactctcactctagttgtgtttaagaggtctttacccatacctgcatgtagactaggataattttagagcactgagataatatgcaaaaacagcaatcatgtagtttttaaaactaactctgagattaaagagaaagtatgaaaacagctaactatgttttgttacagatatatatgagcattgtgatctgaccaaggttaaagacattcccagtctactcaaaccctcactggtgcccagatgtctgtggttgttggtcacctcttgataacaacctctttctctttgcccacccttaacataaaaagaccctgaaatatgttttgacttaagacagcaccttaggatactagtccaccatcttctcagattactggctctccagataaacctgctttcttcccgccatcgctcctctcctgtgtttggcttttgacaggtgagcagctgaacctgggtttgatgacaacatcgagggtcactgatcacagatcaccataacaaatataataataataaaaactttgaaattttgcaaggattataaaaatgtgacacccaaaccgaaagtgagcacatatgttggaaaatatttgaagaacatctaaatatattaatagaataaaaaatctataatccaaaacagcataattagaaaataatagacatttttaataaagattgagaaaaaagatgtgaagaaaatatcatacagacccacttgcaatttgaaattatagaaaatatttcatcaatgaagactaaattaaaacacaaaagctaaaaacccagtgtaagccataaaaatataagagagaaggaaaatataaagaaatgaatagaaaacataaaactatttcaaaaattctaaagaattaattaatttgtagaggttgaaaataaattatagattaagacttactagaaaaacacatgtcagagaatggtggatgagtaatggagggaaacatggtttccttagtaaatacttcttgtctatgctacattccttcttgctggtcttcaaatatttttgtgtgtcctttttcccacacaaagaacaaacttaatccatgctgggaaaaatagtccaaaagtttcatcctgtcagttcatctagcttaatgcccaggatttgattcttacacagcatactttgttaattgtgctttggtgatactgctctttctataaaatgaaggtttgtgcaactctgtgtccaacaagtctatttttccaatgcatgttaaaaatgttagagcaagttacaccttcaggtgtaatattgaagtcaaatgttttctaacaccacgtttaaatccatcactatcattaatcacaaaacctcacctttgccacagataagttgcggttagtacaattcctgaaattaatcagcttcagtaatggcctagaaaatcaccttttaaaaaatgtctgcaatgactgccagtgtttttcatctggtttattatagtgcccagtagttcatcaagttttgggaagactatttaaagtggcactctccaccacccgtcatctaaaagaaggtgctcattttccttgtttcattaattatttgcaaacaattacaaaactaaaatctttctttctggaaacttctcagtggttgggtgtctcccaactatatcatgactttatgtctctgatcctcaccttcatgactaagataaccttgtctctgcctgacagaggatggatagaatatacccatgctgcactgttagaagaaatgacctttacaatcttaagcagtgagaatattagtaacatagataataacatatttgcaatgtgactcataccaaaccttcaaattttagttcttctaatactgtaagtgtggatggtatgggggtatgtacatgtgtgtgtgaaatcctgtgaatcaggcatgtattgagctaaaatcaatttagtgaataccagttcactaaaaaccaattgaacaaaattttgattcactaaaattttgtatatattacatatttataaagtttatagattattacttcaacaggtttcaaattgttttgaacattcttttgaggtttcaatttcccagtagctctttcatcttagcaactgtgttatatttgtttagtagtcaaaattgtccctgttttattgaataaaatgataagaatataatagtatgttgatttctgcttccaaatactgagcatatttcagatgcttaaatgatatacaaagtagtgtttctatcaagcaagctaagaaaatggtaagtaagaaaaaataagaagacattaaatattgtgaaaatctattggagaaagaaacttgcttcacgtattatgcttgaatttcaaaaaatatctatataactctcatcttgcaatgtcatatttcccaaagtactgaaaattatactctggaattaactaaattttattctgcagtggcaaaattatttcagctgtattaatattaattatattaagctatgtgatgattttaaagaatatcacaggtagtaaaatatcctagacacaatgaataaaaaagtagttgagagggtaattttgtgaataaatttttggtaatgaccattttgtaaattaaaaataactagcctttaatggtcaaatataatcctatgtggaggtcctattttaccacccataaagataagtaaagtgaggcagaaagagtttaagtaatttgcccaaatgcattcttcaaataatgtggaagattagaagcatgcctttagaacttgtactatattgctacctgatttgtgctgaattgactttctgtgactttctctctccctaattggtcagctaactaaatgattttttgcaaattgatttcactaaacaattagtacatagttaagatttttggacctataaggaaaataatatcctatcacatgctcagtaaaagtttatagtagcgtatcattttcaatctttgaagcattttgtctttctatctatataccatccatctatctatcaccaatctgttatcatttatctactgtatctagaatggtccaaagtgaaataaagctgaggtagcaatttccaatatcagtataggatagatggctctcaagatacatccagtgaggtaggtaggggaattggagtcactgtatttcacttgaggttaagctcctgcttataattatagataatgtgactatataagcaaacataccaacatgttttccatatgccaaatattaattcattatttttcaataaaatacatatatcttttaaacaaaaccaacactttcattttactaattacaatatttcactatggaaaggcaacttggaaaacagaaatctcagctcaggggcaaaggcaaactctcttgagaaagaaggtagcccagaatcaaaggccaacagcaggtaagtgctaggtggtggagttatggggaggggaggcttcaaaactactcaggatttcggttaatggctggaactttgggagacctcacaggtaaccacagggcaggcaggccattcacaaagtgggtagatgttgattccttctgtgagtcttagaggatgctcacagagggtcacagctcaggtggtgtagtggggtgcgctgttttctctttcggcctactctcctggaggggcagggctcggaacataaagctctggcatcaaggcacgcctaaggctatcagggctaagagtggagatagatctcaggcccaaaatcctaggggaagaggaagaggaactctgctcagaaaacttagatgggaggaggagctggaagcaccagaggaggaggagctctcattgctgatggatgggaaggaagaacctcccaggtggagagggtgaggaggcatgcatacggactgcatgccaaccaggcggggaagcacttcttgggacctcaggatcagaagagcctgagctgctctgaaaggccagctgtcctaagccagccccatgggaaagcgtgttctcatcagctggcccaagctgagagcggcggctgagaagggctgatcttcgctgggtggaacggctccggagggcagtgcctggcgtcatgctggtgctgtgacgagcagggcttgaccttgctgtgcggccgcgaagggcagggcctggggggttgccacagcgttggagggcagggcttggcccggatgcacctctgcggtaagcagggactggcggggtggctcggagaaagagcagatgcagtagcaggacacagtgcccggaaggcagaacaatgaggctgcccctgcctccggtgatggctgtgggaccgggaatgaagatcctgttgcttctgtcccaccttctcctgtgacgcgtctccctgcggcagcgccgcgctgaggtgccacactgctggttccaacaccgcagccgccaccgccgccgccattttcgtggcggatgagggcccgtggctgcccttcatggctgctgtgccggcgaagaggcattctgacctccagggctgccgcaggcctcaccatgtccttggatgtgtgatgccctacggggacagccaggccgctgtggggccacccccgaaggccactggccactccgacgagcacccggcccagaccaagagccctgcaaacaaccgtcataggaagcggccaggccgcaaccaggctgtcgcagctcagaggcctccagggcggggtctgtttcctcggcctttgcagccatcttctccagggtcccagcctagcagccgttgcggttcccgggcttctgtgtcgagtcaggcaacgcagccaggccctgcactcctcagccatgcatctgggccaagccatgcatctgggccaagccctgctcgccgaagcagcatcgttctgccaggtcctgctctccgcagacgtgcatctggttcaggccctgccatccgacgctgcaccacccagtcaggccctgctcttccacgccgcgccactcatccaggcccagctcgccgaggccgtgcacccgcgccgggctctgatctccgcagccatgcctgactgggtggccttaacgccaggttctccctcagagagcaggaatgcggctgctagtcaaaatacatgtattttttaaagacctacaaatgtgtctacagttcagggcaccattttcttggtttcagtcagaacatttctttaattaaggcatagataattggatgtttttcatttaggcagtcacgtctagacccccagagccccatcacagaggttggcacagatgtaaaatgtgatagcatgtacctattaacaatgggtaaacattggaagggcctaatgaactattcctttccctaatcatatctctcaagtgtcacaaacctcatgcactcaaatactctctataatttccagatgtggtagataaatatggcaaaagtcttgctctttgtgacattgcctgcatcaaatgagtagcgactcaatcctttttatttcagcatagctacataatgatgtcatcttcatttgatttctaatgtctcctctttgttccttttgtttgcattgcctgtatctttacttgtccctttattttcaaccagttaactttgttgtcagtgtgctttctagcacgtataaataaatattttgctgattagcacaatatgtgccatgatagtcagaggtgaagccagctggacttcctgggtcaagtggggacttggagaacttctgtctagctaaaggattgtaaacacaccaatgagcactctgtaaaaacacaccaatcagcgctgtgtgtctagctaaaggattgtaaacgcaccaatcagcactctataaaaacgccctaatcagcactctgtgtctagctaaaggattgtaagtgcaccaatcagcacgctgtaaaaatgcaccaatcagcactctgtgtctagctaaaggattgtaaacgcaccaatcagcactctgtaaaatggaccaatcagcaggacatgggaggggacaaataaatgaatagaagttggccaccccagacagcagcagcaacccatcggggagccccttccatgctgtgggggctttgttctttcgctcttcacaataagtcttgctgctgctcactctttgggtctgcaccacctttaagagctgtaaaattcaccacgaaggtctgcagcttcattcttgaagtcagtgagaccatgaactcactggaaggaagaaactccagacacatctaaaggaacaaactccagacacaccatctttaagagctgtaacactcaccgcgaaggtccgcggcttcatggcttcattcttgaagtcagcaagaccaagaacccaccggaaggaaccaactcaggacacaataggagtaatcagaacattaatatgtagaatgttaacttctgtgtttttgatttctgcataggggagagccattctcataattatttacataatggaagattctgtcttatagttcttaaggactagattctctttttgaactttaaaaagtgaggtttcaggttgtgagacggcctgtgaaagagtcatctgccagggaactacaggcagcctccaggagctaagagcagccagcgagaaagcagggacctcggttctgcaactgcaaggaactgaattctgccaacaattgcatagttttagaagagaacactgtgctctagaaagaagtaatgcctgatagagacatgtgttgcagccctgcaactctctgagcagagggaccagctaaggcgcaccaggactctctgactcacaaaagctagaagataatcaatagatgctgttctgaaacaacagaagcttatttctcacagttccggagactacgagtcaaagatcaagagactagcatatttggagtctggtgaaggtccacttcctggttcagagatggtgcctcctccctgtcatcacatggtgtaaggggagagctggtttcttgggattccttttataagggcaccaatcccatttatgagggtaggcctaagcacatgccaaaggccccacctcttaatcccttacctcctaatacctaatacttcctaatgcccaatcatcttgaggattacaatttcaatatgtaaattttagggaacataattagaacataatatgattatttttcataaactttattcttctttactcttaatgctccacctgtttaaagattttgtcagtttcctctggtagttctgtgtcactaggtctgaattttgacgactacacctgagatcttctctgtgtgttattctttcccatagataaattttcagtttcttgttcagcttattttttactaaactcaggttttaggagagtactaaagaacacatttccatagacaggaaagaaatctagtatttatttgcatggccatgtgatatataaagtgtggcaggctctgcttccttctctctggtctgctgcttctctttcagatgctaaggtttagcctgaccctgaggttattacactcctagccattcttgagtcagaaattcccagtacacacgagaataaaaaacctttatggaaatgaggctgttatgtatacaactttgagcatcaagctcttcccaggatcccacctttctgactgttctccacgattttctgtagccaagaaggtagaaattgtgcacaaatccctcttgctgagatgcagagcaaggccgtggtttcacttacatgaagttgccacatctcaggagccctttggcccataggaatccaacatcatggagctggcaggagagcagaagggaagccaaaagctgtgtttcctacacccagaattcccccatttcccttgtcacttccattccatctccttctcttaagacccttctataccttcctacattagcttggggtatgccccttgggaatttccaaaagacatgctttaagagtgaactttaatagtttaatgctaaaaataaaaataaagacatggtaaaaaataagacaaagtaagaaacaggccctgtaaacatggacagcactttttaaaaatctaattagcattttctttttaaataccaatattaaaaatgttataattttagatacagcacttctagatagaacaaaaatatcacatgaaaaataatcagtattttacaatctggagagctagttattatctttacattaactgagaagggataattcagttaaaccttttgttttgttgttgaaacgggtctcgctctgtcactcaggctggagtgcagtggtgccatctgggctcactgtaacttctgcctcccgagttcaagtgattctcccctctcatcctcctgagtagctgggattacaggtgtgcaccaccacacccaggtaatttttgtatttttagtagagacagggtttcaccacgctggtcttaaactcccggcctcaagtgatccacccacctcagcctcccaaagtgctgggattacaggcatgagccaccacacctggcctgttaaaccattttttaagttcatttattatcatttgccttcatcctttaaaagacaagtattaattaccctcttatggaatgacaataaaatctaacatgttctttgttttccccttaatatagaatatcttaatgcatcaaactctattcaagtagattcaggagacatgcagtctttaaaactgtagttctcttctcacatgaaattaacgtgcacacagacacacatgcacagagtgggaagaatatttcagaaagcatacctttaatcatttcatattggatttatcattttaacgtatttaataatatttgaaagataactttagatcttaaaccaatttatgttttcatcatacttatgcaatgaaaatacacgtaatttataatttatacaatttatagtagaagtcataattaaaatgctgttagaatttatttataaattgttgattttaatcatcaatttaaacgctctcctccctcaacacctagttttgccacctacatgcacgctcattccagctattctaaaaaattttaagaagaattaaaagaaaatactttcatttatacacctgaatctccgttgttatataaagtcattacagtattagtaaaatgctttagtgataaagataagtaatgatctgaacttgattattttgaaaagataagcacaaattcattaagcctatgacatttaatgatgttgtgttcctcttcttctaacaatttgaaaaatatatttttatctgtctaaaaaatataaatgaacattaaacccactattaatttaaatttaaactaatatcccctgatcttgaagaattaagcaaatatgtaaacagaccattgtttcttttgaaaggatctatcaatcgccataacatacttactctttaacataatgaattagaaatcaaacttagcatcttatctttagtgttcctctgtgtaaataattttaaaaagctattaaaatgtgggagaataaagagtgaggattcactttattcatttcagactaaaccatataaactaaattttgaactaattttggatttatatttgtagaagacagtgcaaatgacagatcaaacagtgatgcacctaatctgtgtttctgccagtatgaccttaagagggacatggcttgcaagcataggagaatctgatgggtgctttcctgaggtgattatggaaatgttgtgtataaataaataatcagtacatatatttataaagacttctaatcagagactatagcatgtgtgattgcaatcatattctatttattaagacttgtttatgacaatgagacgtgttttatagctaagagtttttattccaaagaaggtttttcacattatttttttcttaattcatttaatagtattgttcaaactgattgctttattttattagatttgcagactggggactttattctttatctaagtactaatactgcttacttgttcaaaagcaaaatattaaatgcagccctgtacaatttaggacatgaatttaaaaaataatgcaatctaaaggcaaaaagtgatattctcttaaaaggccccagtagtaacataacagctgaaagtagcaacaattctggttctagttaagctcatctcataagcaaaattactttgtgaacatctatactctaacataaaccagactaaaaatatttttaatatacagctgtaacttaacaataagataacttttctaaaaatgagtttataatcctctatttcttcacgatgttcaaaaatcttcaatcaccctattcaaaaactcggaaaatgccatagtgtatcaaagaaatattaatttatcaacttatctgagactgtctactgcttaactcttcatgaaattgcaaagtttcatcttaaaatataatctgtttttaacatctgtagaataacatgccactttgagtgatagttgctagactcggtaaatactaaaacaatattgggaaatgttacctaataagatagtgttctataagcagaattttgagtgtgcaacatggaaggtctgtttagaagtccatatattaagttaatgatgctacagcttttggcccatttatggagcccttgtcaggagttgaaacatagagcctggcggcctctaacagactggtctgcttacaacttgcaatgaactggtaaaggatagactagaagaggaaactttgagtgtattatatattttgcagaatcacctatttccttctttttgtttacttttatcatctttaaatgagaataaatccccattaaaaagaatgtgagaagacagaaggtaattgctatggtttgaatgtatccccccgaaaagcatgtgccagaaacttgatccccaatggaaccacgttgggaggtggggcctaatgagaggtacttaggccatgagaaaggagtgaatagattgatgctattatctttggagtggattcattataaaaggggaaatttgcccccctccctttacacacacccattctctctctctctctccccccccccttcttctctctttctctttcttcctttcttgcccttccaccacccaccatgggatgatacagcaagaaggccctcaccagatgctgggccctgtttcttaggctagccagcctccagaattgcaagaaataaatttttgttctttataaattactcaatcttacttctgtttcttataaattactcaatctttggtattctattacagtagcacaaagtggactaaggcaataactgtatatactcaacaaaggttatttgtatggaagcgaatatgttcttaagacagaaacttcagtaaaattaaaatgttatggggcatgatgctagtttttcttctcatatttatacaatgagaataagttattacatgctgcaaaatatatttggaaagcaatatatgtgttgttacatgatgcactcttattctgggccaagaaaacttacccaccccattggtttgaccacatgacttcctttgaccagtggaattttattttgaaaaatattaactgaggcttttaatgaattcagccagtttaacttactacttgccatctggtgaacctacctgagaagagaatgtccaagtggcctggagcctgggcttctgcaataggaatactaatggtcccccaaagtcatctatgccctagtcttaagaatatgtgaatatgttatctttcatgaccaaaaaaaaaaaaattgcagatgtgattaagttaaaaatctttgattatgtggatggactcagtgtaatcacaatgtttataaaaaaaagaaatagagagaaaagggacgtgatgacagaagcagagattggtgtgacactaagaaagggctactaagcaaggaaggtgggtagactttagagactggaaaagataggaaagcacattctcccttagagactctagaaataacacagccctatcaacacttagcttttaaacctcttactgccataactatcagataatacatttgcattcgtttaaatccatgtgtatggtaatttgttttttgtttgtttgtttgtttgtttgtttttgagacggagtctccactctgtcacccaggctggagtgcagtcatgtcatcttggttcactgcaacctccgcctccggggttcaagtgattctcttgcctcaacctcctgagtagttgggattacaggcatgcgccaccacacccagctaattttgtgtgtgtgtgtgtgtatttttagtagatacagggtttcaccatgttggtcaggctggtctcgaattcctgacgttgtgatccacccgcctcagcctcccaaagtgctgggattacaggcgtgagccaccatgcctggctgtaatttgttagagcaacaataggaaactaacaaagcatccacgaacacataagacaagacctgaacccaagagcctgggcctaggtctgccagattttggtctaaaagagatcctagatgaaccgaaaagtttatttctgaagttgaaattctctctttctctctttggctttctatttgaaaaaaaaaaaaaaaaaaaaaactctctctatataaacatatatatatatgtatttttccggttttaacaaaaacattggattatagacaggtacataacacacagattctattacaaacttgctggcagcattacttaataccacatcttgtacatcattacatcatttcatatctgcttatatagatatatttgttctctttaagtctccatgttattaaacaccaaattacatagccagtagccagatgaggaattaaatttagtctaactgtccttaccatataataagagaaaatagaatgttgatataacttaaacatgttataattgaggaaagtttggattaaaaactaattgttcagaatttgttaattacaaatacacataaatgctaattaatgactaattatcagcactacatctggccttagtggtgatgattaaaatttagacgataattcacacttaactgagaattatataaatttttttattaattaggctaaactttttttctgtacttatagaaacagagaagtagaatttatatgttgggaaaaaaggattatttttgtactattggttatgccatatgttaaaaagatgagtaatttttaaactttgaattgtgtttattttgaatatcaatatagactataaagcatatatgttagctaattcaagagaatgtaggtaatttcatttaaaagataattaaatacatacttatcatttaagattacaaattaatcttttaagtcatctgagttgttagttttatttttgcccaaatcatagaaaaagttgataagcatttaaaattcagagctatactcaatatttgttagtaatctaatattccgatttgggatgaatagaaaaatacttagagaaattgttagattaatatactaaaaatgtatgaaacagcgcctcaatttgacagtttcgtggcactgtaactatattgaagctgtacgtttattttaattgttttcctgagggaaaaggatatgtatgagcctatctctttgcacctgtctgtctatctacttatctgtttatctatctaccaaatttttgttagagaaactaaatgctaaaatcattttacaggaaataagaatggcagaaatgtgaagagttattgtgtggggaagtggcctctacatagaaatgtttttccactgaatgttcctgttgtgctgatgaacaaaggagttcatcacaggccagaaactaagatagatagataaataaataaataaataaataagtaataaataaataaataacctctagtgcttttttgtataacggtgatgtaactttctcccttcacaacataaggatatcaaggttgttctgtctatagctctcccacaaccacatccccagatgtccagaggtaacgactttggttcagggaatgccctggggatggcattcaaccaggatagtgttaaacaccaagtgatattttgacatgccaacatttcttgagttactgcaaaatatgagtaaagtactatcacatgttaatgggctgtgaggactaactggcttggatctgggtttgagtcctttgagattatcaggtaagtaataactatgtcaggaggggctgaggactccatgtgattctaatgaagatcaatattgcttgccatggcccattgatagggacagggggcagagaaattctaggcagacaggggcaaagccccaccttcaagctgaagcctgagatcgcagcccaaagtgagaacttagatctctatttccctgctcaaatgctgtcttttcctaaatcacccatgacactaccccaccccatcctttgcctgtaaagatcccagaaaacctgcagagagaagcagcagctggacctcgggatgactatggctggacgtcaggagagaagcagtttgacttcagagggacagcttgatggtgtaacttcagagaagaatctggttagagatggctagactccaggaaaagattacctacccttcccctacccttttctcagctccccttcccactgagagccactttcaccgcaataaaatcccccacatgcactatccttc

SEQ ID NO: 795 - DNA, 1356 bp, Homo sapiens
cctcaggctggataaacaggcctgaaggggacatgttgtatatttatgaacaggctgctttgtctggctgagggaagtgtggcaggcatgggtaaatcattgaatcatgggttctttgaactgatccaacttctctctcactgacagcacttactgtggaggaggaacttttttgcattttgtttcaatttaggatttcctaaaattaagatgagagagtgtccagaagggtatataccaatcacaaggatgaagaacagaaagatgaaccttctgatgtgaaactttagagaagagagaaaaacttttatcatgcagtgggagaagtagaggatcaggaaggacaggatagacagcaacgcgctgatgggtgcacccctgccaggaaccctgctgccggccactgtgtttctcatttgccgggtgtgcctccccagagagaaaatcaagagcaaaacagcaaaaaggaagataagcaatggcactgagaactcagcaacaaaagagaaaatctgtatagccagtgtatcttctttttgaattgtggcattttgggagaaaaatttccttaggaagtatgggaccataaaccctgcatatttgctatggaaaacacaaatcatagatacatatagcagagaccccaggatcatccatgggaccagcttggatatcctcatcttcaaccagatgaagagtgggtgacggacgctggcaaccttggcacaatagaaaacgccgagccatgtggcaagccaaagttccaattcatttataaataagagaattgcacaattcgcagaacacatgatgaattctatgaagaagataacaatcacattaacgtagaagatgaacaactgcagaaaaattctagaaactgccagacaagaaagaaggagatccagcggagccatttttctgtgcttgatcaagtcaatgccattcaccaccacaatgatgccatttgtgaaaatcccaagaagaaattgtatcactgcaagaagaaaatagataatgaggtgagactctagcattttaggaataaaaaattatttacttaaaaaataatgaagttataaagttttggacaggttgggttgttcacgctcttcaattagatcaggactcctctggggaagaagactaacaataaaggcatggggcaggaaggtggtgtacatttgtttatgtcactgctttctctatttagttctgagacagtcaaataaggaggagatactctagcatcaatttgcttcttattgatggcttttgcattttacaggtttacctagctttcaaagtcatcacaggcaaataatggaatcagacaccttcagacagctgggagaa

SEQ ID NO: 796 - DNA, 4099 bp, Homo sapiens
cctcctcctcctcctcctccccgccggggtgaaactcgagcgccccacccgcgcctgacctccccgagcccctccccgggccccgccccttcccggtacaggacccccaccttcgctcctgggagccccgctgcaccccaggagttccattccagcctccccagtgcgagtgcggccgagcgctgacttttgggggctccctcccccgtctcactgggtccctctgcggctcccccgcccgctgtcccggttcagacgtggctgcaccccggaggggggcgccggccgagacctgagacgtggcgctccctctctgccggcctcggcttcaggtacgtgcggttccctcggctaaatctggcccgggggatggggggcaggggccgtctggtcctccggaactcgaactttgtgattttgttctttctgtgtgacatcctcatccgttctgagggagaaactccttaaagaagacgagagagtcagtcgttgcgggttcttggaggagcactttgggggtgagactcccggctagttcgggtcgatttcagcgggattaagtcaaggaaatgaacaaatctgacgaatcagggaggccagagaaggcgtccccaggtagccacgctgagcgttaagagagaagtcccgtatggtcaaagtcattcgtccaattctgtgtcaattattccttgttgcacttttgcaggatccttgggccttactaagtactcaggtgaaaagttgataattgggaagcaagtaaagtacctttgaagacgtgtataattggacactttgttgcagttcttcagtttctggaggaggcggtggggggggagagggagggggtcagcctcgcgaaaagagcaaatggtaaagttataggagtataaggcataaaacttgggttgggagtcctgactggccttgagtggccctttcccactggatgggggtgcgggacagtatctctgggccctttttactcagtctgcgcctcagagggaggcttgaaggtcccctgcatgaggaaatgtgtgaattgccccctcctgaccgcagtgaggtagggacccccgcaaggacccacgttcacaccagcgcccttccagccagtggtggggtatggatgggcctcgctggtcctgggcatggtccggtgcgtccataagggttccattgagctcatccataaaacaaagaagctattgcaggctgcagggtgtcatagctcgcacagtagccatgcagacctaagaggacaatggaaatacaaattgctatcgatgtgtctttattttctagaacttttttttaaaataaaagaattaagtgaaagcaattccgaaggtttctatgaaagcccagcccatccccaaatgcccagtctctggcacgggtgatctggctgtcttgggtactcaggccttactgggatttcctttaagacctctgggaggaagtgtcagtagctgggcaggccttcttggcaagcattcctccctgggttgtggcgggggctcccggcctgctgtgtggcagctgcaggctcctggggacctgaaggaaaagcttaaccgttctcccttcccttgcttggcacttagagcactagttccattccagacattccgattatcttgcctacgtggcacagaggcctaggagcctccctgggaggaagaggcaggccaaggtcttgcctggctgcttctagggggaaagatgtagggaggaagctgccttatgcttggatctgcagcctttgcctggacctgtggagcctacgtggccagggtgagggagacagaaattagaacccaatgtattcagctaatcctcttcttgcctctgaacattgccgttaatacttgaaaagaaaaaaaaaaagcaaaaaaactcttggcatatagagctaagcagtgggaagaagatagctttctaaaccatgacccaataggtctgataacataacatttaactggataaattacataattttgtatatatgtaggggggagttgaattcagttttgctgtttacaggctgcaccaatgcattgttaaaagatgtatattttagtgataattgtgattaattacaaaataattgctaataagcaggtaaataaaccaaattataatttagagtgcatcctttgtttaaagtgaaatggatctaaattgaggatataattttgagttttaatctggggaaagttctttaacttttctgagctacagtctcttcacctggagcttagacacaccagcctggcaggggtatgtcagctgtctgcttgaaaggagaaagacagtaatctgtgtgaaatactcaccgagcacccaacatataagcaggctcttcataaagtcattttgaggtatccacaagtatttcttttttctaaacaaaatttctttgttttttgtttgttttgctttgcaaaggtcttgcttgctagaaagctatctgcattaagctgcttctcatcacattataaaactaaggatgatcatttttaaacaaacaaaagtatttagttatcttttcaaagtaaaatatagctttccctaaactgttttaggtgagccatgcacacaatgtgaaagaatgaagaaaccaacaaaacacttggtgaaaatgatgaattctggggcgctgattcatgtgacttgaaaaatgccatccatttcctgattcacctcaattctgttcggaactatgaaagatcatttatgtttctgcactaattgaccaattttgtcttgtctttacttccctccctagtgcttgaatttcagccacatccctaagctgccatctcagaccagaggaacagggaggggggctttctggaaagaacatcacctggaagaaatcaggacatgactgtgggccatgagtgaccttcaaaggaaagccgggtatctgtggtctttaagatgtggtaagattgtattaaaattatagaaaaaaacctcaatccagaaatcgtggcctcttgacatttacatcttaactgcattttcctaccaatgagatgcattacaatcatcctccataagtgttctctttttacccctgtttccattcttttagatccatgacatttaaaaactgaagaaatggaaagatcatctgatcaggcccatcagtctttttcctaatgctaaacattggtacaaagacgtgaagtttgatgtctcactaagattgcctagggctgctttattgctcacctacttcaaagtattgggaaaacatgattatgggtacaggtgatgctgtgttgcccccagacaggtttcttttgtcaggttcttttgatggattaggaacctacaagtggggagattttagggaaatagcccctccacttggatttcaccaaaacgtctttagggttctcttaccccaagaaacacgcattcctctttagtgtggcagcccactctattggcaaagttaagcagaccagttttactaaaaaggagccacccagaaacttagacagaaaatacttgaggcacagatgagaatgagcacaaatgtgcatagcaagtgcagtttcctggcccttaaactgaagggccaggtcagtctgctcctccaggcacagcctgggaccccatcatgtgccccactctgcagtctgagcttccactcaagtccaccagggcctgcctcacatatatatacaagacccaatgtcagagtctgcctctgcccatgtctggtcagagggttgcactttgccactgctacatgttcccagaggttggcacagcatgacctggacctcacctaacccaggcaaactctgctcatcttcgagctctctggaacccatttctcaagggagaaccacattcccccacctcacagccaagttcaaggaagcagcctggctaaagcaatgactcaaggataccagaagcagagcacgcatttaagaagatgcgctgactcgcaggagcagctgactcttcttaagaagagtttactgattcttctttcagtacgggccttttaataagatattgtattttacttcagctatgggtgcagacaattaaaggattctagaaatctgaa

SEQ ID NO: 797 - DNA, 89 bp, Homo sapiens
caaaacacttggtgaaaatgatgaattctggggcgctgattcatgtgacttgaaaaatgccatccatttcctgattcacctcaattctg

SEQ ID NO: 798 - DNA, 24403 bp, Homo sapiens
tttacaaaagaaagagctttaattggacttacagttccatgtggctggaatatcttacgtgaatggtagtaggcaaaaagagcttgtgcaggaaaactcccccctaaaataaccatcagatctcattaaacttactcactatcatgagaacagcacaggaaagacctgcccccataattcaatcacctcccaccaggtccttcccacaacacgtgggaattcaagatgagatttgggtagggacacagccaaaccatatcaatgcctctataaacccaccaggaacacttctagaaaatgttgaacacctccgaggccccacagaaccctcctctacccacatcttcatggcaaggagctaccatggatccccctccgagtgtgcccagaccagttacaggactggttacagtggaaggcaactgagaggcatagagcaagagctgccctcccactaaagtcacacaccacagaaagaactcattcttcataagaagactggagctactgaaaaagggacagacactagctgccaaaaacctggctgaagtccacaacatcacatcccctcatctcagactcacacaggtgctctctacaccatcacactgtttacttcagagaactccacacacactaagattcccttgcttatttgtttgtctctcctttccagaataggaattccatgaggccaggggctttgcatgtctatttaccgcagaatctcagagcttcttctacagtagatactgaatacatatttgttgaatgaatgaatgtgtccccagatgtttctcatttaaatgaaaatgatcaaactgaccaatttttataagtttagttaaagatgtgaccatcttacttcattacatctccattaagacagtttggtatttcagttacaggtgtatgactgggagttcaattcttttctgtgataagtacgaatgactcaagctaccattcaatattcactttacagatatatgaagcttgtctactcacgttcaaaggttttccttaattcgtcttttatctaaatcagtcaagtctcttctcataaatgagaaatattaaatgagtggcagctctcaagaaataaaaaagtgactagcagaaataatctgcaacttctgtgaataagatttttctcagtgtctaaaataacaaacaccatttatggaccaaagactaggtgccatgagttttagaaattggtccccactccactgttatgtgtaccattatcccagtggcagagatacacagaaagccaaggctcagaggcagtaagtcatgggtccgaggcctcttgctgatgacaaaactggaatctgaacccacgtcaggcttacatttacacatacatgtatacaaatgtacacatatacagcttagattccataaaatacagtaatctagtggtggaacaaattatttctaataaatgttataaaatataaacgcctctctgaatcctttagaaaattaattttgccatgaagtacaaaaaggaaagagatacaacttaagtatgaacaaagttataggatactacaaacagttggtaatatatactgtctttaaaaatcatttctccttatcgaggcattaagccatattgtttataatgtgaagagctattggcatcttattttcctacccataaccatgaccatcacttattcatcttttcatgcatccaggtgcatggaaaggcagtaagtacaatttttaagaaaatagcatcaaaagcagattttaaatctacctgtttttcttcgtttgttttctccaacagttaaggaaagtaatagtaatttctcattccaaaccaaagacaattatgctcctttgctaaggacacagctgtaagtctctacaagatcagggaagactacaatatttcagaaaaacactcccagtcaagtttatgcttgaatgggcagctggaaatgcatcgatgtacagggcctcttttcacggcctctaaaagtgcttgcatcatatgcccacactgtgtctatcccctcccccgtgacgtggtctggagtccaatgtgggaaagggaaccggcaagcaataactcgtgcatcatcctcaagttcacgttcaagtttcttctccaactgcagcatctgtggagagtaacagctattattttagtgagcagtgagtcagaggaaatgatcccaaaatttcctgtttttaagagtccctgaaaatacctgagcaaaaattactacttgttaaaaagagcactctgggacacaaacacataaacaaacaatccattgaaatacagaagatacactgacagcagttgtaagaacaccttctagtattaattataaaatatgccatttttagcagatgtctatcatagatttatagttttctaaataaaatcaggatgtggcagtaattttaataagaagcagttttaaataacgcacttcaacacttcaatatacctagtctcatatatttaagacattatttttccaccattttttaagagagaggggtcttgttatgttgcccaggctggtctcaaactcctgggctcaagcaatctgcccacctcggcctcccaaagtgctgggatgacaggcgtgagccactgcgcccagccacatttttgcacatttttaacatctctgaaatcaggacacatcacacaacactaattgtcttagaattataattagcaatttttttgtttctcaatagcaatggtgcatcctaaaatcaagatctacagtcaatgaaatgtggtatagttagactatgaaaaaatatgcacaattctaccaactggaaatatcatgaaatatttcataatttttaaaaatgtatccataatatactgataatgaatttcttgatagcctaacttataccaccgttgtaccattttattatcaatctaccaataaagagtttttattatttgctagaagtattgatattttaattacatcagcaaattaacaactacttaaaaacttatctgcagatcctaaaaatatattaccaccttcaccaccttcacatcctaaaaataatttttttctactttcttcttttaacttgctattttgggataatttcaaacttccagaaaagttgcaataacagaacaaagaactcctgtatacctatacccaggttcaaataatttttttttttttgagacaagatttatcgcccaggctggactgcattggtgtgatcttggctcaatgcaacctccgcctcctagactcaaatcatcctcccacctcaacctcctaattttgtagagatggggttttaccatgttgcccgggctggtcctgaactcatgagctcaagccatctgcccacctcagcctctcaaagtgttgggactacaggcgtgagccactgcagctggcctacaggtttaccgattttcaacattttgtcacatttgttctcttcctctctttgaacatttttttcctaaaccattgcagaaaaggttgcatacaatatgctcctttacttccttaatacttcagtgtgtattttctaagaaaaatattttcatacataatcccagcacagttatattcaggaaatttaacattgtattccaatataataattccaaataacactgcgattctgtcattgccccaataatgttctgtataacatttcccaagggtatgatccagtccaggaccatttttgcatttagccataacattcctttggtctccttagacggaaaacagttgctcagtctttctttggttttcgtgacaataacattcttcagttatcggaccgagtggccctggcggtgggtcctctgatgtgtgctcatgagcagtgcggtgtgtggtctttggcaacaccccacctgtgaagctgtgaacttaccagggctccacagacacccaggaggcccttctgctcttgatgatggcagtaaccacacagtgaaggtgggatccggtgtctccattgtgcagttgctatttttgcttttataatgagtagtttgtggggagatgctttgggatgatgtaaatcctgttactcatcagagagtccctacacttgaaatagcactcacggatgattctggcctgaatcaatctgctaattctgtcctttcttctagatgtacagttggcactctaccgtaaggaacagctttcccctcacctgctctgcctctctctgtctccttatctaccgatctgctataaggacaaacacctatattcttatttcatttgatgggttataatccattactgtccttgtgtattcgaatgctcgaattctcctaatttggccactgggaggctcttgccgctggcttctctgtcctttggacatgctgttatcaaatactgtgagcactccttacattcaggcttaacaaaatgttcctggcttttgtatcttcccttccacagtcctgattcagcctttttctcaaagattcctggttcctcttagtgagaagtgatatttagaaaacaagatctaagcaaaaattattcctctaaaaagtaaccaagatgaaattgatagggcttctatgatggttttattcctggcctatatcttataaccaagtgctcagaaaaacttctacatgacctacagctggaatgaactaaattctaattcttcattagaatcaatgcgaagataacacagaataaattctattaaggatggaggaatttctattcttttaacagccagtatagattaaaaaaaaaaagttttgttccttgagggaaaaattaaataagcaaagaatgaaacaatatgtgtttttccaaaatatcagagatttcttatggtaattttgttcataaaaaggataattataaacttattcatgatgctattattcttttctcttttatagtttcttttatttccaaatgattgtcatatgctaagtcaagataaacctaaaaatgaaaggagctatttccatcataagaaattaactgactaaattacacataaatatgcaatgaatctggtgcttgatatcatacgcaaagagaagccgtgatgtgtcatgtctgcgtaaaggaattcaaaattattcatacaattataggtttcaaagtggcatgaactcatcctattctaattacatctacaaaactttaaacatagttctgaaaggtataagataacccagccctgccacacacacacatcccgccccccaggaaccccggtttcactgggccgccagtgtaactcactcctggcacttcctcctccccaggctcccctctcaagtcctactggttgcccctaatttcctagacctctaatgccagggtccagagctcatgccttcaacagctcatcctcgtgctccccatggagtctcagctactcccaggctccatctgtgcggatgcccaacaaacctacatctccagcccaccctctggcccgaaccccagactccttctcacccaccactgccagcctgatgtcatgtacacccaaacttcacatgcccatgctgactttcccagccagctccgcctgcaccttccccagcatagttcaaagcaactccaagcgtgtggcaggatggcccggtggtctaaggtgctagacacaagcttccacttcccaaggcaactccaaacttccagtaacttgggccaacacgctggggctgcctgtgaccccacctttgtctctctccccaacgttagatctgccagctagtcctgtggattttatcttcacaatgcacacagaatttgatgcttctcaccagctactccgtggcctggacacctgcaagagcttataacctgtctcccagcttgtacccacccctgcctccacatggcagcctgtgacccttctcaagcccagccagccctgcattcctctctgctcacccaaggctcctgcccttccaagggctggtgtccttcccatcctgcttcctctctgacctccccacgcacactcatgccacacctgcctgcttgctgcactgccccccaccctgcccgaggcgctcttccctgcacgccccctccctaacctcagaggtcacctttgcagggatcctgtccctgccccaccccgcccttgctttgctttgctccacagcacttttgcttctgctgtatgatgcatcttctacaggcatctcatgtaatatctgctctccccactagcatatgagcacctggggcaggtgtgttttctcttgtactcactgaagtattccaagcgattagaacagggcttgctatagtggccacacttgtcaaatgaatgaaggaaagaaggaagaaaaagtgattcagctacgagttatttttcttcactagaacataatgataatatttttgttcatcagttcataaaagccaagcatggtggctcacacctgtaatcccaacactttgggagtctgcagccggaggactgcttgagcccaggagtttgagaccagcctgggcaacatagtgagactctgtccctgcgaaaactaaaaccatcagccggacatggtggcacacgcctgtattcccagcgacttggcaggctgagacaggtgatcgcttgaacccaggaggctggggctgcagtgagccaagatcacgctctactgcactgcagtctgggcaacagagtgagactctgtctcaaaaaaaagaaaaaaaaaattcataacagaatttgtaactaaaattggtcattctttgaagttatgaaagtagatagctttctgggaaaagtataaataatgggtatatttagaccacattcattcattcaacaaccgtttactgagtgatgcctgtgccagtgctgcggtgctggaggcctgggccagctagaagaagaaaggcctggtccctgcccctgagctgatggtgcagtgcacacagctagcagtgtcgaagccttcagacaaagaaatgcacaataacccatctaaggacagggcaacaaggtactatatgagagtaaagcgggccgctggagctcgcctcattgtcatcaaggactgccttgcagaggaaaagacagctggcccatgagtggtcagtgctgttcgacgaagtccagagccagggagaccacagtcagaaggaaggaaacaccccaggctctgggaagagcagcaatggcgaggtccagggggccgagagaaggacggagggctggtgcagagagctgagggcagcatggcccaggggaggctggaggggagcaggggcccctgcgcaccagcctcagggccacagtgagtatttgggccttatccctaaaaacggcaagaagtcacagaagggttttacacaagagcaaggctgatctgctctgcactttgaaaagatgctctcagtgcgtaagctcatgttaaacatggatgttcacaaccccacaactggcttgaccagatccagatgggattcctgctcctttttagatagatacatacttgtgtggaaatgctagggcacctctgattttgagctacaaccgcacagagctgttagggatcatcagtctggtatcagaagcaggggtgagggtttacagccccagagattcctggctctgggcctccccaaggctcccctggctctctgagtatctacctgggcatcagcagggaacgtcacatggcatgctggctttgtggagtcacccagccacggctgggatggtcgactggcacagcacacgccccctcccctcatggcctccactgagacacagcttgatgaaggctgaaagtaggggcctccacacacaaaacttagccttccaaaccaacagaagccatcccagcctccgcacccctgaccgacccaccagcatgaagacagcaagctggccaaatctctattacagggaacgtggacactttgtatccttcagctgctcccctttctccttgggaatagtgaaatggtacatgttccttatttcagatttctctacatacagaagaatggacagtaatcacaaaagtattcataaataataagactcttatttcccctgattgaacagctccataaagtgagtcagtctacttcaaacatggtaagaagcacccggagtcggctccacaggtcctggagtgacgatgactaccaaaggccactgctgccccccgctgggacaagtaatcctgatttcatcatcctgcctctccacaacgcatggaatttccagtaaatgctaacattctatttttataaagcacagattcaaattaaagttacttgtctccaaaaagctaacaattccattttagaacgaaagcccaaacatcacaggtaataaatcaccatcaaaattgcgtatcaatctatgatcccaatcagttttttaaaaatgaccagggagtgtgcccttctacctcatttcacttctataagaaaaggctgaataccaaagtttggtcttaattttaggcctaatgagaattataaatgtacaggatactgtcactttcaagaacattttacaagactgggcacagtggctcacacctgtaatcctagcactttgggaggccgaagcaggcaaatcactggaggtcaggaattcaagaccagcctggccaacatggcaaaaccccacctctactaaaaatataaaaattagctgggcgtggtggcaggtgcctgtagtcccagctactcaggaggctgatgcaggagaattgcttgaaccagggaggtagaagttgcagtgagccgagatcatgccactgcactccagcctgggcaacagaacaagaccctggctcaaaaaaaaaagaatattttacaaaagcatttctaaattatattttaaaagtaaagaatatggcattatactgaaggtcttagtagtagaaatacatttctcaagcactgaaatgtcttatacaaaaatttgggtattaattaaaaaacaaaataaaaaaaggtaaattgtctttttaaaaaattaaaaccctatcagctatatcacagcattttagcaaacattcaattctgccaattttattatggctacaatgatagactttgaaacgtgaaaagggatttctttccatggtctgtgcaccagcaatacagcaaaagcttcccaccatgaccatccttccaaaggctaaggagggccattttcagtacaatactgtggcattttcacttttgaaagtacataatcaaagttcaatatgccatcctctagcaaatcagtaaactgaggtaaactgaaactactcaatgctcatccacccagaaaattatcttccttccaaatgggaggaatgatcaattcagagggaacatctcattaactttccggagcgatttcagcgaagtggaagtgagcggctgtgaaaactgcaaactacattagacacgggacctcagaaagcagtttccaaactggaatgtttaaggcttagggaaatcattgagaatttaatctgaagccaaagtttaaaagtatgactgaatcttttatgattaaacttctaagactctgaagtattttattaaatcaatgaactgaaatccagtgttccctaaaatctctgggaggccatcaccctcacacgggtgagtggtggtgttgtggctggaagggccttcaacatcatctaaccccaaacagagagcaggaaagtgcatactcaccatctgaggcacaccgaaaataacaacgttcgagtactgcgaaaaagtaacctgaacaaggtgggaaaataatcagtagattaagtgcaaaaagccaaacgtgaagcttaacttgttttacagaaatgggtagcagttttccattttaccaaacggtgggttttgatgaactcctaagaacagcggccctccttaagatttcacaaggaaaagaataacatgttcatgctctcattcattttaattcaatccactgcagttttccaaacgcttccctgtaagtcatcccatctcatcctcagggtgactccatccagggcacgccccagtggtcatgcgtcagacagctagtgaccacactgtgaccccactgtgaccagctggtggcaccggggccacgtgttcccgcaccagtccactctataccaccagcttcaccagaacacaggagacttcagaaccatctgttttttgttgttgttgaaccatccttaaaatttgagtccccctcctcttctctaaaatactatgtaaaaaagtgcaataaaatggtctttagttgaaaaactggggggaaatgtgctttgccagttaaaattcttattgcccaataagtcttatttactctatagagagatcgtttatgcacatatggcataaaaaaacaatgcaagcaaaactcaagtgaatttttgtaagctactgatgacaatattacaatggaaaattcttatttaagaaaaagcattttatggaacattcctaaagcaaaattacagggcatttttagagtttttagagtacaaataaatttggaagtatcttatactttatgaggataagaaataaccgtgatagcacgattctccagcaaccatctctgtgtctctctaaatatacgaatatgcatacacacactcacacaggcacacaaatggaaaagtctaatatttatcaataataatttataggatttccaaatgagatgaaaaatctcattattttgtaagaaacagaaatgacaacattttaatttagtaaataaattcttggaattcacaagacctatcatataaaaactttaagcttctctctaaaggagactatttgtaaaacgtatcaattttacatatttcattatgccagaatattcacttggattttaattatttttcttttaatacatttttcagttctcagtcatactaattttgaataataaaattttcccttggatttctctagggccattctctgccttacataccttccacaaatctgaaatataaaatttggcagatccatgcacaccttctcgccaagcgcggtatctggaataccaaactagccatgggtttaattcataaccaactgctgtgaaccctttcttcgcagccgctatgacctgtggagagaggcaggatttattcaaaataagaagaaaaaatgaacatacatggtcaaacaatatgaatatttcctatcaatggtttaaacatccaatcaaaaagcacctcccgtgactaagacatcattttaaaatgtgtctctaaagcgatatagctttgtggacaacgtaatagtcaacccatgcaacttagtttccttgattggttaaagacttcacctcaagtatcagaatagacattcaggttcacttggaacacctccataattgattctaggtcagccaacccccggggaggtcgaacaaaacattgctgaaaatccactgcatctctccatcagtgggctagcacagcagcagtgaaatgaaagtgtctgggaggatggttttgtgaacaagtaataatatgcaataaaaataacctgtcaatgaaaaatctgcaattagttacatatttcctttgtagttaatgactgtttactcaaaactgaaaacaggtaaaagtaaaatgaaatgaatcccaataacgtcaactgtggaatcccactggcctccggagagtgggagggatgtggggcagtcctgggttctctctgcctgttctgtcctgccccattctttaagggagcatcccttgactcagctgtcccacctaagatagttcccaagtactacagtgctgcaagaaaacattttctcagaaaccacagatactcttcaaatacgtaaagcattcaaatatgaatttcaaaactttctccttgatttattgatatggtttggctctgtgtccccacccatatctcatcttgaattcccatgtgttgtgggagggacctggcgggaggtaactgaataatgggggcaggtctttcccatgctattctcatgacagtgagtaagtctcacaagatctgatggttttataagggggagtttccctgcgcaagctctctccttgcctgccaccatcaatgtaagacatgacttgctcctccttgtctttcaccttccaccatgattgtgaggcctccccagctgtgtaaaaccgtaagtctaatcacctctttcttttgtaaactgcccagtctcaggtatgtctttatcagcagcatgaaaacagactaatatatttcttttttttttgagatggagtctcgctctgtcacccaggctggagtgcagtggcgtgatcttggctcacttcagcctccgcctcccaggttcaagcgattctcctgcctcagcctcctgagtagctgggattacacgcgtgcaccatcatgcctggctaatttttgtatttttagtagagaaagggtttcaccatgttggttaggctggtcttgaactcctgacctcgtgatctgcccacctcagcctcccaaagtgctgggattacaggcatgagccaccacacctggccactaataaatttcttagaaacaaatagtggctcccagagggtgaggggaggagaggagtagaaagttattatttaatcggggcagagtttcagttttgcaagatgaaaagagttctggagatgggtggtggtgatggtggcacggcaacgtgaatatgcttcacaccccgaaccgtacacctgcacatggttaagatggtaaacactacggtatgtgtatcttaacacaattttataagtaaaaaaaaaaaattaaattaaaaatatcttaactttctaacctcctcgtgattattctagctcagaatcacaaaatcagtctctatgtctgtaggagccggtgaaaggtgatagagtcctgctggccttcacactaaatgcttccatagcaccagcctttcccactgctgctggaacttttcagcttatctctgggatgaggctaaggatggtgccaccctgcccacagaggaacctgctctgagacacccacttgcccatcagtggccttttatttataggtgcccaactgcggtcaagtgagagaagttcataaaaagactgatcttcggcttagtgagggttaatcactggctctttcttaactctgtattaccccaggaattattacttatacatggataaatacagacaaatgcagaagcaaacaactatggggcaaaaatgtaaaggagtgaaatgccatgatttaacatatttcttctcatgccacctctgttggcccatgtattttaagagacaatttgataattaccagttaactgttctttttcacctggcatgtttacagcacacttcctcctttaagaacaaattaaatctgggaaaaatgaattccaaacacactggtagttgaatagtttggtcaaacaaacataaaatgaaatgagcactctttcaagctgtcagatttagttaagtctttgtgtaagccttactaaatgtaaagcagaaattttaagttctggtttcaaaccttaaaatgttttagcagaactcacaatgcgtccgtccccactaccgatgtccacaagggatcctcttcggcatcgcaacattttcacaacattttcaatctgcttcgtagttgcaggtacaaacggcaaacagacttttcgaagggctggcgttacaaacggcgtggctacagcgtacacagccaccagggtgccacccacaagcccagtaagtaagaacccccagttgcttttctgcaaactgttgacttcaaaacttgcaggtagaacatgtcttgactgactttcttctttaagtgtttctaggggtatacctagattgaaagcaagcagaagagacacatgtagcaccaaatctgaaatccaagagagcatttttttctacaattctcattggcaaacaaactcatgctttttaaaggataatttagctgaatacaagctaaatgtcaactgtaggatcccacaattagttctaaatcctattaaggtattttgaagaacattattcaatactatgagaagactaaaatcttttctttccaaagtactgattttttgtgtgtctaggagtcatccttacaaaacaatgtattcaaacttatcgagtaatttattaatttaatatccattagtgcaagttttaatcatgcactacatatttttatgttctgaactaacaaagcctcataaacaaataagcataaagatgtctaattattacccaatttcaagtagaattaaaggattccacatcaaatctggtctggcatctacaatccagtttcaccaatacaattttaaagtaatagaagagacaaaaatcaggttttaccaaatatcttaaataagtatggtaataaagagacttttacagcggatccaaaaagaacaaaaaataaggccgggcgtggtggttcacgcctgtaatcccagcactttgggaggccaaggcgggccgatcacgaggtcaggacatcgagaccatcctggctaacatggtgaaaccccatctctactaaaaatacaaaaaaaaaaaaaattagccgggcgtggtggcgggcgcctgtagtcccagctactcaggaggctgaggcaggagaatggcatgaacccgggaggtggagctgacagtgagccgagatcgcaccactgcactccagccggggtgacagagcgagactctgtctcaaaaaaaaaaaaaagaataaaaaataagatcatcattttagtactatcataaacataaaataacgcagaccccaatcactgattacaaagaaatgaatggtaccttaaatatccttttgagatttgtcctttaaaatgcatttaaatgggatctcaagattttgaaattaatattgacaaaattgattttaaaattgattaacaaggagcacagtacaggaggtaaaagcaggactcctccagagccagccaaagttaggatcccagctctgccacctcactaatgatgggaccctgaatccctggtccttgctgagcctgttttctcatctgcaaagtgggggtcacagggatattgtgaggatgaaatgagtgtatggaggtaaagcacttagaacagggtcgaatgcagttataggtttcctataactgctgtaagaaattgtcacaaaattagtggcttaaaataacaccatttatggccaggcgcagtggctcacacctgtaatcccagcactttgggaggccacggcgggcagatcaccagaggttgagagtttgagaccagcctgaccaacatggagaaaccccatctctactaaaaacacaaaattagccgggcgtggtggtgcatgcttgtagtccccagctactagggaggctgaggcaggagaatcgcttgaacccgggaggcagagcttgcagtgagccgagatcacaccattgcattccagcctgggcaacaagagtgaaactccatgtcaaaaaaaaaaaaaaagaaaagaaaatcaccatttattatcatacagttctggaggtcagtctgaaatgaattggcaggcctgcgttccttctgggggccctcgggcaggttttcttgtctcttcctgcttccagaggctgcccacattcctaggctcttgaccccacatcactccaatctctgcttctgtcctgacatcaccttctctcacatgcctggctccctcttaatttataggaaccctcatgataacactgggcccacataaataatccaaaataatctcccatctcaagaccactgattacatctgtacaggtgcaggaattagaatgtggacattcctggagaggacatttttcttcccaccacacccatgaactacggcaatctattctagtgcagtacaaatttgaacccaagacacacagaaagctggcacacagcagtgggtcaccctcagggcagccagccaatcgccagcatcccccactcagcgcagctttgttcttgattcctgaagccccttaaaatgagttgtaaaactgatttcacagtggaaaacgaactgggtcggcggagggggcggtgggaggaagaatgctactaatgctagtgctagtattaatgctagtgatgggggtaaagaaaattaactttaagaaggtgatggcatttgatagaaagcaaaagctttaaataatttcagttataattttggcattttacggaggaacttacaggcataccttggaaatatttagttccagaccactgcaataaagtgagtattgcaataaagcaagttacacaaatatttttggtttcccactgtatataaaagttatgtttacactatactggagtctattaagtgtgcaattgcactgttcaaaaaacaatgtatgtaccttaattttaaaatcctttattgcttgacattttggtctgatttatcttcgaaaaattttttttaatttttaaaaaagagtttattgctaagaaatgctaatgatcatctgagccttcagtgagtcataatcttttcactggtgtaggatctggccttgacgttaatggttgctcaatgatgagggtggtggttgccgaaggttggggtcgttgcggcaatttttgaaaataagacaacaatgaagtttgctgtattgatagactcttcccttcatgaaagattgctctgcggcatgtgatgctgtttgatagcattttacccacagtggaacttcttccaaatttggagtcaattttctcaaactctgccactactttatcaactaagtttataaaatattctaagttctttgtcatcatttcaacaatgtttacagcatcctcaccagtagtagattccatctcaagaaacaacctcccttgctcatccataaaaagcaactcctcatccactgatattttatcatggggttgcagcaactcagtctcatcttcaggctccacttctaactctcttgctatttccaccacatctgcagttacttcctccacttaggtctcaaagtcatccatgaggattgaaatcaacttcttccaaactcctattaatgttgatactctgacctcctaccatgaatcatgaatgttattaatggcatctagaatggtgaatcctttcctgaaggttttgaattgactttgcccagatccatcagtgtaatcactatctattgcatctctagccttacgaaatgtatttcttaaataacaagacttaaaagtcaaaattacccccttgatccttgggctacaaaatgaatgctgtgttgacaggcatgaaaacaacattcatgtccttgtacaccgccaccagagcaattgagtagtaactaggtgcattatcaatgagcagtaatattttgaaaggaatcctttttctgatcagtaggtttcaacagtgggcttaaaatattcaaaaatcatgctgtaaagaaaggtgctgtcatccaggctgtgttgttccatttatacagcaaggcagagtagatttagcatcattcctaaggactctgtgattttcagaatggccagtaagcattggcttcaacttaaagtcaccagctgcactgacccctaacaagagagtcagcttattctttgaagctttgaaaccaggcattgatttctctctagcttccaatagaaggttgtttcatccatattgaaaatctgctggccaggcacagtggctcgcgcctgtaatctcaacactttgggaggctgaggtgggcggatcacaaggtcaggagttcaagaccagtctgaccaacatggtgaagcccagtctctactaaaaatacaaaaattagccaggcgtggtggcacgcccctgtaatcccagctactcgggaggctgaggcaggagaatcatttgaacccgggaggcagaggttgcagtgatcaggccactgcactctagcctggatgacagagcgagactccgtctcaaaagaaaaaaaaaaaagaaaatctgtttagtgcagcaaccctcatcaacaatcttagctagatcttctagataacttgctgcggcttctccatcagcacttgctgcttcaccttgcattttcatgctctggaaatggcttatctttccttaaacctaatgaacctaccactgctagcttcaaacttttcttctgcactctcctcacttctctcagccttcagagaactgaaaagagttagggccttgctctagattaggctttggcttaaagatatgatgtggctggtttgattttctatccagaccactcaaacttgctccataccagcaataaagctttttcactttcttatcatttgtgtgttcactggagtagcacttttaatctccttcaacaactttctctttgcattcacaacctggctaactgtttgatgccagaggcttaattttcagtctatttcagttttccacatgccttcttcactaagcttaataatttctagcttttcatttaaaatggtagaagtgtgactcattcacttgaacacctggagcccattgtagggttattaatcagcctaatttcaatgttgttgtgtctcaggaaataggagggcccaaggagatggagagagatagaggaatggccagtgcagcagtaggaaaacacacatttatcgattaagttcactcttatttgggcatggcttgtggagccccaaaacatttacaatagaaacatcaaaaatccctgatcatagatcaccataacagacataaaaatagtggaaaatttgaaatattgcaagaattaccaaaatgtgacacagagataaaaagtgagcatgatgctgttgaaaaaatggtgcgaacagacttgctccacgtagggctgccataaaccttctgtttgtaagaagcacactactgaatggggcatgttggttcatacctgtaatctcagctactcaggaggctgaggccagaagatcgcttgagcccgggaatttgagaccagcctgcgcaataatagcaaaatcctatctctaacaacaacaacaaaaaagtgcactatctgcaaagtgcaataaaacaaagtatgcctctgtttgctcaagtggtagtcatgcatttatttaagaaaagtcggccaggcacagtggttcatgcctataatcccagcactttggaaggccgaggcaggaggattgcttgaagccaggagttcaagagcagcctgggcaacatagcaagaccccatctctacaaaaaataaattagccatgtgtggtggcatgcacttgtagtcccagctttttgggaggctgaagcaggaggatcgcttaggcccaggaggctgaggctgcagtgagccgtgatcgcaccattacattccagcctggacaactgagcaataccctggttgtcaaaaaaaaaaaaaaagaaaagtcaaggcacatttgtacatgtgtcatgccctctgtaaaaaattatcttgtggacattccagttgtacagtacagcagttaagaggatttgggttacacagttctggagtctcagaacttaattagttgtttaacacaaggtaagttgttactaaggcatggttttctcctcagtaaaatttggaaataatttgtttaaacacaattcaagctgggcatggtggctcacgcctgtaattccagcactttgggaggctaaggcgggcagatcatgaggtcaggagattgagactatcctggctaacacagtgaaaccctgtctctactaaaaatcaaaaaaattagccgggcatggtggtgggcgcctgtagtcccagctacttgaaaggctgaagcaggagaatggcgtgaacctggaaggcggagtttgcagtgatccgagaccgcgccactgcactccagcctgggtgacaaagtgagactccgtctcaaaaaataataataaaataaaataaataaacacaattcaaaattggccagccacagtggctcatgcatgtaatcccagcactttgggaggctgaggcgggtggatcacctgagctcaggagtttaagaccagcctgggcaacatgtcaatacctcatctctaccaaaaatgcaaaaaattagccaggcctggtggtgtgcatctgtggtccctgctacttgggaggctgaggtgggaggattgcttaagcctggcaagtggaggttgcagtgagccgagatcacaccactgtactccaacctgggtgacagagtgagacctcattacaaaaaaaaaaaaaaagattttgcaataatactatcctcataggattcttggaacaggtaaataatgtaaacaaagcatttagcacaagcctgagaggctaagtaatgactattaattgctattattattctcaatactatcatatgcaaggaggggctcaatttttaacagctttgagatataattcatatacatacaatttgcctgcttaaagtatataatttaatgtttctttttatattcagatacatgcaaccatcactacagtcaatttttgaacatttttattacctcaagaggaaaccccttatcctttagctatcacccccgcatccaccctctatcccccagccctaagcaaccactaatctactttttgtctcaagaatcccctattctggggcctggcacagtggctcacgcctgcaatcccagcactttgggaggccgaggtgggcggatcacttgaggtcaggagttccagaccagcctggccaatattgtgaaacaacaactctactaaaataccaaaaaaaaattagccaggcatggtggtgcacacctgtaatcccagctacttgggaggctgggggcaagagaatcacctgaaccggggaggcagaggttacagtgagccaaggagccaaaattgcaccactgcactccagcctgggagacagaacaagaccctgtctctcaaaaaaaagaaagaaaaaaaaaaaaaaagaatcccctattctggacttaaaggaatggaattgtatagtgtgtggacttctgtaactgacattttttacttagcatgtcttcaagattcatccaggttgcaacttgtatcagttctttatttctttttatggcttaataatattccattgtatgcatatgccatatttttgcttacgcatttgttcaccaagtttattaaacaaacacaagtcagatgacccaaatttcatttttcacctgtgtagatatgtacctttcaattcaaccagcaaaagatgtaataaaaagttcctgttcttcacggcctcccatctaggcagatgaggggtggggtccaggagaggcagacacagggctggttgtgagaaatgctataacacaaacaaaacgctacaggcatatgggagaggcggaggaaagactgattccaacaatgggaccagtgaggtgttggcagagagaatatttgagctggagccaaaagcagcaagccttggaaccaaggtgtggaaggcagggaaagcctttctggagcacagagtgagagacaaacaggaaggcaggcctctgaaggccaggctgaatgtgtattttattctatgtgcactgtgatgaaactttttgagcaaagtcaccataatatttgtgtttttaagaaaggcaacacaggggcaatgagtctcttgatgaaatcattctattttctgtcccaggttttgatgcctgcaagtcttgcaacgtaacaaacatttgcatggggaaatcaagatccatacccattgctggagctttggaagaagttactatgtacatccaatataggatgtacaatataggaactacattgttagctccattcaggaaaaacaattgattcctttttgcgatggggtctcactctgtcgtccaggctggagtgcagtagcacaatcacagctcaccacagccttgacctctcaggctcaaacgatcctcccacttcagcctcccaggtagctgggactacaggcacatgccaccacacccagctaattttttaaatttttttctttagagacagggtctccctatgttgcccaggctggtctcaaactcctgggctcaagcaattctctcgcctcagcctcctaaagtgcctccatgccaggacctgtattgattcttatcagtaaaaatcaggccctgaatattcaaaactaaaatcaagactgtttctacaaatccttctaacggaacatgttcagactcccagactatcctatatataaatggcaagaactttctttcaggtgttctttggaacaaggagccattctattaaataatggctgcagtggccactggctactttcattgagcacttagtagtccatcctttaaagtcaaacacagaatgaggttaacttctactgtgtccgggccctgcttgcttattgacttctaatattggttgaaaacttcaatttttagtggcagatttggatcagctgaagctagaggcagtgacagatgtacaataaggtacccaaggttcttatccaagttcaagccaaaagaaaaaggccaagaagagagaaggagcctgttaggaatagtaactagccacgtgtttaaagcgggcttatatcagaatgtcacaactcataaggactgttcattgtgcacttgtatgtgcatacctgtttaataactacagcatatgttatgtccctttagcatatattcttatgtccttaagaagcctttcttatactagtctaatgtcatttgtgtccttttgacatacatgagctattgatattaggaaaaatcctctctcactccccagtgttttgacagggaatcaactacacagaggatgccataggacattctatttttcacaacaatcgaaggagccaaatgaattgcagaagtcaccatttttaatgaggaaacactgaattggcaaagctaacgtgaaataagacctgactccaaaatctaaaatgtccttgaagaacacttcaaggtctagcgcgtaagtatgccaagcatgaagagttaacagatcaccaaccatcccatgacagtcagtcctccctgtttttagagacagaatctcgctctgtcgcccaggatggagtgcagtggcgcgattatagcgcactgtaaactgaactcctgggctccacccatcctcctgcctcagccccagagtagatgggaacacagtcgccaagtctgttcttgagtttcaggacagggtcaaatgttatagtgcatgtattcatttcagcacttattgagtgcctaataaagtctgggaataatacaactttattagttaagtccctgcccatggcagtaggggagaagcaaggatggaaaccctcaacaaataaatctaaacctatcaaatattaagtcatgatcttggagggcggggaggaaggcagcataagagatttagaggacagctgcggttgccaagatctttctgaggcagcataatacagggcttaagagtgagacctgccgggcaccgcggtggctcaggcccaacacttggggagacctagacgggtacatcacttgaggtcagccgttcgagaccagcctggccactacggcgttaacaccgtctctactaaaaatacaaaaattagcgagcgtggtggttctgtgcctgtagtcccagctgcctgggaggctgaggcacgagaatcactggaacccgggaggcggaggctgcagtgagccgagaccgcgccactgcactccagcccgggctacagtcttgtctcaaaaaaaaaaaaaaaaaaaaagagtgtgggacccattgcatcaggctgtgtaactgtttcttactagctgtataccagtggcaagttactgaaccatttgtgcaaaatgttaatttatttaccaacactgtgttcagcttgccaggcaccgttctccttgaatctcacagcagccctgtgagtaggcactactgttaccaccgtcactttgcagacagggaacccgagggacaaagaagttaagggatttcctcaaagccacagctaggaagagcggcagaactgcgattccaatccatcagtgtgcctccactatccctattccttaagatcgtgccaaaggctgagtcacttgcactaagtagcctagaacagtctctggggaaacgcgcccgccgacaaggatcgccagaaccggcgcgggcaccgcgcggcgaccaggagctctggtcaccgaaggccaggctggaggccagagcagccgcccgcacccggtcaccgcctcgacagtggagacctcagctgaccgcgagcccccggcccgcccgcaccccttctcatgcccccaggaacccgccaagccgctccagcctcacctcctcctccctccatcgcgagatttccaacagcgtttttaaaaaaaaaaaa

SEQ ID NO: 799 - DNA, 16221 bp, Homo sapiens
cgattccagaagatactgtctggcgtgaaattagtctcagtagaaacataagtcccgcgcgtcttgtgctgcgcgtgcgcaagcttttgggccctcccgagaaagggaagtgcattctcgcttccgtagcggtctccgccggttggggggaagtaattccggttgttgcaccatggcgtccatggggaccctcgccttcgatgaatatgggcgccctttcctcatcatcaaggatcaggaccgcaagtcccgtcttatgggacttgaggccctcaaggtaatggcacagggacctgctcgcggtgggctaaggggaggtggccgaggccgtggctctgcgcctgcgcgagttgaggagcggctctgccatgtgctccccggaaaggtcgagaatctccgtctccctgcggtctccggccgctcagcccgcttactgagctcgggagacgccggcgcctaatcctgggctcggaatgtgggggccagccaggctgggccgccagcgcccttcggagctgggtggggccgctcagtccggtcgcccgcgggagcaaagcgggaccgcctccccgcccggctcctccagcctgacggccgcgtgggactgcgctccagtgggagggcgccggggagatgctctgtcacctgtcggttaaggcgctgctgcttaacctttcgctggtccacccgcaacggcccttccgttttctttgtcactcgtaaaggtgtggtcacttaacagggtatttcatttctgagtgcttttttgcccacccttgaggaaaaatagcgaagagtgaaaaacggacgcacataaccgtaatacaaggtggtgtgcagtgagaaggacagctacggagagggtgcacataagcgtggtgctggaggacagctttagatcggggtgagaggtagcattctagggagaggaaacggtagaagtaaaggcttgggcaagaatgcgcatggcacgttgtagaatggaagagccatccggttttaatggagcactgacttctttaacttacaatagttcccgaaggtggaagctattgaatgcccaacatggaaaatacgacgttatctttggggaagaaggggagccattgagggggttttgagcagaatttcagtagagctgcacttcaggcagcaaagcttgagatagaccgaagggaataaggaagaccagaggggttaaagaaaccagggcaggggtgcaggtaagaaacatctgagcaccagacgttgacagaaaatgcagaggaagggacactccgagagggccttcagggtttgttataaagtgaattcataatagaccattccactaggtctctcaggtgtccctgttcacttagtgtcttggaggtttacttacgcaaagttagaaacaatacagttcccctatggactctttgtttgacttagtgctagttacacaacctcgcggaacctccttttccagggggaggtgataggcctccgtcaagctgaagacttgacagtgatattaaatggagtgacttagaggggctgcacagtggttgatccacggtaggcactcagtatttgtttcctttctagaaagaaaaagtttcaagctaattgtattatgtattccattttattttccacttaacagggacctgcagagaaaataacatccaatacacacacctggtgtaacaacataactaaaactaggttgttttgcatcagccattttgttcaaactgcatgcatttgtgcccagaagtcgcacactctgagacagggttattttacaaaactggggacttgggcccagagcagttgagaaattgttctgaagagcagttgctactaaagagcattaccatggtcagggccaccgctgtcagagtcaaagccagtggtctagagcagcattctcaagtttggcatattgacattcgaggtcggatcattctttgctgtgggagctcatttggacagtaacctgggtgtttaagtctcttaaaagagttggatgctgttggtaggcatcctgtgagtgttgaggctcagcagtttagggatatacacttgctccctgacctcatagaacgtccagctaacttgaagaaccaaaatatatggaaattgaaggcaacggtaaaagaaatgtataggccaggacgtgaacgttttaatggtaatggtcacagttctttctctctggtcatttagagccttaaaggtaatatgtattttgttgagattcttcacttgtttaacacttaactgtataatatttcaccttaaaaatgcaggcattgactgggcgcggtggctcacgcctgtaatcccagaactttgggaggctgaggcaggagaatcgctggaacctgggaggcagaggttgcggtgagccgagatcacgccactgcactccagcctgggtgacagagtgagactccgtctcaaaaaaaaaaaaaaaaaggtgcaggcattagttggcttaggaaggaatcatattctaaaatcctgtaacctaaaacagagcaggctaagtttccaggccagccagcataattctgttttatccataatatgtattatgccttgatgtttgatactcttccctctggaaacacacagaactagcagaaggaagaaaaaggttttttccacgttgccgagcagtagggcaaaatagatctcgggatttcgggatctctcctatttgccaaattctttacatccttttctttctgcctcttgctttctccttaaaaataataataataataattctattactcaatttggtagctaaatgtgaaaaaaaaaacaggtaacttttttattatcactttgacagctacttaccttccttaagagggccagtttcagccgggcgtggttgctcaaacctgtaatcctggcactttgggcagccaaggcaggtggatcacctgaggtcaggagttaaagaccagcctggccaacatggcaaaaccctatctctactgaaaatacaaaaaaaaatgagcagggcgtcatggcgcgtgcctgtaatcccagctactggggggctgaggcaggaggatcgcttaaacccgggaggcggaggttgcagtgagctgagatcatgccactgcactccagcctttttgagacacagcaagactgtctcaaaaaaaaaaaggccagtcagtaactttgatctataaatataattattgggatttcaggtgggtggaggaagatttttaaagcaagagcagtttttctttttattttgtaatggggtctcgccatgtttcccaggctgatctcaaactcctggcctcaagcaatcctcctgcctcagcctcccaagtagggggggttgcaggctctagtactgcatccagctcaaaagattacaattctgcagtaaatcatagtgtgacagtaaggtgttgtatgtttacagttggactgtttctcatgagtacaggcccctccttgtctgcagatggggaacccgcagatgtacaagcctagatgcaagggacttgagcatctgtgaatttgggtatcctcgggggctcctggaacctgttccccatggatgctcagggagaactgtggctcctggaaccaattccccatggatgctcagggaggactgtgttgcacagtggtcttgcaacgcctgtaaggtcatagtcatactgtccctcttctcagctgtaaatgggctggtaaaagaatctgtctcattaatgtgttgaaaattcagtgagataacacaaagcacttggttctctttctttacgtaagaattgcttattaaaactggagtcgtaaatgttataatacttaaacctgtctgttgccccttaaatgtagaagcttctagacaatagaaactaagtcataagtgatttttgtagtcatcagatgtgtgcttttaaccattgaaattatatgtaacagtgtttgctttttctgtttgtttcattagtctcatataatggcagcaaaggctgtagcaaatacaatgagaacatcacttggaccaaatggtaagagtccaccattccgtgttttttagcaaaagatttaaattataaaactgtcaatataaacctctctacagaaaggtggagtattgaggggaggcatcttacttccttaacacagccaaaattttttagtgtatttcaggtttcttaaacatggttataatcgtgtgcaatattaggtcggacctttttttttttttttttagcatgtaacatcatttcattagcattttccaaatcatagttgtcttttgagattaacattatacttaatgatgctccataatgttttgccaattatgttagccaatctaaaaatgccttcatgcagctactattttgtgtatgttgcattatttgtatataataaattgcacagataagagctgggtcaggaggtcttgttttatagtttgtgatattggttgccagttttttgcgcaaagcctactaaacgttgttttttagggcttgataagatgatggtggataaggatggagatgtgactgtaactaatgatggggccaccatcttaagcatgatggatgttgatcatcagattgccaagctgatggtggaactgtccaagtctcaggatgatgaaattggagatggaaccacaggagtggttggtaagaaaagacaaaacatcctttctcatttaagagacgtcatttaagaccacagggctaacatgcctgctgagattgttgtctctgaatcagagcatgaggagacagacaaatccaagttgaaaacatgctacaaaacaaatgtcggactttcaaaactgacagtgttacaaaagaacagaaagagggctggggattgttaggcatggagaaatgtgtaatgattgattggacactgattttgcttgtcttttaagctataaaggatgtttgggaaacgtggaagaatttgattttggatcatgtactgcaatgctgagtttcctgagtgatctgtgaccattatattgcagatgtgtaggagaatgcccttcttctcagctgtatacctaaatacttaggagtgacatgtcatggtttctgtaactaattctcaaatagttgaacagaaacagtatgtacatgtagagaaaatgtggcaaaatgttaataagtaaactggtattcgttttagtattgtaccttttttttctgaagatttgaaatctttaaaaagttggggagattgaagacaaaatatcagtaaggttaccttttctgcagatgaaatttgaattcattcaacaaatatttattggatactattgtatgccaagcactgttctcggtgcgcttggagagctgtagatttaaacaaaattcatctttgcgaccctaaaatgaggagaaaggaggatgggggtggggggaataaataataaacacgttttagtctcatcaccaggctgaatttcactgagtagaccctggcccaggaaacataatagctttttacctcttagaaaaatgttctttttacattatattctttagttacgttcttcacatcactgagggttgaatgttcatctgtaaggggacacatgtcctattcgaccttcgctagaactaaaacgaggctttcttttaaaaatagagggcttctgcctctaagatgacttgcagcttaattctagaagctgcttctttccatgatagcatctaacttgtgctgattatactaaaagtgaagttttgttgtttgcctgaactgattgtctgctggcttatttgcagtcctggctggtgccttgttagaagaagcggagcaattgctagaccgaggcattcacccaatcagaatagccgatggctatgagcaggctgctcgtgttgctattgaacacctggacaagatcagcgatagcgtccttgttgacataaaggacaccgaacccctgattcagacagcaaaaaccacgctgggctccaaagtgtacgtttcagtagatgatatgattacccatttgtagaggaggcagtttgtttgccatttcttaaaggcaacacaaaatgaccactggtggatttgtatcgatttgattatttgttttgattacttggttttgctttgtttttaatgtagatgtagacagatgcattttgtatttaagttgagaactgaatttctaagttcaggtataaatccccttgacaatatttgcaaaatatagttattttaatttagcagaataggttgtgttaaaaatcagctaaggctggatgcagtggctcatacttgtaatctcagcactttaggaggccaaagcagtagcttgcttgagctcaggaattgaagaccagccagggcaatgtagtgggaccccatcgctacaaaacaaaaaactagccaggcatggtagcacacacttcagcaactccagaggctgaggtgagaggtcgaggctgcagcaagccatgatcatgccactgcactccagcttgagcaacagagcgagaccctgtctcaaaaaaaaaaaaaagtcaactagaaagggtcctacctggaggatatgtgaattttcttaacacttctttctataatttctttgctggggagccattgggggtgggttccactttttattcagcaaattgccgatccaaaattataatttagtaaagagagtcttgaaagcgacttgtctctggtgttttcagcgttcgtgtaatgtccgtttgccaggcttactgccaggtcttatgggcactaagacacagctcttctcccaggagactctaagcaacctcagccaaggggtgcgctgattatgtacaatgccaaagacttaaggtctgttgccgtaatataacataaaaatccagtgtaagctgctttattacattatattaaatcagtgagagatgttttcaattgtgtgcttgtggtggttttagcaaaaaggaatgagggatcttctaaactcagagtagtcagggaaaatgcaggaaaagtgtctgcttctgttgccttttcccctgagcaaagcctatgttagagcagaagccttcagcaatgcctgctgtcctcctctaaccacagatctcagcagagactagctccctaggcaagagtgagtaccctaggggtagcctcttgtcacaagtataacacttattttctcatgaaaggaggacatcatcattacttgaagtgtacaaatcagttttcttgttgctttataagttggccttgttctgtttgcaagtattaagtcatctacttaagatacaacatgtttactttcatggttctcttttatagataacctgtgatttcagacattatttcaagtgctaggtttccctagttgtttttcttggctcaaaaattaatttattgaactgtctattcacatgtttcaaagctttcaaaaaggtaacaccctccatctataatggatgttgtggtgaattcttggaaagtttaaatgccctgtccagtcctttcagttcctggttagtgctacacttcattgagataagagtgactcttcctgagtgattacttacctttcccattctgttctgaacttgtaaaatagtaacagtattctgtaaaagtgctgcattctaagaagaccttaattcatgccagactacagtggtttcttgagtacattcataatggaaggaaatagtaaatttcagagttagcgaaaataaagatgtaattttttcctatctaagtatacagtcccctttagggcccatggatcacaggttaagaatctgccccagactgttgaaaatgcaggttgagatggcattcccctctagaagactcaaaacatcgtttgatttatatctttgagtaacattgtgttatgtggcctgctttggttgcagtaattgtgaaaccaatgaagtttgttttgtggtgttttcctcagggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaagtgagccattgcatctcacagcttcgcactgttggttaactcttaattccaccaattaaaatgtctttatgttcccccatagaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaagtaagtcttaccagagtcctcagtggaatttaaactcccaaagggtacagttagttaggtttggttagtaaatatgtgtagtctttcttcagttctaaaacatacacaggaaaaaaccaaattgcatagaaaggcataaacagggaagaattctaattttgtcttaaaatggtagcgtgttcaggccaggtgcagtggccatgcctataatcccagcactttgggaggctaaggcaggcagatcgtgagatcatcgagaccatctgactaacacggtgaaacgccatttctactaaaaacacaaaaaattagccaggcatggtggcaggcacctatagtcctagctactcaggaggctgagacaggagaatcgcttgaacccaggaggcagaggttgcagtgagctgagcttgcaccactacactccagcctgggcgacagagcaagactctgtctcaaaaaaaatggtagtgtgttcagggtcctgaaagaagtgaccctgttacctaaagccgtgctttcaattgtacatattatatttgccgtcctggacaaatttaacttagcttaccttgcctttaagatttctgactataccttttaggcaagagttaatgagtaactggagttaaaccagaatgcactcatagtaatcccagttctttgctcagttaagtctagtttgggttcatgaataccttagcgtaggtgtgctttctctctgacatagcaactcctctttgggggctgcgtccttgggagttgaaaacaccagtactcaagaagacaggaacgtgggttggttagggtattatttatcatagcaaaccaactagagactattttcatgtctgttcttgggaaagttgttgaatgtactcattgatgatacggttcttggtgcctacgacataccaggctctgttgtaggcactaaaggtacagcagggaatgaagccaagctcgtgctcttgagacacagataagagaaaggtgggtacagctccattacagacactggtcagagaggtgacctgtaaggagaggccaacatagggtgagagcagtgcccctgggggaggagcattccaggctgaggacagatggggatgctcctgagccaggaacattgttggcttgtacaaggaagagccagcctcagggattgaagcatgctggcgggagcttataaataaaaggccatcatctgggccggtgggacagttttcatgagaatggtgcctcagctgtgctggggggccacagataaattgagaggccagggatgttactggatcgtgctggtgaggcgcaggttgctgagaatgagaagggaatgacgatggggctagatagtaaaatgttaaagaatgagaggcagggacccaaagaggaacactgcaggtgactgaggagcaagaaggaccctctcctgttctgagcatgtgagagggaaagcagctgccatctgaggagggttgcaggggcaggttggttttccggggttgtgacggagagattgtataaggaggctgctgttctggactgagttccagagggtcagggaaggaagagagggagagccaggcagtagcaggtagcctgggaggcctgatggagacaggtaagccagagttgtggggcacggtgtggcagtcccaggtgagcaccagaggtggggtgggcagcctgatcgttgccctcctaattgggaaaagtgactttgccatttgcaggtcggggtgagggtgcttcttactggaagcagggttgcctctgtgagtgcccgaattagtttatggatccactgaggattgtccactcaggtgagacagtcaagttgcaagtggttcataacattgtttgtttaaaacatactcaggtgaaactactctgtaggtgtttgtgacaggacagagctgttagccatttccccatggttggggaagggtgttagctttgttgacgtttctgtgggttttgcctcactgtaacaatagggttcagcagaattactgcttgtggtttttaaagcataaacaatgaggtgatccccattgataaaatattcactatttagaatttggaactgacagaaaagtggacacttgtctatttccttccttctctttcctttgcttttgtgtttgagtgcacctgccttacacccaactgtgcctctccttttttcaaacattgtaatgaagaataaatacccactttctcttaatacgattgtggtggttcttttcccagattaaagagactggtgctaacctagcaatttgtcagtggggctttgatgatgaagcaaatcacttacttcttcagaacaacttgcctgcggttcgctgggtaggaggacctgaaattgaggtaggatgttccacgtgaagagactttgagaagtaggggttcatcttatgtgttgaggggtgttttgatagccctgccttaaataactgcatcacaccaaggctggcagatgaggggagggtgagctgggagagaggaaagcgctggaatctttgttactgtttggataacagtgctgtgtgtttctggtgttccctggcattttgaaattctctccctgtgttgtctcacttggccctgtcgttgacttactaaggctggaagacctggtctcatccaaatactaatggcagtcccaggcaacggtgcctcggtggttctcactgcagcgcagtgcaaggaacatgcaggctgggttcccagagtgagggagggctgcacagatgggagatgagggtatgagcttaggggacgggcgccgggtgatagatctgggcagcaccaaagccccaatcaagacgtccagctcaagagccttgttacctagcaaggtgctttgggttgaactggagatgtctcggtcaaagtggggcagcagttctagtgaacaagttggtcttagatcaagttttgctcatttgtggcccagttttgaaagttaacttcaccagtactgtcttcatccttctccctgaccaccccaattagctgattgccatcgcaacaggagggcggatcgtccccaggttctcagagctcacagccgagaagctgggctttgctggtcttgtacaggagatctcatttgggacaactaaggataaaatgctggtcatcgagcagtgtaagaactccagagctgtaaccatttttattagaggaggaaataagatggtgagaattcaactatttgtcctatactgttgcttattttgcttcatggtctggcttttttgcctgtgtgtatttaacagagacacagtcaccataagaaaaataatcgtggttctcaaacaatgacgtatcatggtgtaaaattactgaagaccatgttaaattgttaatttcacaaggcacatttgcctttctgctgtcccttagagtatacaatatacactatgagatttttatatctttttaaatacttaaacacagtttaaatattcaagtcctggattttagaatgtttgatacagttacattaggggttggttaaactgctagccctagcaacataagactcattttaattacaatatggtattattaccaaggatgacttacatctgtcccttaggtagaaaaagggaacccaagtgaataaccattgacgatctctgttctttgagaatgagtttttagcacattgtgataaatctttgcgagttttgtcagtttttgactcttgcttgaccgtgtatcctagaatgagtcactggccgcctctgcctcttgaattttgttaactacattgcaggaaggaaagctagaaagataaatattatccgatagtggaggccatctaaatattagagcacagcctctctgtctttaaaaaggtgccagatacttggctctaaattgactagatcttgatcacattaattcaggcaaagctgttttccttagatcattgaggaggcgaaacgatcccttcacgatgctttgtgtgtcatccggaacctcatccgcgataatcgtgtggtgtatggaggaggggctgctgagatatcctgtgccctggcagttagccaagaggcggataaggtaagggatctgtgcagacttagtgaaagattcaggcctcgctgatggtggagactgtgaagctgcggaacagcgaggtgctggatgcaaaacaagcatcgtgagctgtgtgtaggtgacaggtgttttaatctaagttaattcccacgttcctgtattcagattctggttaccataacctagcatttctcagctgttttcagccagttcgtccttgaaataataaatctatagtcttttaatgttatttgaaattcaaaattaatattataacttaaaaataaagccataagagctgctgtattttgagacatctctcacatgtatgtataccctctgcctgtattctgtggtgacattataatattctgatagatacaaaaataaagacagcctgttcttacaattctttgtgagctgacttttcaaagtatgtgatacagttgtgttttcacggtgccgctgggttgttttgtttcgccaagtgcactcaccatacttctgtacctttccagtgccccaccttagaacagtatgccatgagagcgtttgccgacgcactggaggtcatccccatggccctctctgaaaacagtggcatgaatcccatccagactatgaccgaagtccgagccagacaggtgaaggagatgaaccctgctcttggcatcgactgtttgcacaaggggacaaatggtgaggagctgtcacgcctctgcgtggagggggggggatgtctgatttaaactgaataatcatccactgtatgtgctgtgagatgatggtgtctttttaaatatgtaagcccacttcaggtgttcaagtcctgaattttagaatgtttgattgccgtaggaattggttagactactagacctagcaacatgagactcattgtaataacagtaaagtgcatatggtactatcaccaaagatgacttaggttttaatctctggtttttgggaagtaatgccttattgctgtttttacacagatgtctgtcagtgggcagcatatatataacagctctgaagtgggctttagttcacagttcactgtgtggttaatcctgcacactgtggagtgttttctaaatgtaatatataacctctgtagccacttgtgtagctcggctcccaaaaagatatggtggctgtagcttgttgaaacagtggtctcaggcatttctgtactaaatcaggccatgtctgtaatccatccacagaatgacagcttttgcttaaaggtataggtacattctgctttccatgctcaaattccaagggtttcaatagtagcaactctttgtgaggcaaacatttaatgtttctaacttgaatgcctggttgtgctcaaatttagcatttctagggccgggcgcagtgactcatgtctgtaatcccagcactttaggaggccaagccgggtggatcacctgaggtcaggagtttgacaccagcctgaccaacatggtgaaacaccatctctacaaaaaatacaaaattagccaggcctggtcagggcaggcacctgtaatcccagctactcgggaggctgaggcaggagaatcgcttgaacccgggacgcagaggttccagtgagctgagatcgcactgttgtattccagcctgggtgacacctgtctccaaaaaaaaaattagcatttctagatctttcttggaaatatcttacatttcagctgtggtcagatggacttactttagatttcctaagttagggtatggatactttgtgggataagatgttcctgaaaaatgtcaccctgtagctagtcattgaagacagtgccctcccaacagctctctttaccaggtgcgagttccagagtgtccttggaagtaatgaaattacattcatctgaaaatgaaatataactgaaattagtggcttcctgcttggcttccaggagtttgtatttcttaagtcttactgtgattccctaaatcagaaagagttggttattgatagtttattgtatgctattttaggataatcagtgtccttgtatttttcagatatgaagcaacagcatgtcatagaaaccttgattggcaaaaagcaacagatatctcttgcaacacaaatggttagaatgattttgaagattgatgacattcgtaagcctggagaatctgaagaatgaagacattgagaaaactatgtagcaagatccacttctgtgattaagtaaatggatgtctcgtgatgcatctacagttatttattgttacatccttttccagacactgtagatgctataataaaaatagctgtttggtaaccatagtttcacttgttcaaagctgtgtaatcgtgggggtaccatctcaactgcttttgtattcattgtattaaaagaatctgtttaaacaacctttatcttctcttcgggtttaagaaacgtttattgtaacagtaattaaatgctgccttaattgaaggggtttgggtggatttttttttctcaaaataagctgtagggactattttaacagcttaaacaggagctctcaagatgcactttcatattgagaggaatatgggcttgatcctcttcctatctaaatgggtgggccatttgattgtagagggtccaccacagaattatgggatgccttaagtgctgttactaggttgctcacagcctaacctggcgtgttgtttagggctgatggagacccatgtgagcctttgctttcctctggccccggccccaccctgaacacagctcatacacagaatcaggaccagcatgtgcagagctggccaccagcacaggcttagggcagttcagaacccacttgtttccctatcagagggacacagtgaagtggaggttaaagtaaattacaggaaataagggagaaatcttgcagttaccatgttcagatagagtgactgaaattaattgtacttactaaagtattaactagctaacagtgatgggccaagacgctccgagaactctaccgggattgtctgttctgacaacccagtgaggcagatacactttcttactgctcacatcttacaggtgagtactcataattggccagcatctcaccaccagcaagtagtagggccaggtcaatcccaggcagtctgaccccagagtggcccagctcatcccctactctgttatttgcttgttaatgattctctagattttctaaaataatgtttcttagcattgtgatgataaagctcatgatgaactttatcactagttatgccaccttaactagtcagatttcctagaattaggaaatggtgactcttgtctaaatttggttaagtgatgaatttgggttaccgtctcatgtgaacctggagattcaccagtcttaacttttgggtcattgtgttttctctacattcatgcattggatgttttgctaaataactcctgtggatttaggaatgtgtgctaatagcaatcttcctaattttcatgtttatatggaactatgcagttgagtattgaaagctttaaactgagtttatttacaaggactgagtctagcctacagagaacatacagcagccttctttggaccacagtcttatccgaggggtctgtggttgtatcagaagagccactaaaccaatccccctttccaaaattgaacctcacagacgttcctgttttttgtgattgagaaactggtcaatgaacaggaagacttagagatgtttcacaagcctttgatttttgtttcatttatttgtaataaacctcttccacgtga

SEQ ID NO: 800 - DNA, 24403 bp, Homo sapiens; identical to SEQ ID NO: 798

SEQ ID NO: 801 - DNA, 24403 bp, Homo sapiens; identical to SEQ ID NO: 798

SEQ ID NO: 802 - DNA, 24403 bp, Homo sapiens; identical to SEQ ID NO: 798

SEQ ID NO: 803 - DNA, 24403 bp, Homo sapiens; identical to SEQ ID NO: 798

SEQ ID NO: 804 - DNA, 24403 bp, Homo sapiens; identical to SEQ ID NO: 798

SEQ ID NO: 805 - DNA, 23166 bp, Homo sapiens
caggggcggggcctgctcgcgtcccgggtgcctggataccgagcgcgtccgtagtggcggctggcgctagggaactgcagggtctagggtgttgtcggagtggcagttggtccgaatttctcccgaagcccgcggaggagcgggtaagagccccgcgaatccggccccaacctcgggaacgggatgggaggcggccctggccgcaagccccgcgctgctagcgggtccaccgcgtcgtagccgacagccgcccttcttcctcgcagcgcgccgcgattcaccagcctggtcccttctgcggagagcgatgccgcttcccgacaccatgttctgcgctcagcagatccacattcccccggagctgccggacatcctgaagcaattcaccaaggctgccatccgcacccagccggccgacgtgctgcggtggtccgcggggtaagcgcccttggcccggggagctgtccggtctacatgcccaagccagacgagcccagagagccctcctcccggaccaggggccttacgcggcactcagcgtccttaagagtatcaggcaaaactttccccttagcattggtgacatctatacttgagtgttttatctaggaaccatttcgatttatcgactatgagacccgaaatcattgcaaaatgctcacttacctacaacgtaatggcaactcaattgtttaaaagtgtttatgatgaagatagactaaaacttaacaaagtaattgcattgggcaaaaaagtgtttacattatgttaaaaaaattacacggttgcagtcactttgtgaaatgactttacaaagaggaatattttagctaagttcctcatctgcagagagtcctctcagagctatgtatacccagagctggttaaatttattagaaccggaacgaccgtggtcatactgaggtcatcatccctagagtgctcagggtaaactgtccagcaaatgaagcttcacagtttattttttgccacaaacattccaacacttgccaggaacagacattcataatctcaaagttacaagtcaacagatcttagaggcattaaaagaaatcctcttggttttacaggagagctctttgccccttttcaataaacagatgtaaaacaaaaactcacttttatgatgacaagagtcagcacaggtgtaaatttaatttaaatattttagtcatcaacatttcaaattttggctgggcttggtggttcatgcctgtaatcccagcactttgggaggccaagctgggaggatcacttgagcccaagagtttgagaccagcctgggtaacacagcaagaccccatctgtattttttttaataagaaaactaatttaaaaagaaaaaaaacagccaaattttgctggctttaaactctataaccaaagtgaattagtttcgtttggctgctgtaacaaatcaccacaaaacttgacagcttaaaacacagacatacatttgggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcccgggcgacagagcgagactccgtctcaaaaaaaaaaaaaacacagacatacattcttgcagttctggaggccagaagtccaaattagtttcactaggctaaaatcaaggtgttgacagggctttgctctttccagtggttctcaggaaaacccagctcgtttccttgccttttctggcttctagagctgcatttcttggacgccttggctcatgtccccttcctccattttcaaggccagcatcttcaaatctccctctgcctccttcttccaaggacactggtgattgcattcagtggccatccagatagtccagggcagttttcccacccgagatccttatcagtccacaaaatccctgttaccatgtaaagtaacattcccaggttcctggaacatggacctggatacctttggggctgttattttacccaccaactgagctacttgtccatccagtgcttgccttctgagaaatgcttttatcaatggtttctgaaagactctttcaaagttcttgctaaagaaatatagcctctggttttaaccattattcaagcttaaataaaaggatttataagagtttgtgctgtacaaaaaattccaagatttagcaacatcttcttggaacattaaactatatttagtaataccttagagatagttatgttaagcttcactttgtttatttatttatttatttttgagacggagtttcactcttgttgcccaggctggagtgcaatggcgagatctcggctcacggcaacctctgcctcccgggttcaagcgattctcctgcctcagcctcccaagtaactgggattacaggcacttgccaccacacccggctaatttttgtatttttagtagagatggggtttcaccatgttggccaggctagtctcgaactcctgacctcaggtgatctatccacttgggcctcccaaagtgctgggattaccagtgtaagccaccgcacctggcctaaacttcactttaagaggcttaatcaggctgggcatggtggctcacacctgtaatcccagagtttgggaggccaaggctgatgaatcacctgaggtcaggagttcgagaccaacctgaccaacatggtgaaaccccatctctactaaaaatacaaaaattagcttggtgtggtggcacgcatctgtagtcccagttacatgggaggctgaggcaggagaattgtttgaaaccgggaagcagaggttgcagtgagccaagatcgtgccactgcactccagcctggatgatagagcaagactccatcataaaaataaataaataaataagagacttaatcaggaactttccgaatgtaccatgctactaatttctctcaagagccatttatttatttattttttagatagagtctttttctgtggcccaggctggagtgcactggtgctatctaggctcacggcaacctctgcctcctggttcaagcaattctgccttagcttcccaagtagctgggattacaggtgcgtgccaccacgcccagctaatttttgtatttttagtagagacgggggtttcaccatgttggccacgctggtctggaactcctgacctcaagtaatctgccctcctggcctcccaaagtggtgggattataggcttgagccaccgcgcctgaccaagaacaatttgtgagtttaggagaaaacccaggtattattcattcggcagtatatatgtaattgtaggttcaaatatgtttcagctgtcacaggacagaatctgttagggagagctattcaaaagtaacttgagtaaggcgggacttggtaagtgcaaaaatgaagggtcacgaaagttaagcaaagtagtggcttggtccttgagagattttgtaggcagagagattggggcttgggtggggtggagaggattccaggaagaggaagcagcacaggaagaagggggtggagacaggaaaaagaaaaaccatcaaaaccaaaacaggaaaccaggatacccacggacataactgctatagaacaagcaagtaggctgagcacggtggctcacacctgtaatccctacattttgggaggacgaggcggacaggttacttgagctcaggagctcgagaccagcctgcacaacgtggcaagaccttgtctgtactaaaaataaaattagccggccatggtgatgcatgtctgtaatcccagctattcaggatgctgaggcagaaggatcacttgagcccaggagttggaggcttcagtgagccatgttcacaacactctactccagcctgggtgacagagcaagagcctgtctaaaaaagaaaaaacaaacaaacaaaaaagatgaagcaagtaggcattcctctttcctcaggttagggttcttttcaaaggtgcttttcaggtgggcaaatatcaaagatgagccagcctccccctaagcctgtggactccactgtgaggggagtcggctgttccttatgacaccattgtgcagttgtgcctcacacaggacaatgaacataagaatcagtcaagtaatagaggctgctttggttggcgtgtgcctcaaggaactggcagaggctaacattagttggtctcacctcaaaagcaggcatttccagcctcggccctactgacagttggggagggcacaggaggaaggggcatcttgtgcatgatgggacttagcagcctcctggcctgcacccactggatgcctggagtaccatccaccctctgttgtgacaatcaaaaatgtctccaggccgggtgcggtggctcacgcctgtaatcctagcattttgggaggctgaggcgggttgattgtctgagctcaggagtttgagaccaccctgggggcaacatggtgaaaccccgtctctaataaaatataaaaaatcagctgggcttggtgatgcacatgtgtaatcccagctactcaggaggctgaggccggagaatagcttgaacctgggaggtggaggttgcaatgagctgagatggcgctactgcactccagcctaggccacagaacgagactctatctcaaaaaaaaaaaagcgtctccagaaattgccaaatgccttttggctggggaggagggtggcgggtgggggaaagaggaggagcattatcccccactgagaactctgcctccagaggctgtatctagctcgggattccttgcctgagttatgaggagttacccccatgaaataggtgaaaaccttgattagtaggaatgtggcaaaacgaggcacctattcttcacccacaccctttaggtctttaggttcacatttgtctaactcactgctgccttcaaatcattaacaaagccacaaaatggagctgaagttgtcttacaaagcaaggaaacaaagtcaaatttgaggggtgtaaagagagagaaaggatgagatatgaagtttattttagtctatcagatatcgacttatccatatttatctgtagcaatgtttctaactacccatggctttaaaattgttatctgtggccctggtggatgctttgatgttcatttgcctggatatgctgtctcttttcatcatgctaaagtcattagggccccaaatgatgtggcttcagcatcgccacctctggcaaagataccaaggggcgtgagtttctcagaaggtcttgcctggcacccctcccaccacgagccagaggctgggtgtgggttccctcttgacttattgccccaacagtttcccactcttgcccccaacataagcagcaatatcagtgtcccagaaaggaacaattaaggggaacaataccaggcaggaaaagtgggggtggggggatgggagccaggccagcacctgccattcccagtgtggaagtaggtgacctgtgtgttcctgggctgcctcagggttgaatatgcagagacgcttaaagtcaagcacctcaaaaagcagcaagaccaaacccacctgtcaaaagtgggaagacggccaggcacagtggctcacgcctataatcccagcactttgggaggccaagctgggaggatcacttgaggccaggagttccagaccagcatgggcaatggaacaagaccacatctctgtaagaaataattaaaaagattagccaggtgtggtggtgtgtgcctgtagtcccagctactcaggaggctgaggcgggaggatcccttgagcttgggaggttgaggctacagtgagccatgattatgccactgcactccagcctgggtgacagagtgagaccctgtctcaaaaaatttaggaaaaaaaaagaaagaataatacatggaactccagctgattgtgaagtggcagggaggaggggaagaatcacacatgttgaaggagcttctgcgagtgccagccactgcgccaagcccttctcacacaatgctccccaaccctccaacagggagtctcattatcccctttgccaacagagaaactaaggcaggcagagaaggttaagtcagagaaccaagtggaggaaccaggacataagcccgggatgttggtcttcagagctgtccttcctaatcaccgttgttttggggggttatttaagaaattggatcgcatagctgttttttgtgtattgatgagctttcagagatgtctgttatttattagctatttttcagctctgtcgagaggagatccacttcctgtaaaggacagaatggaaatgcccacggcaacccagaaaacagacacaggcctgactcaaggactcctgaaagttttgcacaagcaggtatgggggggcgtagtctctggcctcaggcagctggcctgtgctttccttaccgttcactgtgcattgatgacagagcggggcacaccccagcaatgtatttcaaacctcctgaggtccctgaaatcctgctttccctgccacgcatcgtcaaggttgattcaaggaagaaatatgttgtgtctgggaggtctttttctagcttcaacagccccaagtcactatccaggggtagagtttagaaaagtgaaatataatttcttttaaatacaaaatttacatgacactagattctgctgggcaaaacatacaaaatttcagaacctggggggtttccagtccgttctccaggtgtgtgtttgtgaaagctgtgcgcaggcctgagtaagcctctgccttctctgtctggaaggcggggctggcctttggcccccaaggtgggcagcagcctctggtgtccagtgctgtggagagcctgggcccccttcctgccttgcgcttctttgccccacacgccatcctgtttttacagacgtgagttactagaaagtgggtcacggagcaaggctaggccttcctcatgactcggttcttttgctaaaagagacaccagtggcataaccttgattttcaaactgacttatccccattctacactgtgaagtactgtgcttctgcgcaggatacagtgaattctgaaactaggactaccttaagggaagcaaagaactcttgaatggtgtagcttgcgaaaagacatgctgaaattgctcaaagccttttcatccaggatactgctagcagattgcagaagttttcagttttgatagattgtttaaaatagtagaaggaaggccgggcatggtggctcatgcctttaatcccagtactttgggaggctgaggcgggcagatcacttgaggtcaggagttcaagaccagcctggccaacaaggtgaaactttgtctccaataaaaatacaaaacttaacagggcgtggtggtgcgcacctgtaatcccagctacttgggaggctgaggcggaagaattacttaaccctgggaggtggaggttgcagtgagccgaaatcatgccgctgcactccagcctgggcaacagaatgagactgtccaaaaattaacaaataaatatataatagaagaaatacatttattttcagttttaagatctctcctatctaactgttaatgtgattaggggctggatttttaaaatgttttttactgagctttattttttattgtgaagcatttcagacagatagtggagtatcgtatactcaatatcagtatgcctgtttcattaagtcataacatgatgccgtattcgcttcaccgtccttttttcatttaataaataaaaggttgccgctcgctgccttccctgccttccctccccagggctgacagaaccccctgtcatgcatttggagttcatctgtcccctgcatggggcgggttacttggtgtgtgttgaatattcacagcattcattgtttcccaggttttaaaacatacataaattgtcatgctgtgttttccaaacagtgtcaccacaagcggtatgtggaattaacagatcttgagcagaagtggaagaacttgtgcctgccgaaggaaaaattcaaagcgctcttacaactggatccttgtgaaaacaaaatcaagtggataaactttttagcgcttggatgcagcatgcttggtggggtatgtacctataaacagcatattaataattctgtgtcatcatggtcccagcttaaaaataatttaggtttcagtaactaaaggaaacactttagtaactttgtcttagaaaagcatttccccctgctccaggcctattatattaatattttcaggtgtacagttattttaatttacagaaattatttatgaatgcctcaatttaaaagttaatagtagatgaaagatatggatactattaaaatatatttaggttttagaagaaaatgcatcaatgactttttaaaactacaaatcattttgtaaactgataactgttttgctcatctgtggaaagaggcatacaattattttctactttagtagaaatctattattattatttatttattcattttttttgagatggagttttgctgttgttgcccaggctggagtacaatggcgcaatctcggctcaccgcaacctccgcctcccaggttcaagcgattccctgtctcagcctcccgagttgctgatagctgggattacaggcatgtgccaccatgcctggctaattttgtatttttagtagagacggggtttctccatgttggtcaggctggtctcgaactcctgacctcaggtgatctgcccaccttggcctcccaaagtgttgggattacaggcgtgagccaccgcgccggccttagaaatctattattaataactaatagatacagtgagattttgctgatgtttgagtataagccaagcaacttaggaataagacatgatcctccaggtgacgaggcgagcctgggaggtcggggcgagaagggagaggttggagctgggatgatgttggcagggcttcctttgcaaacccagagtcagtcttctcagctaaagtcttgctgtgagacatggtggttgggtgaaggaagagtaaccaggcatctgccatgtgaagcttatgaagaaaggaggcagagaaaggagaaccagctccctttactacatagatgaacaatttgattttcccccctcccttcagtctgtggccccagtgtgtataactggtccttgcttcacagccctcactcagctttgctccatgcacagagctctttcattccattttcattaaaacaaattacttgaaatgggtggtggtaaacacccgcaaggctacccaatgtggccactaatgcaccaacagtcacttccaaccacctgtggcctcctcccatgtcctgtccccctgcctggtggcctgaagcaatgacatttctgaagttcctgcttctcgcttcctgacctctgaaacacatgcttctatgtgtcccgcaagaggtacactgtggaattttagttggttttgacttgatgaaaagacatttgtgttgtcagtaattttctgaaattttcatcctaaattatatgactagatgtattcatctgtacatcacaggccacgttgttcattcccttccttcgccatgtcacatctgagtgtggcgcagttcaccagctctgcagatggccccagtgggaagctccgtgccctcagggagtcgggtgtggtgtggctgtagaatgagcaagagttttgttgtgtaactgctcaaaggcaatggaggtgcttcctgtcagccccgggctaattgtgccaaggcctggatgttggcaggcatggtaccctccagtagcaaggacaggtgcagatggcaccaggggagtgtctcaggggtattatcaagatagacaaaggcaaatacttttaattattggagacatttttatgtcactttgttaatctggaactctgtgaaatctatctatctatctatctatctgtctatctatctaatctatctatctatatctgtatctagctatatgttttttgagatggagtctcactgtgtcacccaggttggagtgcaatggtgtgatcttgactcactgcaacctcccaggttcaagtgattctcctgcctcagcctcccgagtagctgggattacaggcatgcaccaccatgctcagctaattcttgtacttttagtagagatggggtttcaccatgttggcctggctggtcttgaactcctgacctcaggtgatctaccagcctcaggttctgggattatagattacaggtgtaagccactgcacccagcctaaagtatatgtgtgtgtgtgtgtgtgtgtgtgtgtctgtgtgtgtgtgtgtgtgtgtgtgtatttttttttttttgagacagagtcttgctctgtcacccaggctgtagtgcagtggtgcgatctgggctcactgccacctccgcctcccaggttcaagtgatttccatgcctcagcctcccaagtagctgggattacaggcatggacctccacgcctggctaattttttgtatttttagtagagacagcgtttcaccatgttggcctggctgatcttgtactcctgacctcaggtgatctgcccgcctcggcctcccaaaatgctgggattacaggtgtgagccactgcacccggccctgaaatcgatatgttaacaatataaaattgtatgcaatgtttgaattaatgttggtggtttctgcctctaagcttagttgtaaaattttgattttaaaatgatgagaaagtagaataattcatgtttttggatccatctttatagttttcaccttcctaattgtgaaaattaagcactagatttaaaacacaattgaatctgatttgaaaaataaggcctcttgtccatgtagagtgtgtgacactagatggagacattgtgttaaggatagagcttggccgtctaagctgactcctggggaagagacatcacaaacagcacacattcttttgggttcttcctatcatagagaataaattgacaccaggaatcatgctgtgcatcactgcgggttcctgcctgtctcctgacttgagccacctttgccagcaggactccagatttgcccttgactccttccataggtgctggaggcctctcctggttgtagaaagccacagccaccctctgctctggtccagtgcggctgtagactcagggtcaggttcaagtgtggaagctgacctctcctccctcagaggagcgtgtgctcgtctggggtccatgtctgctgccagggatgcctgctctgccctggctcccgcggcccacagagtgctgagcacgagttcaaacacctgtctcggggtgcgctgggtagacaggaggtgctcggaccctccaggccttggtgtggacagttgtgttgttgaccttgttggccctgggtggcttggaggtgtgctaagaacacaaagctgtgaattcaaggaggggtttcttcatgtcgttcagcgtcataagcgttcatttttatgctttaaaaaaataccttcaaaaaggaggaaatgaagtgcgatgagaataatttgtagtggattaccacctgcagaagtttatttcacataggatgctgtgtaattggtggctagccgctgcctgcgtgagcgggatagatgtcgttcctgctccctgcatctatggcgggggcgtggcttgtggcaggtgtactctctgtgctgtttacatttatttatcttagaaatcactctagtcaaattcatcgagttgaagatctctaaaaagactggaaacctctgcttcaatttctgaatcatacataccattcattccacaaatgtttactgtgcattattttgtgccaggccctgttctaagtgctgcaggttctggagtgaacaaaacgggcaaacatcaccagactcttggagctgatgttctgttatatccttgaagccctgaacactgctctacttattacatcaaaagctatcaattcaggttaaggggcactgtgagctgccccaggcaggtgaacaaggacattaaattgccatctggatgttaagagattcctgtcctctttctcaatgttttgatgtgcttgcatggtgaaatgaccatatttgtatgttgtggcttttatttaatttttttttttttaagagacagggtctcgttctgtcacccaggctggagtgcagtggcatggtcatagctcactgcagcctcaacctcctgtactcaagcgatcttcccacctcagcctcccaagtcgggattacaggcatgcagcaccacatccagctaattttttattttttgtagagacaagtatcttgccatgttgcccagggtgatctcagttcctgagctcaagcagtcctcttgtcttggcctcccaaagttctgagatttataggtacaagccacagagcctggctgacttttatttttccatttctacaatgccattaatgatcctgagcattaaagctgtggatcaaaatgttttgttttgtcttttaagcatggagatctttttttttttaagataagaaaattgtgaaccaagtctttcatccccatactgacactgacagagtcagtctgtcatgatcaaaacaaatcacattgactttagtcaggctttgaaacgcatttgaactttcttagtcacagaagcatcattcttcgtttacaaccacagatgcacacgtgtctaacgcagttttccatctgaacacggtgcacgcagtgggcatgatttctagggtttaaccgggtgcgggagtgcacagagccctgcgtgtgtattctctggaatcctcccaacagccctttgaggaaggcaccatcaggattgcaggctggtgccccaaggcagagagaagctgagtcacaacaggtgacttggaagtggggagaggggaggattcctcctagtggctccatagcccaaggaatgtgcagcccacaggttaggaccaccttattcaagtttacgcctgagatttcctgtctcggagaagaacaactcctcgggacgatcatcaaaatcattttgtgtcctgaagtgattcatcccctggaaggcattcaacctcggcctcctcctgacaacacacactttggagctctcagaacatcgccccatccagctgtgctacagcatgtcagattcagtgactgacctatggtggttccctgttggtccgatgtgacagccacctgcgctgcggcagtgacagaggctgcatcctggcttactcctcgctgctgtttccttccaggtttccgcagctagggctcgaaagcccattcggaagtgaccaagaaaggccaacagaattcctcatagcccctgcagcccgtgagaagaagacacagccacgcccccaccccccagtgggagcctgaggccacaggcgtgtttaggaagctgtccctgaagacgaaggagccgctcaggctcctgactcccctggccccagctccagttcccctgattgctcatgtccctccctctgtgggaaagaggcaggggccacgctcccctgaccaaccttgccctgtccgctggagattcccatgggccgctgatgcgggccgctgtggcctccccatccctgtcctgcacaggatatcacaccccagccacggggtgaactgctccttcccattcagggcctcctacccttacctgctgtcagccccagaaatggttttaaattaggaaactctagaggataatagaattcgatgaaaaggcccttaagctcttgaaaacgcagtgctgggttagaggcttttaaaaaccagtgctcggtcagaggcttttaaaaaccagtgctgggtcagaggcttttaaaaaccagtgctgggtcagaggcacagcttcactggaagtccagtctctacccccagcacaggcagctgtgcctcagagggggacctcctttgttctgattctgtgtaaaacgggcctattttcatttccatgccagctgagaggtgcccttggggaggtgtgaggtgactgttgaggggcctcatatcatcatgagagcagctataatttggaaactgaaaaaccccacagagttggcatgccgaaaatgcccggaaaatagtgggtgccctcgtgcctgtgctcttcactcatctccacttgaatttcagattatggatcaggtgtaaatacttggttaaaaactaagtgtttggctgggtgcagtggctcacgcctgtaatcccagcactttgggaggccaaggcgggtggatcacctggggtcaggagttcgggaccagcctgaccaacatagtgaaacccccgtctctactaaaaatacaaaaattagctgggcatggtggtgtgcacctgtaaccccagctattcaggaggctgaggcaggagaatcgcttgaacccaggaggcggaggttgcagtcagccaagatcgcatcactgaactccagcctgggtgacaagagtaaaactccatctcaaaaaaacaaacaaaaaaataagtgcagcttgccagtcacctctgcccagcacatatcgcacatgggagaataaatcagccacacagcagacggcagcatggggcagccatgccaaggagagggtcttttggctgttgtgcaagtgactgtgccacccacaggcctttggaattgagaaacaaatgttaagaaatgtgactcgcagcacaagatggagcaagttgccttatgaatccttctggatataaaaattgctgcagatcttattgtcagaaacgttgacatgggtagtgtcatcacgcctttgcagaggaagtgatgctcgagtgttttgatgtatttttccttaaataccgcttcctctgaagccttggaacggcgcgttacacagatctcatctgcctgctccatccacgccaactccttcctttccgactcatccttcctgaggccccgcagtcctgcacacggtggtgacggacttccatttgtgtccagtgtaaaagcaaatcccatcataacaacatgtctttgagagtttcaagcaaggaacatggattgtgaaatacacgactcggctttgagcaagtcctgtcttggggacagtcttttagaggagccacgtgtgcagtggtcctggagcggtgcctgcagctccacggagcaggttctgcacttttcctagagagagcatcatgttgccctgggagctgcactcaccccctaaccgtgccgtccacctcggcagcatcaggtgcagccgccaccagcactgctggcatgggaagggggtggaaatgggaggaactgccccatcaggccgctggggacagggagatcagttctgttcagggctccatctcctgcagccaaatatctgggtcctcagataggcgacgtctgtgccccaggtcttgttcccagagcccgcctggcggctgctagacataataaaatggagtagtcactggggtgagctcagaggcccaccggctgtgctccagtcctggctgggtgacttgggtgattgctgagcccctctgggcctggccaaggtgtctgtctgctcctcgcagtaaccacacgaggtgactgtcattattctcactcccagaggaggacagcgggctgtgttatcagccttgctctgaccatggtgttctgtagggaaggctcattttgtcccatagcctggagcggcctcagagccctttcctgtccctgaggatgtggggtttattcctgacacagccactgtggagctggacagtccaggcctggcttgcagcggccctttccctgcatctgcagctcccccgtgaggatggtgctccaccctggccctcctgtgtttgtttcttgcgcttcccttggaagcacagccctagattcatccctgcaggcgattccccagggatgtcagccacctccgtggctgctgcaagcaggagctctcagtctgccctcacaccccaccccagcagcctgcagggcaccaccctgctcgggaaggtcctggttctcagtcatgtttgccaagcgatgtggtgtaaatactcccactgctgctgagttcaggctgccaaggtgaagtcctccagctcacacaactgctggaaacttagcagtaggctcatgagccggctccagcacagcaccgggctccgaggaaatcctgtgccacccgccagtccttgtccttcctgtcctgtcctgtgtgctttgacacaggagattgctctctccaccaggaaatgcttttcttcactcaccagcagcctccctcctggctgcgcctttcaagtccccatgctggtccctcatctccccagctcttggtggtatagcgtgtccatgcactgtcctcccacctcggcaacctcgtggggctcggctgtatacaccgtcctgctcgtatacactaccccacccatgtataccatccccccgtgtataccatccccctcatgtacaccatcccgctgtgtacaccatcccgctgtgtacaccatccccctcatgtacaccatccccctcatgtacaccatcccccgtgtacaccatcccccccatgtacaccatcccccctatgtacaccatccccctcatgtacaccgtccccaccatgtacatcatccccccatgtacaccgtccccaccatgtacaccatccccccatgtacaccgtccccaccatgtacaccatccccccgtgtacatcatccccttgtatacaccaccccacccgtgtataccgtccccccatgtacaccatcccctcgtgtacaccattcccccgtgtacaccatcccgcccatgtacaccatctcacccatgtacaccatccccccgtatgccccatccccccgtgtacaccatccccccgtgtacaccatcccctcgtgtacaccatccgcctgtatgccccatccccccaccgtgtacaccatcccgcccgtgtacaccaccccacctgtatacaccaccccgcctgtataccccatctcgcccatgctcccaagtctcctccgtgagcgctaggcctactaagtagccacctgagtcaccagttccactgggcgcctgacagacatgtcagtggaagccaccccaaactcagcttctctctggaacttttgcagctgttcaggcaccaaacattggaaccacttttcatggttctgtctctgcccacatgcaaccaccagtgagttctggtaactccaccttcaggagaggctgagtccggcccttcccaggcccctggctggattattccagcagcctccttgccaggttcccgccttccaccctcctcaccgggttcccgccttccaccctcatcactgggttcctgccttccaccctcatcactgggttcttgccttccaccctcatcacttctcttcacacatcggcagaaggactccttagaaacactctacagtgctccgtctttgtttaaaaccctttgacaccttcccatagaccccagccaaagcccaagtcctccctgggtctgtaaagacctccgtgatctgcccccaccccatcccgctgacctcatttcccgcatccctgcctctccatggcctgctctagctacctggagctcctggctgtttctggagcacacagaagtgcccctggaattctcccagcatcccacatgactggctccttccccctgggtctgtgcttacatgctccctgctctgaccgtccctgaccacccgattgaaaatgtcatcctccaccccggcactgcctgcctgctgctccaggcacgccctcttccagagcaccctagaatccaggtgttgtggctctcccacttgactgtgatctccacatgagcaggcgttaggtgtctgttcactgctacatcctggtgtgtaacaggcacttggcaaacgtggagggaatgaagggctgttgccatgtgtgtgtgttggcgaggggggttacgtttaagcagccacctgtgtgagctcaccttcatcagtaggcagcgtgaccatccaggcaggtatgagatagccactctggcaaggacggccttcacagaagggactcgaggtggggactgaggggagggtcccataggccagctgcggaattaggacacctgcccccacagcttaccctggccagggtgttgaaggctgcaggtcatgatgtcttggtgcagaaggagaaaaggagacctgggctatgtgttctcttttgaaaagatagtaatcttatgttacatggttctcccaccttcttgaaacaaacacacaaacagctcatgttttttcaacaaggatgaattgagcaagttggaggtgggaggccatgggctggccctggggagccctggtgcccaggccctgcagttccagcgccatgcagcctctggtctcatgaagacgaccttggcctgttagctgccccccacccccgcagggacttggctgggagggcaggtgctaaaagtgtctgccgtgtggaggcaggaaggctgctcagaggatgggctttcccgctgaaagcagagggtgggctgctgtctgggatgagcccagcagtttggaagagtgtgagggagatgaacggtctcagggaggaagtccggttgctgttctggagctgagacagagcccagagccttctgtgtgaacagggagagagccaggacagagcccggacagagccctcccttctgctcggtgggcaggcattggcagacacccagggcttccttgtaggcatgcaggccgttggctgccagccctgccctctgcaggcagcacctctggctggtggcagagttcattcagcccctgggcacgtccccgggtgtgtctccgggccagatggggctgcacagttctgcattagcttaggaagttggttttcaagacattgatgcttccttttgtctgtaacagtcatttctattttaatagaaaataagatctgtgaattagaattttttcctggtcaattgcaccccattcgaacctttccttttcatttttcattatggcaattgtacattcacctagttctcagttcagatggagcacatactttttggagaatttctgtcaaatatgctagagtgttgattctgctgatgcctgctttcaatgtgagtgatgccaggagtaactgtttttctccccacctggctgtggtgctcccagtccttgaacactgcgctgaagcacctgtgcgagatcctcacggacgatccggagggcgggcccgctcgcatccccttcaagacgttttcctacgtttaccgctacttggccagattagactcagatgtgtctcccttggagacggaatcctaccttgcctctctaaaggaaaatatgtaagtatgcaccctctctaggattcaggtatgttgaccatgggagaatttcctgtttcacttcccccttgtagggaaaaactcagtttttcctttgctctctcaccacaacaataatcaacacagaagactgctatgatcaaatgtgtggaggtttttcctcaccaaaaagcaagcaagtggtcctgcagcagacaccagctgtgcattctcattccgtctctaccctgtctacctggagatagcctgagatcccacaggttgagggttcagtccccaagactgcccccaccctgccccatttctgatgctagttgcaagccccaggttattttgcctgtgcttctgaccgactggctctaaatcagggttcccacaacccctccttgggtcaattaatttgctagaatggttcacagaactcagggaaacactcatgtttactatttgattacaaaggatattttaaaggctaccaacagtcagaggaagacagacaaagggcaaggtctggaagggtctggagcatgggggcttttgcccccatggagttgaggtacatcccctccctgcccgcaaatgagctcttgttcaccttcctgttggtctcgatgtgtttagcttccgggaaactttctaagccctgtccttttagggtttctttttcctggaagctttgtgattgattaaatcattggccaatagtgatcacctaagccatcagcccctctccccacctccaaggttgggctgggctgaaagtcccacccctctaatcctgccttgggctctccagtgaccagccccatcctgaagctacctgggccatcagccaatcacaagcataaagaaagaactcactttggagattccacagattttacttgtatgccaggagcgggggttgaagaccaaatatatatttcacaatatcacatcccttgtctgcaataactttgtcccaacgaatcccgtgtttggcagaaggtttaggcacacctgatagtattcagggtgtgtgtaagtggagccgcagatcaaaggccatcagcgaaagcaagcagcacctcagaagggagcccgacctctcccgtggctcccacccatgtgggctgaggctcaggtttttttagactttagagggagagaatgtatcttgtcattaagactcatttatcccagatctatcctgattcctatgtacagcatgtcaggtggtactaaattgtagcatgttaaaaagtgagatagaggctgggcacggtgcctcacgcctgtaatcccagcactttgggagtccgaggcaggtggatcacttgagatcaggagttcgagaccagcctggccaatatggcaaaactccatctctactaaaaaaataaccaggtgtggtggtgggtgcctgtaatcccagctactcaggaggctgaggcaagagaatctcttgagccctgggggggcagaggttacagtgacccgagattgtgccattccacttcagcctgagcaacaagatcgagactccgtctcaaataataacaacaataataataataataataataataacttaaaaagtgagatagaattcatttctccacaatgaaacgtagacatggattactgctggtggacctcctgacagtagtgccacggatgcaggatcatttgcagaaacttgaggatgtcattgacatcagccacgcaattctcactctgatgaacttgctatatgaccccgacacattgcatgttatgttgtatttgcaccaggctgcatgtgatgtaaggctggttctgctctgaagcatgacttggagctaacgttggaatatattgtccagtgttctgatcacctgtaacatttttaaacaagattaatgaatcctccctttaaagacaagatgcagagtaaaaaggaacaaagctcttgggtcctgcggaagttctcatttgttcattccctaaaccatcattgggtgctgactctgcaccctgcactacctatggggaggcagagagagcagcccagggctggtggggtgggcagaggtggtggtgacaaccgcagggtccggggagctgtggtgctgcagagtaagcctggttaacagcaagaaagggccttctaggtgcaagggcaggaaagggcccaggtcctccaggctccagccccaagggagatggggtccctgaggtcttcccggcacttccccttgggaccactgccccccaagtgctggttatggtttgtccctgagccccacacctctcatctcgaattgcccacagtacagtttattgagcacctgctctgtgccaggcattggcgcaggtgccggggatgtagtcagtgaacaggtcacgccctgacccctggagttttgccctgtggagcagacagacatcagacaagcagattttaagacagtaggtcatgttcagtgccaagaggacagtaagccagggatagggaccaatgggggctggtcccagggccgccttctggcacagcacacacccctgctcgcctcagcctcctgagaagccccctggcctgtcatcaccacccagagtcttgtcccctcctcccaccctttccaaccggccatgatgccacctaggatgcaggccacagcaccaggagctggcgctcaagtgatccgccagcctccgcctcccttcctgtgccagtggagcctgcgttctgtgccctgccccacctgtcccagccgtcctcgtctccttgtcccttccacatcgtttcctctccttccttcaaactcacatcccctctgcccaccatgggctgagcctctggactccatggtccctctttttcctccttcctctgtcatccactgtcactccaaccctcctgtcctcgtggaagaccgcagctcccaagccatcccttctgtccgccttattcttgacaccatcctggctggtgtctgcagtcacatggacgacacagtactttgtccccagctctcctcctggtgcccacagcctctgcttctgcaccgccatccgggtcatgctgggccccttctcctgcccgatccgcgcacctcttctcttcttttgtgctctctgatgcggctactccgcctgacagagccacctgggacatgggtggttccatctcattccaaatccatgtcccaagcctccaaagaactgggaccctgtgcagcagccacttctcccaccactttcctgagatcacaagtcatcaaaaaagaaaaacctatgcatatagcacccatcttttcacctagaaataaagctacatttattatacgttttggtgcactttgcacaagaaaatagaatgctttatttttggaagtaagaattactgatgagcaaccataaatagtttttaaaagtagaccttttaaattatatcgcattttataaaaatgttactaagtatatgatgagaaattaccaataaatatctttatctgtttccaatttagagacgccaggaagaacggcatgataggtctttcagatttcttctttccaaagaggaaacttttagaaagcattgaaaactctgaagatgtaggccattaatacagagaagaatacattttaatgtcaaaatagtgctctttaaaattctggcaccaaatacaacttaccctgaatcaca

SEQ ID NO: 806 - DNA, 23166 bp, Homo sapiens; identical to SEQ ID NO: 805

SEQ ID NO: 807 - DNA, 22025 bp, Homo sapiens
gtcagttgcagttgaactttattcatccgttcacacctgggtccctcccggcccccacctaccctggccttgcctactcagggcttccaagattgggtgtcggggtggctttgcttatcctccagatgccttcttcccaggatgtgatccgtgccctccaggatctaagggatgaggactaaaggggtctgttcctcctccaggcagctggcatggaaccgtccgtctcagcggctgcttggtggtggcggtgtggatgggtgtggctctctgtttgctggggggtattctgccaggatgtataggaagccacccagggctgccactgctgtggctgtgttgtgggaggagcagccatctaggggagagagcccccatgagtgctgggtggcaagaaccttggccctttattcaacacagtctcattgaaagtgcttttcagccagacgcggtggctcacacctataatcccacactttgggagcctgaggtgggcggatctcttgagatcaggagttcgagaccagcatgagcaacatgatgaaaccctgtctctactaaaaaaatataaaaattagccaggtatggtggcacgctcctgtagtcccagctactcgggaggatgaggcaagagaattgcttgaacccaggaggcaaaggttgcagtgagccgagattgcgccactgtactccagcctgagcaacagagcgagaatctgtctcaaaaaaaaaaaaagtgcttttcagatgtcattccaggcaacttgcaagacgctgagtgggtgcttcggtgctcccttaggccccttttgctgggccgggtgctcttccgccagctgctaagggctcccttctctgggaggtatgtccctcccaaataacttaccaatacagggatacaaaagcctggccaccttggcccagggggatgactctggtgcaatttatgctccaaggcattcccctcccacccctgcggggggatctggcctgaggccgcatcctgtccagctcctgcctggcttagcctgcttccctgacttacgtacctcaataaacccacgcaccggagtcctgtcccaggtcctgtgtaagaccttctgagatggggaaactgaggcttgggtagccgagctgagcccctggccctggtgactccacagctcatttcctgaccccagtggccttcctcttagttgcctctggtctgcctggtcccgtgtgacctcatggctcatggagtcagagtctcaggcctgagcacttgcctgagataataacccttaggtgtagttagttctttgagctcaaagtgggctgcacgcctctagtctcacaatctgtctgcttgtggaagggagccaggaattctttcctccctacccagagactttgggaaggggaggggaccccagccaggtccgttgaagggagggagaatgcagatttcaaggtgccgaatgactaaccctggcagctcatgcctctcagtggcctactgtatgccaaatacaatggggagggctttgcacgatgatcagttgttagcccccaacagtttggtgcccattttacagatgaggaaaatgaggctcagtgaggttgtgtgactttcgcagcaagttagaggcagaagcgggactcgaacccacacaacctgacctcaaaccctgtgctcctaatctctacaccagctgcctcctgctccgtgggcttgtgtcataagtgcaagaatcagcacacccctcctgggcagttttctaggctgctggtcaacctggaggtgttccaggaaaggccttgggctctggaatttctgtggcttccgctccagtccctaggacagtcctcgtgttgggctctggggacgggcagctgaccaggtagtacacagcaggcccctaccaccctagccataggcagccccagcccctctgtgtcataaaggcctagctagggtaggacctctggaagtctcctgggaacttctctcccttctcctgcgtgacttttggtggcagctacgaaactgactcactggatttctgctttcactctctcctgtccacctgtaggtggatgatgaggccacagtggggttgatggagagatgtttagttactggaatcatatacccacatatgttggacatccactctgtgagctggctattccatatcccttcctgtttttgcctgcacttatttattttttattttattttattttattttattataattatttttgagacacagtctcactctgtcacccaggctggagtgcagtggcacaatctcagctcactgcaacctctgtctcctgggttcaagcagatctcctgtctcagccttccaggtagcgggattacaggcatgcaccaccacgcctggctaatttttgcatttttagtagagatggggtttcaccatgttggccaggctggtctcaaacttctgacctcaggtgttccacccgccttagcctcccaaagtgctaggattacaggcatgagccactgtggctgtcctatttattttttattaatgaaaaattgaaatcaaagtcctctctttcttcttggttcctcccttcctgtgtccccctccttccctttcttctacgttatttcttgactttcttctacgttatttcttgcctttcttcccatcccaatatacttatatcctgttctcactttctttacattggccaactgaccatacagtttattgtcgcaaccaggacactttggaggaaagagggcactattcataatggctccaagacaacaggtgtaaactggggcagctctgggagcactgggctgtgtggccaccaaaactgttctggtcacttgcccattcattggctttcgggtcccttctctgcctttccttattccaaactccagcacacagacccctccaaactacatttcccaggatgtcttgcctactggtttcgaccaacaggaggtgcaggtggaatgaggggagaagccagaatatttctcccttcctctctctgtctcccccttgttcagcccctgcaggccctattaacactgcctcctcctgccattctccagctctagggagggtagtggcttcctgcaacagtaaaatctctgggtttttccaccttttctgttttcagctcttacaacacctctgagatgagtttcctctagtaaattccctctgttgaagttcctgacgcaggttctattttcctgaccagaccttgacttagaagggttactgttgctatttttaacaactgaaacttctcttttatgctcctttaacaaaagacagtatctcttggactccccactttctttctttcttttttttttttttgagacagggtcttgctctgtcacctgggctggagtgcagtggtgcgatctcagctcactgaagcctccacctcctgggttcaagtaaatctcatgcctcagactcccgagtaactgggactacaggcgtgtgccaccatgcccagctaagttttgtatttttagtagagacagggttttgttatgttgcccaggctatctccccactttctaagaggaggccatcagggacccccagcctcccttccacctctcaacatgaaggccctctgattagtgcccctttggtgatgccaagtgcttttcttccatagcagagaataaacacaggcctctgttttgctaggatatcttagtttcatgtcaagaaactcccttgggtattttcattacctggaaattgtttttctcgcctcttcactctcctcgaaaaatgctgctgatattgaatagctttagataattcttcatcttcagcatctgggagaagagcaaaagttgaacttctcaagagagatttttattttttacatttttatttctttttactgcttttattgtagagacagggtctcattctattggccaggctgggtgcagtaacgcaatcatagctcaccacaacctcgaactcccaagctcacagaatccttcctgcctcagcctaccaagtagctcggactacaggcatggactaccatgtccagctatttaaaaaaaatttttttttggtagagatggggtcttgctatgttgcccaggctggacttgaactcctgagctcaagtgaccctccagccttggcctcccaaagtactggattatatgtgtgagcccctgcagctggtctcaagctgaatttttaaatgttactcactaaacctcctgcccccataacatttcaaggaagttaggtcttctcttgaaacttgaggctattccggaagtttcctcctgcacctgtctgcagatccttttgcatggcctaaacttgtcatctactgatggttttccaaactgtggctccccaaacacccaccatcagaaccactggaggtgcctgttaaaaatggaagtccctccaagataagcaaaaaactgagggatttcattaccactagactggccttacaagaagtgctcaagggaatcctacatctgaaaagaaaaagacaataataactatcatgaaaacatgaaaaagtataaaagttactggtagaggagaaatagaaagaagaaagagaaaagaagcaaaactatcactagagaaaagcccaaacagcagtgataacaataagaaaggaagaaaaaaaaatcaaaggatatagaagataaccagaaaacaattaatgaaatgacaggagtaagtcctcacaagccaataataaccttgaatgcaaattgattcagtcccccacttaaaagatatatagagtggctgaatgaatgaaaaaaaacgacccaactatatgctgcctacaagaatctcacttcactggtaaagacacatatggaatgaaagtgaaagagtgagaaaagatcttccacataaatggaaaccagaaggaagaaggagtagctatacttagataaaacagactttaagtcaaaaactgtaaaaagagacaaagaaggtcattatataatgataaggaatttagcaagaggacataacaattcaaaaaatatatgtattaaacactggagaaccctaaagcaaatgttattagatataaagggagagatagactccaatacaataatagctgaagacatcaacaccttgctctcagcattggacagatcatctagacagaaactcaacaaagaaacactgaatttaaactgcacttaagaccaaatgaatctaacagacatttacagaacatttcatctaactgctgcagaatatatattcttctcatcagcacatggaacagtctccaaaatagaccatatgttaggccaaaaaacaagtctcagcaaatttaaaagaatttaaatcatagcaagtatcttcttgaccacaatggaataaaactagaaatcaataacaagaggaactttcaaaattgtacaaatacagggaaattaaacaacatgttcctgaatgaccaatgagcaaatgaagaaattaagatgaacatttaaaaatttcttaacacaagtgaaaatagaaacacaatatgccaaaacctatgggatatagcaaaaccagtattaagagggaaatttacatcaataaatacctacatcaaaaaagcagaaagatttcaaataacgaactaatgatacatcccaaggaactagaaaagcaagaccaaatcaagccccaaattagtagaaggaaagaaattgtaaagatcagagcagaaataaataagagactaaagaaacaataggaaagatcaatgaaacaaaaagttggtttttaaaaaagatcaacagataaattattaactagactaagaaaaaaagagaaaagactcaagtaaatgaaatcagaaagaaaaaggaacttttacagctgataccactgaaatacaaaggatcattagagactattataaacaacaaattagaaaacctagtggagtgtgctgggtgtggtggctcatgcctgtaatcccagcactttgggaggccaaggtgggcagatcacttgaggtcaggagttcgagaccagcctggtcaatatgatgaaactcagtctttactaaaaatacaaaaattagccaggcatggtggcgggcgcctgtaattccagctacttgggaggctgaggcaggagaatcacttgaacccgggaggtggaggttgcagtgagctgagattgcgccactgcactccagcttgggtgacagagcaagactctgtctccaaaaaaaaaaagaaaacctagtggaaatggataaattgctggacacatacgacatactgaaattgaaccaagaagaaatagaaaacctgaacagaccaattatgagtaatgagattgaatgtgtaataaaaagtctccccaaaacaaaaagcccaggacctgacagcttcactgctgaattttaccaaatatttaaagaacaaataccaattcttttcagtctcgtccagaaaattgaagaggaggaaaattttcccaactcattctacaagttcagcattaccccaatactaaaaccagccaaggacaaagcaacaacaaaaaaactataggccgatttccctgatgaacctagatgcaaaaatccttaacaaaatactagcaaaccaaacccagcaacacattaaaaaccattcatggctttcctactttgaccacttccagtaagtaatgaatgttttgcattttaaaaaaaatcattcatcatgaacaaggggactttattggagggatgcaaggatggttcaacatatgcaaatcaataaatatgatacattacaccaatagaatgaaagacaaaaatcatataatcatcttaatagatgcaggaaaatgcatgtgatgaaatttaacatcccttcatgataaatctctcaatacgttaggtatagaaggaatgtgcctcaatataataaaggtcatatatgacagacccacagccaacattacactgagtgaggaaaagttgaaagcttttcctgtaagaactggaacaacacaagagtgcctaatttcaccatttttatttgacataatactagaagtcttagccagagcaattaagcaagagaaacaaaaaagggcatccaaatgaaaaaggaggaagtcaaattgtacctgtttgcagatgacatgatctgatagacaggaaaccctaaaagctccaccaaaaaaactcttagaactgataaatgaattcaacaaagttgcagaatacagaataaacatacaaaaaatcagtagcatttcatacacctacaatgaactagcagaaaaagaaatcaagaatgtaatcctatttataagagctaaaaccaaaatacccaggaataaatttaaccaaggaggtgaaagatctctacaaggaaaactgtaaaagacactgatgaaagaaattgaagagaacacacaaaaaatgaaaagacatcccatgtttatggattggaagaattaatattgtgaaaaatatccatgctaccgaagtgatctacagattgaatcaaaataccaatgacattcttcacagaaatagaaaaaaaaatcctaaaatttgtatagacccaccaaagaccccaaatagtgaagcaatcctaaggaaaaagaacaaagctggaagcatcacattactggacttcaaaatatgcttcaaggctataggaaacaaaatatggccaggtgcggtggctgacgcctataatcccaggactttgggaggtcgaggtaggcagatcacttgaggccaggggctcaagaccagcttggccaacatgtagaaaccctgtctctactgaaaatacaaatattagccgggcatgatggtggtgggtggctgtaatcccagctactcgggaggctgaggcaggagaatcgcttgaacccgagaggtggaggttgcagtgagcaagactgtgctacggcacaccatcctgggtgacagaacgagactgtctcaaaaaaaaaaaaaaaaaaaaagaaggaaaaagaaaagaaaaaaggcaaatgagctgcatagacatctctcaaaagaaggcatacaaatggccaacaggtctatgaaaaacgctcactatccctaatcatcagagaaacgcaaatcaaaccacaatgagatagcatctcacacctgttaaaatggctactatcaaaaagacaaaaaatggccaagcgcagtggctcacgcctctaatctcagcactttaggaggccgtggctggtggatcactttgagctcaggaattctggatcagcttgggcaacatggcgaaactctgtctctacaaaaaatacaaaaattagccgggtgttggtggctcccacctgtagtctcagctactcaggaagctgaggctggagaatctcttgaacccaggaggcagaggttgcagtgagccgagatcgcaccactgcactccagcctgggtgacagagtgagaccctgtctaaaaagaaagaaagaaaaaaaaaaaagacaacagataacaaatgctggcaaagatgaagagaaaggggaactcttacacacagttgatgggaatgtaaattagtacagacattatggaaagcagtatggagatttgtcaaaaagctaaaaataggactatcatatgatccagcaatcccactactggatatttatccaaaggaaaggaaattggtatgttgaagagacatctgcacccccatgtttattgcagcgctattcacagtagccaagatacagcaacctgagtttctatcagcagatgaatggacagagaaaatgtggtacacagacccaatgaagtactatttcaccataaaaataaccaaattctttcattcatagcaacatcgatgaacttggaggacattatactaattgaagtaagccaggcatggaaagataaatgttgcatgtccttcctcgtatgtggaagctaaaaaagttgatctcatagaagtgcagtgttgaggcagggtgcctgtaatcccagcactttgggaggccgaggtgggtggatcacttgaggtcaggagttcgtgaccagcatggccaacatggtgaaaccccctctctactaaaaatacaaaaattagctgggcgtggtggcatgcacctgtagtcccagctactcgggaggctgaggcaggagaatcgcttgtacctgggaggcggaggttgcattgagccaagatagtgccactgcactcctgcctgggtgacagagcgagactccatctctaaaaaaaaagaagtggagtgttgaatagtggttactagaggtggggagggggatgggggagaggagataaccagaggttggttaggggatgcactagtacagccaggaggaggaataagtggtaccgttccatagcactatagggtgattgcaaataacaacaatttgtggttttttttttttttttaaagacagtgtctcgctttgtcacccaggctgaagtgcagtggtgcagtcatggctcactgcagcctcggcctcctgctgggctcaagtgattctcccacctcattctcccaagtagccgggaccataggtgtgcgccaccacacccggctaatgtttttgatatttttggtatagatggagttttgccatgttggccaggccggtttctaattcctgagctcaagccatctgcctgccttggcctcccaaagtggtgggattataaggcgtagcctattgtgtattttcaaatagctagaagagcgaatttggaatgttcccaacacaaagaaatgacagatgtttgaggtgatgcgtctgctcattacatattgtatacatgtatggaaatatcacactgtaccctataaatatgtacaattattacatgtctattgagaataataataaagccaaaaatgcaagttccacagccccatccccaacccgccgaagctatacatctggaggcctaagaatcttcatcgtataaactcttttaaaaacgcaccatcttatttcaaaagcttttgcttcgtggagcatcccaagcttctaatgaggacactagcatttcctgggagctgccgtgtacctggcacaggctatgcggcttcaaatgtattacgttgactctccttgcagctcaggaaggtggggattactatgctcatttattttcagacagggaaattgaggctgagaggggtgaagcgacttattgcaaagggaccagctgtccattgtcacatggctgggaagtggctgagtcctctgcctctccaccctctgctacgtcacctcctcccatgtagttgttcccagtcacccacctggagagcctttcctggacttctcttcttcctcaccctgtcgtctcctttatagctcttatcagaatgtgcaattatttcacttcttggtttgtttaggtgatttatgtttcttttcctcaggcctctagttttccctagagcctagatggtgtctggtacattagtgggtgctcaatacgtacttgctgaatgaatgctgatgtggtttggctgtgtccccacccaagtctcatcttgaattgtagctcccataatttccatgtgctgtgggagggacctggtgggaggtaattgaatcatgggggccgtttcccccataccgttctcacggtaatgaataagtctcacagatctgatggttttataaggggtttccctttgtgcttgcttctcattctctcttgtctgccactatgtgagacgtccctttcgccttccactatgattgtgaggcctccccagcagtgtgcaactgtgagtccattaaacctctttttctttataaatcacccagtcttgggtttgtctttatcatcagcataaaaacagtacaatacaaatgggcttgttaatgcagctgtaggggccaacaccttccaataagacggcctcctgtcttgccacattttggcttccaaggctccgagcccgtttctccttgtgtgtacacgtctgtgtgtgtgcacctgtaggttacaaatcccttggcaaccttaacaccaatgcattgttcccacacctggcctagaaactcagagccacccccacccccactgccccccttcttagccagggcagcagcgcagctcaccaggctccccgaagcatccttcctgctgtttctgccagctgagaatggcctccagccaccggagcttgtagaagtcggagaagccgcccattccacagaacatgactggaagtaaagacgggggccctctgcaggcctgccccccaggcccacctcctcccactccccagggctgccacggtgccacctgccttcatctgcctgggttaggcttaggaggtgggcgttcaatgcagaggagggaaggaggcagcttgagcctttgcctgaccaactaggggctcccatgcttgtgtcccgcctcccactgagggccttggtcagggctgctccaaagtcaggatcagtggaggagtttggacaccccagccagctagcagcctcccaagcgctccctgtctgcctcatccataaggctttgtgggtctgtctgccagtcacctggtccatctgtgtagagctccgtcactggggcagcctttgggggcaggaaactgtcacacagtggcaggtaaaatacaggatgcccagttacatttgagttttcgataaacaatgaatataatttttgagtgtaagtatatcccatgaaatagttgggataaacttatactaaaaatggattcattgcttatctgaagttcaaatttaactgagcactctgtatttttacttgcttaatctggcaactccgtgtgtgtgtgtgtgtgtgtgtgtgtgtgtgtgtgtgtgtgtgtgtgtgtgtgtgtgtgtgttggtggggggacaccctgttcctttgccccgggggcagaatgctggccatactgttttccatgaagatgtcccgggtagggtaggcgtatccgatggcctcagctctgcggttcaagtccatcatgttggcgcagaagaggttgatatagtcctggctctgttggagtggtccctgtgtgcaccccctctggggagacaaacacccaaagacaagggagtcagtggtacagatgacagacacacgccctgctatgggaaagtcttgcagttctgagacggtcttgcaaggggctgtgtttagggctgtgtttagggcaggtctttttctccttttcgcaggatttcttccccatgcacacccccagcctgctgggttcgagatccagctctgccacttaggagcaaaccacttggtttgctaaagtaacctttctgagcctcaagagtttttatcaggaaagggcgaggcctctagaaacggcaccagaggggctctcgtagggggatgacacagctgggaagtgcccaatgtgatgcctgggccactaggaggtgctctgtgaccgatcgcgggggcaatgcaatgtacaacgagcctgaacccgcgggcagcttcagtgctactcaaagtgtgggccaagaaccgggctggtgactccccacactgggagagaagaacaagagttgacagcaggctttagacacttctgtagcagtggtcagagttactttccacctgctgaatctaatgatcaaaataattcccttgtaatatggtttttattgtatttataaaaatattgggctgtcacagcttgcagagaaataataatttttaaattctgttgaacaaaaacagagagtgtctcctcagctaaggatttctggacactgaatcacattgttttttgaatgaagataatgaaccctacctttctgtatgaagaaatatatatggccaggcacagtggctcatgcctctaaccccagcactttgggaggccgaggcgggtggatcacgaggtccggaattcaagaccagcctggccaacatggtgaaaccccatctctactaaaaatacaaaaattagctgggcatagtgggacgtgcctgtaatcccagctacttgggaggctgaggcagagaattgcttaaatccgggaggcagaggttgcagtgagctgagatcgtgccactgcactccagcctgggcaacagagtgagactccatctcaaaaaaaaaaaaagaaggaaaagaaatatacatatatatatgtatatatatatgtgtatatatatatatagtggtatatatatacatagtggtgtatatatatagtggtatatatagtgattatatatatcgtgatatatatatagtggtatatatatagtggtatatatatagtggcatatatatatagtgtgtatggtagtatatatataaagaaaagaaatatatatactggtgtgtgtgtatatatatatatatgccaccatatatatatttttctttttctatttttttatatgtatatatatagagagcggcatatatatatatagtggcatatataatgtagtagcatgatctcagctcactacagcctctgcctctctggttcaagcgattctcctgcctcagcctcccgagtagctggaattacaggtgcatgccactatgcccgactaatttttgtatttttagtagagacgggattttaccatgttggccaggctggtctcgaactcctgatctcaagtgatccacccacctcagcctcccaaagtgctgggattacaggtgtgagccaccgtgcccggcctcattcatttgtttttgtttacagagttctttctgatgattctcttttattctctctttctctctctcgttgtgtttttctgatgccctacagtccagttcagcaggcaaagctatctgtttcactggcctaacagaatcccaaatgccagatcccaaatcggctcaattacacagcaggagtatgataggggccctacttctccctcctgaggtcccaagtagaaatccaaagctctgcttattttcctggtgtgtagcagacagaactacactgccatgagccctttttcatttatttcttttttctttttttttgaggcagagtcttagtccattgcctgggctggagtgcagtggcgcaatcttactcactgcaacctccgcctcccgggttccagtgattctcctgcctcagcctcctcttgtagctgggattacaggtgcacgccaccacgtccagctaattttttttttgtatttttagtagagaatgggtttcaccatgttggcccagctggttttgaactcctggcctcaagtgatctgcctgccttggcctcccaaagtgcttggattacaggcatgagccaccacgtccggctgccccttttcctttttccttccccttcccctggcacggcgggggctccctgggcactcaccattctggcccagaggaagaagagcagttggtgggacaggcagtagcctgagcagccgggcttggtcatgaggctcctgcagaggtctgagaggccgcagggctcgctgctgtccgtcctgggggaaagtggttccaagctgttaaggatggagcgctgactctgccctgcgtcttcccagccccctagttgtagttgttggaactcccagtagattccagacacccagctgggcatgggggttgacagagacaatacagcagtcctgcattttgatttgctaaatctggctgccctagcccaggaaagatgacgctagagctattctggggttgaggaagccaccaaggctgaaacttcctattgctccatgggccaaatcacatcttttccagccccgaacagtgggtacttgaacccagaccacttggaatctgggcccaacatgcttattcctcctgcaccagccaggcgcggtggcttacacctataattctagcactttgggaggctgaggcaggcaagtcacctgaggtcaggagttcgagaccagcctggccaacatggtgaaaccctgtctctacaaaaaatacaaaaattagctgggtgtggtggcacgtgcctgtaatcccagctactcgggaggctgaggcaggagaatcacttgagaatcacttgaatccgggaggcagaggttgcagtgagttgagatcgcatcactgcactccagcctgggagacagagcgagactccatctcaaaataaataaataaaaataaaataaaataaagtaaaaataaaaaatacacacacaaatacaaaaattagccgggcatggtggcgcacatctgtaatcccagctactcaggaggctgaggcatgagaatcacttgaacctggtaggaggagcttgcagtgagccgagaaagaacacaccactgcactccagcctgggggacagtgagcctctgtctcaaaaaaataaaaataaataaaaatttttaaaaagcagaggtccttggctggggcccagcccctccgtgaatccagctgtgtcctggcctaagcactgctctgaaggatgctgacaggatgcggcctgggcaccggctgcccactttgcccatgggccctgcacctagggctgccctggggccttgttccaagcccaccaaacaccaggataaaatgaggagcccagctaggctcagtcctgtcttcctggagctgcatcctcactggggatggggacaggctcataatacaaatgtaaattgcatctgtggctataagaggtgccaggagaggccctcacaggaggtctgctatgtgctggggtcagagataggatggggttggaggtaggatgctggcgccagccctggaggatgggcagacttcctgaggcccagggggtggagtgggtggggtggggggagcaaagtctttgaagtgggaggaagccttggagagtctgaaaagaggcctctaggggcctggagacttggaactgcggagaggaattggggatttgtcctggggcctggaggtggtgtgttcagccatggctgctggaaggcctgctgtggcatgggaggccagcgggcggctggagcaagggggaccctgctggagtaggagagggcagtacccggcagctacagggagctgcacctgtgtctgcacaaacccctggcttcagccctagggcttggagaaggaggagcgggacaggaccagctgagaactagtgcgtttgggtttccagcaaatagggcaagtgcagggcccacccggttcccagcagctgcaccaggcacacgtcacttctctcctctgagaatgagtcctggggcccgaacgtggggtacaccaaggaggcatcagtgtggatccaggcatgtgggagcttccaaaacccgggctggagggtcagctggaactctggcagagaggacagatagatggggtggggtgtgggggtgacccaggagcagtgggccaccctggtgtccccacctcctcctgcagccctgcccactggcaggtgcagctcagggctctaagccctgtcccctggtcccagattgggtttgaaacactcaagaaagctccttttgcttataaaaccattttttcccctaatcaataggaacagtgatgggacgggatttgactaaacccactgcatcccatggaaaccccagataaataaaaggtttagtttcccaggtgcagggctcacgcctgtcatcccagcacttggggaggctaaggaaggaagatcgcttgaggcccaacgttcaagaccagcctaggcaacatagcaagactctgtctccacaaaaataaaaaaagtagccaggtgtggtggtgtgcacctgtagtcccagctgaggcaggaaggttgcttgagtctagaagttggagaatgcagtgagctatgatcagccttttttttttttttttttttttttaagaggcagggccaagagcggtggctcacgcctataatcccagcactttcggaagccaaggcgggcgaatcacttgaggtcaggagttcaagaccagtctggctaacacagtgaaatcccatctctactaaaaatacaaaaaattagctgggtgtggtggcaggtgcctgtagtcccagctactcaggaggctgaggcaggagaatagcatgaacccgggagacagagcttgcagtgagccgagattgcaccactgcactccagcctgggtgacagagcaagactccatctcaagaaaaaaaaaaaaaaaaaaaagccgggcgtggtggcgcatgcctgtagtcccagctacttgagagaggctaaagcaggaaaatcacttgaacccaggttgcagaggttgcagtgagctgagatcgcaccactgcactccagcctgggcgacagggtgagactctgtctcaaaaaaaaaaaaaaaaaaaaaaaaaaagagagacagagtgagacactgtctcaaaaaaaaaaaaaaaaaaaacccccccaaaaaaaaaaacaagtggggaggtggaattagtggggaggtgatattggtagaccttttggtttggtgagaacgtggagctcttaactaaacagatgcccagtcatagatatctttaagatgacataggtggggacagtgttagggaccaggcctgggagagggtgggggaccttaaaattggaaaggtcagcatgggctatggtccctgcggctggactgccgtgtgagcatgaagcgtggcctggctacctccccgctcacccccatgcatctgatgggagtggggagcagaggggacagggttggagcagcatgatggactggttatttgtgccccgcccttgccatccaggaacaactcagccaaacttattagatgggaccttttgcagggtcactcggggctggtgaggagagagagactctcagtggtcataaggcatgagaaagataaaccccactgttttgaaaaatagtgtgtggacaacttcgggaatttctactgacatttaatgaagtggattaaaataatttggtgacatgggacactactgtttgctgtgcaaagggttgaattgccttttggatactctcccctctgggacagcccagcctctccgctctagtctaggaccaggacctccagcttgtgcgtgcgctgaatgcttgagagaagacaccctgcttcctctgcacacctctgtgtgggtaggagagcccgtcagagtctgaagtcaaggatgaccgcacgtccccagggctcgtctgtggcttgctcagcagacaggtccaagttggttacggactgtcccagcccagccttgccccaggagagcccacgctgggttatttcagtcaatatccccataggcgctattcctgagggaatgggacaccctgcgtgtgctcacctcttaggtacttgggatcactcagcttgaggtagtggagggatctctggatggcagcctccagcttctcccccagcatccccacgcgcaggctcagcggctgcagcaggggctcctgggcccacttctcccggacactttttagctgctctggaagggaacagagttaattcattcaactatttggaatcgggacctttttttgccttggaacaagaaaaaaaaatgccccaaagtctaatgcttcctgggagcctctctgccttctccagcactcagaggggaaggatttactgagctgactggaaatgaggccaggatgggggtgatctgggcaatgagaatgggtgtcagagtagtagaaggtggtggctgagagcttggtttctggaggcgggcctgggttcaaatctttgatacttgaggttcaaatcctcaaatccttgactcatatactttcttgttggatggccagagaaaggttgcagggtagagaaccactgtgtacagttgagcaggttgtacactgcacaagggcaacacacatttggatcatgggtttgtatatgcagtaagacaatttcccagcagatggctgtcaagtgacttcaggaaggaagtgcctttttctaattcccacagaggtaccctgtgggctagcagtggctttgttgaggtgggagacaatggtgaagatccagaggtggccagaaattggggagacatgagtgagaacatccgagtgagagcattcacgcagggctgagagggcgagggatgaagtggggcagctgcagtcaggtaggaaccttgttagggaggatgggctaggttaagaaggatgctgaggtagtcctccagggcgaccggctctggcacgccccctctgctcagccccctccatgggcaaacccgcagggaagaagtaaaggcttgggagtgctgacagggaggggctccctgtgtgtcagagtgtctcctcctgtgattgcaccgggtctacaaagtccaataggacaggggtccccaacctccagtccattactggtctatggcctgttaggaatggggccgcacagcaggaggtgagtggtgggtgagcgagctaagctgcatctgtaatttacagccactccccatcattcgctgtcactaccgcctgagctccgcctgctgtcagatcagtggctgcattcgattctcacaggagtgtgaaccctgttgtgaattgcacatacgagggatctaggctgcacacaccttatgaggatctaatgcccgatgatctgagaccgtctcctatcacccccagacgggattatctacttgcaggaaaacagtctcagggcttcaactgattctacattgtggcgagttgtataattatatattataacataataacaataaacagaaagtgggctgggcacggtggctcacgcctgtaatcccagcactttgcgaggccgaggcaggtggattacttaagtccaggagttcaagaccagcatggccaacatggtaaaacctcatctctaccaaaaatacaaaaattagccgggcgtggtggtgggtacctgtagtcccagctatttgggaggctgagcaggagaatcgcttgaacctggaggtggaggttgcagtgagctgaggtggcaccactgcactgcagcctgggcgacagagcgagactccgtctcaaaataataataatataataataataataaataaaaaataaagtgcacaataaatttaatgcacgtgaattgtcctgaaaccctcccctccacctcagtccatggaaaaattgctttccacaaaaccagtccctggtgtcaaaaaggttggggaccactgcaatgggacgtagaccctgcccactgggagctcattgtttagagagacacaggtgaggaagccgttgctgctagtcaaggatgctcaatgctttgatagatggaaacagtaatggctgacaagtactgagccccactggtaagatgacatatacacacaatctcatgagacacatgtgcatgatcgtgtgatactcccatccaccagctgcagctgaaggatgaggaaaccaaaactccacgagagcagttaactcagtgccatgcagccagttgggggagatccaggatttgaacctgggcagtccagttctgaagctctgttctaggcactggcactgcctttgctcccttctgggcacagttcacgggtgtggttgtattaagcactgaattcctagggaatctgttatggagcaagattattgagaggagaaggggcagtggatgtgggatgtggcgtgggtggagaagccgggctcactgcagctgccaaggagtggggaccctggtctgaggctgttaggtggggccgctttcccagtgaatgctgcccagtcatgattaagagaaccccctcccttctttgctaaaagaggataataataatgggtgtaacctcagggatgacggggagagggcactgaagtaccccatgcaatgcacctgggttgtgcccacattgagcagatacttagtgaactacagcttttgctatcacatgcgccccaggaagcacccagccctgtgggagccacctgtgtgcttgtgtgtgtgtgtgatatgcttgtgtgcatgcgtgcatgcgtgcttgtgtgtgtgatgtgcatgtgtgtgtgcgtgcgtgcatgtgtgcttgtgtgtgtgtgcatgatgtgcgcatgtgtgtgtttaccttggcctgtctccagcccccttcttggggatcttatagctctcaaagctaaacaaacacttgactgtttttgcagaaccttcaggagactttggctgcaagtggaggaagtggggtgggaacccgatcttgagggtcctcagttttgtccacagccacctcattcaaggggaggggtcttcccacaaatatctgttaacggggcactctccctgctccccttgttcgtggcgttgtgaggaggggctgtcaaatggatcatttcattctgagaaaaagataattcccaaatcccttcccatgttgcctttaaatctttcctacttctaaaaaattgcgtaacagttagctgggccacagccgccaggaagatccagcccctggcctcctctctccttatagccgaggcaggctatactggggccaggagtctgccaggtcccaggcgtacagagcagggcaggggacaaagctgagagctagcttcccagtgtccagccagaggaattggggctcactcaccttccagcactcggacccccaccatgccatccaggttgatttcaggcagcctctgttctaggaagacggtggctctctccagcgcagacaggatcaggtctgcaatggtggctttactttcagcagtgtccagcccaggcagtgaggaggaccacagcggtggcagtgctgtcagtaagagcaggagcagcagccccaggctggccatggccggcctctgctcactgctggtcacacgctcagcaccctgagctctggccaagcccagactgcctctgcacgccctcctcccacctccttcccacctccccctggcagacatgaagacaagtggcccggcagggctgccaagaagcctggggtggcctgggcaaaggactctgggaagggtggctgcagggggatgacggttaggcagcggaggttaggccagtcctgggcgtag

SEQ ID NO: 808 - DNA, 22025 bp, Homo sapiens; identical to SEQ ID NO: 807

SEQ ID NO: 809 - DNA, 73401 bp, Homo sapiens
ggggcggaaaagcctgtttacacagactgcacaccgcctggggaataatgcagtaaaggaagtgagccggctcggcctgactgctccaacttcctgctctcacacacaccagaggggaaaaaaaaagaggagcgagagaaagaaaaaaagggggaaaaatcaggatctcattacaagagccacagaccgtctgcagacgcctgtcagcatggaaagtcgggggctttcgcccgggtcctcctagaaattccccccgaagaagactcccccacatctgggtaggtaacagggcttctgcctgttgctcggacacttaaaaagtttgtttgggggtgttttctttttttctttcttttcttgggcgcggtgggggtggggcggggggcgccgcggggtgggctgcgggccggggtgggggtggcggtgcgtccgcgcgggagggccggccgcggggagggggcgccgcggatgctcctgcgcccgcgtcgctgccaccgccgtcgcccgagctcgcgccgggcccggggctgcggggaccctgcgcccgcggctcccctccctggggctgcgctgcgaccccagaggaaggggcgccgggcgtgcaaccctgggagctcgcccagggccccgctgcaggcagcgcggggagcgggggacggcgagacttcgggtccctgggaagaaccgtggcaggagcaggctgagtgcctggaggctggaccaccgccgaccttccagctgggaccgcagtcaggctcccctcgagtgggcaaagtgcactggtgctcggatccagggaggaagacagggatggagagggcggtggaggacatgggtcgcgaaggtgtggggctgggggctgcgtccactctcgcttggcaggtgacccccgcccaggtcaccgccccaggcgcacgccccatcggacatttaaaagccggtggtctctattgggcatggttttggagaaggaccaggcaagaaatgatcttggggccccttccactccccatccctgtttaccttcgaactcaacgttggcctgtgacgctactgtaacttttggggaggcgggattaagattttggagtagttaaaaagcaaaaataaaaggtcttggttttgttatcttttctgaaccgaatcatcctagggacaagctgcagttaggcggcgggtggaggtggaagcaagaaatgttatttcagaaactgcaaaaggggctttttagaaagaaaaaaaaacgagtgtcgggagagtttctggcttgtctggaaacggcaagactaattgccatgcgcttccgctttgaaactggcagcagacagcatcttgaaaatgactcactagaggagctcacaaagaaactgtggtttgctccttcttaggtttatgtatttgtgccttttacagtttcctttgtagtgttcgaggggtcccccgccccttccccgccagccccctcccaccctccctcatttgaaagcccctggccggtctttaactacccccaccccagtcctccagcctgggggtggcggggaaaggggaggctgagttgtttttggagttggctgcggagagggttaaagggattctgctgctgcagggggaaaaagttccttgaattttccactggctgctgcaggaagagagagcccccttagtcattgctaagtaatgtctgcacacacaccaactaatctcattaggagtttccgctgctcggcacaggaggggttttgtgcagccactgtcagcctgggagcccggcgctggggaaggagacaagttatggctttatttacttaggggtgcagccgcccaacgagccttttcaggacatgtcttgaaaactttgaagtcactttggccattttggatttcagatttgcaggtttttctttcccgcgtgtgtatgtgtgttgagaggtggggggagataagcagctcacacacacccatcttctccatctgtgcttgtctttgggggtggggggggtgtggagcatgttccaggcatctattcatgagccgaaatcgatttgtgagccttacaaaataccctctgatctctttttctttctctctcgccatggcacccatttatttggaaaaggtcagttaggagtttcaatttatgaggatgataaaattacaaattgtgttaggagggcacatgggtcaggcagttaaggagactgtccataagtgttcttagagtttccagtaatgatcctgcctagaaacccccctgagtttgaaaagtgatggcctttctatgccaaatatagcaaaggccttctgccctctaaaagtgtttttttttttttttttttttaatttaaatgttgcgtagaaatgtgtggcgttactaaaaagggtcaaaaggaacctgattggaatgatggggcccctttattgacaaagacatgttgcttttaaggtgttggcagttcttttacggtggcaaagttgtcctaaaaacagcccaaacagcccgaccggggtatgagtcagtggacatgagtacaggatgtccctaatgctatgccttcacagagtaggtgctcaataaattgtagcattgaaagctgtgagtaggctaacaaaacttataataggtaagaaaaaagacttacgagatctcatacattttgcatgagtgttccttaagaatggaggttgtaaactctctccagagtacatttcctttaaataaaaaagggagtatttagaattcctccttctaagtaattatttgggacacataggttcatttacgttagtggttcacaactaggagtaattttacctcccaggagacatttggcaatgtctggagatgtttttggttgttataactaagggggtgcattggcttctggagggtagacgccaggggtgctgctaaccagtcaacaatgcacaagaaagaattttttttgcccaaaatgtctatagtggattgagaaaaatcttatttactttaatgatgatgaagatgatgaaagctctttaacacgcattcagtcaacaaataggacatttaaaagtcatcatctgtaattttggccacatacgtaacatagcattcatgaattttctctttctctttttggtcagtaacatgcaataatagagtgacatacggatggtgaccttgtgatggtgtaccctttatgtcctgaattaggccatccatctctgaaactctgcaagtatagcatcttcatgcacttggtaccaatgctgttgagaccagaatggcagtagtccagataggggagagcagtgatttgccagctccatttgagttttgaagttaacctaaacatttattaaagacctcctctttttcttatataaaaaattaaataagtcaaaagtgctaatatacagtacatgtaactctgaggtcatatattaaaatttatatttgtaataactttttggaacttgaatcttttcctgaaattggttttaaaggacttccaggcagtgtatgtaaattaaaatattcccttcttagctgtcagatattggattttgtgtgttctgtgggacccaattatatttatatatctatctgattcagaagaccagtatggtgctgtgaaatgttgcaaaacatgacctgatgacaacccaaaacacttcatagaaaactatccaagaatgtgacttcctggagtagagtcttttttcactgagggtgagttgctgcttactaatcgttagttttgttgccttccaattctaaggaatgactcagtcatctccatgtttcccagacctggacttcctcatgaaactttatttttttaattgtttatgttgccagggctggccttgcactcctgggctcaagtgatgctcccacctcagcctccgcagtagctggggttacaggtgtgaacctctgtaccagctgtctcattaaagtttaaaagaaatgggctgtctgtccattctggctttgttctggctgtagagcccagatgactgtcttctgaccctttcctaaggttctgtacataaatacgcagatgagaggggaaggggactccatttttgttagattttcttgtatgtttcaggcaaaagttttttatgtcctggttatctttaattcctctttgcctgtatagatcgacttataacacactttgagaccatgctagcagaatagtatcttctaaaggttggttgttttttttcctattgtaaaaaatattaatgtgaattgccttacaaagatacagaaaactgctataaaaaaatagacatctcccataattccactgtttaccttttgatgtgtaattgttcagttttttaaaaaaatgcatatgtgtgtctatgtatatccacacatgcacataccatttttaattgaaagcacactgtacttactgttttataacttttttcacttaacatgtaacacattttaataattagtaccgagaccgaaattatcacatagagcttctatttattgatctaataaatgtgttggctcaaccatggattgacataatttcttcatagacttgttcagtgttttttgtcctctgtggttcaagtaatgttctaagaatgctgccctcttgaaagactgagttcctatgtgctgtgaaattttggattttgatgagtttctctgtgatttaaggatgagtcatgatttgcagtagaatatcaagatgtagtaacaggaagtacagggcactacacatgaaaatagaatgttaaatgatgaagagaaaccaggttaaactgaaaatataccttgaaattatccaactatgaagggagaggaaggtgtgttttgtacattttaacaactcctattactgtttcattttctatcagtggagtttccaaactttgaagttggtgttttaaattgatttttagctcaagattgctgttgttcatagccactttgaattgaggtcattcagccttttgattgaaaccatggcagtgagaccatgaaaactctagttttgccacttatagagcagccccagtaaataaaattagctgtgtgtgtgtgtgtgtgtgtgtgtgtgtgtgtgaccttctgtgaaattctaaatgtcttcaaaaatggtagattactcagtcttttaaataactattctgtgcagaaattcaactccccatggttcctgcctgaaaccaaaataaaaattgcctttcatccattactggagatttacatatatgtcagcagttttaaagtaaactttgaactagtcatttcaataaattgtgatttggtttgaattcccactaggaataaagtcattgactactttattgctatgtattaatttacatttcctggaaagtactacttttttctaagaattaaataagattataacatggctttacttgtatatttttaaagaaatttagacaatgttatattagtgtattctaatttgaattagactgaaatgaatttactcacacactctaaaacaaggatctatttatgacacatagtgtcataaatatgcttaaagtttctatagctaagaacaatttctgaatatccatgtgtaatatgggagtgatgggataggtataaaacacttatctagataccttctctttttattttttaaattgatataaatgtacatatttatggggtacatagtgattttttacatatatatcatgtatagtaattagatcgaggtaattagatccatcatctcaaatgtttatgatttatttgtgttgggaacatccattatcttccttctagttaattgaaactatatagtattataggcatcctgcagtgctatagaacacgagaacttactcctcctgttggagaccttctcttaagactgatgaagctagggctcctgtactccaagcaatagagtaaagaaaacgaggctcttggtatcttcccctctctcttttttttaagttgaggtatgatttacatatattaaaatgcgcagatcttaagtgttattgtatacatacatgtaaccctacccaaagagacaatatttccatgtccccaagtgttttttggcttatgtatttagagacagagcctggttctgtcacccaggctggagtgcactggcactgtcatagctcagtgcagcctcaaactccagggctcaggtgatcctcctgcctcagtctcccaagcagataggactgcaggtgtgcaccaccacacctggctaattttttttttctttttgagacagtgtctggctctgttgcccaggctggagtgcagtggtgcaagcttggcgcactgcaacctccgcctcctgtgtctaagcaattctcatgcctcagcctcccaagtagctggtatcataggcatatgccaccatgcctggctaatttttgtatttttaatagagacgggcttttgccatattggccaggctggtctcaaactcctggcctcaagagatctgcctgtctccacctccaaagggctgggattaacaggagtgagccaccatgcctggcctctggctaatttttttattttttgtagaaatggggtctcattatccctggccatttacaaaattctgttacggcaatttcatgattctaccatatagattcttaaacttcagaataccttgataaaatattgtggtattttatttaatctgcttagttaaaaataaatcagaatgtgtagatttcctcatcatacagtaagaggaaaaagaaaaatcctttctgtattacctgatatccgcaaaatatttaaccaaaagtaatatgtgtgctttaggaaaaatgtattacctgaagactaattgggatgagaggatattagtaaatcttcccagacctcagtttctttagcctgatggtaaagtagttgaagtggaggctgggtgcagtggctcacatgtgtcatcccagcattttgggaggctgaagcaggcagatcacttgagcccaggagtctgagatcaacctgggcaacatagtgagaccccatctctgccaaaaattagctagacgtggtggtgcgtgccagtagtcccagctacccgggaggtcaaggctgcagtgaaccatgattgcgccactacactccagcctgggtaacagagtgaaaccctgtctcaaaaaaaaaaaaaaaaaaaaaagggattgaagtggagaagctgagatatactccctttcaagtcggaagccctatttgtgtactgctatatttggaggaaaggtcttgactcctaagagttgtgaaagtgtgatatgaacttcttgctgtcatctccagacatctgacttatagacatatgcaggaatttaaacaaacagctattttgtggtggaaaagggggatctccataagtttccccttgaattccattttggccccttattgaataaggaacactccagtggaaggccagtattagctgccatgcttcctttcctcctagtcttttgaggtttgtgacaggcagcactgatttctaatgacccacagccacctcattcttggggacatcagtgactgtctgagttggtgctctgtagcaccagataagagtttggtcacctggtgaaattcctcctccttccttctgatagtctttgaaagtgctgtctgcccccactgctgtatcttgagggttcttacattcctctgcacccgctctgatcccttctctccccaggagctagaacaatcctttcaaaacacagatctgaccaggtcattcttctactgaaaaatcttctagtgacttcagcttaggataaagaccaaaacccctaactcaagctgcaagatgtgatttgggccagcaaactgacttttcctcagttcctcaaatgcttaaggtgtcctctgccctctgtccactgggtctttgtcaatactgacagaattttccccccgacccctctatttttcagactccatgcctaaccaatttgtaggcgtcttttagttcacactcagctccaccatgttttattggggaagcctttcctgtcacctagagtagatctccctcagtcatctgctcctggccttcagagcccttaccacaagctttttttttttttttttttgagagatggagtcttagcctgttgcccaggctggagtgcagtggcaccatcttgggtcactgcaacctccaccatgtgggttcaagagattctactgcctcaacctcccaagtagctggaattacaggcttgtgccaccacaccttgctaatttttgtgtttttattagagacagggtttcgccatgttggccaggctgatctcaaactcctggcctcaactgatccgcctgcctcggcctcccaaagtgctgggattacaagtgtgagccaccatgcctggccaccacaggctttatttacaggttgcctcattacctgaattctctctctccaaattcttgttacccaaacacaggaacatgagatggagtctcgctccgtcgcccagtctggagtgcagtgatctcagctcactgcaacctctgcctcctgggttcaagtgattcttctgcctcagcctcccaagtagctgggactacaggcatgcgccaccccacctggctaatttttgtatttttagtagagacggggtttcaccatgctggccaggctggtctcgaactcctgacctcgtgatccacccgcctcagcttcccaaagtgctgggattacaggcatgagccaccatacctggccaggaactagacagttttagagacatctttctgaaatagggctggtgcccctcattattcattaatgctattttctccaaaacccgggaaccaaatagatgtgatagcatggcatccctcatgatctgaagttactgtccgtaactgcggtcccattcgatttggatattgggggatgcctgcacgtgtctgtgtcatgtgctgcatgtctgcggtgccatcagtctgtgagctccctctgggcctgcgtccgtttttctcatcctttgtattatctcagcactttgtacaatacctggcactcaatgaattaaaaataatctgaagcgggggttggggggagcttgtcaatatagccccaccttgttttgcccttggacttgataaagccgtttgttgctatgcatatgtccatctcttttctagacaatgagttacttggatgaataggcagatctcttggttaaaccataaagacaggctgggcgcggtggctcacatctgtaatcccagcactttgagaggccgaggcgggcagatcacttgaggttagaagttcgataccagcctggccaacatggtgaaacccaatctctactaaaaatacaaaaattagccgagtgtggtggcgcatgcctgtaatcctagctacttgggaggctgaggcaggagaatcgcttgaacccgggcggtgaagctttcagtgagccgagattgtgccattacactccagcctgggcaacagagcgagactgtgtctcaaaatgaaaacccataaagacagccaaaaagctcctctatgccacttcccatacttcttgtttagacttgcaagaaaagtggatatatagaaatgaggttagtttgctagtatcctggaggacagggtttggctctattgttggtatcagtgttactatactgagagtggtcggttaacagtaaagttattcgtgggataggatatgttgaaagaatctcaatgtaaagtttttttttttatagaattaatcattgtagagcaaccatcattagtcctttattaaagacttcagttgatcaggttttcgtagttcccttggataaccagtttttaatcctgtaagatccacagttcagggtccttctttacttatagaaaacctgtgtgtgtagcttccatctatacctttttgaaattaatgatgtttctgattgagtttggaaataacaaaagattctgcttacgtgattatgaagacttgattgactaaacacccaaacgggggaggactaggtctcctaataaatttcagctgggttttgccaaggagcaatttgttgataggtcaaaccttgactaagcggaatgtatgattaaggagatttttctccttgcacgtaattgtcagaatagagagattacatcaacaacagcagcagcagcagcaacatcaaaataagcccgaaattattctagggtagctgcaggaattctctgtgggaatcaacagtaggagttctcctctgcttgcacctgtaggttgtcatcatcctcagagttaatgatcctgaggctcaggaagatcatactattctattaagccagaaaaggaggtgtaaatgttagaatgattccctaacactaaaagttaacaatatttctctggttaacgctcattgaactggaaatgtcacttcccctcttcatccccttattggagtttggaaggctcgcctttagaggctcagatgcaaatccttgttggagttgattcacagatgaaagggctatgccctggaaggtgaggagtgtgtatgcgcctttacggatgtgggctgcaagagggaggtctgtgtctgagagaatgggacaataggtgacttcagttggtgctgctcctctttgcagagtcactacccatgtaggattgaagccctggttctgtgagagggtaggagcataagtgaatgtttactaaccgtctccacccttgaagaatcattgtttcacaacgagaagtcaggagagaacctagatttattacagaatttgcaggaaagaagaaagcatagattcctgatcacctcagcacatcccattatgaacatacagagaggggaccaaaccatttagtattatctttgggactgtgtgtgaggtgcagtacctcagtttccttgtatgatcttgaaaccctctggcaactagaattcgtgagcactgggaggcaatttatttctgctaacattcctgtagattttttcaagccccagctactgatcatttagaccagagggcattggatggtttcttttctttttttcttttagagacagcatcttgctctgtcacccaggccggagtgcagtggcacaatcatagctcactgcagcctcgagctcctgggctcacatgatcttcccacctcagcctccctctgtaatccactgggattacaggcttgagccactacacccagctcttcttttcttttttgaaaaagcagtttagaacaaatgccttgaaatgctccaagtgacacccgagtgagggttagaactgattaaactccgggcagagagatgttatcatatctttgctgcatgcatagcccagtgcaaaaatgcccatagatggactgacttcatcttagatagttgaggcaaaaacagaagagccagtcagccacttggcgtttctgtcctcacttaattcacccctttagttgctgtaccattaattctcgatgctggattggtgacaaatgaagtaatctgaagagtgttaaaattttctttaagtgtattactttaatgacaaaactatatgctgcttgaaggcatcttgaatcagatgacccaagtgtactgtgaattctcaaaggattgggggtcacggctctcaaataagctcgttgccctgctttgatttcaatcagagctgaaccacaagaacagcatcttccttcagcctctgccacatcctttgtgtgttttttttaaacctaaatattaaagcctagtagtttgtctttcagaaaggagaaactttaaaaccttgatgtagatcagacgtgcaccagatgattcaaatattttacctaatgaaaggggcaattttctttttctttctcttctttctctttcccttttatttatttatttttttttttgagacagagtctcactctgttgtccaggctggagcgcagtggcgcgatctcggctcaccacaacttccgcctcccaggttaaagcgattctcctgcctcagcctcccaagcagctggaactataggtgtgcgccaccatgcccagctaatttttgtatttttagtagagatgttggccaggctggtcttgaacacctcacctcgtgatctgcctgccttggcctcccaaagtgcagggatgacaggtgtgagccacgattttctttcacaagggaaaaaaaagatcctctaaagcaggatctggctgttattttgtacagttaatatattcacgctgaacaattattggaagagcaggtagagtaataagttgtatatgacatttcaaaaagggactgcccaagccagtggatggcagatgcccatgtgggaattaagggcagcgaggatgctttggggtacagattgatgtttgatgttaatgccaccaacagccagtctcttccatcagatgcttttggtggtctttgcataacaccattctctggacatgaatgaatgaacggttggtctgcccctcgatgacagttttaatgttattttgctcatttattcagtgcatcttgatggttaatttaaaaatctatttgaaatatgaggcattatgagaagactgttaagttttgaaatcactcactgtcttatttttgcaagttttggaaataacagtacccaccaggaacaccaagctgttttaaaatgtgttccacttacagttgtttgtctacaagtcgggtttggtttaaacagacattgaatgagaggtgagagggctgtgcttgtacttttaccttaacaccactgtgtttttacttcctgttaaaattaactttattagaggtgctgtatacttagaatccctctgcatttggcaccataaccatcatatgcagctagacttgatgtccattgtacaaaaatgtgagcgagacataggcatgtggggagggtaaagctattcaagggctagtgactacctttgtgacttcagatgcagttaaaatcccacacacatgtccaccacatgagcaggtgatgatatgttgaagactgcagagtcactgttttttatagttctcttccaaagcgaatgtattaccataccagatttatgtataaatgtttatgcctggaatttgcatttcctaaaccatgaaagagttttgttgagaagagcacgaaggaaaaacagtgaaactaaccagttccttgcttcaggaaccacctctgtaaggcagctctttgtgcttctcaaaaacctctaaagatgttgatggtgatccctcggtcatgaataccagtaactcataaccatttttgcaagaatactgtatagagtgggacccaaagactgggtaatgtcagtattatccaactaaaccttgacatgttttggcaaatgttaaacttcagaaaaagaaagaaaagatgaataatgcaattaaccctttgtataataaattatcagcaattcaaatatgctgtaaagtgttaacactgattgtatcctctaaatagtgtctagctcagccaactgttatcctttgccatatctgtgtaccatttaaaagagggattaaaaatagtttcagtggatttactctacgaagggagaaaggtaacttttccaggtaggctgatgttagagggcagttttttgttttttgtttttttttgagacagagtctcgctctgttgccatgttggagtgcagtggcatgatcttggctcactgtaacctccgcctcccagctcctagcgattctcctgcctcagcctcctgagtagttgggattataggcgcccgccaccactcccacctaagttttgtattttcagtagagacggggtttcgccatgttggccaggctggtctggaactcctgacctcaggtgatccacccaccccggcctcccaaattgctgggattacaggcgttagccactgcacccagccagagggcaggtttttttagtgacttaaccatccagaaatgattaagtttactttgttattttaaattctatagagaagataagaaagttcccagttttcctgagaagagcatgcaatggcgtctctccttctccaggccactgccagggctttctgtgaaggagctggaagggagagggtcaagagttcttgttgcttcatccagttcccaagaaaattatagcctgatgtgtcatgcattgtgagaagcaggcactggtgaggagagacgagttttggtggaggcagtaaatgaagtgcaaccagatttaaatgacctccaaggagcctatgagatgcactgtggccttggtaggacaggggagcagaagtcatgctcacaccagagggagttttgcagggactggagaaaggagctgcaaggggaggaagaggctctataactctctccaagatagaaccagggaggtagaatggctgtgcagatgttggaggtcccgggccaggtgcagctgggccagggaaaggggaaggtgcacagatggttgggcacctctctgccaggaaacactcattgctgcatcaggactggggtgcccagcacagctgtgcagacttcccggtccccaggatcccttggggatccttctgagaggaaggggtgatgtcacagcccacacctgaccccacctgggaccccttcctccccagggttgcaccatccttcctgaccctgccgtggtgcagcgtgtgtgcacacgtgcaaaacagagacagggcagacgtgatgttaaaggccatttgtaagcacaacagattgcaggatgccatcgatgcaaaaagagtttgagagaggagctaacacatgagattttcttttattaaacatattttatcttgcttttttttttgtaatgtttccactgggtggtgctgcaggaattcctaccttttgccttggatctacccttcccagaaagacgcctctaaagcataataggaggaagtcctgatttagaaagattttacagtttcaacacaatagaagagttggaggatgctctggcaggaaatgtttcagtttctggatgtggaaaaaccgccatcattttgtatccatgcaaaaaggttctcattgcactgggtaaatactttcgactttcatcagcttcttctttagcacagaaaatctttcaagtttatcagaaagattagggtttcattctagtggaagtggtctgtaagatttcctttattttgatttttgtaacaccatcttaaagtaagtaaataaacattttcttacattgacaaccatagatttaagaaaatacttctgtcaaggctgtctttaaagctgaagacattgttccatccttattataaagatcatttatacagtgtactgatcaaaaggattacatatttttactttcaaatactttcaagaagtcttttagtttgatagtatgtaaaggataagactgactttaccccttctacagaggagaaggttgaaatacagaagttaacatccctgctgtagctcacacgactttttctccttttttttttttttcctacatttgaccaaggcacagaagatcacacaactttttaaggttttggctgcaatgaggatttgtttatcttgacctcccccaactttttttctgttgtacacaggattgaattgtattgatattaatagtacaaaaatttggggaaaagattttccattcaagcaaaggcctctgaaacataagaatcaaaagtagtatgagggtcggggggccagatgcccactggggatttgagagctcattaatttaaagctcaaactgaaagacagtttgtaagatcctagtaagtttcactgactgcggaacagcctgtttttttcggggcatgttgtggtcctccatgaaatcctaaacactgctttcttagaacctgaaacaggcttccctagaggtgtttctttttaaaggaaagttttggaggcactgctgggtactagggaccttgccagatcctgtcatgcacggtttccctgggattccagcctgtccctattcacacttgaagtgcttctcatgattcgtttcgtgatgtgaggtgcatgcatgtttggggcccctcttgggctaggctagctcacttctgtttcctctgactttcatcctgttccaccgccctgcgcgcgggcgcacgcacacacacacacacacacacacacacacacaccccgagtgggaggtccaggggcaccgacttccagaacacgcagcttctcaacggcccacttgtatcgagaaccacccttgcttatttagtgttgggtgaaccttgaacctatttaaaccacgatacagatctttgaaaggagggcactggttaacaaaatggtggatggggtggattcaaagattctttcttgaaacaacccaactggagcagctggagacacagatgaggcaacaccagaaatgaacaaggaaatgtcctgatttgattcctagtaggaatgtatttcccacgcattacaatgagacgtttcccttagcagcagtgaagtgtgcatatgagaaaagaagcctctactgggggcatatgcgcgttgattaagaacctggactttggagccagatgcccctggatatgaggctctgttggcccattttacccatgtggccatgagtgtcttatttcacctttcgaagtcatagttcctcgtgggcacagccaactgagagtattaaatttagacagcatgtataaagcactcagcacaattcctggtacatagtaagtggtcatcaaatttaattgcactaaaaagaaaagctcctatttaataaagtaatggatttctttaggtatgggcgctgttcttcagaattccatgggatctcagcattgctggtggtggaggatatattaatagctaacgttttcttagaacagtgctcttaatttgaaatttataagttatttttagagttttataaatcctggtgaaattatgtgtattttgtatagctgtatatttttcctagagaattttagattgtcagaaaggtccatggaccaaatatgtgaagaggaaactgccctggggatgtcattgtgtgtttgtgtgtgtgtgtgtgtgtgtgtgtgtgtgtgtgtgtgtatcagttttatgtatgtgaatatattttaggttgaatatatgagattgctggtatttaactagttttgatctctaaaaagaataatttcttacagttcaacttaatagttgtgatattatgaaacaatttgaaatatatcacaatgtgatatttataatgaaatatgattgtagcttatttttgtacgttatttatcaaagcctagcaagttaaaattcatcaggcagccttggaccactagtaaccatatttacctaaaataacttgtgcttttccattgaccttaatcacaggaaatacaaaataaaaacttttctgtgtccagtattatgaaacagtctttaattttcattgtggatttattaatagctttattacatctaatgaatcatttttctgatccaaatgactactgtttaggagaatctgcttagtattttttccctgttgaattcacaatgttaattactttggggaggaacaaaaattctgagttttcttgggcgataagaacctcagtgttgtttcagaaggcagagttgggctgcagtactgaaggttaaaacagagctaaaacacaagacaaaatgaaaccagagctgcagtgacaaagtgggacagatgtaggaggccaggtttcctgtggcccattttccagtttcctgcctgcaacctgcagaagaagaggaagctgaatgttaccaagtatgagaactgcgggacgtgcttcaagctagaattaagagaatgcaaacaacacaggcaacaaaaacaattgcaaagaaagtgaatgttcaggttttagtccaaaaatgtctgggaaggaacagcccatctgtttaaagaaaaagcattgtcagcagagcttgtccttccatgtgagactctgagggggcctagggactgcctcaggttgtaggaacctctgttttttatagccccactcatctttcaagacatggtctgctgttttaatacagaaggttacctgaaaagattttccctgcaattcccaggacttctaaatctgtttcctggggatgttgttataggggggaggtggatgtggttaaccaagcagctctaatgaacggcagcctcaatttgggaaggccgggtgaccagttggctgctttgatctaggaggcttatattcctttaaccacccaataaaatttttgtctgatgttttcaaagaagagattaaatgaagatgtgtgtgtgttgaagactgcatagtgcacactctgtgtggctaccggtgagccacgtggcgggatacaggactcaaagaagatcacactggagaagggagtgagttcatctttctcgcgggggagggggaagcaaaataaaattattttttctaggctctttagctcattttggaagagtctgtgaagtcagatcttacaatacccatcttagagaaatcgagagccaaagaaattgtgattcattacacaccttttaattgagtacctattgtttgtcaggggctgtgttggaagtgctgggtaatgcaagtgaaatgatggctaaaaataaatagctgtttatgtgttgtggaaggcttcatataaggcatatacgaagggggcatagaaaccttgttgaaggtttaaaacatatataagcctttggcgcagtgccatgctttttccacacaccatctcatttaaattgccttgctgctttgtgctacagagaaatagggtgtgcttctgggacaatcagttatttctttaccctgcagattgaccacctcttcttctctaagcccagaaagaacaaactctatcccaggaatcttaaaaagttttggactgttagggatcaagaggtacccacacgaggcagccttggatggaaataggcccttttctgtcttactgtgggcccgctctgaaaatgtaggataacatagggctgggttgtatggtggttattagggtggggtgcggtgaattctgtgggaaaaagtcgaatggttgtaagacattttctcagccagtgttaacgaagccatcatttactactcacccatataaaagtcactgacaaaccaattgagttacttctaatttagccagagacagcatagttccagaaggaaagaggggtgttcctacacacagtaaattgcatatgttgttatttcagtggttgtcagtgatttcctctgaaaaatctctctttttttttgttttgtttttgagacaggttcatgctctgttgcccaggctggggtgcagtgatgtgatcacagctcactgcagcctcaaactcctgggcttaagtgatcctcctgcctcagctccccaagtagctgggactacaggtatgtgtcaccacatccagctaacttttgtgttttttgtggggatgggggtctcgtgttgcccaggctggtcttgaactcctaggcacaaactgtcctccctcctcggtctcccaaagtgctgggattacagacatgtaatccgttcattaaaaacccagtaatccttgcattgtgctagatattacattgtgctagatataacatgtacaggcatgtaatcccagcaacctttctctttcccaagatggaagagttatttaaaaaacattgcagactgggccagacacggtggctcacgcttataatcccagcactttgggaggccgaggtgggtggatcacctgaggtcaggagtttgagaccaccctggcgaacatgctgaaaccctgtctctactaaaaatacaaaaatgagccggaggcagtggtgtgcgcctgtagtcccagctactcgggaggctgaggcacgagaatcacttgaacctgggaggcggagcttgcagtgaaccgagatcacaccactgtgctccagcctgggcgacagagcaagactctgtctcaaaaaacaaaacaaaacaaacaaacaaaaaaaaaaacagcaaaaaccattgcagactgtaaagagtaagtaaataggtgagcaatacctacttttgtttaccttttttaaaatgaacaatttgtagatattcacagaatgcaaatacttgttaataaatgaaaagcttgggagacatgaagttggcctcatgccttttttatacacagtgataatgatcaaaataatttaaatgtcctttgaaaataaatttaatagtcttccaactcacagaaataataaaaaacttcagaacttgtataagtttttttttcaaatattatccttatttacttaataccttacacttactctgtgctgagttattgcagatccctaataatataaaatgttgtcttccagttctttgactgaggtacagggttcattttctataatgaaatggctactaccctttgtcttagacaatgatagtatcatgacatggaaatgcatagcagatactggcagaggagttgaactcagcagaattttcagtaagaagtgttcaaatccatcttcatttctctaaccatgcaaaatttaacaaacgaaaaaagacatgggtacctcatgagcacctattttgtttattccttacccagaagtttttctccttttcttgggctctcattgccttttttttttttttaagttgcctcgtttcttatttcccaccacatagaagcttaagaaaatcaaagctaattctgccccctcaactcccacctcagtaaaaatgaaacaaggaacatgcaaagggaagtgctaggttgccatcagtagaaagaagaacaaataagtgggcatttcgacttctaagaatggaggcaaaaacctcatactttgcataaggggtctgtgcggcccttgctcacattaagacgtcgggcgccaccttgtggccgacaggaaggaggtcagcttccaagaagaggccagtagcttttcggtgacagaggcaggaggcagctgggacacctgaagctgggatcgtgtcatgtgacctgacagctctcacgtaggcggaggcgggcacagcgtaatgagaatgatcaatatttctgtcaatagcatctttctttttgaggctccgtcggattaaagaatgaatcaaagttaaataaaaacatgggaaagactaaagagggacataaaacctttttttttttttttttttttaaagagagatggtctcgctctgtcacccaggctggagtgcagtggtgcaatcacagctcactgcagcctctacttcccaggcttaggcgatcctctcaccccagcctcttgagtagctgggtggacaggcgcggaccaccagacacagctaatttttgtattttttgtagagatggggtcttactcttgcccaggctggtctcgaattcctgggctcaagcgatccacccacctcggcctcccaaagtgccaggattacaggcgtgagctatcacgcctagcctcaaaactgttttcataactgcattctttaagtgcaaaaagctgaaaacagaataagggcagaaaataatcactcagagtctgcaaaaatgtccctcccctctgtgccagaggtcaagcgttttactctcggcctctctactctgtgtcttttgccctgaccagcccgtgaatgccctcctgtagggccccatctgcagcggctatgagcggtgttgtcatcattgtcccttggcttgtcatttagaacatctttctttcttcgctatctgacccaacagctctcatgtacttgactctccttcctgctccagagaaaccacatagatgggagccgaatgtaccccagggaaggagagagccccagggaccctctttgctgaggtcacacagcttggaggcctcagggtcagcatttaaaccagtgtttgttaagctggagtcggagaatcagtgccctagcatctgagttttctgcaagcatttacgattttttgtgctttcatatttgatgatagactacaaaacagaagcatactccaagtcaccttataaaccacagtcgccatgtggctgaagagtctccctggatttcagtgcctgtgtggggctcattgcctaatggacaaagagcccaggtgggtgctgtagctacacaatgccttctagcctggtgaaggccatgtgactccacagcaagctctgtgaggaggattccctgtagcttaaaaggtaattgtagttaacatttaaatagcacttactttgccccaggtgtagtttaagtgcattattagtaacttctgtaactcttacaacaaccctgtatgatatgatacttttatcatatcagtcccattttacctatgaggatactgaggcacagaaaggttaagtaacttccccaaagtcccacaaccagacaggacgagtctttgctgttgaacccagagagtcaggtgccagaatctgcgcttaccttccaaatagacaaaagtgcttcactagcacctgctttgagttatagaaaatagctaaacagctggatgcgatggctcatgcctgtaatcccagcactttgagaggctgaggcaggagagttgcttcaggccaggagttggagactcctgagcaacatacagagatggtctccacaaaaaattaagaaatgagcagggcgtggtggcacatacctgtagcccaagctacttgggagctagagatgggaggattgtttgaccccaggaggctgaggctgcagtgagccaagatcgtgccactgcactccagcctggctgacagagtgagacctagtcgaaaagaaaagaattatgcttcagtgaaaaactgcattcttgactctagagaagactccctccggatgatgtgattctgattttttggaaggtattttacaacgttgttgactataggtaactgatcatgaaataattctcgtctatagacagccaaattctgtcttacagagtgccattgactcccacccctagttttgcctccatttaagcatttatttcaatgttcttcttctataaatgcctctattattcagatgcttttttgaactcattataacgtctgcctggttccctactgaattatgagtgaaataaaatctcgaacgtgttcattttgatatctgtatgagagccatgatttaaccctcttttgaaaattattttttaacaaaccaattcctcagctgggcacagtggctcacacctgtaatcccagcactttgggaggccgaggcgggcagatcacctgaggtcaggagatcgagaccatcttggccaacatggtgaaaccctgtctccactaaaaatacaaaaaaattagctgggcgtggtggtgcgcacctgtggtcccagctacttggaaggctgaggcaggagaatcgcttgaacccgggaggcagaggttgcagtgagccgagatcgcaccactgcactccagcctgagggacaaagagagacgccgtctcaaaaaaaaaaaaaaaaaaaatcatttgtcaacactgagaacgaaaatcacttttcctcctcctcctttaaaggaggtatgcatatgattcacgtttgacaagctgctctaaatcatctaacttcactctaccatggcagatcacagctctgcattacaaagggaaaggagttggggcaagtaacaggtggttttgccctctggagtaggagtgggtggacctcagccccctgtgaccatggtcctggtcagtgctggtagaaatggtgagagaccagccagagacgggaaggccctgcaggctgcaaggttgaggtgaggtcagaggaatccagaaagtatcagatgtgaagggggcacctcttcctgtaagagcagcaatgcctttaaaagcagactgatgggcctcagtatgaaagcacagagttcgattctgcaaaaagaatggcattaaaatacctgataaaattttgtacattcaaaataaggtctgataaggacgggaataatagactggggactccaaaagtggggagagagggagggagtgagggctgccagattacctgttgggtgcagtgttcgctatttgggtggtgggtatgctagaagcccaatccccgccattatgcagtatacccatgtaacaaacatgcatgtataccccctgaatcttaaaaaagtgggggtctaggcaggggaaagataagcattttttttttttttttttgagacagagtctcgctctgtcacctaggctggagtgtagtggcgcgatcttgcctcactgcaagctccacctcctgggttcacgccattctcctgccttagcctcccgagtagctgggaccacaggcgcccgccaccacgcctggctaattttttgtatttttagtagagacagggtttcactgtgttagccgggatggtctcgatctcctgaccttgtgatccgcccgcctcggcctcgcaaagtgctgggattacaggcgtgagccaccgcgcccggccaagataagcattttctcattagataaagggaattttaaaaaaaagatttctagcatgccttttatgtgttctacatttttgaagctcagagtggtgggaaatcagctaagtaaagttaggcagatgaaacattttaacttagagcaggcctccatgtgcataataatctatcaaacataaatctcaagtaccaccactttttcaattgttgatttaataaaagccacagtgtactgtctgaattactcacattccttaaagtggcatccagataaatgggctttattgtacctgcctgttaagacattggacttcattaaggattctaggtatcaaggaattaatttagaaaaaaaaatcgtttaaattttttttccggtgagagagatactcatatagatgagtttacgaaaatctgtagtgttagcggttattggaagggcgtacctcccagcatgatggtacaaagtctgtgttttccaacaccccagagggcaaaatttccaactggcagaggcgcagtggaatgtacagtgtgattgtatgtgaaaatagttgtgtaaattatgaaacttgatctcatagttaaactacgtcgagtggaacgaaaacaatatggagagcgctgtggcagctggtggcccactgcccacctgtccccctacccaaacctctgccacagacaaccacgcattttcatcatgcagatggctctggccagagaggatggtgggtcccagagctgcctgggggctccacgataccccagagtgacttctgagcgtagacaggagtgactgatctttgtagatgcaatgataagctcacaggaaagtagtttttcgacttagctctgagtaatgtctggctgcgatttccaccgggaaggctacatgactgcccagtcatcgaaactggtggatccaccaggttgaaggagtggctcaagagagcgcgagaagaggagaacgaggccctcagcacggggcgaggctgggcatgcctcagacaggagaggctggagcccttagtcacctccgccggagcagtgttgcgcatagcaacccctctgagtaatcctctgatgatcccctgtgcctgcagctgccacccaagctctgcagcttggttgaactgtgggggcatttctgtgattcctagtgaacagctcttgccttctctaggcgagttcctttattccagaaatctgggaggccctgaagcagtaggtccccatccccaccactgctcctctgcctgttccctttctactctttcacctgtcctttttgtcctttttctttctttctctccttctacctttgcctgaggttatggccatagcacccatggctgccacttagcccatgtgtggcctctgagtaaaaatgtgatcagccgatccctccacacctagtagcatactttttcgtgattttttttttttttttttttttgagatggagtttcgctcttgttgtccaggctggagtgcagtggcgcgatcttggcttactgcaacctctgcctcctgggttcaagctattctcctgcctcagcctcccaagtagctgtgattataagcgcgggccaccacgcccagctggttttttgtatttttagtagagatgggatttcatcatgttggccaggctggtcttgaactcctcctgacctcaggtaatccacctgcctcagcctcccaaagtgctgggattacaggcgtgagccaccacagccggcctttctcatgattttgaacacaagctctagagcataaagataacagcaccccagcaaagggagaattttttttttaaacaaagacatcatgtattttaatagtcagcttttgctgcagtggtgctgtgtaaccagttgccccaagatcactggcttacagtggcatttatttttctcacaagtcagtgtcacggatgctgcttcagatgatgggcgggtggggcttggcttcggactttgggttgagttcaggtcacctccatgtgtctcattctggggcagcagcttcctggcagcatagcacaggaggaaaagtgccaacttatgatgcctccaagaccccaactcggcaatgggatgctgtcactttcccgtgtcagtctcctggccaaatgcaatcacatggcaaagccccaatgtcagcactcctcccacagccactccagtgcagggctacacagtcacctaaggagagggcagttgagaacatttaacaagtctgccatatgggttctcataagtcatgcccagaacatggtctctgacacatggggttggattgcaatgaaaagtgattctgtgatgcacaagaagctccgaggaggccaggcaggtggaaatgctaagtgtagtaaaatacatggatagatgtttctgctgccctcctgtcccattcggaacgtgatgtcagttaaaagtggggggtggcggtggccgaccactttcccacctggcatgtgagcagaggccccacagtcccttccctgcagacctccaaacccaccggcagccttctgccctcaggagcagattcatctgagcaggcacttaaagtttcaaagatatgttaaagctgactgactgacatgtttggccaagaaaatctcaagaatttgcgacaactgttagccgttcttagtgccagtgaagagaagaaagttgtggctcatatccaagtcatcagaagggtggttcataggaggagttgggactcgtcagctgccatgcatcccagcaaagtgggggcttgcaagatttgtgagatgcagaggtggttttgacccagcagtgaaatgactgtcttacagaccattgtggttaatactgatttctgtaaagaatatcccctttaaagagccctaaataaaatgccctgtgggtaattggagagcactcctagtctactttcctttaattgagaggagttgtggggttgacaatattggtacaaataaccctccccaaggcaattattctggcttccaggtctcccagagctgccccctgggttgcggtcactccaggttcagtcccctgccccccgcccaccaggacttcagtgtctccctcctatccaaggggatgatccctagctctctgtgccactcacaacagttgatccgtggcaaagcttttgaggccagtctaaccacctttttttaaatgtaatgaggattgataacacaaatggattattattattattactacttagaatcaatacctattgtcatgaaagtcctcaaaggcctgaaattgagaaactgcccaggagtggggaaaaacttccttgagaaggccctatttgagctgggtcacaatggatgagaaagagttcaccaggctccaaagctaaggaacagcattttagccagaagaaatagcatttaaaaagttcacaccagagttgaaggaaaaggataacattgtatatataggtttttgtctcttcatgggagaaattgcttttcccatctgtgcatctgtgatggtgggctttgacctgcagcatggtgagtgccgggaaagggaaggtctctgcaattggcagtgattgttcggtttcacaagcatccacggactgggcagctttgagcattgtatgggttatcagagtgctggcaatacaaaataatccagcaaagtcctttcctcgtgaagctcatcacagtaggaaaggcagttacacttagacatataccacaaccacaggagagatattccaggcacctgtataaagtatggggtccagcattttagttagagaccgactatattagttctttctcacattgctatagagaaataccccagactgtataatttataaagaaaagcggtttaatgggctcacagttctgcaggctgtacaggaagcatgatgctggcatctgctgggtttctggggaggcctcaggaaacctgcaatcatggcagaaggcaaaaggggagcaggcgtgtcacatggccggagcaagagcaagaaagcgagggtcaaggtgccacacactgttaaatgaccagatctcatgagaactcagtcactaactcaaggatggtaccaagggagatggtgctaaaccattcatgagaaatccacccttaggatccagtcacttcccaccaggccccacctccaacgttggggattacaattcaacatgagatttgggcggggcacacatccaaactatatcacggacccacaaagaaattgatgggatgggcgggaatagacacttgtgttaagtggggaatggtttgaatggggactcattctgcaagtggtcatgtcattaatcattgttctgcatcattccccatgcatcgctgtcactcgtggggacatgtggtgaatagaggaggatcacagggcctccctgtatttctgaattgtggctccttacagaaatgcagccaggaagctcctggttcagagtggccccttgagatggaagtgaaagctactttttattaggttcactgggggaaggaggggacagctgagttgcccattctgaagccccctctctcctcgccaagtttggtcggcatcgtgaccagcagctctgacctggcctcctctccctgcaggtatggagagtgcaatcacgctgtggcagttcctgttgcagttgctgctggatcagaaacatgagcatttgatctgctggacctcgaacgatggtgaattcaagctcctcaaagcagaagaagtggccaagctgtggggactccgaaaaaacaaaacaaatatgaactatgataagctgagcagagccctgcgatactattatgacaaggtaaacccttgaccttgcatggggccgtcttggggagggtggaatcccctctgcgtagttcactgatgaaagaaaataatagcgtgctatgaatcaagttagaaaataaaataggggcagtgcataccttctttttggagaaaagctgtgctgtagggattttccccaccctctggacgccctttggatattactgagggtcacattttgtttcttctgcattttcgtctgagtttgctgaagaactttgctcacaatacaaatgagatgcaggcaggctctggggctttcctcatgttgaattgcttgaatgacacaatgcgtgttaaaatccggaaagtctgtttatcctgtctggtttgtggttcaattaaagggacctttcctggaaggtggtagctttggcagattattttttaacaattcagtgcctcagtatcctcgtttataaaacaggaatcagcataggaataataataggaataggaatcctgtctcaggattgtggtgatgaccgaccgagccattacatgtaagtacttagaacgctgctaataggagtaggaatcctgtctcaggattgtgatgaccaaccgagccattacgtgtaagtacttagaacactgctaataggagtaggaatcctgtctcaggattgtggtgatgaccgaccgagccattacatataagtacttagaacactgcttggtatgtggtgcttgcaacttcatgggaaacttccctaattggaagaaaaaacatgttcatttttaagtcatagagatgaggcagagtgccttgataagtgataatatagcgtagttgccaaaaccaggacagttggagtgagttttaatgcatttctggaaaagcagttttaatgtgcttgctagggcaaaattattgctgtttaggagaaccatttcaggccttaattgttagccatttcagtttgaatctgttgttgctgaatatttagcctctaagacataaaggcatagagccatgataatggtaagcttttgttctggttttattgttcatattaaaaggtgaattaaaaactgatttaaatattagttcctgatctatatttagggtatgccgtctgccaacccctttggaattcaagacataaggattatacgtttcaggaagtagagacatcattaattataaagtgttcctttatgtgatcgtaattgcacgtgattgtgtcattgaaatgctaaaggtgctctcctttaacgtagcaattaattaatcctgacttactgcagagtcctactaagatataaaagcacttcttgcaaattgcactgtctgaaagcctcgcagatggcttattgttttgcgtgttttcccaggttctaaattctgcagtgggaactggggccgctgaaggaaaacactcccgttgcctgctggcagagtgcctaaaagctgggctttgagactcaaaaagcattttcattgttttcaatcaaggtatcaaaaaaagaagtcctccctctgtgtctgggacttgactcatctcttccctggcctgggcctgggggcttaagggttgtgtctctttagcatgaagggttgtcctgggctggaaatgactgctcacaaaattagcaaagccattcctgtttagactatatcttatctcccttgggcagattttaaaatctctagagagagcagtttcatagccttcagtcaacaagtatgttctggcactttctgtcagacgtctaaggtgctgtgctgagcacttcttccccttgtctcctttaaactttacaacaaccccatagacaggtgctgctgtcatcatcctccttatacacatgagaacgtggaggcttggatgagaaacctgcccaggtgcacacagccagtgagcagcagagcccggatttgaacccagctggtccacccaggttcccagccaaaaggcacacacacaccctgccttctgggccattcatttcctttgcctttgagtgtcttgagttccaggtaggcagtcaggctgtccaaagggtattacaacctaagaagttttgtttattaccaagagcctcaggctgggcatagtgcctcacacctaatcccagcactttgggaggctgaggcaggaggatcacttgagtccaggagtctgagaccagcctgggcaacatggtgagaccctgtcacaacaaagaattaaaaattagccgagtgtggaagtgcatgcctgtagtctcagctacttgggaggctgaggtgggaggatcatttgagcctgggagtttgagactgcagtgagctctgattgcaccactgcactccagcttgggcaatagagggagatcctgtctcttaaaaagaaaaaaaaaaggaaagaaacaaattcagtactgaaaaatcccagcaaacgatgtgtatcaggtagagcccaaggtcaggagtccaggtggctggtgtggcctgcctgcctgcactgcccctttctctcttgccaggcagagcatgggggctggccacatgacctttgagcagccccaggcatcaagctggagctggcagtaagggcaggagcagcctcctatcctgttgtatcatgtagactttggccaccagaagaaattgctccatgtctttccttctacagatatacctgtccacatgcacacacacacacaagtatacacatacacacctgtccacatgcacacagagatgtccacatgtgcacacccatgcccacacagatgtccacatgtccacacagatgtccacatgtgcacacccatgcccacatgcacacacagatgtccacatgcacacacacatatgcccacatgcacacaggcacacacacccacttgcacatacatatccacatgcacacgtggccactgccatatgcacagacatgtgcacacgcatacatgtacatgtgcacgcatggctggttaattcttgcttataaaatgctctcaagtgatgagcaagacggaaagttagactcttaatacagtttaaaaagaaaagaaggagagggggaggaagataagaagaaaagagatggttgagggaaatggaggggagaggaaaaaaagaggggatggagaaggaggaagaagaggaggcatgtcaaaaagagatgacgaaaactacactctatttgacattttccgatgacctctttcttccttccgttttgccagtgtcactctgtgatgataggtgtaagttgactgtgtgcattgcccgtctgtgaccgttttcgactcacagaaatggcagtctgaagtggctcggcctcttgcttgagagacagattggagcagagtctttgtggatgcaaagccacctgggccactgccgtgtgtgccaccctgaacttcaagctgccctgaaccgcgtgcgtttctcagtgtcacgtacagctcggcctgaccgtttgccttttagtgttctcttccttctcggtgtcctcctcctcttcctcactaacattcatccagagcctttcagtgcagaaatcaggtagctgctgaactcggcagctgcgtcctttttcccatcatctcttctgtcctttgctagctgtcatttcttccctcttggcttcaactgcacatccctgggtttgtcctaatagggaatttttcccacttgagtagacaagcatgagaatatcattatttttatatgttatatgttatatttttagcagagaaaaaagtggaaaatgtgtgcaaacttgcagaaggccccccggaggagggtcgtccctgtgcccatgctgtcaggaaggccccggaggagggtcgtccctgtgcccatgcggtcagaaaggccccggaggagggtcatctctgtgcccatgcggtcaggttggggctgaggcactttgatcattgctcctcctcagagtgttcttttcctcccctctcagattataataacgaggtagttacagagtgagctccagcctagatcgtctgggtttgaatccagctccatgactgtggccgtgttgcctaatctctctgagtctcagcttccttttctgtaaagtgggtataatagtagagtctacactgtggggctgtggtgggattcattgtgttcacacgtgtgcagggctgagaacagggccccaaacagggtaggcacaatgaagcatgagtcagaataataatacagatgacagtttctctatcactaatttgaacattgcagacagtgcaaagaagaaaattagaaactgggaggatcacttgagcacaggagttcaagtccagcctgggcaacgtagtgagacccctgtctctttttaaaaaatttagcacaatttattaaaaaaaagaagaagaggccgagcatggtggctcacgcctgtaatcccagcactttgggaggccaaggtgggtggatcatgaggtcaagagatcaagaccagcctggccaacatggtgaaaccccgtctctactaaaaatacaaaaattagctgggcgtggtggtgcacacctgtggtcccagttactccagaggctgaggcaggagaatcgcttgaacccgggaggcagaggttgcagtgagccgagattgcgccactgcactccagcctggcgacagagtgagactctgtgtcaaaaaaaaaaaaaaaaaaaaaaaaaaaagaagatcaaaacctttgttgctacgttgctgctcaggcacatggagatagggaaacgccggatctgagtattatggcccttttcacttaggacctatcaggagcactttgtcgtgctttttaatgactgaagacagatgacaacagtttctttcctcagttgcttattttcatatatttaatctgttctgaaaattcagctgtgaagatgctttcttatttaaatgactctccctcaccgctctgaatcaaagctctggcacttctctgagcacctgcagttggagccagtctccaccttctggactgtcttagtgactggtgggagctttgtatccagagccctcgaggttaagagtccagctgtccctcaacctcagcgtctcagttcacccattggaaagtggtgatgggaacagcacccttccttgtcggactgtgtgaggatggaaagagaagataagatgacgcggataaggtgcttagcacagtgtcaggcacctactcagtgaaggctcctcattccagttatgtgtatttataaaactgactgtattatgtcgtagctgtctgtatatagctgacttcatcgtggccttctggatgcaccacttttgtcgctctggtacctcggacagggtctggcatgtattagttgcttagtaaatgctagacgagtgaacaaatggataaaacactgatgtgtccactactcaagtgcacaccatttatgtcatgaaagttgatattaatgagtgataaactaaaaaataaaagtagtcactgctttttgtttattgtcccgtagtttcctagggctgccaggtcagatgaccacaaactgtaggtggcttaaaacaacagaaatgtgttgtctcacagttctggaggccagatgtccagagccagggtgtcagcagagctgtgctccctctgactcaggtggactctttcttggcctctccccagccccgggcttgccagcagtccctggcgtgccttggcttgcagcagcctcactcggatcgctgcccccatcatcacatgacgttctccccattctgtgtgtccagattttccttttttttttttttttttttttttttgagacagagtcttgctctgtcgcccaggctggagtgcaatggcatggtctcagctcactgcaaactctgcctcccagattcaagggagtctcctgcctcagcctcctgagtagctgggactacaggcatgtgccaccacacctggcgaatttttgtgtttttagtagagatggggtttcaatatgttggccaggctggttttgaactcctgaccttgtgatctgcctgcctcatcctcccaaagtgctgggattacaggtgtgagccaccgtgcctggccgattttcctcttcttatgaggataccggtcattggattagggcccaccttaatgcattatgacctcatcttaacttggttacgtctgtaaagacccctttctaaataaggtcctagtcacaggtattggggattaggacatcagcatagtttggggaaggacaaaattcactctgtaacacctccatatacagtcatgtaccacataatgttctggtccacagtgggccacgtatataacagcggtcccataagactataattccatatttttactgtaccttttgtacgtttagatacgttgagatacatacatacttactattatattgcagttgcctacatacagtattcagtacagtaacgtgctgtacaggtttgtagcctgagagcatatagcatagccttggtgtgtgataggctagaccctccaggtttgtgcaagtacatgctatgatgctcgcacaacaacgaaattccccagcgacacatttctcagaacgtagcctcatcgttaagtgatgcatgactgtatttcagacactgctgggctttttgtttagatttttaaaattatacttaaaaggagagtgttggtttccctctataagtgatggttcgattcagcaaatcctaaaaggaaactgctccccatgacaggcacagcacctagattctgcagcaggtataaacactagactccgtgacaggtgtgacactagaatcaaagacacatcgctgagccaagtccccagggtggagacaggtccacccaagaggagtcctgccttggagggattcagagttgctgggaattgagcagctccctggtctcgaagtgcacatgattttaatagatgacttaaatgggaagaaaaggcgaccctgggggcgccaatcccggattggcagtgctgggatcggaggctctgatcactgtgctcagaggctccttcctgcatctacagttgtgcggagtgcacgtgacgcaggtgtggggaaagtctggagggccagggttccgcatccgagctccaccagggaactgctttccccagttaagcttttgtagaggctgcggggcaaacccaattataattccaagaaaggagtgatgccccatccagggagcggcatgttttgcaacccgggtatggatgaaaggcccctgttgatttgagaaacacacaggtcatgggaggtgcctgtggctgagcccgtgaggggcagaaaccagagtccgtagaggcctaaacaggacatttaactgaggcctgggcattttacacttcctctctgtcaaacagctttttcccttggtcttgttttaagccctaggagataggtttgttactgtagttctgatggtgtgaatttttggataagtttttttttccttaggtttaaactgagtcttccagaaggtagttttataacctgatgtaacagtaaggatctttttcagagattttatttattaacaagctaacaagtctttcactccttaacatcagacagatggacccttcatcttagagtagagaagagcggggcccatgcccagagcatttctgtcactggccctgacaactgccaggcaccttatgggtcaagcctgaggggcaggaattcctgctgggattcacagcattcaccacttcttgaataaggcttttttttggagacacagtttcactcctgttggccagactggagtgcagtggcgcgatctcagctcactgcaacctctgcctcccaggttcaagtgattctcctgcctcagcctcccgagtagctgggattacaggtgcgtcccaccattcccagctaggttttgtatttttagtagagatgggatttcaccagactagtctcgaactcctgacctcaggtgatctgctcgcctcggcctcccaaagcgctgggattgcaggcatgagccacagcacctggcctagggtttttaattatacatccacctccagttgacacggcctcttctttcacctctgccttttcctcagccatccagccatccctttggaaacatacctccttcctcctgaggggctcagcagctggttggggagacagacatgaaaccaattttagtagagaaccccgtgtaaagtgctggcatggccaatgctggggtcttctgggagagcagggagggatgtagaggcagagggaaggcctccggaggtcaagacacttgatctggatcttaaggaatgagaatgagtttacccggctgaaaaaagttagaagggatataccaagaagggaacagtgtgagtaaaggcagggacgtgtggatgagtttgacctttcaagcacagagtatcttgggagtgagggcaagatgtggttggaaaagtgagtggggaatggagtgtggagtatatcatgctaaagggttggaactctgtggtgagagccaatgaaaagttaaaagctggctgggtgcggtggctcacgcctgcaatcccagcactttgggaggccgaggcgggtggatcctgaggtcaggagatcgagaccattccggccaacatggtgaaaaccccgtctctactaaaaatacaaaaattagctgggcatggtggtgtgcgcctataaatcccagctactcgggaggctgaggcaggagaattgcttgaacctgggaggtggagattgcagtgggccgagatcacatcactgcactgcagcctgggcaactgagcaaggctccatctcaaaaaaaaaaataaataaaaatacattaaaaaaaaagttaaaaacaggagatgggggagggggcggggaatgctcacacctgtaatcccagtactttgggaggccaagatgagaagattgcttgagcccaggagttttgagaccagcctgggcaatatagtgaggccttgtttctacaaaaacaaacaaaaaaaagcccccaagaaccaaaaaactaataataacagatgagcaaaaatgacaaaaaattagctgggcatggttgtgcgcacctgtagtcctacttactggggaggctgaggcaggaggatcacttgagcccaggaagtagaggctgcagtgagctcttactatatgactgcactccagcctcggcaacagagtgaaagagcaaaactctgtctcttaaaaaagcaagagagtgctatgagcagatttccattttagaaataaaaatctgtgtctcctcttactgttcttggcatggatcattttacacccaaccatacagccttgatctttctggccaggtaccatgaatctatttctctctgctggccgagttggccctatcacaccttcagcatgaggtggagagggaaaaaggatgggctctggtatccccataatgtgggcaactgtcttttgctcacgagaagctgaagacacgggttctctctgttgttgcagaaggagacctggaagctttcacaacccctcatcctcttctgtccagcagaccttttgtccttgctggcactgaacattcaaccccgggggaggctgaaagctctgctggctcccttctcatcaagagaggaaaatggtgataggatgaaaaatcctcccgtctccacagcaacctcttggcttagcctcacgatgtactgaacaatctttacttaattggaagggatttcggggagaacagtcaagacaaagtcattggcaacctattcctggaattagaacgcatcaccttcttaacttaattggataattcattttaaattgggcgtgcaatcacgacaagaaaatgttagtattaataatacatatctgagatcaactgcctctcccaagaaacctggccctggtggaattctttaattcctccaaaataaattttgcaaagataaaatgatgttgtcaaagtggagaaggaacaaacatccagcaggcattcatatcccagaactttctagaacacctctgttggtcatggaatgttagggaagacctggactccctttggggtgttttatcgatcgagggggccctctgtgcccggccctgggtgtgagtgttgagggcctggtgtgttttgttaagtgtctttctttcctaccatagcagctattcagatggttggaagcataacagatggcaatgggctattgcctgggggcgcaggggatgaccagggcctctctcacaagcttgggtcctggaagctgcttagagacctgtggagtggctgaaccgcctcatggaggtcttccaatctggtcacattgtgccgggagatggcagctggtatcaggggaccaggctgctgggagcagggggctgcgtgttgactgaaggtgctgcctgtcttgcacgtgcttccaggccagcttccctgtggcactcagtgttcccccaaaatagggcagttgctaagaaacagggatgagccagaggcccgggagcgccgtcaacactgtgttgatgaggatgcttctgcgccaggggctcggctgccaaagctcttgcggccttgccagatccacttacgtcaggctgttgcccaagcccacaccgagtctgcgtttgccagcatgagcgttcctgcttctgggatttgagctgcaggaaaatttagtggttgtgtagacaaactcacaaaaactccaacattcacagcatagcacccaccacccgccgtccacccacgcctcagctgctcctctgcacggcctctcccccacccctgcctgtgctcctccacggctcttctcagttcctaccccaaatttgtaacataaaaaagagatgcttacgtgtgtgcagcattttgttttaagccaggcactgtgctaggtatttttacatctattagcttattttccaatttgtgatgcaccagtgctggtggtcgatattgagcccattgtagaggtggggatgctgagtctccaagaggtgtaagtcacggactcaagatgcagcagcagggcggtggcagagctttcagactaagagtgttgacccccaaggcccatgcctgggcttccaaagctggagggcgacacagctccagagccctgggcccagacttgagtcctgtatgcccagtactgctgatgattaccccaagggcagccagggaggagagacaggcccccggtattttttaattgaaatgacagtggaaaaactgctggcaagattatctgagtcagctgaaaatgtgagtttgagtggccccggaataccccacgcttccagaagacgcttcctatggaaagtactggagcgtggcactcctctgcgtgtgcgcctcccagctctcggcggcctccaggaaggagtccaaactcccttcaccatctcaccccaacccaactgccttccctgcacccccacagccgccccccaccccagcatcttctcaggccccctccttccccctgcccttcttgcctggctcactcctggccacccttcagactcctctctctgcctcctccagctggcgcctcacttggtgatggccgtgtctgttccatggcccctcccagagggacttggtttctcctgctgtcattgcgtctcccttacggggccgcatgctgggttttcttaccatttcctgcatcctgcagagccgagggcgtggcagcaccaatcaagtgtagtaggaatgagtaggaaacaagcatccttctccatggcacagaagggagtctgtcaccttggaaagtcactcaagagaggatccaagaaagcgtcttgccctacctacccctcctttagcaagtgaggatcttcgaggggaggggagtttccaagtcaactggtgacaaagccaggatgagaagacactcccagaccacctgtggctaatgacacacactgcccggccatgccatctgccagcgctggaggtggccgctcaacacaggaaggtcaaggtcagtgttagcagctcccccacccagcaggggaaagggaaagacttgcactggggagcagttttatttatttttatttatttattattaattatttttagatggagtcttgctctgtcacccaggctgatgcagtggtgagattttagttcactgcaacctctacctcctgggttcgagcgattctcctgccttagcctcctgagtagctgggactataggtgtgccaccatacccggctaatttttgtatttttagtagagatggggtttcaccatgttggccaggctggtctcgaacttctgacctcagttgaaccacctgccttggcctcccaaactgctgggattacaggtgtaagccaccaccccgcctgagcagctttatgttctatgttattaacacttaaaaggcctttgaataaaagtacccttgagtgtttaaggagagccaggagggagacaggactccaggtccagccagcagcagcgcccagccaagaaggcagggagaaaaatgctgcgaacgtccagtcgaatcctcccgggttggggtgtcctgccaggccagcaagccagcacttctcactagcaccctcagggtgccacgtgtactcaggcagcagggatgaagagcgcctcaacttcaggctggccaaatttggtgagatagttcacgctgcagtttaccggtgccagaaagcaaagaaacctcaacccaaaccacaagaaaacctctcccgggagccgacagagttggcctgttcagagacagagttccagcctttgttggcagcacgtcattcttagaagtctggaatgggtgtgagtgggtgtgtacgtgtgtgtgtgtgcacactccaaagttcggctttgcacaagggacagcctaggctccaccttacccggtgcctgtaccatcgcagtgggaagggctagttgcaccccagtggcggccccaggctgtgcctcctctgcctcgctgaacagagacaattttaagaaaggggtgtattagtttcccagggctgctgtaacaaatgaccccaaacttggtggctcaaaacaatagaaatgtattctctgaaggttttggaagacagaagtgtgtaatccaggtatctgcagggccccgctccctctgaaggccctagggaaaaatccccccttcctcttctggcttcttgtgggctccagccacccttggtgttccttgacttgcagctgcctcactccagtctctgcctccacgtcccatgaccaccttccctgtgtgtgtctttctgtgtcttcatgaggacagaagccattgatttcagtgcctacctcaaatccaggatgattctgtctcgacatctttaaccaattacatctgtaagaaccctgcttccaaatcagatcacattctaaggtccttggtggacatgaatttggcagggacattaaactcactgcagcggtgggtgggggaagattgccttggtgagaagcagctcaggtttatgggtcagaggagccctttcataagatgctcttaaatagctgggtgtggcggctcacgcttgtcatcccactactttgggaggccgaggtgagaggatcgtttgagcccgtgagtccaggatcataagatgctctttagtgggggtgggtgtgaggtgagcctgccccccagacatttgtagcagagtctcttatggccagctgactgctcactgtcccctctgcttcaatggcagagacagagcagaggcaggggatgtcacactgcatccaagccactgaggggcacttcaaggacagaagctggcttcactccttctccattcctcagagcctggcatggggccacccataggagagtgtgtattcagtgttcactgaaagccaggtgtggtggcttgaacctatagtcccagctacttgggaggctgaggcaagaggaccgcttgagcccaggagctccaggctgccgtgtgtaacagtcgtgcctgtgaatagccactgcattccagcctgggcaatgccagcaagaccccatctctaaaaaacaaaaacaatgtttgctgaaagaatgtttgcttgtcggagagatacagtaactacttgttctaactttggagaaaggacacttcgggtttcatgtcaggaaggagtgagtcagactgtggtctggaagggaacccaaaagcaggagttgaagaaaatgtgttggccaggaagccgcggcctggagatactcctctgctacttgtgggtgttgtgaactcagctgggagcctcgggtctcacatctgtgaagtgggtatcaaagcgttgtgaggctaacatgagattttgtgtgagccttctgtaaactgtaaagtaaggtgcccacccaagaaattttcctggaaggcagaataaaatgaaaagtgtgatataatgagcagtgtgtacgattagattattgcatgctaagcaagattcactgggtgagggtcatgttgtaaggacctgtgtgagtgaggcactgactgcgttgagtctttagaaaaaattagcctatggggtatttttattcccattttaggggtgagcaaactgagccccgtgtagatgttcagtaactttcccaaggtcatagtaagcagagaggctggaattcaaacccagatctgttcaccccagcactgggtccacatgacttctggcccgtcaaggctcctggcctgtgcccttgtgtgagctgctgctgggcacgggcctggagacagccgggggagcttggcagtgggtgccatcaccgggctgtatatggtggacacgagcttcctgttgttttcctgtcaccctcgtcccttggatggcatgccacttatagtttggctgctcatgtccagtctgctgcactgggagtgctgggtcccccgtgcctcatgttagggtgtccctccaaagcaggcaccttctctaccctgtggattggcagaggcagttctatttctaggtaatgaatggaccttacggaagattggtctcttccgcccgaagagctagaaataactgttctcaagcaaggcccatgctttctcagcacagagctggttttcccaggcactctgcagttaaccccactattactctggaatgcagagaccccttggccctgtcggatttactttagtagcagcctctgcttccaaatgcagctgctttctggaagagggtgtggtagtggaacagaaatggcttaggtcttggcactagatacaattgggttcaaacttcggctccaccagttacaagctgtgtgaccttgggctagtcagctttttagttcctatttctttcccttaaaaagtcttaatttgacaagtaatacatatcaaatatacattctttaatgtgaaaatacacataagcaaaaagaaatatgaaaaatcactgttaaattttagtatacctcttttaagattaatttttctacctccttttatttacacatatatgcatatatacagtagaaaacatataaatatatatgcaatagaacatttttaaaataatggaattattcatactgttttttttccccacctaatgtatatttaaaggtatggggaagtgttagcaatgtcgtgtcccctgaagtagctacgtggtattccattgtatggctctcccaatatttaacctacccccaggtggtggacagttggatataacctcactgtccagggggaccttggcttctccatctctgcaatgggataacagtgcccatcctgcaaggcagctgtgtgtgctcagcatgcagctggccctcataaatgctggcttctttccttgtcctttctctgtactggttcctttcacgtagggtatctaccacgataaaatgagtgtgccccaaataaatgcattgtctcgtgtgtctgctcagcacctgaacaggttcctgcctcgggtcttgctgacaagtgcgcagggccagcagcttcccgttggcctctcccaggaaccctgagcagaggcctgagcccaagcagacgctgcaaggctgctcttctccctcccagtctgggcagcatggtttctgctctgagaagccgccgggagcagttgagatgagctgggtgcctggttagtgtctgcaccacctttcggggcctgacatgtggcgtctcgcctgtaggctgcggccagcatctaagcggagcacttggatctagcagttattcacatctgcggctccgtgtgtccccctcctagaacctccccacaacccccaaattaattggattgtgtaaggttttcgtcacagtggatgtcaagtgctggccgtgttaggcacaatataatataagccttgtatctatttcttgtctgaacctaactaaataaaaacatcatgtttccctgctcagttgagatatgtaaaccagatgtaattctgcctgctgtgcaactgatcatgttacccagaactttggacaaagctagcagaatatgcgcagccttctgtgagggttaattttgtctattaaattgtcattagggctgacacagggtgatatttatgttttgttctgtttttgcttaaatgggagtgtaaaaatgatgataatactaatagctagtatatgttatggggcttgtcatgcgtggatgcatcgggcgttctgatagaagctgtatatggatgtctcattcagtcccatgaggcagatggatcagtccccattttatacatgagaagctgaggcattgaactcaggcagtgactctggagcctctccttttaatccctgcagcagtctttgtgatagggtcaagtgggtatttattggaaaggtcccctgctctgtcccccttacccagtgcaggggttaagaagggcctgtttgttaggaaaagtcttcagcacaaccgatcctgcttgcttactgagctgctgacattctcagttttgagaacgaggtaggagagttgcagaatcagagggcaggagcgctgtgtttccagggtgccctgaaatggcagaggatccaggggccagaccagaatgacgaggaactcgccacaggcctggctcctcgcggggaggaaaacggaagatcagataacaagactaagcacgtgaactccagatgcataaccttggatcaaaattggggtgccagaccagagtgggtggacagacacatgcagcaaatatttgccacgtaaatggatgggtgaaattatggctcattaagctctcacgggaggtgtgaggttgtatgtagcatgtggagtttgcatatggcctctaatatctgcctgggagttttcagtttaaaaatgccagcaaagaagaacaagcaggtatatgtatgggatacacccacagggagctttaaccagcctaagaatgagccgtggaaaattgtgtctttcatgcctgtggctttatgcctgggtcagttctccttatagttggtaattcattcaacaaacatttaattaactcatttaaatataatcctaataacatcatcaagaaggtaaatctaattccatatgcatcttttcattacctagcactgcatatgctttttttaaattacaaaacttatcgaaatatttctcatctatctactatttgagattatttacacagactccttcctcttcaaagggcacagtggagcgtttgtgtgtgtgtgtgtgtgtgtgtgtgtgtgtgtacatatgtaaacacactgtggacagccataccttttcttataggtaggtatgcctgtaacctgtcagggtaacagacagcactgaaatggaaatggaaatatgacctgctctcttggcattttctatgcagttaaagtgaaataattgagggatcctgtcacgagatcctgtcatgggctgctgtcatgggatgccttggtccccagaggtggctggtgagttgggaagggttcttctgcacaggtctgcccggaatcctgtcccaaagggacgacttgccctttaggctactactgcattctcaaaatggcaacttggacggggtgagggattaattttggtatctggtcctcctcttttgcctggaactgccactgggctctgtttgaaggggatgttgctttttcctctcactaaaattggtcccatccttgctgcccgtaacctcacatggaatgcctgccgggcaaagaggcagcccttttgcaaatacgtatttaatgggaaattacaaagagactggtcccacccatgtaagagggaagcggatgtgtgtaacactctaaaaccacgctggagatgcactcagctccacccgacacagaccagcatcgctcaggttaccaggcaactgtgagcaacaaatacttgtgagtctgggattgaagggggtggaaacccgactttttctaaatatcctcatcacttaccataataagagcccttacccaagtgtgcttgtgtcccgggctgcctaagttggcctgaatcttgtgtcacccttcatagtagccaagacctcaggagtcagattgcctgggtaccatctgttctctccaggtacaagcttccaacagtgtataatttatactttccgagcctcagcttgcttatctccaaaatggggataataatcattccattctctaagaggattgagtgagttgatggttgacaggttcttagaagatagcctgacaaataatacgtgctcagcacatactagcttgtattattcctgacactgagtcttctcagcaaactcttggaaggaaacttccctctggaagccacagagagatcttcaaacatacatggcgctgcttctgggggcagccctggaagataaggaagaaggggctgtcagtgcagctgcagggacacacgtcctctgagcccaggttgttcctaatcctccagccgtgggcaccgctgtggggggctttccttaccagctcccctcgtctagcagatgtccccggtgctgagtcactgggctgcactgctctgacccacttactgtacccgaccctgccctcttccctcccagttccactctttagccttcgaccctggcaggtttccaggtagccagatcgaatccgtctttcccattggtctctagagaagcatgacctgcctcggttctttccaatggctgtcacttcctccttttggccagctagtaaattgtctccatccccgtcactgcgtaacctttccccagaaaactcttggtgtcctctctgctcccccagcagaggcagcagctactgaagggcccttcccagtgtctccctttttacattctgagtagggttatgacagttgcttctagctatagaaagttcccactgtcttccacttaaacacgtaaaatacttaagattcttatatgttcttttctttaaaaaccagcttcattaagataaaattcacataccatacaattcacccatttaccatatacagttcagtggctctgagtatagagttctgcacccatcaccgtgacccactttagaacattttcattacctccttccttccacccctctcagccctaggtaaccatgctctactttctggttttttgtatagatatcatgattctggacatttcatataaatggaatcatatgtgacctttatcatgtaatatctggctgctttcactttgcagtgaatcatagaatagaatattctattctatggctcatgcctataatcccagcactttgggaggctgaggcgggcagatcacctgaggtcaggagttcaagaccagcctggccaacatggtgaaaccccgtctctataaaaattaggcagggcgtggtggctcacgcctgtaatcccagcactttgggaggccgaggcaaggcagatcacgaggtcaggagatcgagaccatcctgacttacacggtgaaaccccatctctactaaaaaaaattagccaggcatggtggcgggcgcctgtagtcccagctactcagaggctgaggcaggagaatggcgtgaatcagggaggcggagcttgcagtgagccgagatcacaccactgcactctagcctgggcaacagagcgagactccatctcaaaaaaaaaaaaaattagctgggcatgatggtgggtgcctgtaattccagctgcttgggaggctggggcagaagaatcgcttgaacctaggaggcagaggttgcagtgagccgagatcacgccactacattccagcctggacgacagagcaagactccatctcaaaaaaaaaaaaaaaaaaaatctatgattctgtttaatgaaattgaggcccattatgttatgtttgttccttactattccaaacaatattccttattgttcttactatagtctagtaattcattattcctcaaataatgaattctaggccttggtgcagagcttcattctttactacagctggataatattccattgtaaggacaccccacatttcatttatccttttgctggttggtggacaggtgggttgttcctcatgttctttttaacacagcaaggccatatgatctgtctgaggctgcctttcagttcccaaccattttttgagcaggagagacattttctgtcatttttatcacagcccttggttatttcttgatgtgttcatgaatgtaatcccaacttagacatgatgttccaaacctataagaaaattagaattttttttttttttttttgggaaagaagaaacagttatttaagacttgttagaataaatgattcagatcctttttcttctgtgtttttattttggctctaaataaaacatttatagaagtttgtcttttgtgtaattatttaggctctaaaaacttcactcagtttagatgagtgttcaaactcgctgagggaaaaaaataaagtttttccccagggagaaaaatattatgagctaaaactaaaaataacttaaaattttagcgaaggaagcattaacacaccaggccagcacactttctttttaatgggaactgaccctgggtcaggtgggtccaatgacacccttatttaatttatttcctgctgggagctgattttcctgggcatgttctgacccagggcactcggcagagacgctgctaacaaagtccaggtggaaaacatctgagtttcccaaatttctctaaaggtttttaagggctgttcagcttcgagtagcagcgtgagtgtgaggtcgctggcgtaaatgagaccccgcgggttaagttgcaggtgggagctccaggatgcagcaaggtggccgcggccactggaactgttgtttggccttgactctaatctaaggtgccctgggcgtcggcctgtatgctggtgctcagtgaggtttctccatgactctgtatgagatctcctgtgctgaatgggacccttaaatgtgcccttcgctgccatcatttaaggagggaaaaggcaaatcagaatgtcataatgtaaaggatggcaggcaaacacatgtttttagaaccacactatgatttcaaaaggcacatcaacattcagttgaatttcatgtctattgggggatctttgatttctctccccctaaatttgtgtggggatgtgaaaaagcttacgctttagaatctgtcgatcttggtggttcttgggcaaatgactctccatccctgggatcttgtttgtgtcagaaggatgacatcctccacctccatcagggctaatgtggggatctaatgaggtgccttatgtacaacccctggtacagaagagaggcactcaatcagagctgcttctaaagctcttctacttgaaatgatctttttttaatcctcactcataccctggttttaggtggaatagtttctaaggaaacagagtccttttcccataggatggtgctgggtttttgtgcttgagagagaccatctttgtctctctgagccccttggacgccaagatgcatccacagggcaaggcacacgcaagcatttggtaggtaaatatagaacccagtgggttcggcagggaattaaagtatccatttaataaacctcaagaacagcatagcctttaatataaagtcccttctcccaaagggttgcaaaaacttttgcaatgattattgcttttcatttatagcctaatgtttgaggactggagccataaactgaagagccagaagtagacgctagcaactaaaaatactgtcaatgaatgtcacagatatccaaagtagacaattcgttttccttccagtggctttcttggcaaaaaaaataaaaattaaaaaggaaaaaaatgactgagttaagaaaacgttgtagtgtttgatgatgataacttgcattttataatgctttccagcttacagaatgctttctcattattatttcattgaattcttctgactcgcagaggtaggtaagacaatactgtgttatggttcaggacatgctgcctctaccacttcacttcctagcaggtggtcatgtgagttagggaagtgctctaagcttattttccaaatttttaaaataggagtcacaacaccttccttttaggattgctgttcagattgtatgagataagatatgaataatcccatccacatagtaaaggcttcataaatggcagctgttactatgttattacatagaataatcctcactcggccaaggttgggggattgcttgagtccaggagtttgagaccagcctgagcaaccaagtgagatgctgtctccacaaaaaataaaaatgtaaaaattagcagggtgtggtggcatgtacctgtagtcccagccactcaggaggtggaggcaggaggattgcttgagtccaggaggttgaggctgcagtgagccatgttcgtgccactgcactccagcctgtgcgacagagtgagaccctgtctaagaaatcatcatcatcatcatcatcttccttactttacagacgaggaaactcaaagtggcacttaatttgccaaagatcacaaagatctagtaatggcagaactggaatgcacatctaattctacttccaacttcattcctccttccacttttccttagccaagaatgtaaatcaggaacattttggtgcttctgccagcgacatttaccattatcatgagctcttacatggtttctcgggtgcactcagattttcaacgtctacttttgtatttgcagaacatcatcaagaaggtgatcgggcagaagtttgtgtacaagtttgtctctttcccggagatcctgaagatggatcctcacgcggtggagatcagccgggagagccttctgctgcaggacagcgactgcaaggcgtctccggagggccgcgaggcccacaaacacggcctggccgccctcagaagcacgagccgcaacgaatacatccactcaggcctgtactcgtccttcaccattaattccctgcagaacccaccagacgccttcaaggccatcaagacggagaagctggaggagccgcccgaagacagcccccccgtggaagaagtcaggactgtgatcaggtttgtgaccaataaaaccgacaagcacgtcaccaggccggtggtgtccctgccttccacgtcagaggctgcggcggcgtccgccttcctggcctcgtccgtctcggccaagatctcctctttaatgttgccaaacgctgccagtatttcatccgcctcacccttctcatctcggtccccgtccctgtcccccaactcacccctcccttctgaacacagaagcctcttcctggaggccgcctgccatgactccgattccctggagcccttgaacctgtcatcgggctccaagaccaagtctccatctcttcccccaaaggccaaaaaacccaaaggcttggaaatctcagcgcccccgctggtgctctccggcaccgacatcggctccatcgccctcaacagcccagccctcccctcgggatccctcaccccagccttcttcaccgcacaggtaagagtcattcctgtcatctaagccacagccagcttcagtggcttagcaaaaaaggaagagcaactaaagagacttccttctgtccctcaaaacgttgtcctatgactcgtaccgaggtcactgtgtaaatgtgaagggaagctgcttttccatcctcagaccaaggggtgcacatgagacagggtttggtttgtcgactctagtgggatgcttgattggtttcttgcttttagcggcctaaagtgaccataggtggaacacgcacactggccgacaaagcagatctcaccagcgatttccaagggaaagttgagcgggccagtttacatttcgggaggcgcttgggctttatgaaatttttatggcagaatcttctctgggggcgcttaataaggagccacttgtgttctgttaacaagaaaatagatgtcaactgatgccgccatcgcatgtcagtgtggagctgtggtcatagcgtaggtaataagaaacaaaggggccaccccaaacagctgcttcgctgaaagcagcactactctgagaaagccccagtccacagcactggcgagaggacagcaaacttgcagagccaaaaaagccttcgttgttattagtcccaaagagaaagcagccttttcctttaaatcagatattcagatgctctttcttgtccagctgacaattgcagtgcaaaggcgtagtaggtgctgggaaaccatatttctccttccccttgaaaattggatgcaattttagtggcagaggttaaaagagtattcgttttaggttcacagacctgcattcagttcctggctaccctgcttcctaggagtgggactgtgggcggttgctctctgggccaggttccatgtgtggaaaatgggaccatggacaggctttgtgagctggggacacctggtagcattgttaaccgtggagctgcacccgtcccctgcctctgtaatctcatcgtagttgtccctgttgtcattagcagcagccgcggcagcatatgacgggctccccacgtgtgccaggcactgctccagatgctttacatgcattgcctgtatccacacttacagcagccctgtcacgtggatacaggttgagcatcctgtttccaaaatgcttgtgaccagaagcatttcagagttcagatgttttcagattttggaatatttgcatgatacttgccagttgaatatcccacatctgaaaatctgaaatccaaaatgttgcaatgagcatttccttggagtgtcatgtcaggactcagaaagtttcagattctggaggatttgggatttgggaatttttggatttgggatgctgagcctgtgctattattatcatcctgtttcccagctgagataaatgaggcacagaggtaaagtagttcgtccagggtcccacagccaataggtggtagaggtggctttggatccagtgtctgcctccagaatccatgctctcaaatgaaatgcattcccgctgcgagaaggcagtgtccctgatcacgatggccgtccatggagcacctgaaagcagctctgggccactgtcctctccacgctttctctggactggattctgcccaggatttcatgacagctcaagcctgtgagctggtggtgacgcgcgccactgcggagggggagggccaggggatcaggatataggtcagagtgagcacgtgtgctcttaaatcaggcatcttccagttaagcaaggctgtccagtgaccaagggctgctgagcaaatggctcagaaacagcagctcctgatgtagctcaggggagtatcttgagaggcagggccagggtagatgatctgagcatctcctcccctggcctcctgtgtgtttacaactgtcagggtgagaaaggtccgaagccaggccagggctgactctgatttaggtgtctgtgttccctgggagcctggatcaccttctcagaacagagtgaggcagatgccagccctgtctcagaggaagtcagctcagccagccctgtggataatgtggatggagtggtggctcccatcggtggggctgagggcgtgagagaaggatcaagggtggatgcccaacaaatggatgcagagggcacgaccaggagccagaagccaccagcatggcctgaaactaggtgggaaggcgtaggaaagccaggatctttacaagaggacctgtgccttaggcagtgagggtgcctggtcctcagccaagctgtgagggtggggctgtgatgatttagtgccaggaagcccagaaatggtcctgaggggagggaggcaacaggcagcatctggacccagggcaggagagtggaagtaaagggacctggctcagagagggccttcgggtcaaaggaggaggaggggcaccaggcagtcctctaaaccacgcaaaactaagggggtcaccagctacactgggagatggtagagcctcgggactcagaccccactttgaacttccctcacattcccagagtgtgggctctgctcctggcatggccatgggtggccaacagggagggagagaaggggcaatgagggagacaccagaggggcccgggtggtagtcaggggtgtggtacttattcagagttgagttcttgcagccggtttcacccaggcggattccctgagatcagataggatatcttgaagccaggggtggtttaggattagggtatgtcagtgtcagatttggactctcagattccctcccctgggagctgcttcagggggtgccccagaaactcacccaccagcaccagctcagtagtttgtcttccaggtgacagccagaaacagcgtggctctcaacagccaggcattctgtggaattcctttcggcctcaggagtgaaggacaactgtggggttcagggtgttccacaggcagcagtgaggcttcagtggttttcctcttacctgagcactttgtcacagaaactctccttttctctgtgtgtggggggtgtgctgtgtgcagtgtgatgctgtgtgcacataaacatttgataatctgtgggctgtcagctttgcttagtggtgggctttggaagaggtgaaagctgtgtgtgctgtaataacccgataccctgaaggtacaaattccgaaggttggttatttccagctagaatcatggcaggaagaaggggagaagtaagggagccttggcatggcctgtgtcacgtggttaccttatcacacctcatacaggcatccctcattttactgtactttgctttattacgtttcacaattaattggtggtttttacaaatcgaaggtttgtggcaacctggcgctgagcaagtcttgtcagcgccagtctgttcttccaacagcacacactcactccgtgtttcaatgtcacattttggtaattctcaaacatttccaactttttccttactattatgtctgttatagtgctctgagatcagcgagctttgatactactattgtcattgttttggggcaccatgaaccacacctgtataagacagcaaacttgatcagtgttgtgtgtgtcccaactgctctcctgtgtcaaacttgatcagtgttgtgtgtgtcccaactgctctcctgtgtctccctctccttgggtctccctattccctgaaacacaacaattttgaaattaggccaattgataaccctatagtggcctataaagtgttcaagagaaaggaagagctgcgcatctctcattttaaatccaaagctagaatgatgacggtgaaggcatgtccaaaaccgagacaggcctaaagctagggggctcttataccagttaagtatgtaaatgtaaaggaagagttcctgaaggaaatgaaagtgctacgtcagtgaaaacatgaatgataagaaagtgggacatcctgattgttgatatggagaaagttttagtggtctggatagaagatcaaaccagccacaacattcctttcaggctaacccagagcaaggccctaactcttcaattctttgaatgctgagagaggcgaagaagctgcagaagaaaagtgtgaagctagcagaggttggttcatgaggtttaaagaaaaaagccatctccataacataaaagtgcaaggtgaagcagcgagtgctaatggagaagctgcagtaagctgtccagaagatctagctacgctcattgatgaaggtggctacgtcaaacagcttcactgtaggtgaaacggccttctactggaagaagatgccatctaggactttcatagctggagaagagaagtccatgcctggcttcagagcttcaaaggacaggctgagtcttgttagtacagcttgtgactttaagttgaagccagtgctactaaatacactctgcctgtgctctgtaaatggaacaacaaagtctggacgacagcacatctgttttcacagtttatggaatagtttaagcccaggtgagacctactactcagaaaaaagattcctttcaaaatattactgctcattacagtgcatctggttacccaagagctctcatggagatatacaagaagattaatatttttcatgcctgcaaatacaacatccattctacaacccagaagtcaaggagtaattttgactttcaagtcttattacttaataaatacatttcataaagctacagctgccatagatagtgattcctctgatggatctgggcaaagtcaattgaaaaccttctggaaaggagtcaccatcctagatgctattaagaatattcatgattcatgggaggaggtcaaaatatcaacattaacaggagtttggaagaaactgattccagccctcatggatcactttgaagggttcaagacttcattggaggagggaactgcagatgtggtagaaatagcaagagaactagcattagaagtggagcctggagatgcaaccaaattgctgcaatttattgatcaaacttgattgggtgagtagttgcttctcacagatgagcagagaaagtggtttcttgagatagaatctactcctgttgaagacgctgtgaatattgttgaaatgacaacaaaggactgagaatattacataactttacattacattacttagttgataaagcagcggcagggtttgagaggattgactccaattttgaaagaagttctactctgggtaaaatgctatcaaacagcatcacatgccatagagaaatctttcatgaaaggaataatcaattgggccaggtgcgctggctcacgcctgtaatcgcagcactttgggaggccaaggcgggtggatcacctgaggtcaggagttcaagaccagcctggccaacatggcaaaaccccgtctctactaaaagtacaaaaattagccaggtttggtggcagatgcctgtaatcccactacttgggagcctgaggcaggagaatcacttgaacctgggaggtggaggttgtgatgagccgagatcacgccaccgcactccagcctggacaacaagagcgaaactcgcatctcaccaaaaaaataaataaataaataaaagagtcaatcaatgtggcaaacttcattattgtcttattttaagaaactgccacagccaccccagtcttcatgactctgcctccttgtccctggttctgccctgcttcctcccctgtccctttctgtagctaccctaggcccccatgggagtctccattttgtctccttttccgtaggatcagtgctacagacttctgtgggattaactcaccttttaaagaccttaaaaccatggtttcacttgaattcagacaactttaggagcttccagagattcagtcaccttttatttgaggacatttttttaacctcaaggtggcattgtcatggattctgttggcatctgtgggagcttaggattacagatatttgtgggtacaacctgctagacatcttgtttctctctcctttactttcttagagactgagtgacttaccggtatctcagatcaccaaatcaagtgatcagcaaatacttctgcatcttctttaatcagtccagtaacaaatgtttatcatgtattcattcatttgggagataatcactgaaaactaagcattcgcttagatacctggagatacagaggttagcaagatagaaaccgttcctgttctcatgagtttacaggttgctgtccagcatacggggcaatatataacatagggttataatttagggtggtgtgaaattatggaggaccctgagaactggctaaggaattttgacttgtttggattggaaattaactgctagaggctgggcgcagtggctcacgcctgtaatcccaatatttagggaggccaagggggcggatagcttgaggtcaggagttcaagaccaacctggccaacatggccaaaccccatctctactaaagataagaaaattagctgggtgtggtggtgcatgcctgtaatctcagctactcgggaggctgaggcaggagaatcgcttgaacccgggaggcagaggttacagtgagccaagattgtgccactgcaccccagcctgggtgacagagtgagattctatctcaaagataaataagtaaataaacagctgctagaggtataagtgaaaaaaatctcattagaatcaacaaataattattgagcaataacagagcctagaaaggacaccaaaactacagttgcttgtttttatgaccttaggacctagccatgacaacaaggcattacaagtgcacacacacacacaatagcccttggcaagagtcaaacatgcagcacagagaagcgctttaggagctgaggggcaagatcgtttagttcaggtcaacacacatgaactgagtgcccatcatgtgaaagctgctgtgtttggagctggggctacaaacgtggataaaatagtctctgatagttaggagctcataacttaagtcccttcatctagtatctcaggtgcaatacaaaaggaatactaagttgcaaaaggaatcctaaggaggaaggtattaactttgcctgagatggaggaagaatgtccagagggcttcctggagggggtgagaccactggtacagggtgttgaaggatcagcctgtggcagggtagacagggagaggaaggcatcgtcggcagaggaacagcttgaggcaaggcatagatacgtgaaatagctttgtgattaggggaggtatagcaataggaagcattgaaggggtatgagtgacagtctgaattgttttaggaatcaccctgctggcgagattgggaagggggaaggctggatccaagtaggatgctattggaatattccaggcgaaagaccatgagtatctaaggctgtatggtgggaggggtcagagggatggatctgatgttgggagtgccgtcagcaggagttggtgactgactgggtgggaggagtggggagagccagaattgagtgtgaggaacatgggaggaagactaagctccctgggaaaaggctaaacgtccagtcggggccatgctgagtttgaggaccctgcaggaaattcgggtggaaaagtccagctgcatctggagagcggagagtgttttggagccggagaggaagttaggcagtcatcaacacgcaaggggtggtgaaaccatgggaacggatgaggtcacttgtggagagggcctgtagcccagggaactatgggctgggctgggtggtcagggaagttctgagggagcgttgaaggactgttgggttagaatgcctgttcctccgtgcatatgaggaaagctcaggacacatcaaagcaagtaagagggtttggggagggaagtgtctacgaagagtcaaactctgtaaaatatttgaagagatttattctgagccaaatatgagtgaccatggcctgtgacacagtccacaggaggtcctgagaacatgtgccccaggtggtcggggtacagtttggttttatatattttagggaggcatgagacgtcatgaaattgccaggcaacttcaaggtatggcaaggaaatatattttggggttaaatattttttcctcgttccataatgttactccagagtcagattgaaaagtaagtcaccatatatagggtcaaataaaacccatctgatgagaatttacggtttgtagggcatgactccctagacccctaggtaggaatttgggcaagataaaaaatgagagcttagtcctcagaagttagcaagtgtgtgaacccagattatggggaacctcaaatctggggctaaggaggacatcacatcctttctgaaatggtgactgaatgttgagtgaactcagtgtttgagggtggttgatttggcgatggggtacagaatagatggggagaccggaggcaggtggactggcctgggcagctgttgtggaatgccatctgtaaggtgataggggcttggatgcagcaggaatggaaatgagggataaacaggagactgagttgtgggactcctccagaggctatgtccggagcttgcagttatcggaaggcattttgcatggtggggcctgggatgcgggtggtaaatggggctgtgcatgcagggtttatgtcttgttttatcctcatctgtggcacctgaaacatagtttgcactctcggtcagtatttattgaggcagtgcctacacggtggtcctgttgacagaaggggaagagtcttaagaaacactgatgtggaaaggtgctgagcttcatgaagttggagcatggtggggcatccaagtggagatgcccaacaagcgataagccaggggggacccagctagagctgcagatggcttcagttcattggtatttaggagatgaaagtacaggaggaataaagatgagcagataccttaaaggctacagaaagaataagaaaaatgtgccaatcaccataataggaggcagaacatgttaaatgttaagaaaaaaatggtcacaaagtgttacaaagattcagaaataagaaatcccatctggttgaggggagatcaggaaagtgtccttggaggaggtggcattttgatgggcagaggaaggcaagaggaggaggcagcgggccggggcaggggtgcacaggtgggcatgcctggatgccagctcaccctggcgagctcagatgtgcaggctttttaggagactctatgaagtggaagtggaagatgaactgagtggggaaaatgaaaaggggatcttgggatgagggtcttactctttgcaaatgcattgcctgtggcatctcctttcccagcagccgtgggatcaggagctccttatctgccatgcttgttaaaacgagactgtctttggggaaggaaagaaaacagcactttttgctgtggcttctttagcccttggccctcaggctcagcccactctgcctgactccaggagcgtgtggagagaggctgtgaagtctcacactgtcccggagataacccagagcaggtgttataggaactttccttaaaaaagcaaccacatggttctttaaggccacaggattttcagggagaacttcagggatagaagggagaggagggaatgaaatcattttacagtgtttatttgcatatattatagaagacatttcagacatattaaagatgagaaacaagaaggctacagtagtctgagtacatcctgtattcctaagaaacaaatgtgcaaacatctcaaatccagacatgggtatacgttttagaccagagaaatagaaattctagaccttgtacattgcttagaggattaaaaaggaatgggcatatgatggccatggaggagagaaggatagctgtgttttgtggtttagaagattgtctctttaaagctttgagagccttcattgatggataaactaggaggccttgaacacactggttattaaatgttaatgtgacatattgaggttggaaccttgctccagagtaacatgcaaatattagttttcagaacacctgagcttgtggccttgagcctaacacaactgacagtagcctccaagtccaggctgactcagttgagttggtctgtttcagaggattaagtccttctctgtatacagttgagaatttctccctcacatagatgaagtacgtttagtaagtatgtcatgtatactttcaattaattaccaatccatttattcattcaaaaacatgtatgaagtacctagccagataactgcctctggcacttgttgagcatttctatatgccaggcacatatcttataagagcttgcagtagatcagcttatttaatcttcccaacaaccctgtaacgtgggcatttttattctccccattttacagatgaggcaactgagacagagagaggttaggtggcttgcctgaggttacctggctgggaagtagtggttctgagattggaaccctggcagagctcatgctgagccgtgaagttttaactgttaggccagatggcctggcatgcttgtgaaattgccttggactagaacaaatgggaagcttattcaaaacatgtatttattctagtaacctcataggtcattcagtatgtaggaaatgccatggaaccaacgactcaaataatttggtataaatgtgtttacatttcagcagcttcacagtttgaggaactttggatgtttgtctccattctgctgaacagagcagacctttcaatttaggtttaagccaaatgctgttggtaattaatgatgctacggaggccaattctaggaaaaaataacactttagcatccagcatggtgcagtctgaaaggctggcgcctttgctgtggttcttcttacacaaagcaccttattgacatcacaaaaccactgagggactccttctagtcaccaaaggtacaaaaccaccctgggccggggagtttgtctccactgagaataaaagccatgcagacttagcagctgggcgggtgtttcttctgccctcctgctggcttgcaggccaggactcctgctgtgtgtgtgcaagaaattcagtccttggaactcccctgggaaacccagggttttggctttatacccaatctgacaagaaagggccctccctgcccccacccaaaccattgccagggcaatgaattctcatcaactccacatccggaaggaatctggaaaacccggctcagagcttctgaagaggctgctacagggtattttaacagcaaatcccaaagccttaacagctgttgatatggagaccatttaaaaacgtgtgttcgtaacccaagtaatagatgtccactgtagaaacacaggaaaatatagataagaagaattaaagcccctttatgggatcctattttgtttgtatactaatccttgtttaatctgggaaggggaacaagttaacaaaccattcggacgaaagttgatacaaacttgaattttccaccagaatgtttagggaaggtaatgtgtcaatacctttttcctttatgaaaaaagtgttaataaaattagcattgaagaaaactagccagccaggtatggtggctcacgcctgtaatcccagcactttgggaggctgaggtgggcagatcacttgaggtcaggagttcgagaccagcctggccaacgtaatgaaaccccttctctactaaaaatacaaaaattagtcggtggtgggtgcctgtaatcccagctgcttgggaggctgaggcaggagaatcgcttaaacccaggaagtggaggttatagtgaaccaagatcgcgccattgcactccagcctgggtgacagagcgagactgtctccaaaagaaaagaaaattaaaattaaactgttcacagcccctcagaattaacgttgccagttttcctgagatggtaaggtcgtttcctggcccatgcctagcctacctaacctctctctgctgctctgttgatcatggcccaagtcaggtgaacctatatgaagaagtctgtttgctttacttcccagacaccaaatggattgcttctgactccgagtccactgctctccagcatacatttctggagcagccttagtccagttgctccgctgagtcctgccaggctgcaagggccaagcacgctgttccaggtgagcgtttggaaatgaacttttgaacattaagcttctgagggatggttttttctctaaatcctgcagaggtaacggtgagttttgccatatgttgagttgaaatattaaatgtccagagggggttcatgttagtggggttgcacgcccttcagaggcagacattttcattgaggcagaaattgcagactcatgccagacacccatacgtggaacaattagttcttaaagtgttttgcatattttcatttgtctatgaaaacaggaaatttattaaggaaaaggcaaaactttaagaattattctttaggccagtgtgatggctcacacctgtaatcccagcactttgggaggttgagggtgggaggattgtttgagcccaggagtttgagaccagcctgggcaacacagcaagaccccatctatatttaaaataaaatgaaaataaatattattatttataaaagtccacaaaagactttaaaatattaatcctcctagttaatgtagcaacttgtttgacataaagtgaaaataaaaatagtgaacaatttccccatcctgggatagaaaaattacttgcatcattttatgaatcatcattaagttctccttgttctgtaatgaaaaaggagaatccagggcatttggttaaaaaataatgaagacttagctgctttatcttatagaactctccatactaggcgagcaccttcattattcattcacacaccagaatcttgcaggaccgtcacttgctatcatggagaaatcagtatttcctccttgagacccatagatcattactcactgattaaggtgttactgtttgaatatgttgagtgcaggtggaaagaatcctagggacaggactgaagaaaaggtggacccagtgcaaactccctctttcccaaattctagcttttctcatcgtccctgcctgtatcctgtgccccacagtgtggcttaccccaagttagttgcagctctttggataccatttcatctagcacgtggcactttgtattatgattgcctgttgatctggcaatctttctcactaaactatgggccctcgagaccagaatggaatcctgttcactgtggtgtccccagcatctggcacatggcttggtacacaagtgaggctcagtaataattgactgtctaaatgaattcacaaagagaagtctgagaaaggccagtattaatagcaagtcttcatgatcatctgagctggtcattttgcttgtcaaggttaatgtctgctgagtacctcctctgtgccaggagctgtacatgctgggattcagggtctctttgtaagggtggagctaaagaggttttgattgccatcttgcttctttggtttcctagtggagttagggtagggtgtcatgaagtgaccatatccttggagtaattgggtttctatctctttcacagcccttattcccatcacaacaacttgagctatagtcatgttgatttttaacaatttcagcttgggtaggaaaagagaaactagaaatagcaaaaagcaatgagcaaatgttgtattaggaaagtttaaaattaggaatactaatcttttggtggagagataaaaacacctcatttcctgaaagtcttaagattagagcagcagaattctaaaattaatagaatagaaagaaattgtttggttacagtaaactccatggcagtagggattgttatactactctaatcctagaatctaacacagagcttctgtagagttcagtaggtatttgtgaataataagtggcctctcatttctctccttactgggaattctgccacctgattggtgcaggccttggcaacctcctaggaaagcaatggagcactattggctgggggttctttgggattccttgtcttagataccttttccagcccaacactcccaacaggaaatgatggttcatgtctacagtgattcgacacgttatcaggatctctgggagttgggatacgtgcatccgctcgtttcttcagtcctcagtcactactgtagaccaatggttctcaaagttagcatgcaaaataatctcctagagggtgagttaaaataaagattgcagggccccactcccagagtttctgactcagtaggtctgggatagggcctgataaaaactttttttttttttttttttgagacagagtctcactctgttgcccaggctggagtgcagtggtgtgatctctgctcactgcaatttccacctcctgggtccaagtgattctcttgcttcagcatcccaaatagctaggactacaggcgtgtaccaccacacacagttaatttttgtatttttagtagagatggagttttgccatgttggccaggctggtcccaaactcctgacctcaagtgacctgcctgccttggtctcccaaattgctgcgattacaggtgtaagccaccgtgcctggcccaaaaacatttttgtcatgttcctagtgatactacccagtctaggaaccaatttgagaagcactgcagaccagaggttcctagtttatatttagaattctgcatcagaaattactgcatttaaaggctacctgcttagagttttaatttcaccaagtggacctgttctctttcctgaagccattcagaatacaacccttgaaaaaaaagacaagctggtattccggatggctgacaggttgtatggccttgggctctctttttgtggctggatccaggagactaaggaaaaacaattttttgccttttaaaatattattagtcttcctgtgaaaagagcaactgagtatggcaaaagttgaaaatagcaattttgagaacggtaaacaacaaaatatggtagaggaataactttctgatttttaaaactagatgttacaattgatacatattcagaattcagattactatcagcagtgcctcttatttttttaagaacttttttttttttttaaatttagagacggggtctcattatgttgtccaggctggtcttgaactcctgggttcaagtagtcctccacttcagcctctggagtagctgggactacaggcataccaccacgctggccaacatcccttttaaactgatgaaaataattttctttcaaaataacaacaaacctctttcatgtacgctatagatgtaatgaaggaagaaaaaaatagatttggcttacacattttaaatgatgctggcaagtttcctattaccatgattggaaaggttgatcagaatccttggggtaatagttgaacagctgaagcatttttgtacagaagggcccctaatatgattactatagcaggttatagcagatatgaaagaattccaaggaaggagagagaagacgcctttctggaagaggtatgctttaaaattgagaaatgtttaggtaaggagagaggcaccgaagacattgtgctaaatgtaaacaaagaaccttgatttatataaataaagtgaactcggtttttcttggacagtttattattttcttcttgtctaaggatgtctgttccatgacttttgaaacagattttgttccaatgtggaatatacctagtaggaataggtatgtcttgaaacaaggtagagctaattaagttttcaattaagaatgtgtgctgtaatttttagttcaacaaatctaaccccagcaaatatttgcaatgctctgcgacaaggactgtagggacagagaatatgtgaatagtggatgagtaaacaaactgctgcagaaagtaaggggcagacgcgctttttccagctggccactggacaggctccaaggaagcagtggcgcctcagctgggaggaagggacaggatttcgatcgagtacatttagatgaatagagccgaatgacggggacgtgagagtctgttcaggaagggaccaggtgataggagataaggttggaaacgcagctgtgggccttgaatataggcttaggaatttctctctttatctgttaaatgtttacgctttttaagctggaggtaggaggatgagatctctgttttagagaacaatcactgatattagtgtggaggaagaactgaagagaaagtggaaggaacaggaagataagaggaaatttttatttttattttttgagatgagctcgctgtgctgcccaggctggagtgcggtggcacaatctcggctcactgcaacctctgcctcctgggctcaagcgatcctcccacctcagcctctcaagtagctgggactacaactacaggcatatgccaccaagcctggctaagttttgaaatttttttgtagaaacgaggtctcactatattgctcaggctggttttgaactcctgggctcgagcagtcctcctgctttagcttcctaggaagggctaggattacaggtgtcaacgaccatacctggctagaggaaatgatactacaaatattgaagggagaatcatctttgagattaaaacagtggacacaggatataattagaagacattttagaggtgagctcaagagaggcagactttgagctgggtctgaggggtaaagtaggtattgaaaattaagtagaagcaaagattactaagtgattaacatactggaaatgctactaaataacaatagttaaggccgggcatggtggttcatgcctgtaatcccagcactttgggagggtgacatgggtggatcacttgagcccaagagttcgagaccatcaggggcaacatagcaagaccctgtctctccaaaaaaaatacaaaaattggccacgtgtgctggcgtgtgcctgtggtcccaactactagggaggctgaggtggcagcactgcttgagccctggaggttgaggctgtagtgagccatgagcatgccactgcactcaaacctgggcgacagagtgatcctgtctgaaaaaataaagataaaacataacaatagttaacatttattgatgattgatgacttattgtgtgcaagacgttgttcttagcacttttggtggcttctcatttaatactcccagtaattctattttagagataagaaactaaggcacagggatattggctagtttattcaagataacacactcgtaagtggtggagccctgactcaagttttaagtttgtggtcccagccaccattctcactgacttggagtaagcaatggaagaagggcgagttttgtgggaaagaggcattggttggagatgtctaaaatggaaatggttgtcaagtccaagcatggtactggagaaaaggtggctggggacaaaagtttgggaaacgttgcagtttaaaataggggagtgtcatgggagaagagcctaataaagatgactaaaaaaatgttagaaaagccaggctaatcaagagaaactatgtccattgagtatacagaaataataagggcagaaatcagtaatttattttgcaaaacagatgaataccaaaactgattctcttgaaaacaccaataaggtacaccaaagagagagaagatgcaaataaacaaaaagaatgaaaatgcaggctgggcacagtggctgacatctgcaatcccagcactttgggaggctgaggcaggccagttgcttgagctcaggagttccagaccagcctgggcaacatggtgaaacctcgtatttaccaaacatacaaaaattagctaggcatggtggcatccacctgtagtcccagctacttaggaggctgaagtgggaggatggctgggaggtggaggttgcagtgagccaatattgcatcactatgctccagcctgggtgacagagccagaccctatctctaaataaaataaataaataaatgaaaatttaaaatctgttcatcttcccatgttcactctaactcaatgggaagagtggttagtagcacggaccttttaaacaagagtataaactatatgtgcatagatttgataatgcagttgaagtgaatacaattctagaaaaagttaaaattctaaagttccagaaaagaaacaaaaaccttgaatatgccaataatcattaaagaaattaaaacagtaattaaagataccccctaactcctaccaaaataaaaagttgtaaaatgttggtacagaaagatttgtttaaaacttggctgtgttgcttattagctgtgtgacctttagccaacagaacttatttgaaatctgttttctcatctgtaaaatggggacaacaaaacttacgttacagctcctaggtatcaaatgaaatgacaagccttgataaactctaaggtactagacacaagttactgaaattgtttgaaaattgcaaaaacatatttacttaaatataagtatttgttgtacttctaacatgtgtcaggctctgtaatttgatatttggcgctgaagtttaactttcctggactaaataggaaataagctagaaaagacagcccaggagatctttttgacacatcatcctcaacaacgaaaatctagttgcaagtagtcacatattaaaaggccttgttcagttgggattgcaactaacatatttgtttcagacctgaaactcattatcagagcatatactgtcatcctactatatttatcatcttagtgaacaacaatacagaaatcttattctttgtcacttatgagtgatctgtgtgatattttaattagaatactttcttagctccaaaataatctattctaaatctttaaatacatttcttactttagaataaatgctgcaagaatcatctttgtagtaccctgaaaaactgatggcaaatttcaaaatatagtattagaaattactgactcacatgtaaagagtctatggttttcaaaacactcttttaatatttaatattaaacattattttaatatttatagcattatcagcatcctgagtagcttagaacttttaaaaaatagtgttagaagatgctttagcaacatataaattatatattttttcctagtagcctatgcatatagaataattagggacattttctgggccttatcctttgtttgctctatgtaaatcttgatctcattgtcatcttccaattattctgtaaaatacattggcaactaatctctatcacaggggtgatgagagaaatggactgctatggactgtatgggaatgtaaagaacctaagttcttcccaatggatttgcaataattattgtaaaaatcttttgtcccctacagttccccacactgcttaatggccacatgccagtgccaatccccagtctggacagagctgcttctccagtactgctttcttcaaactctcagaaatcctgatgacgtctggccacaattaaggactcattaactgatgaaacaaatttgtccccacgggctagtttacctgtgtcgtgagaaggacattgtgaaactcttgttaatttggtttgcacttttcataacatggatagtctagatttatgttagcattttaaaaactgtttttgatatattcaagtatatatgaaaatctgtttggcattaagtgaattttaatgtttttgtttttatatccttttagctcttaagtgttgaacactgttgacagtgaagaacttttcttaatggttttcagtataactaataaggatgtgaagcttttttctctttagttctgagtatgctaaactgtgtgcttatatagactataaccagttgtgccttccttcgcatttaatgtaaatgaatgatttatatattttttagtattaagaggaaatgtttgaaagatgaaaattagtatcaaacagctctctagtagaatttcattatttttcaccagtgggcaatatgaaagcatatatcacgttttgttttactttcaattgtataagaattgccttagaacctcttttgaactgaaattcagtaaatgtccaagtaatgtttttataataaactaagccatatttagacaataaacat

SEQ ID NO: 810 - DNA, 1329 bp, Homo sapiens
aatggcattcgctgtcatccgagctcagagccgtgtgggcagccgcgggctatataagccgcgagcctggccgccgcggggcagacggcgacagcagcggcggcgagcgcctcggagcgcggcggaacagcgccccccgagccccgtgccccccgacgggtccgcccgcccgcccgccctcccgaggagcgccggcccgggcccgcgagggccgccgccaccccgcagcagatttggatcccccgcccggcgagcccccggctgctgcctcccggggggccccggcgcagcggccgccctcggagagccccggcgccccgccgcccggccccgcagacgccggaggcgccatggccgccaagcccggcgagctgatgggcatctgctccagttaccaggcggtgatgccgcacttcgtgtgcctggccgacgagttcccgcagcccgtgcggcccgccaagctgcccaagggccggggccggctgcggcggccgcgccagtctcgcttcaagacgcagccggtgaccttcgacgagatccaggaggtggaggaggagggggtgtcccccatggaggaggagaaggccaagaagtcgttcctgcagagcctggagtgcctgcgccgcagcacgcagagcctgtcgctgcagcgggagcagctcagcagctgcaaactgaggaacagcctggactccagcgactccgactcggccctgtaaggggcgccgcccgcgggggggacgcgcgcgtccgcggtccgcgcggggaccggcgtgtgaaccccgagagtgcccgcgccctgctcccgggggacccgcaaggacccgggaccgccgctcctcgcgcgctcggactcccgccccgctgcgaaccggtcggtgcgcccctcgccgcgctcgccctggcccgggagcgccgggagcggggccgctttcctcgtccttgtaaatgtttattttttaactcttcccagtgcgaactctgctgtgagtgtgtgcggggaggcgcgcccgcgctgagtcggcggcgggtagccactccatgcccttgtccgatggtttgcaactccgattttgcacaccgctccaccgtgccccccagcgcacacccattcacactcacgccaacactctcgctgaacacttttataattgttaggcgtggccgttgggactttgggcgcagcgcggctgctactgcgtctggaggattgatatttatttttgcattgcgatggctgaaggcatttatttaacgatctttttacctggatatgtctgtgaggctcctgaaaggagacaaataaagtcaatatatttgcacagtgca

SEQ ID NO: 811 - DNA, 155067 bp, Homo sapiens
tttgaatccaagtagttttaccatcttttattataaacaccatcacatttcaagtttcctctttttgatcacaaatataggactttttcttctcctcttaagtatacagcatgagacacagcgttggggctttccaggtttcttacagaaatttccttacgacaaacttagggttagcatccacagaccatgctctcggtcacatccttcgacatctggattgcccaagacggttgcacaggatgcagactccaaagaggatgaggttggtacataacgttttgaattccaggataacctgaaacagaggcccctccactgcccacattaaaaggctgcacaaccaggagggcgccactttctgagtgtgggcttagagctgctgctctcgggctctagccccacttcttgtttgaacacatggctcaaggtttccctacgggtggaaaagatgaagaggacactggaggttaagaacccagcaggccgagcagtggcagcaatctccaccggaggcccggcctgtgcttcccctcctgggatggggtgaatgggggctggtcaggggtgccagatggtggtcttatttttacttgaattattctgcattttataactcaaggttcaaagctctgtgctaaaactagatcggacctttccaacttcttagaaaggttcctcgaattcagattcccaaaccaagtattcagctatttaaaacctatctgtgaatgtaagggcccaaacggaagctatttggggcgtgatttctaaaattaccatcacccccacctagaccagcctttgttgggggactagggataaagtgggttctctgggtgctgggggtggtagacttaggggatgaacttcagctcccctgcccatggtcctcctctcagttttacggtttttgtgaacttgtctcacccactcagtaagggagcctggaactggactccaagggaggcaggaccatgtggctaagtgcaagtatcccccgaagtgggggacctttctcactgtaacagggaccggagctggtgctccaaggtgtctgtccctcagcatttcctcaaacgccacacgggacatgctgcgcggcagcggcaggatttggggggaagtcagaaagcacctcgcgagcctggagcactctctgcctcagattctgggagtcgtgtacggggggggggagccgcctgaacacgggaagaagcgccgcctctgggggtggcagctacgacggacagggaggatggaggagtgggccaaatgcagtttcagaccaactgacgaccctaactgtgtgagcgacaatcacctgtgagcctcgaatgtgtggggccaacgctgagccgcccacctcagtcgcccacctcagtctccgggaagaaaagcctccgggcggccgctaagcctgggccacagttcccagccaccacccacgccgccacaaccacaaccgcagccccagcctctccgctatgagcgaacaaccagaaccatgtcttacaaagaacagactcaaaaaatatatataaataaataaaaaccttaaacattcttacagggatcttaaagaacagaatacatgttaaaaacctcagtaatttatatcaattttaagcggtactttatatacaatggggaaaaaacacatgcatagtccaaatacaatgttgaaaacagcattttcataacaaaaaaccccgaacactaagtgttaataccatgtacatgaattcaagaaggaccaccctttttgtctgttgcacacagtttatttaacaatatgatataagaaatgagttggtattttaccattctatacagtgattgaatcttctcgagtttcgtatttataggaattagagcgcttgcatgatttacactagaattgcttttcctcatttcaagtttcacatagaagaaagaaaagaaggcttcttctctagtaacattagcatggtctaagagtgatcatccctattttttgtctaaaaccagttttatcagagaaacaaagcaacaatttctacatctgcaagacaagtttggcttcagccattatgtatagatagatgtgtgtgggtgtgtacgtgtgtgcacgccggagtcaattcctatcatccagggtaatactgggagacgcccacagagttcactatagaaaaaaatcttcccgaaacatcacaaagttatcgggatacattataagcttgcattatttcaggaatcagttctgaatattatttttcttcttacttttaaacataaatgtttaaagtcttgaaaatacaaataaaaaatatgaatataatgaacttgtttttcccgttaaaaaaaggcatgagtcaccagcaatgacgacaaaaagaatccaaacaaaacccccctccccccaaacaaaaacaaaacggaaaaaaaagaaccccccccacccccccgccaaaaaaaaaccaaagagagagaccagatatttaaatcaactggtttttaacaaaaaaatatattctttgtattgtttctttaaacatcaatccacccttccatggctcggaagtcgcagttccatctaggaataaaaagaacctagatgcctggattttcagtacaaaaggtccaagaacatgaaagggaaaaggtgatgctctcacaatgctacaagccctccacaaacttctctagcgtgtcccccgtggtgtccccgaccagggacagttcgctggacagcgcactcctgctgggggtgttcagctgggggagcattgcactctgttcggggttccccaagtgtccctgatctatggagctggccatggtgactgcgagtccggggtggggggaaccagtctggggtgagacgtggtgtggcgaaggctggggctgtatccgtggtgacgggctggaatgtggaggctgggactggggccgtggagactggacaggggctggagaccgcacctggttactaagggacgtggcgatctgctggccagggagatgcgaggcctgtggctgtcctgagagcatgtgttgctgggggctcatggggttcggctggcctggggacccaatctgctgcttcatctgctgttgctgcagaatccgctgctgcagggcttgctggatgttgggggtgctgtctgcccccagccccggctgccccatctggccaagctgtcccatctgagccgccatctggcccatggagctgccctggagggggagatgctgctgcatgcgctgctgctgctgcatggccggtgggtagcctccgggtccttgaggctgctggaactggccgtgccccgccatgcccccagccatgccggcactcccttgctgctgctgctgttgctgctgttgttgctgctgctgttgctgctgctgctgcagcagctgcctccgtaacatttctcggtactgtggattcatactcgccatgttggggttgtgtcctgggttcatgatgttcaaggcctggccctgggggttcaggcctcccatcgcctgctgctgtggaggcacaccgggccgcggcacgccagcctgcatggcattcaggttctgcaggctgggctgctggtgcatgccaggctggggttgcatgccgggctgggactggaggccaggctggggctgcatgccgggctgattggccacgtacttggctgtgcgctgtttgatgaaagctgccattagctgcgggtttgatttgagaatgttcagcacctgctgttgctgctgaggggagctgggcgacttcagggtccgcagcaggtcttgcagagcgctgggtgagatgctcctgggtggctgcacgctgggcatccggggcccagccacggccgcctgggcctgcatggatatcacaggcctgggcaagcctggcatgggctgctgctggggaaggggcgcctgctgccactgcccgggaggcatgctgggcatgacgggcccgctcacctggttgggtcggggcacattcaggctcacgggggccatctggctccccggggtccccatgcccgtgcgtcctgggggcatgctgttgttgatgttcacccggtacaggtgctgctgctgctgggcctcacgctcgatctgccgagccgcttccaccgctgcaggagggggctgggccgggggtgggggggccggcacctggctggtaggcttccctgtggacaccgtggtggggggctgagtccgggccacgctggggaagccagctggtgacatgctcacgggtgagggttggggctgggcagggggctgcggcgtctggggtgtgctgggctgctgtgtgggggtcccgggcggtgctgaggtaggagaaggcagactctgctgaggcacgttgcgggtgttcatggtggccatccgccggcgcatgagctgggcctgctgcaggcggtgctggatctgctgctggcggagcttgtgtttgatgttgaggcagaagggcacggggcatttgttttcttggcagtgcttggcgtggtagcagcagagggcgatgagctgcttgcacaccgggcagcccccgttggtcttgcgtttgcagcccttggtgtgctgcaccacccgcttcatcttctggcaggatggcagcgagcagttggcgttgcggcactggcacgcgtgcaccagcgactggatgcagcgctggatgctcagccggcgtgactcctgggggctctttgactgtggctcgccctggctgctgccctcgtcatccaggcccagcccccacttcaccatcttatgggcatggctcttcgtgttatagcagttgatgcagaggtcgtagtcctgcaagcaaggaaaggggacaggccggtgtcagcatgggacccagtaccaccaggcatcctggctgcttccctccaccgctaagtctgggtctgtgccaggagacccaggcaggataggagacccagacaggatgcgagcacggacaggtgggagacccggacagggcgggagcacggacaagatgggatcatggacgggatgggatcatggacaacatgggatcatggacaggacgggggcatggactgcctatgtgttgctcccaaggaccttcactcctggcaacagccctgaaggctcaaagataacctgacccatgccccaagaacccctggcctgtaagctcacggacagtagacaccagcccccttccttccgacttcctctgacctgggagtcacatcagcccttgccacagcctgtccaactcctgtactcaaactatgaagccagacagtgaaaggctgagggaggccggtccctcccaaagcgccgacagctgccgtgaagtgcctctgggaaggcctgagctatccgcagtgcaccagtgggacttccccaacgcgcaagcccaagttactgaaaactgctcgcacctggcaacctgatggagccctaggaccaggtaccatgactgtgttcacaaaaagatatgaaaactgccgcattcagaaactagaaagaggacaaaggagactggagaaaggtggaaagcggaagaagtgtgtgaaggtggggagggaagaaaggccctcgctctgctgaggacccgctctgccccgctacagacaccacagcaagtgaggaggctccgggttggcaggtgatggtgactgtcctgggagggggatggtgggatctgtcacctgcctgccctgcacagcctgactcggcccatgcaagggacacccacgtcatttcacaggggggtcaaaattcctagaggggagtgagggagcatgaccggggggtccttcaggaacaagtggccagaggggcccaagctgccaacaggacagcgggtgtttccagccatttagcaagactagaactgggcacagacaggccagacttcccagcagagcctccctctggccgtccccagggtcaggcctgtggctgtggctacacagagcaggtttaggaaacacacacacagcaacgccttctgccttgtgacgctgtcctagttctggaggagtcagtgcagccaccatcaggtacagacaccaacccgggcacccatgcaaagggacaggatgcttcgtcagaccccaggccggctgtgggggtgggggtgggggcagggcctacctcgcacacagtgcagtgccagcgcgtctccacgtggtgcttgcactcgttgcaggtgtagacaaagcggtcctggccctgggtgtgcagctccaccagcatgcagagcgtggaccacttggagcggcgcaaggaggagaactcccagtgcttgtctctggcgagggtgaggaaggcgtcgcgcccatccatgaggtcacagctgagcagggggtcggggtcgacgatggggggcagggtgttgatgacaggcccagcgtgcaggtggatcacgaagaagacctgcaggagaggaggggctttagtcccacacaagggacatggcacctccagtggtgagctcagggcaggcgcagccacccagcctgcagaataggcaggtggctgagcctgatggccctgatgccttgggatggaacaaaattggtgacacgttgcatgatgtcacccaactggtccacttggtttcctgggggccacttccctcccaccacagacctgcacacgggcccacgcccgccagctgcgagtctttccctcctcccggccagaggcacggctgcagcaccgcagcccacgcctacctccttgtgcttctccatggtggcatacagcttctgggacaggtcattggacacgttgggcatgctgggcttcttcttgttggcgcggctgatgctgcttttgttcttgttggttttcttgttgttcttcttcttggcattcttgctgtcgccctgactgccctgcaacaacacgcaaggctgtgagaccaggcaagtgcccctccacacttggcacggacgcccagctcccaggccgtgggcatcaggaagctcaggccaaagtaggtcaccaccaggcagaccccatacgtgaacggctacaggtggctgtaggtgctgcagccttcgggacagagcagggcctgtcctcggccaggctggtgtcattatcagctttatgccacgctgcctctaaaggggaaaagagacccagagtgcgagttcagaaattaacaaatgagggcagtgggggctgtttccactgtgccacaaccagatgcggaagattccacgtcacaactgtggtcagcagctgtctgccttgaggaaggctctacacacccgagaaagcatgagagcttccaggagacaggaaagctgctgatgggaaaagcagctgccccatcaagagcagggactctgaggcccctgcggggtccactcaaggcccacggagagcaggctggctccctgctggggccatcagtgctgcgcctgactggctgaaggtgggcttgctctcagcccacaggctcctcctctggaaagaacgcaggattaccactcacttacactttaacagagagctttattttttttgagagacggagttttgctcttgttgccaggctggagtgcagtggtgtcatcttgggttcaagtgattctcctgcctcagcctcctgggtagctgggattataggcacccgccaccatgcccggctacctatcattttttttgagacagagtctcgctcttgtcacccaagctgaagtgcaataacgcgatctcggctcactgcaacctctgcctccaaggttcaagcgattctcctgcctgaacctccctagtagctgagattataggtgctgccaccacacccagctaatttttgtatttttagtagagatggggtttcaccatgttggtcaggctggccttgaactccggacctcgggtgatccgcccgcctgagcctcccaaagtgctgagattacaggcatgagccaccgtgcccagccagagagtttcatttttaacaagatgagagagactcttggtgttcaaagagaggggtcagtccagagagaattcaacaatccagccgggcggggtggctcacacctgtaatcccagcactttggaaggccaaggcaggcggatctcgaggtcaggaaatcaagaccaacctggctaacacggtgaaactccgtctctactaaaaacacaaaaaattagccaggcgtggtggcgggtgcctgcagtcccacctactcgggaggctgaggcaggagaatggtgtgaacccgggaggcggagcttgcagtgagctgagatggcgccactgcactccagcctgggcgacagagcgagactccatctcaaaaaaaaaaaaaaaaaattcccaccccaccgacaagcagcccgaggagcccaaatatcacgtgggtcctccgcaggattcagagacagaaaagggacgtcaggggaaaactgaggaaattggaacgaagtgtagacttaacaataatgcatcaacatcaacaaatggctcaccgtggcagcaaatgtgccacactaaggtaagacattagtaacaggagaaactgcgtgctgcaatatactggaactctgtgctcaatttttgtgtcagccttaaaacaaaggaagcctattttttttgagatggagtctcgctctgtcaccaggctggagtgcagtggcacaatcttggctcactgcaatctgtgcctcccgggttcaagtgattctcctgcctcagcctcccaagtagctgggactacaggcgtgcgccaccacacctggctaatttttgtatttttagtagagacggggtttcaccatgttggccaagctggtctcaaactcctgacctcaagtgatccacctgccttggcctctcaaagtgctgggattacaggcgtgagccaccacgcccggcctggaagtctatttttacaaaattataaaataaatatgttcatgaaattaagaaaatatagacaagtaattttaaaaagttttgtttttctggtcttcccgagcagcagtgttctgtgttctggagctttccctgggcacatttgtctccgtgtttgcgacattcctcacgaagctgggactgcacacagggagctggttccgtttctcgccccacctgacactatcgcgagcctttccccatttcccagaattgacagcatgatgcagagcagagctaatagcaaagcagtgctccaccccacgcaccagccctcactaaggctgacccccagagcgagctcctggggtgttgctgacgaaggcatgtccctgcccattgttgtccatgaaccaaacacacaagggacagcaggtctacatgccgacacctcagcatcccgcctcctaacacatgcatgtccccggtgcacagggaaggctgccccagcaggagcccctatcaggcctgtcttctggacaaccccactgctgccatgccacaggcaggtgccccctcctggggtggaactcagctgcgcaaagcctgtctcggacgcggtaacctcccgtgtcacccttaggagatggaactcaagcattaactcaccagacaccagtgagaccagctacactccagcgggagcaagtccgaagacaacaggccaggagctctgcttaggagccacctagggcgtaaacccacgccaccccctgcccgcgcctcctctgtcctgcgaatgacactctggggcgccgtccagcaggtggctgcctctcaaccacctgtgcagtgagcacgagtgtgtgtggcggaagcggcccaggccccacgctccgcctacagcccatccggcacccacctcacagacgtgctctcatatgggacaggcaccagagtggcagtatgtccccagccggctcccggctgcctcacccatggcagcagcccacgcaagagccacctccattcaccgcttttcctcactggtcacaatcgcctgtcccaagttctggggctgcagccttcaacgttcgtcatcgctctccctgcacctacagctacagcccacacccacgccaccatcatctcttccccagacagccgcacaaacccgcacacagcgcgcctcctcccaccgcctggcgggtcctcttccagcaccttcctgtggtgggcgggtctggcccacacgccacctccccaaggctccttccccttcagagctctgccacgctcagagcacaccatgcttgggtctgggttctttttgtttcacatcctaccaggacacagccactcccttgggggcggagatggggttttgtttgttctgaaacggagtctcgcactgtctcctgggctggagtgcaacggcgcaatctaggctcactgcaacctccgcctcccgggttcaagcgattctcctgcctcaacctccctcgtagctgggattacaggtgccccctcccacaaccggctaaatttttgtatttttagtagagatggggtttcactgtgttagccaggctggtctccctttcctgaccttgtgatccgcctgcctcggcctcccaaagtgcggggttacaggtgtgagccaccgcgcctggccagggatggggttttgtttggctcagtctgcactgcctggcactcaggggcagcgccaaggagagagggcagcagggcatgagcatcatgtgcagagtggccaccaaacacggaataaggcctggcaaccctgtgcctcctcgactcactttttacatcagcgggttgtgtcctgactgccccatgtcccattttctgtcttcctctcttccctctccgagtctaagtggacccccagctccccagagcatccactgtgcagagagtgcagagcccacactgctgcccaccaacgccctgtgctgcaggtggtgtcgacgtgcatgtgtgaacggagacaccaccacaggaaggacctaacagtcgacacgcgcctcccagcctgccaccctgcagctccagcgggacacgtgggcaatggagctcagagaagggtctgtacctcagtggtttcactggctgcagtgctctcttcctttttcctctcctcttcttcttgttctagttccttaatgctctcttctaacacattgggccagaaatcaccttcaaaatagggcagttccttggcactggtgagcctgtcttcagttgcttgtttgaaaatatcctgagtgggcaaagcacaacagtgagatgagggccatgcacgcgtgccccccaccatggtgcgacagacccccacgcaagcgtgcccctcaccatggtgtggcagagtcccatgcatgtgtgcccccccaccacagtgcagcagacccccacacatgtgcaccccccaccacagtgctggagcccctatgtgtgcaacagtgatgcacaggccccaatgcccactgatggaaacagctccaactgtgctgctctcagacggccaggggaaagcctcaatcagctgaagaaaatgcttctaagttctcactttaggcttttatttttctgctttctaatcctcataagtgaaggtaattaacaagtatgcgaatgcaagaaaaaggcacacaaatatcctcccctcagttgtgacaaaagccaccaccttccttcagcgccgggtaccttgtagtcatggatgatccgctctgcaaacgccttgtccagcatctttttgtaccactcctgcagtcgttttggcttgggtattttttgatcaggtgggtggcaatggaagatgtaatcatctccttcacttggaggacaggcccagatgtgccctgtcacatacctgcaggacccacgcacacacgtcagatgaacgtgccagtgaaatcggccctgcctttaaggagttatagcagaggagcaaggactaaagccaggacagaagtaaccagagagagagaatgaatgcccacaaagctgggtgtggtgggggcaaggctcgaactttatcctgagcaaatgcaagcctgcaaattagccctgcaacacttctcccttggggtgcacacacagggcagggccgaggctgcaaaagaaacctgaggcctcattaaagaaccagggaatatgatggctcatcaaggcaatgccatccccttcctcctgtgcactgtaaaggcagttcggttgactatttttctccaagggtcaatgtcaacataaacctcattcattctgttcaagacactttgatcaaatgcccctatccttttcaagtttcagaagggaatggggcaggtctagagtacagaaaccaagggctagagaaggaagccagacccaagacagcatacgctgcagggttccgtttacacaaaggattcacaaaagacaaattcagagagacaaagtagattagtggtcgcctggggcagggaaggtttaacagcaaggggcaggaggaacattttttttcttttttctttttttttttttgcgggcggggggcagagtttcattgttgttgcccagggtggagtgcaatggcatgatctcgactcagcgcatcctctgtctccctggttcgagtggctctcctgcccccacctcctgaggagctgggattacgctaggcacccgccaccacgcctggctcattttttgtatttttagtacagacagggtttcaccatgttggtcaggctggtcttgaactcctgatctcaggtgatccacctgccttggcctcccaaagtactaggattacagactaggtgagccaatttttttttgtatttttctttttttcttttctttcttttttctttttttgagatggagtcttgctctgtcgcccaggctggagtgcagtggcacaatctcagctcactgcaaccccccgcctcctggattcaaggaattctcctgcctcagcctcttgagtagctgggattacaggctcatgctactatgcccggctaacttttgtatttttagtagagacagggtttcaccatgttggtcaggctggtctcaaactcctgaccttgtgatccgcccgcctcggcctcccaaagtgctgagattacaggtgtgagccaccgcgcccggccttttttttaatttttagtagagatggggtttcaccatgttggtcaggctggtcttgaactcctgacttcaggtgatccaccgcagcaggagggatcttataggtcaataacaatgttctgaaactgacttgtgatagttgcactaatgggtaaagttactaaaaaccactgaatcatatatccaaaaaaggggaattctatgatatgtaaactttgcctcaataaagttaaaaaaaaaaaaaaagggaatgaaaaggaagtaaaggtagggaaagagcttgctacgtgcccaggagccagacctgtgaggctcggggagcacctggaaagaggagctttggagattctgaattgatcttaggatggaaaaataaaaacgcataaaacttaaaatacccattatttcacggaataaacatacagtaaaaaataaagggttcttactagttccaaataatttaatccaaactcaccctaatttcttcacatactctaaatatccaataaggatctcatggtaaacggctgtgcggaggcaacgtggccggaagaaatgaatactatccagataagaaatgtacacacgcctgtgggaaggaggcacatgtttaactcagggtatccctcaaatctgaaatcaaacacaagcaacaaacaacaccctggaagtttactttttagacagggtcttgctctgtcattcaggctgcaatgcggtgacgcggtcacagctcactgcaacctcaacctcatgggctcaagcaatcctcctgcctcagactcccacatagttaggatgacaaggcatgtaccatcatgcccagataatttattttttgtagagctagggtctcactttgttgttcagacttgtctcagactcctgtggtccagttatcctcccacctcggcctcccacagtgctgtgattggccagtttttcttttgatggtatttacactggccaccaaacaggatgtgataaacaaacaaacaaaccaaaacccaaaaaccaaccagtcaccaaccctgctgccaatcagttaaatggaattcagttttcgtcactgaacaaaaggatgaatggcaccactcggcacagagagccacagttaaggcaaactgagaaaagccacttttagttccttcttgcccagattcctgactgcacatgaagccctcgtggcagagctacttcctctgttcaggtgccaggctgtcccatcccaactccccaggtttacctgcgttaggtaagagcgggtcccacacagactcgccacacaaaacacgctcactgcagtcatctcaacagttcatttcccgctagtttaatggaaaacaaaactaactactttggttagttaattgtggtttcatttactttaatcccctatgaaggctcacaggctcctctgggacacttaagagccctggtctatcctaacacggctcactgaatgacacgccctggaaggagctggaaaactacctcgtgtttggaggggggcaatcagagccgtattcttggacgtgcattccaaaaaagcagacatccacgccgtcaatttcctcaaaagcaaacagagctttggttcgatatgggaaagattcagacatttccccagaatccacaaacctgaaacaaaagccagagccggacatttacaaaggctgttgctgacaaggtgcttctgcacaccaggcctgctcctctaactctggccactgcagatgagcggaggcatggccacctcctcagaccgtggcctggagtcctccctatgggccagtcagccccggagcagggagcacttgctttctgaccagtttccctcactagggaactgcacctctgtgaatgaaatacgggattctgaggaggactggctatacagcagtcccccttatccacggggtgtatgttccaagaccagcagtggatgctggaaaccatggacagtatcaacctctatgcgttttttcttatacacctgtactggtcacaaaattttaatttataaattaggcacagcaagagattaacaagaataagtaataataaaataagaaaattataaacagtatactataatatggtatgtggtctctctctcaaaatagcttactgcactgtatagggtaactaaaaccccagacaggacaaccgcagctgagggggctactgcacgcattcgctgctgcaaagtcttggaaggatgacctcaaactcaagagctttgcagagagcaggctctggcaagcgggcgtggggactgctcgcagagcactgtagagagcaggcacactgaccgtgacttcatcccgggcttgacctccaccgtcttgtctgagctggccaccactcggacaaaaacctccccggcttcagggtgattctggcgccgcaaaaatttgttcactcggtcttccaagtggtttcccagtcttgtggtctgcagccctaggaagtccagaaggagcaggtgagagggcttcaacagcactgctgagacagtgactgagactagagaatccaccccactttgcagcacaggctgatattttaaaggactaatgttctccaaacacggaagaaatctaatctgtcctgtgacacgagtgttatataaaggaaaggtggactctgggatctcaggcactccactcctgaaaaccgtttacgtgcccaggtaacctgcatctttttctaacagtatggggcagaagacctatagcggtgggtccaaaattgacaggggctctagggcggagcagatggatgtttccctgttgcttcccgctttccctggagggcagagatggcacaccctcagtgggctcctcctgcccagctctgaggagaaagtccctactatggagtctgacgtgaacgtggaacgttctagggctaaccaattaagctctggccagagcctgtccggtgcctcaggagctggcaaagtattggtgtccaagcctgccctgagccatcgcctcgtgcggtgcacgaatgaagtttccgagccttggcgagggcagcctttcctgggctcacctccccgccgccacccctcctcacccagggccagccccgggagggctaccgtcacaggagctagccagaggcaggacattacttcaggacagagaacgcctcatatacaggttaaaaaactataagggaaagttgcaaaaggttcttagtgattacgtatagacaatgagattttaaaagatgttttcttctttgctggcttttaaatatttcctacattagtgagaaataggaaaattgggaattttcgaagattccttagcgagctagaaaatttagaccaaacttctaaatttcatttttctgcaataaacaaaccagtggtgctgatttttggataagttgtacctgaataaaaatgatttaaaaagaaaaatgtggccgggcacaatggctcatgcctgtaatcccagcactttgggaggccgaggcaggtggatcacctgaggtcaggagttcaagaccagcctgaccaaaacggagaaaccccatctctactaaaaatacaaaattaagctgagcgcagtgactcacacctgtaatcccagctctttgggaggctgaggcgagtggatcacctgaggtcaggagttcgagaccagcctggccaacatggtgaaacccccgtctccactaagaatgcaaaattaagtcgggagcgatggctcatgcctgtaattccagcattttgggaggccgaggcaggcggatcacgaggtcaggcgatcgggaccatcctggctaacacggtgaaaccccatctctactaaaaaacagaaaaaattaggactacaggcatggtggcgggcgcctgtagtcccagctactcgggaggctgaggcaggcgaatggcgtgaacccgggaggcaagagcttgcagtgagccgacatcacgtgactgcactccagtgtgggcgacagagcgagactctgtctgcacaaacaaaacaaaacaaaaaaaaaacaaaaaaaccccccaaaaaaacaaacaaaaaaaactcttccagagtaacttcgctatttgacacctgtgatccacacatggctgcatactccagaggtggtctcagacagcacaggggtctaggcgcaggccgtgctcactgcggtgcactctgcgcaaccttcctcacagtgctgcctccttttctgttatcactcgatttggccactgttcctactttttcatcactccttgccattgctgcagttatgtccttgtatgtgccgttatgcatatgtgcaaatatttttataggatacatgtgtgaaagtagacttgctaaatctaaaaatgaacactttaaattgtgcccctcgctttctggcattcaacttgtatcttcatccatggcgcatgacaggggccttttgtgccttttcctttctcatctctgggctgtatctttttaaggaaggcttttcataactcaacacaataaaattattatcttacttttatcctgaatgcatctgcagttttgtttacttttctcgctttttaatctacctgaatttggttttgcatatggtgtatgcgaaggagatggttttcaatgcaagattaaggaagcatacctttactctgtgatcagacaccacaacgcctgtgctgacacacgctcacactgagagtagagctacctctagtctcctaggcccttttctccagtaatgttccatttctagatcttgggctcatctaccgaatgcccacgggtctttctggatgctgcggtgggagggggctggacctgctctggggccacttgtgccattccgcccagtcacctcctgcccctttcaggcaatgactgttctacggaggcctagttctctgggtaattctgttttggctactgagcctctggcccagggaagaacttccaatttgctcaaatgcattagcgaactcactcagagtgaatcctctgaagcagggcctctcaaatggaggcaactgtgcccctccaggggacatctggcaatgtctggagacatttctgacagacgtaatgaattgctgaggaaggtgttactggcactgagtgggcagaggccaggcatgctgctaaaatcctgtaatgcgcaggacagcccctaaaacagagggttacctggcctgaaatgtcaacagtgcctcagttgagaaaccgagctaaggaaaagtattacaatagtttatcaatgagtgatatttcacaagtttttaacagaggcagtgtaagctattgcataactttggatgttggttaacaacagagtttgaacttgaattaagactcagtctcaagtctacagggtggcttcctcctccccttcccccagtgcatggtccatcctagcatttccatctctcttctactctgagctccccaaatgaccctggttctattggggatctcctgagcaacatgctagtcacctgtcctgccagagaaaggtgacagctgtagggagcagctggcaagtcaatgttagaacactgctgcagttgccgttcttgtgtgggtttgctggttaactcggcaaaaggccagcctggcgcgtcaagctgcagaaggccatcccaagacttgagaattgactctataaagattaaataaccataaacttttgataacaatgcaatgtggtcttaaaaaaaaaagtcagccgggcgcggtggctaatggctgtaatcccagcactttgggaggccgaggcgggcggatcacaaggtcaagagattgagaccgtcctggccaacatggtgaaacccgtctctactaaaaatacaaaaattagctgggcaaggtggcgggcgcctgtagtcccagctactcgggaggctgaggcaggagaatcgcttgaacccaggaggtggaggttgcagtgagctgagattgcaccactgcactccagcctggcgacagagcgagaatgtctcaaattaaaaaaaaaagaaagtctactcatgcaaagttacttctagcagtaacaggttgttccttctatttctgcacaggcaccaccagctgcagtaacatgtccagccaagtccacatgcaggccaggctcctaccgctcctggggtggtggctggttcccagaggccatggctcataccccactgtagcagaagccagcacccacgggacagacccacggcagcccacatagggcccagggttagagagtgctggccaacattacaccacacatgcacgcacgaggggtgaggggtcttaggtctaaaccacttgagaataatctgttgataaattttctcagaatttacaaagtttactgcacatctaacctttcatctaaaacatgcgctgatcataaatgctgactttcatataacaatcaggccaaatattccctttaagggtggactgagatgttttacacttgatgaagatccacagcccaaggctgcgagtcctgctctgagctctgtgctcagcagccccgtggctgagatgaccattctgagaagcacagacttcagggactcacagctgtgctgcctattctcagtgaagcccctgaagaacattcttgcattcttaccctcatgactggcctggctctccttaaggatgagacaagaaaaatacaaagtactggggaaaaaactaacgaaaatctttgacaaccgaacctcagaaccatgtgttgagaggaaccaaagaacaatggggacaatttctacaagtttctaaaatgtgcagtccaggaaacagaaagcttcccgaaacttactcttagcactgaatttgttttcttttcgaggtctgccagttttcttcaagcagttgtcgcacacaaaactgcaaaataatagtggtatgatgagactgtatataatgatgtaaattgtcaaaccaacaaaatgcagcattcagatagtttgttggcagtttaaatcacattattataaaattaaagagtgaagaggcagactgctttgattccacaattcctaaagcggacaaacgcttagaacttaaatttagaaccaactgccatctctcttaatcgctgaattcttgctgacaacaatgaatgagatgcagtagccactgcaactgccccgccactggctctgtgcagaactgccctccaggccaggggaaacaactcaccctgaaggccaaatgatgtcatagtgcagaacgcaaatctgatgcatcttccggccacactccttgcaatcaacgaaactaggaggcaaagaaggcgcactgttaaagcacacggaaccacaagaccagagtcacttgtagaagtctgtgtgtgcgtccacaccttgttctctgggttactttgagtagtgctgacattaatgcgtgtgttggctgattcagctatattttacaatgcatccgtatgatatcttctacaggaaaaagctttcttcttttgtttgtacaagcgcttcattcctcttttctcccaatctccctttgcaaccagaaaggaaactttactttttaaaaattgctgcgacaaatacatatttcacaggccggtatttctgacactgctacacatttgcaagaacaatgccttctctaggtgatttcacatgccaaaactgacttaaaaaatagagaacaatactttgagttctaaacatgtgctcttaagtctaaaattgttgaggatactaatgggaaacacggccagttcagagcagccacgctaggcgcgaggcacaaaaacaccagttctgagtcagttacaaaaggtggaatgtgtcaggcctactggcaagttgacaagggtttattcaagtaaacactggtgaagcgagagaatggaccacccattccccacgaatcctccacactgttctacggcagcccacaaccacggcccaccagggctccgtcacctccaggaaccgcctcaacccaggaatcttaaatgccaagatgacattttgaggtcaagaccttgggtttttgtcagctccctcccttgctgccaccacaatgcatacctccgaggataggctgaagggactggtgagtaatgtgattccctgtgtgctcctgagctttgagctacagctcctctaaagtgtgcccctgccctcgtccccttaatctgtccattgcacgtgctatgcaagccctcagccatgggtctaccctcatctggcttctctgcccagtctgctggagggaaagaaaagacacacacacagatctgtgaaaaaaaaaacacacacacacaaatggcggcacccgttcatggtcctatggcactctctgacagcccggctctgtctggctacctctcccttccacgtggcagctgctctgaatctgcactcctttcctccagtgcttatcctccacaagctctgtctttgacaactcagccactgagctcatccccaacgctaagaatttcaaaggttggggccaagaacttcctcaattcctgtgccgtctccaaaggtcccctgctctcaactcttccctcccatgtcaggggaaaggagtgtcccccaaaactacactggggacaggtgcagtggctcacacctgtaatcctagcatgtggagaggctggggtggaaggattgctttactgggagtttgagaccagcctgggtaaaatagggagaccccatttctacaaaaaatttaaaaattagctgggcatggtggtgtgtgcctgtagtcccagttacttagaaggctgagctgggaggactgcttgggtctgggaggttgtggctgcagtgagctatgactgcaccactgcactccagcctgggtgacacagcaagaccctgtttcaaaaacaacaaacaaaatccaaacaaacaaaacacactgcatattctagaccccatgacatccattttgaatttccccctttctcccactcccaattattatgggccaactagatgtctccccttccctcagtcccccagcaagcccccctgcctggctccaaaagctcttgctttaattggtgtttcagtttcttgccttctcctgctttgtgtctcttaactaacttctctactacagaacaatgtcttctcctcttctgttcagttcacctcatagaccaaagatgaccctcttacactagaaccagtgctattcttcaaaacctcctcagcacattataggataaagtctaaacgtcaagagacagtgtaatggcccttcatgaagttaacctctgcctaccaaccacccactctaggggccttgtagttttattgagcaacctgtgttctttcatgcctttgtttctagaatgctctgcagcttcaatgtaaatgtcatcttgtccaggaaaccaggcgcaactgtggtgatgccgctctgcccaagcagggtcccttctgtctgggactcacttgtactgtctcctgctgcaggctgtgccattacccagctgtctctctagactacaaccagcaggaaggagaccccttcactcatccatgtgttccctctgcctggcacctactacttgaatgtaatatattttgaagttgaaaagtagatataaattggccgggcacggtggctcacgcctgtaatcccagcactttgggaggccgaggtgggtggatcacgaggtcaggagttcaagaccagcctggtcaagatggtgaaacctcgtctctactaaaaatacaggctgggtgcggtggctcacacctgtaatcccagcaccttgagaggccgaggcgggtggaccacgaggtcaggagatcgagaccatcctggctaacatggtgaaaccccgtctctactaaaaatacaaaaaaattagccaggtgtggtggcacatgcctgtaatcccagctactcgggaggctgaggcaggagaatcgcttgaacccgggagacggaggttgcggtgagctgagattgtgccattgcactccagcctgggcaacaagagtgaaactccatctcaaaaataaaaataaatacatacatacatacatacataagttagctgggcgtggtggcgggcacctgtaatcccagccacttgggaggccaaggcagagaattgcttgaatctgggaggcggaggctgcagtgagccgagatcgcgccactgcactccagcctgggggacagagcaagacttgtctcagggggaaaaaaaaaaaggaaagaaaagtagatataaataataatgaaactataaagccaaggagagaaagacacaatgtgaaaagaaaggtggaaagtcaggaaaaacaatccgatggtcatgagaggggtgggcgctctgccctggcatctcgccaagactacagctctaggatttcacatcatcgtcctgtctgtgtaccatgtgctggtagagatgaagtaacctgccaaaagtcaagctaggtttccagaggtggcctgggtagaaatctgtgcttgccactctagccactggcttccctggagagggtcaggatagggagagcagggtctgtttcttgccttggctgagtcacagcccacacttcccaagtagccaacgctcctggagcctgtgctcaccctggggacaaaaaatagccagtatcgccatgccaatttggagcgccctcagaactttacattggggacctgggaagaggctaccacactgaaaaaaatctgaagtctctttaggggctgttatgaagcaaggttagcaaatgcagcactctcactcatcactgtagaaaagtgcttaacagggccgggcgcggtggctcacgcctggaatcccagcactttgggaggccgagacaggcacatcacctgaggtcaggagatcgagaccatcctggctaacacagtgaaaccccgtctctactaaaaatacaaaaaattagccaggcgtggtggtgggcgcctgtagtcccagctactcgggaggctgaggcaggagaatggcgtgaacccgggaggcggagcctgcagtgagccgagatcgtgccactgcactccagcctcggggacagagcgagactgtctcaaaaaacaaaacaaaacaaaaacaacaacaaaaaaagtgcttaacaatggcaagaaaatgtgccaagctttacattatttgagaaagcagtttccaagaggttttctttctggtatttccctttaaacgatactactagtactaccccaccaaatactcctaacctttggtctctaaagattcatgctaaatggcttcttaaagacacccatgaccaaattattagagaggttctcatagaactaaaacatccatttaatcttatcattgttaaaatccagtaactagagtacatgttacagagacatacatattttgtttaagtttaaaagaaatctatatctaaaagataacctcacaccagaaattccacttacggcaacatatttccaatgtttttacccacaacccactccataaggagtaactttaccgatttcaaaccaaaactgaaagtaaaaaagaaatagctatatacttacggttcggggtctaaggtatcatttttcttcttttcaaactgatcctttgaaattgtccttgttttaaaataagaaaacatgttttattaactaaaatttatctgttgagtataaactatagggtctctggaatgttattttgtaactagttcttcaaacaaaaagacatgatggccccttaaaatctcaagtacatgtaataacggaatgaacagaaaatttaatttcgtagaacactacaatgtctttttctacatattccactatcatttcttttccttctgttttttcagagacaaggtcttgctctgttgcccaggctggagtgcagtggcgtgaccatggctcactgcagccttaacctcctaggctcaagtgatcctcctgggtagctgggactataggcatgcaccaccaggactggctaattttttgattttttgtggagatgagggtctcattatgttgccaaggctgaactcaaactcaccccggttctgagtagctgggactacaggtacaaaccaccacgccctgttaagtttttttaattttttgtagagatggggtctcactatgttgctcaggcaacaatccaattattaatcacacaactagactaaagagaattaggatgacaagggaaataaattgaaaatgtagaatttcagtcactttggtttgtttgtcttacaagttaggttttttctgcatttgaacaaagaaaatggtagagcgtaagtgcctacactgctggaagaagctcctgtggcaaacccttcctttctgttggggaagtcacactgtggtagggtggtaggaatcatggaagactggggaactcagtctgacgaaaagagggaacggcagacctgggcagatgtggtgggtggctggcaggtttttagttacttaagtatagaaatgagttgataacacaatttgtgcatttgctttttcttgccacacagtggccattctaacactcgaaggtaactctgccggataataaacactggaaatacaagtttaaccctgtgcaggagtgaactaacaaagtcatagctgtccactttggagctggtaaacaacaggtaaagcactagtgaaggaaggaaacacatttagactttaggccaaaaaatggggttggagaacactggaatccattaatctggattagacttcagtaactgaaaggatggaggtttaagtggagataaactaaatgtaaagggcagggcatgtacaccaaactcattttttgctactgccagttctgcaaatggggatacctggtttctcaggtataactgaaaatttacatggtcgggcatggtggccccagcactttggaaggccaaggcaggaggactgcttgaggcaagagttcaagaccagcctgggtaacaacagtgagaccccatttcaaaaaaaaaattaaaataaagaaaatttctaattccccaaaatggaaccactaggaaaaagcaattattttagaaaaaaagacagaccaaggtcaagagagaccagtggtctccagtggtaggccacagtaccaccgccttgaatgataaaggcagaggtggcgctgtggttcagccaaaacacatttttcagtgtaaatgtatacgtatacacatattcaaattaaatgtgatcatagttaatatgaaacaaaccccacaacacaacagactgtaatcccagcactttggaaggcccaggcaggtggattgtgcttcagtctaggagtttgagactagcctgggcaacatggcgagacctcgtctctacaaaaaatacaaaaaaattagctgggtatggtggcgtgcacctgtaatcccagctacttgagaggctgagaaaggaggatcgcttgaacccaagtggtcaaggctgcagtgagtcgagatagtgccactgcacaccacccaggtgacagaatgagaacctgtctcaaaaacaaaaaaccaaaaaacattgcaaggaagtcaaaatggcaccggtaccttccttatagtcattggtaagaggaaaaaacaatttaaggtcaccctccctcaccccagagaaaatgacaggacggtacttacgtctggggctgtgaagggtcgtcacccagggtcacattctcgccctggatctctgtgaaacacttctcacagaaatgatacctgtcagcaagaaggccatacttgggtgaactggtccatcataacacacagccacccaagcaacgaagccaccaatcagagcagggcagagcaccacgacgaagggggggcgttgttggttgattgatgggtcagtgaggacaatgaaaggaacagggggcaggtggggaaaggcaggattagagaacagggaagggaacaaatagcacagacacagaggtaagacgcagacaccaagacaacacagagcagaaagccaaggcaaagcattgattagcattcggtctcattgcacacatcacaggccatcatcactaacaacgacaggctcggtccggctccaagaggcaaatgttttcaaggagttgttaatactagaattgcatggagcccaaatttaggaatctgaattttgttcttactcagagaaagtcaaatataactccagggtttgagatggaaaaatttacttgaacaaaacagtctgacaaaaggccttaaaaaagcaatttaaactgaaatagctttatttttcaaaatggaaaatttatgcttgacagcaattcagagattttatttccggtattaagccagatctttaaatgtatgaaaatgctgagcacccagaactgattttaattttttcctgtttttttttttttcatgttaatcattcagttaattgtgttacaatacaaatgaaaccaaatccatattctagacaaacatttaacataaatgcagtcagggtcaaagactttccacccatttatcaatatgaatatacagagtaagaaatgtgatatattgtataagaaatacaatatatgtaaatccatgaacaatctttgaaaattcaattctaagctttgatttgacatttttggtactgggaccaatcattcatcaatctgaaagacttagcgaatgactgttctgacttgggggcaatccaagttaagtgaatttagagttaatctttaaagaacaatctgcatttgagaaattatccatcaccccaatttcttgtaagacaatatagagcctgggctcaagctatcaaatacaaacaattaaaataaaaactactaaatgtttggaaaggacataaatgagaaatcaacagaaatgcaggctgatgctgcataaaacaagatgagtacacaagaataccgtaagaataaacaagcgggtggaggtggatcacacaagcgagaagaatgagtgtcaggtagcgacggcagcacgaatgcggtttagtgctcaaaactatgtctacaagatgccaggaaggattagtattaaaaacagtgcgacaggactcgagcgccaggctgaaccaccaagtgcagaatgggacgcggcagctgcagtctcactcacttgcgcactcacacggctacagaagactgaggcgtgggccaccgtgtggccagttcactaccactaggacaggtcccccacaagtcccaaatctaatcttaattcaatacattgagcattttgtctgttgtatttcactaaccacacacatacagcaaattttaaagcatacaacttcagtgcatgcacatctcaagatgagccaattttttgtgtttggttgatgaggaacatgacagattcactagattaatgaaggtttcttgctgggactaatttatttggcactaactcaattaataaattatgtcaggatttaacactctgacaggcaagaggcagattaatgtttttctttaaatatgtattttttttttccctgaatgaactatagcaatattctggccattcactattttgtaaatatcctaaaatccggtatgaagaagaacttccgtgtgcaggagggtatggtcatcactggcaagaaggaattaaagtacagaaactataaaccaattcagtggcaaccaaaacaatacacaaaaaagacattccctcaatccccaatacttcccttttataagtaaaactcctaattgagtgccccattcatgatacaatcaaacacgcagaactatggccaactagaagggaccgttcaagacattctgaaatgaaactcccaccgtaatcacaggtgagtctaaatggttttaaaatcctggagaaatcctttgcttttatttaaggacagcaagcccagcaacatccaggaaacaagaaccataaacccatccttccccaccgaggaaagtgacactgagggaggcactggtggtggaatggcagcccatgcagtggctgggaaactgaggctcttcctgtatgactgactcccaccctggaaaatcccaggatcagaaccggggaggcaaagcattatcaacagactccttgtctgcctcaaaactgctggagaaatggacaatttagcctgttcgtgtttaagaaggggaggaagaggggcccgtggcttcactttattactgttctgagagaggaagacagcacacagaaaagggaacagtcacccccaactagtaaaatcagctaaagcaaccctggcagtctatgagtgatagatgttattgccagactgcccctaccttcttacctagtccacactttattctccctggaaacacataaagatttagaaattcacttttcaacttaagcgcctagatgacattttgcctggtgtgaaggaagcagcttgatgaatatggaattgcaaaggagaaatacttcacataatccagtgatgatgcatttcagggttgctatagtaccatggaactgcatagtttatctgtaagggtaatttaatatatggactaagttttcaaatgcagattgttttaagtaccatatcagtacatatcactgggatatctatagataatacttatattatctacagatactaactgggaaagctaaagaacagtttttccaacatgagttactttcaaatttgcaaagtatgaaaacaagtgaaaatgtaatcatacgctcacttatatattagggtttcacttgtttaaatgatctgtaggattttttattgttctaagtgcccagtttaggactacaagtgccaagacaattattcataagaacactgcagtgttcataaatagtcaaagttgaaaataaaaacataagcagttaaagtatttgttacagaatcaggccactgctttctcaggatgataatatgctaacctactcagtcagatacactgttctagagagcatgcctgtgatcgtctgaggaacgctacgcctacgctttaaaaattatcactaataaaatggaactcctttatttgcatttccactcttaaaaatacattacttttgtttagtaaaaatgaagttctatacagaaataaaattagacgtttcagaactttcatgccatcaatgactttatatgccatcaatgacttcatatgccatcaatgactctttggtcctaccaattccatttaactttaattgctctcaatgtaaaagaccaaaatctgtgcaaatcagcaaaggcagggtaccaacggacccaggaacaggccccacaacactttagagacagtggtaaacaatctaccttccttctagaccaaaactgtgttgggcaacgtagcaggggtggcatttttctgggtgtagttaatattaacctttctctgaagatatcattaactttattttgcttggcacaaatggtttttaaagtgcattcctattcattatttcatcattgaggacctgacaaaatgaggctgcgagggaagacgctattgtctgtatcacagacaaggctaagcttaatacattaatacatcatggggtctgctgaaggtcatggggctaaaagcataaaaggagtggccagaacttcccaaagagcagcaagtcactatgggagagatcccattaggaaggggctatggtatcattttaaacttggtcataaaatgtttctattgataaaggggaagttgagatggaaatcagactctgaatgttaaactattttcagcaggacaattgcacacgctgcacttctagcagggatgcagtttagggtctgtccttcccccttgcaccagtgtttcactacactgaacagtattaggaataagcaggccaggcttattcctaatagaaaaggcttaggaaccttttttgagacatttttgtgtcaaaaggattttttttaaaaataggattttgatgggagttattacttatcttgaatatggatttttaaaaaaaacatagaagaattaaaacacataaccataaaactccaaaattttcaggcctgtgaacaaataacaaaaagccttctgtcttctttgaagtataggacataattactctgaccaaatgagagtaaaataataaaaaacgccaaaccccactgttgacgcttattatttgaacctaaagacaaagaacaggcacaaacctctatcttggccacagagaatccagctgctggctcataaaatagaggcaacgtcacagtttgagcaagattcctgacctgtgcctccacgcatggtgcgctcacactgcagcggcacatggacacttacacgctgcggtacagataagctgacttctcaaacaactccaaaactacgcaagctgtattttgtgggaaaccacaacaaaaaatactattctcactctctacctattttaagacaggagatctattctttagccatcttcatattccaaaagaatggcaagtatttcttaagcagatccaccactcacaaaaccctgaaatggccatcttataataggaggcaacagaatcacattcttgaactcaattaaaacaccagatctcattttgtatcgtgctgctagtgtaaaatttaaaaataaagatcatggacccttttcctctgccttataggaagcagcactcatgcaagtctttccatgagactgatcaggccaaattaccaggcaaatatttgcaggtagaatagtaaaatccacattttctactctatgaacatcttgaaaaaggcatgtcaacctttatcagagttactctcaacttcagacgcttgcttctagggctgcgttttagaacgggcagggctgaagaaataacgtacctaatccaagtagtacggcaagacttggctctgaggttacagtttttacactgtaaaagtacgctttataactaactaagaggccatgggcctaagtgactaacaagacactgaaaccgagccactttttctctttttttttcttttcaaatagagatgggggtttctctatgtcgccaaggctgataacataactcctgggctcaagtgattctcccacctcagcctcccaaagtgctgggattacaggcgtgagccaccacacccggcctgaaattgggccactttttattggaacttcaggaaagaaataatgtacacagactataaccagatgaacgtgccttgccctaagacataatgcaggatgctgcttgacgcttacctattctgatagctgtagtaggcagcatcgcgaggaatggtacacagctgcttcccatagcagcacaaagtctgtggggaaaactcatactgcaaaaataaaggagaaatacttttatataaaaatacattccatttactgtcttataatgttctagtctactatagagactagtaaattatttctgttagtatattagacagttttctaacaattttagtagctttaaagacattttgggatagcatgtgatagaactggctctaagagacattcactacagacaggtaccacaggcagagaggggcagccagaaacgcttccccatggcctccctcagtaagcgcctgtacacccagctctgatcacccatcacatcgcttcaggcatcaactgtgtcaccagacagcagattgcacatatgcactcccagtatacaggcgtggtctcatattagtataacacccctctggctggattaaccaggaaaattcactttccggaaaaacttaaaactgtaccttgcgtccacagcaatatccaagggactgcatgacagggtcaatttcctgctcaaagacctctgcaagcttactgcaaaacttatagactcgggatgtcttgcgattatagagccaggcattgttgaacatgagccagacgtcgtccacgtactgccagggctcttggtattgccctgtgtccagcttccgcttgatggtggagaggtccatgggattctttacgatgtcaaaatagtccttaaaaaaaaaaaaatggtctcagtatagggaatcccccaatatccaaatgccagtctcatctggcagctttgttttaaaataatagaaacagaaagcaccaaaataacttccattcccaacagtaagaaataggaaatgaaaagaaaataacctctgacgcaactgattttactcactaaaagtgtaattagtattttcaggtatgatcacattataatactccaaaggcaaaagtaaagaaaaattgttaaaagatacttctaacaaaaaattttaaaaatagatctttaatccactgaattaaaatagtgaacaagtttatcaaacagtgtgtatttctagatattcactcttgatcctagcaagcaaaatgaaattacaagacaaatataaacacaaagctagtaatgactgctacatagaatcggctgggtccccatggcctttgcaaggctatccaggaatataaaagagagaagcccaaatatttttttacagttcatgttcacaaattctttcagacaaaagtgacacaaggccccaaatataaagtgaagtctcaggggcatgtgcttcccttgcttcagtgcacccctcctccaaggaccagggcttcatgaacaggtgaaatcaaacaaaataaacactttcactgataactgttaacagacaacagttttttatattaggagaacaatcttcaaggcagggggattattttatctaatttcaagagataaaacaatggacactcagaagtcacaccagcaaagttataatctatttttatgaattaacttactggaattccgaggagctggggatctacaggctgccggaaaggtaatgactctgggtcctgtcgatacagtgcttctagggttggcatgagggcctggcgtaactcctctggtttaaagactgcagagaaaacatcaagaaaagacactttgtaaaaggtgctcagatccctcctacctcacatttaaaacggaatcctggctgctgtgacatcccagccacgatgctcctaaggcactcgaggggctctcgtccatcaccgttaaggactaaagcttctgaaaacacactagtgtcagaactgtgttcagcttgtgaggcaaaatacaacactgggaagtttgcttcttccatgaaaggtttccaacattaaaaacttggctgaaaaagaaagtaaagctaactcccaaatctgtctcattcatcaaactgggtggcaaataaagccatttcaggctgggcatggtggctcacacatgtaatcccagcactttgggagactgaggagggcggatcacctgaggtcaggagttcaagaccagcctgaccaacgtagtgaaacctcgtctctactaaacacaaatttagcctggtgtgtgtcgggggttcctataagccccgctactcgagagggtgagaaaggaaaattgcttgaacccaggagacggaggttgcagtgagccgagattgcgccactgcactccagcctggacaacaagagcaaaactctgtctccaaaaaaaaaagaccatttcattggaagggaccttaaaagatcctctgagtaaagttttttatccttggctaaattaaattcaggccactggagacaaacggttttgaatctcataaatgtaaacagtaatagagctacaaaataaagcatttttataaaaagttccatattgcttactcccacatttactaatgccaatttctccaacccctcagacaccttactgcctactacactctctgttttcactaatacaaacataaaatactggctgccaaatacattcaagatggtacattcatacaaaccctcaacaagtatgggaacaggtgccagggaagctgttcggtgtgggaggccggccagtcagcagtcagcgtgtcacgaccccacctggctcatgttcactcacacagagaagaaactggaggcaaagatgtctcaggcattctgatgccttagcttataagtgatgtattttttcttggtgttctttaatttttaattaaattattatttttgagacaaggtcgcactctgttgcccaggttgggggacaatggcatcatctcagctcactgcagcttcaacctcccaggctcaagccatcctcctgcctcagcctcaggagtaactgggactacaggtgtgtgctaccatgcctgactcatttttaaattttttatggagatgaggtctcactatgttgtccaagctggtctcgaactcctgagctcaagcgctccccctgcctcagccttccaaagtgctgagattacgggcactaagctatcatgcccaggtttttttttttttttttttttttttttttgagacagagtcttgctctgtcacccaggctggagtgcagtggtacgatctcggctcacagcaacctcagcctcctgaattcaagtgattctcctgcctcagcctcccgagtagctgggattacaggtgcccaccaccacgcccagctgatttttgtaatttttagtagaagatgggtttcatcatgttggccaggttggtctcaaactcttgatctcaaatgatctacccgccctggccttccaaagtgctgggattacaggcatgagccactgtacccagccatcatgcccatctcattttatatttttagagacagagtcttgctccaacgcccaggctggagggcaatgtagtggcgccatcatagccactgtagctgcaaactcctgggctcaagtgatcttgtcatatcactatgttgcccaggctggtattgaactctcggcctcaagtgattctcctgcctcagcctctcaaagcaataacattataggtgtgagccactgggcctggtctgttttttgtatcttgaaaagatttgttttttttgagacggagtttcactcttgttgtctaggctggagtgcaatggcgtgatcttggctcactgcaatctccgcctcccgggttcaagcgattctcctgcctcagccttccgagtagttgggattacaggcatgcaccaccacacccagctaattttgtatttttagtagagactgggtttctccatgttggtcaggctggtctcgaactcctgacctcaggtgatgtgatctgcttgcctcagcctcccaaagtgctgggattacaggtgtgagccaccatgcccggctgaaaagatttcttacaacaggtaagtggtaaactgtaatttaaaaatcagattaaaatatggtaaacatttaaagttccagttgggaagcggcaagcatcaggtacatggacctgccatcaattctgtgtggggtggggatggtctaacttgacaaattctggaaagcgtcatctgattcctaactggtgaaagcaaaagttaaaagttggaaggaaaaacccatgtgtttaacaggctcactttagagatgaaaacaggcgcaccaagaacatgcctcagggctcatttccatcaaagcccaggatacagactcttgaccaacctccgcagacaccgcctcctctccagggcacgtggctgcttcagacctctgacagcagcctgaggtccgggcaaccaggtaaaaaccccgacgcagcactccccacgcacacggtccccagcacttgaaggtgcaaaggcctggtccagggtgcagacgtgcccttcacagtgggaagcgtcggaaacacacagccttgcttcctactaactcctttcttctgttttatgcacagacgaagcagcatttgctagtctttgaataactttttatgagaaaacaattatgtaacaaatagccttttgatttctctgaatgaggggttggcaaattatgaccaagaggccaaatgtggccagctgcttgcttttctgtatggcccaagagctaacaatggatttcacattgtttaatgtttggcagaagaaaaagaaaagaatactatttcatgacatgtgaaaatcacacaaaattcaagtgttagtctccaaaaatacagctttattggcacatagctgtgctcattcgtttatataggatctgtagctgcctccgtgccacagtggcagcactgaggagtggtaacagaggcctcaggacgcacaaagcccacagcgtggatcactgggcctctgcacggagaaggcctgcagaccctgtcaccgccccagtggtaatcgggagtgacagggcctgaaacaagtgtcactttggttgatcatttattcattcattaaataactattcaaattccgtgctgaggagagcattttctttccttttttttttttttttttttgagatggagtctcgcgctgtcacccaggctggagtgcagtggtgcaatctcggcccccaaagtgctgggattacaggcgtgagccacggtgcctggccgaggagagcattttcagactcctgtcttcaccagcacctttctgtaagaagatcccatatgtgcagaagtgaagtcaggagtgtatgtgaactgcgccgctcccctcctctggcccgaggacctgctccacgcggcagggctgttgcagcgcaccagcatctcccaaaaacgcggctctcgagcccttggaggctgctgtctcatatcgcagtccccagcccctgtgactactgaaattttaccaaacgaataatattacaaaaaataaaaaactcagttcctcggtcaccctggtcacatttttatttttttgagacggagtcttgctctgtcgcccaggctggagtgcagtggcgcgatctcggctcactgcaagctccgcctcccaggttcatgccattctcctgcctcagcctcccgagtcgctgggactacaggcgcctgtcaccatggccggctaattttttgtacttttagtagagacagggtttcactgtattagccaggatggtctcgatctcccgacctcgtgatccgcccgcctcggcctcccaaagtgctgtgattataggggtgagccaccacgcccggccaccctggtcacattttaggtgctcaagttatagcactgccctaggcccttctatgtgctgtaagatgaaaactatttcaccaaaactgaaaccaattttttttttttttttgagacgaggtcttctggagtgcagtagcgtaatcacagcccactgcatgcaaacttgacctcctaggctcaagcaaccctcctaattcagcctcatgagtagcatgagggactataagcatgcaccaccataaccagctattttcttatttttttctacagagacagggtctcaccatgttgcccaggctggtcttgaactctgggcctcaagtgatcttcccacctcagcctccaaaagtgctggagttgcaggtgtgaaccccaaagcccagcctgaaacaattttgttttgagacgaagtttctctcttgttgcccaggctggagtgcaatggcacgatctcagctcactgcaacctctgccgcctcctgggttcaagtgattcttctgcctcagcctcctgagtagttgggattacaggcatgcgccaccaggcccgactaatttttgtatttttagtagagacggggtttcgccatgttggccaggctggtctggaactcctgacctcaggtgatccacccgcctcagcttcccaaagtgttgggattacaggtgtgagccactgcgcccggcctgaaacaatttttataacactaaattatcatttgccttttgcactatgttggacatctgcacagatgggaaaaaagcaatcttttttttttttttttttgagaaggagtctcactctgttgcccaggctggagtgcagtggcataatctcggctcactgcagcctccacctcctgggttcaagtgattctcctgcctcagccttccgagtagctgggactacaggcgcatgctgccacacccagctaaaaagcaaaaacaaaggaaaagaaagccaacatcaccaaactctactgttatcacacacactgctgctgctgtacagtcacaagaaaaaaaataccagccatgcttaagaaaatttgtttaaaatttttcttcttttttttgggtagagatgggttcttgctatgttgcccaggctggcttgaactcctggcctcaagtattcctcctgccttagcctcccaaagtccttggattataggcatgagccactgctcccagccaagaaaaaatattctttatttttaagacagggtctcactctctcatccaggctagaacgcactggcacaatcatggttcactacagcctcaacctcctgggctcaagcaatcttcccacctcagcctcctgagccattgggactacaggtgcaccaccacacctggctaatttttaaactgttttgtagagacagggtctcactacgttgcccaggctggtcttgaacgcctggccataagtaatcctcctgtgttcgcctcccaaagtgctgggattataggtgggagccactgtgtccactcatttcttaattaattaatttatttttgagatagggccttgctctgttgtccaggctggagtccaacagtggcatcacagcttgctgcagccttggacccctgagctcaagtgatcctgctgcctcagcctcctgagtagccaggactacaggcatgcaccaccacacttggctgatttttaattttttgtagagacagggtcttactatgttgcccaggctagtcttgaactcctggcttcaagtgatcctcccactttggccttccaaagtgctgagattacagatgtgagccaccacacctggctgaaaaaatattcttgatgagatagtaaaaagtattccttgtattaaatcttaagcgtttggtacatgtgtgtggtttttttttttgttttgtttttgtttttgtttttgttttttgagacggcgtctcgctctgtctcccaggctggagtgcagtatctcggctcactacaagctctgcctcctgggttcacaccattctcctgcctcagcctcccgagcagctgggactacaggcgcccgccaccacgcccgcataattttttgtattttgtttagtagagacggggtttcaccgtattagccaggatggtcctgatctgctgacctcgtgatctgcctgccttggcctccgaaagtgcggggattacaggtgtgaggcaccgcgtctggccgcctggtacatgtcttttattctgtgtgatgaaacattctgcctatctcctcacacagaataaaagatgtgcgctgcataggcacagtggccacatcaggaggcagtacttgggcaagtgttggaatttacagctgaagtagctgcttgccctcgtggagcacattaaaactttcaggaatgactgagagataagctatagttactaagctctggttatatgtcagacattttctcagaaatgaacaaagagggccagttacttcaaggacaactgacagtatttgttgccaatgctaaaatttgggctttcataaaaaaatcaaatgctttggaaaacttgtacatgggcttcacagcttctcaaaatttattattagtattattttttgagacagggcctcactctgtcacttaggctggagtacagtgacatgatcaaggctcagtgcatctttgacctcccaggctcaggtgattctcccacctcaacctctcgagtagctgcagctacaggcatgcactaccatacccagctaatttttttttaatagagattaggtttcgccatgttgcctaggctgctctcgaactcctgagctccaggctagagtgcagtggtgcaatcatagaccctgaattcctgggctcaagcaatccttccccctcagcctcccaaaatgctgagattacgggtgtgagccaccatgcacgccctgcttttctaagttggtaagacttgtttgaagagactgatggtggtattaacaaatgttgatttttttttgacactgtatagtgaaatatgtcaacatatggaaaatctgcagaacttaagtgtcaattgaaaaaaaaatcatgcaagcacaaaagatccattccaagtacaagatggatcaatggattctaatgtcacagactatgaaaaatccagtgctatagattctggttcaatgtcgcaactaacctttaagaaaccttcactggctgaattttggtatagtatcaaagaatatccacaatcagctgaaagggctacgaaaatacttctccctttaccaactacaggattttcttcatacacttcaaccaaaataaccaatcacaacacagtaaatgcagaggcagatacccttaataacgccactattcttacttatttttgttttggaaaaattgtttttcatataaatgttttctatgggtgccatgtaacagactattttaaatgaactaaatatttaaaaatttttctctttttttttttcagacaacaatctcacttttgtctcccaggctagagtgcagtgatgtgatctgggctcactgcagcctcaaactcctaggctcaggcaatcctgccgcttccgcttctcgagcagctagaattataggcgtgcaccaccacacttagctagttttattttagttttgtagagatggagccttgctatgttgctcaggctggttttgaactcccagcatcaagcaagcctcccatctcagcctcccaaagtgctgggattacaggtgtaagccactgtactcaaatttctcaactttagtttccagtagagtaagcaatgatagataatccacacaacaactctctggggccctcaatttctaagagtataaagagccctgagattcactgtactccacactctccagggtcccttccagctgcagagtaacatggtctcagtctctaacatttctctgcaatctttcccaaaagtgtcatctgcagccttggactttctgagtcctgtctcccatttctaaggttcacttgacaattttctgataccctgttatctctttactgtggatacatctcaaatggattccatccaacttccactgtgaggcgggcttacctcacacatctcagaccccaaagatgcctaacctacccctcccccatgtctcactacacagggtccctaggcgccaccctgcccctcactctgcatgctcagcttcctcactgcacctgcagaaaccttctgcctccaagtcaccctgtgctgtcataatgaccatcttccttaaattatggcttttttggttattctcctactcacatacatcactggttctttatacttttatgagtaaagccaagctccttaacctgctcaaggacccagacacatttcaactcggcccctgccagcaccatcagaagacagctctgcagcctgggtgccctcggagcagcagctcatctctcactcctgccatgagccccacaggcacagggcaggggtcctgctcagcctgagtgtttctgcaggggaaagtctggggaatggcaggcaagaaaggtaaaagggcagatagaattatgtttctactttagcttttaatcctccacatggaatcctaacaccgtggaaaagcagcatgctttaataaggtaatgaataaatggcctactttttttgcgcggctgcgaaggagatgttgactgagaggctgtgccgttactgctactctcttcttcctctttaacttctactttcacttcaggtttcttttcatccacttccattggttctgatttctgctctgctatgtctgtttcttctttaacttgggaagctccttgcaaatcctcctccatcatcttgagaaaaacattacagataacatatgaatatcaaacacctttatgttaccgcaacctcacgggaagactcttacaagcctaaaacaggtttgttaaaaccttcctctagtcagagttgcatttatgattcctcttctcttccggaagaagaaataaagtacttggtgttcattaagtcgcttcagcacagagtcagtgcaattatggtcctaaatttaaaagtgtttttttttttttttttttttttttttttttttgagacagagtctaacacccaggctggagtgcaatggcaagatcttggctcactgcaacctccccctcctgggttctagcaattctcctgcctcagcctcccgagtagctgggattacacgtgtgtgccaccacactcggctaattttttatattcttggtagatatggggtttcatcatgttggcgaggctggtctcgaactcctgacctcaagtgatccacctgcctcggcctcccaaagtgctgggattacaggtgtgagccacagctcccagcctaatttaaaagtttttaaatgtaaaactgctttaaaaattgcacatactcagatttttcactacagatatttctaatttggaataaaaatctccttgaaagttggggcagggaccaaaagtccttctcagaggcaggtgtggtatgagacaggaaggagcagtggggactgtggctaattggagagcccactacagttggtgctcacaaccagactgctgtcacacagggatgcaggcacaatgctgaaagcatctcatttttcaagaaaagccagaaatctagagttttatttgcaatttcctgatttttaaggtattgtgtgggccaaacacatttagaggctggatccagcccacggtctgccagctttcagcttctgccataggttaattagtaaatgaatccaccaccccttctgtagtctacctctgcagaactagaaatgaatggagaacataaaataaaaggctgttggatgattcaagtatttcaaatataagccagtattcttcatttcgggcaaaataaacccacccctcatatttaaaaatgaaaaaccaagctgttttcaatcaatttcctatacaccaaaccccgaacccacattcaaacagaatattttaactaaagtcagggatacccatggcaggctccaagcctcgcccgaggacacctgggtaaagttgcgatacgcagtcaatgcattcctagggagcggcacccacctcagacctgggctcccctttggattcaccaggatcgggctcagtgtcctctgcttgggtctccgtcttcatttccagcacaggtacgtcaggtcctggctgctgggaattggtttctgcgctggccaccgaggagggggtagggactctgttatcaatgctggctgctgcctgggaaagctgtgaaaaaaccgaaagcactgacttcagtaagcaaggtaacataaatgatcttcaactatgctgctcatgcaacctacaatttcccattaacatttctcaatactgatccagcaggtgcccttctgtgaaaccgaagaacaggggttaaagtaggaatgagttctagagggaggtaacagcagccagaggtacaactcaggtcttgccacaaaggcagaggaaacagcagagcttttcaaactttgacataaatttattttctcgaagttttctagctaaatcatgaaatctcatattttgaaattaattcccttcaatatggtggttaatgtgtatggtaaaaggctgaattatgaatgcctaagcacatctgaagggagggaaatcaagtgcctacccaaagacagtgttacccagcctgtgtgaacggtaggaacacgggtgctggtggagtaaatgaacattacacgaaggaaccactaaaagaattcctaatttgcaaattcttactcaatggaatttttttttttttgagacggagtctcactctgtcacctaggctggagtacaatggcgcaatctcggctcgatacaatttctgcctcccaggctcaagcgattctcccgcctcagcctcccgagtagctgggaatacaggcaccagccatcatgcccggctaatttttatatttttgtagagacaaggtttcacaactttggccaggctggtctcgaactcctgagctccggtgatccgcctgcctcagcctcccaaagtagtgggattacaggcgtgaaccaccgcgcccagcctcaatggagttttaagtaaacaaacaaaagatgacaatgtctcgctctgttgcccaggctggagtacagtggcgtgatcttggctcactgtaacctgtacctcctaggctcaagtgatcttcccacctaagccttctgagtggctgggactacaggactacaggcacacaccaccatgcttgtctggttaaaaaaaatttttttttgctggagacgaggtctcactatgttgcccaggatggtcttgaactcatgggctcaagtgattctcccaccttggcctcccaaggtgctgaaattataggtgtgaaccaccgcgcctggcctgacacacaatttttatgggaaaattatcttctaagagtcttggcccaaaaacagcagagacagagaggcttaccggtgtgccaggaggctgggcgtgcacaggcgtcggctgttgctgcgatgactgaggggtagccacagacgggggctgaactggggtttgaggctgcggggtcacctgggcctgggctgctgcctggactgtaggggtgctctgggtttgggtagcactgggcactgagccaggagtcggggtgggagtctgcccggaagacgacacaggagttgatggctgagtgggagctgctggctggggaggagtcatcccaggtggtgtcgtgtgctggagagatggcatgccagcagccgtggaagcaggaggcggtgttgggtgcagtggtgactgtgtcactggagggcaaggtagctggctggcctgaggccccagcatgttgagagggttaggaagagcagcaccaggcacctgtccctaccagaaatggacagagtatggtaaaattatttcccccgtttgaaaatgtgatgaaacatttgaaaaattaaatgtatgaaaaaaaaatttttttttttgagacagtttcactcttgtcgcccaggctgcaatgcaatggtgcgatctcggctcactgcagcctccgcctcctgggttcaagcaattctcctgtctcagcttctcgagtagcagggattacaggtgcccgtcaccacgcccagctaatttttctgtttttagtagagatcgggttttgccatgttgtccaggctggtctcaaactcctgacctcaagtgatcctcccgcctcggccttccaaagtgctgggattacaggcgtgagccaccgcgcccagccaaatgtatgggaatttaatcacattttcttgggagtgttctgcttgtgaaaattcatcgagctatacacttgtaatgggcactcctcaataacggtaaaactacacacgtttcttatagtctgatttatataattaaaacaaccattgaaacttatggcttaaacacacacatctacagcagtcccctcatatccactcggatacattccaagacccccagtcttggaacgcctgaaactgcggatagtactgaacccaatatttaccaagatttttggatctgacaaccaaggtggacactcagtgactaagaggtgggtagtgtctacagtgtggaaatgctggacaaataaatgattcacatccctgggggcacagagtgggatggtgacagaattcatcatgcaacttggaatggcactcaatttaaaactttttttttttttttttaaaaaaaaaaagacagagtctcgctctgtcacccagtctggagtgcaatggcatgatcttggctcactgcaacctccatctcccgggttccagtgattctcctgcctcagcctcctcagtagctgggattacaggcgtgcaataccatgcctagctaattaatttaaaatttatgaattgtttattcccagaatttcccatttaatatttttggaccacagttgaccccaggtaactgaaacctcagaaagtgaaatgacagattgggggagctactgtacattgacccagcctataagcttcatgttctataacatgtacccaatgttctttaacattttctaagcttagcttagaaaaaggtattttttttttaagttgcttcttccctggggactataaaataaataaataaaaataagaataaaagttattgaccataaatatatacatccataagtacccttaacaattaaaaatttaaaaaaaaaattctctctgaaacacaaacacacacacacacacacacacacacacacacacacacgttagttactgaaagagaactgtttcagtgcagtggttctatactggggatacacttcagaattatttgtgaacattttaaaaatgattctgaatcactgttctagagcaggggttggcaatctcccagggcaaacacactgagctgcttgtttctgtaaataaagctttattggcacacagccacctcatttatgtaccacagcagcttctgcactacaagaacagaagtgatgaaaaccaagattgaatggcctgcaaagctgaaaatatttagtatctggccctttacacgaagtttgctaatccttgttctagagaaatgaaatgttatggaaagttaagaataatcatttagtgaggaaatctaatatataataatgacttatgcagcattatttcacattaaaaactcaaaacaaggctgggtacggtagcttactcctgtaatcccagcactttgggaggccgaggtgggtggatcacctgaggtcaggagatcgagatcagcctggccaacatggtgaaatcccgtctctactaaaaatacaaaaaaaaaaaaaaaaaaaaaaattagctgggtgtggtggcgggcatctgtaaccccaggtacttggcaggcttaggcaggagaatcgcttgaacccgggaggcggaggttgcagagccgagattgtaccactgcactccagtctgggcaacaaaacgagaccctgtcttaaaacagacaaacaaacaaaaaaaaacttaaaacaagaattttatcttttagggaggatttggtgtgttttaaatacatgtatattttgtatacagtagcaatgatacgcactacaactaacaaaagaggaaaaaaggaaggaataaatggaaaatcaatttcttcagctctagattgagaaattaaaaacatttaacaagaagggaactattgaaatgattctgttagcttgatttcacctggcagtggagacaggtcaaaagaaacaaaagccaaatcatcaagagtgaattcatgggtccttctcactcgctttttaaaatcctaatgcctctcagggtcacgttaaagttagaatttaaaatacacaaacaaaaaataagaaaacaaaaactcaaagatcaaaacacaaaagcatacaaaccaaaaattctaaatccattcccacttttgcatatagttaacccagaaaggataagagaaattccaaacgagttaaggactacaggacaaaggtggagaaaacaaagagaagctgatacaaagacatgaaatgtgcattctggaattttaatttccacgaaggaagacagaaaaaaaaaaccaaaacttaacacaagaattttatttcctagggagccacggtcccagtggggcacagtacctgtgacacgcctgtttgggctggcggctgccccatgcccacactcatcgccccgctggatgacgggaactggttctgtggcagaaactggctctgagcgggcgcctgggccatcatgttgttggtgtgtgcacccatcatgttcggaggctgaggcattcgggaaggagaaatggccatctacgagacaacaagcaccaccagagctgtagttcggaagctgacggccagagttttcaaggtgagccagaatgatccaaggcttcacaaccccagaggatggcaagcacagggctcacatcctgcccttcctcatgggaagagaccaccacttgctaagaactcccgcgctcctgggcaccttacacactttctcaggcaatctctcaaatgagccagcttcaaaatgtcctctgaatagaaatcaatagcaggctataatttaaagtttaagacatgcctatgagttctctaaagtgtttagaaagcagcctcggaacagcgagctctcagtcaacagatgctgacaattccctgctggccacatatctgaggctgccttctccagccttggaactcccacattctcacaaagccacacattcctatgaatttgttattccaataaaataactaacagtcaaataattctgtgtagtaataatttttttaaaatgagagatgaaagaaataaagcataacccaaattcaaaggaacaagaaccacaggattctcaagtgacatgaattctgctgcttagataatgttccatgtgagagggagggctatctgcagcacagcgaaagagaacacttacccctggcactgagcccatgctgttcatctggacagagtggttcattggggaggctgcacgaggtcccatgggtgcttgtggcaactggacgttccccaaggacatggggttaaatgaattcatccctgtaaatgtacccacaacggttcattaggaaaagcacccacaggaaaacagaattacaacttgctaaataaactcttaagtaaaataagatggaacgcacaggcaacagaaaactgaaaagaaatcacccaattaatcaatgaagatgatgaaggaacagacttctccatatccagagaaaacggcatcaatgtgggggtggtgacggtggcatggtgaggggtaccagggaaggacgaggacatgaaggcataaggttgggtaagacaggaacaagtgagacattaaacgaggctgtggtagagctgagccagagggcacagtaccaaagtgtcatagcaacaaagagggtgaggaggtgccctgaaaggacagcaccctcacaagctacagaagagatgtttccagagaccagggcaagcttctgtgcacacccatacctaatgcctctggagcagctgacgcccatcatccgaggattcccagctccttgctgggtttacattcattgttagaatctgtgctaagtctccaaatgttcttttaattttgcaagcaccttaagcattaagaagtgcccaagggtcagccgtcctcaaccttagcctcctgtagtttacaggaacaccacatcactgaaagacacttcacagccagtaagtgtctccagactgcggtgtctagttccttccaatttccaataatactctgtaaactctgagttctaaagaagcaccagttcaaattagtcttaggaccaacactagaatctgacagaaccctttagagaatttctggaaggtgctgccttagcgctgctgtagtcatgagaaggctcaaaggatgactcacggagcactaccttcaatggctacctagaaatggtaccctcaaataacggagtgccgatgcagaccaggaagactttccagggagtctataatgtaagcttccccactccttgagaatttttttaaacaaaatgaaaaacaattactaaggaacagcacttaaagaaatctgtatttacccagatgtgctggtagggaggttgctaagtgcataactagaaaacatctattccaatattctgctggtaaacagcaggggcatcataccccacaccagcagcatcttcctatccaggctgaagtcctggaccaatccccaacacagcatccagccactttcccaaggctcaatttctctgactccttgatttctttcttttttttttttgagatgagatttcgctcttgttgcccaggctggagtgcagtggtgtgatctcaactcactgcagcctccgcctcctgggttcaagcaattctcctgcctcagcctcccgcgtagctgggattacaggtgtgcaccaccatgcctggctaaattttgtatttttaatagagacgggggtttcaccatgttggctaggctggtctcaaactcctgacctcaagtgatcctcctgcttcggcctcccaaagtgctgggattacaggtgtgagccactgtgcccagcctgactccttgatttctttcaaaaatcaaagcctgagcaaagcctctttccttagagtcttctggataatgtcaccaccttgtttcacaacctggaaaaatgtcctcctgcttgggtctcaatggtcaagagctacagggttttcaaatgctccctgccccaaaataaaaatcactgcttcaaccaaccaaaaaccagaggctctctacttaagaacctttcaaggttgttgagacagctgctgacaccccaacctggcacaggacctgtgtgtacactctctccagaagttgacatccagccagctgggcttaacccctagggccaagagcagcccgtgccgtccccatttcagcctctgcaagtgctcagcagtctaggactgtcttgcatgcttctccttctcagcattcagaagcactccctccccacatctagggtgcttctttctcggactcttcctaagagtaacgtaccacacccccttcaccatccattaaaaaaataaaaagctggccgggtgcagtggctcatgcctgtaatcccagcactttggaaggccaaggtgggcagatcacaagttcacgcgattgagaccatcctggctaacatggtgaaaccccatctctactaaaaaaaaagatacaaaaaattagctgggcgtggtggcaggtgcctgtagtctcagctactatggaggctgaggcaggagaatggcatgaacccgggaggcggagcttgcagtgagcccagatcgtgccactgcactccagcctgggcaacaaagtaaggctctgtctcaaaaaaataaaagaaaagaaaataaagtaaaataaaaagctaaggccgggtgcagtggctcactcctgtaatcccagcactttgggaggctgaggtggacggatcacggagatcaagaccatcctggctaacacggtgaaaccccgtctctattaaaaatacaaaaaattagccacgcgtggtggtgggcgcctgtagtcccagctactcaggaggctgaggcaggagaatggtgtgaacccaggaggcggagcttgcagtgagccaagatggagccactgcactccagcctgggcgacagagcgagactccatctcaaaaaaataaaaataaaataaaataaaatagaaataaataaataaataaatagctaaatactgcttcttatctcttggaagatctttcctataatctccaaacttcatactataaacatatccatactacctgtagaactgaattctgcttatcagcaaaaaggaatggaaagaagaaagggttagaaagaaatatacagggggagaggaaaaaacagtgaaagttatggctgttgaatgtaaaactaaaatatgattcaccacaaacagttcaataccttgagaaacttgcatgcgattcactggcagggacaggggtccatctatggtggcaaaacaaaaacaaaaacaaaaccaccctagttatttaatataatccttgattcaggaataggaaatttcttattaggacttcaaacttaaaagggaaaacagccaataggtccaaaagcacgtgtgttccaatgccagcgcaccctgtaaagggccttcccaagagagaaactcagtgtcccaacacagcctgaggcaggtggtcagggccactgccacatcaacagcttctgcagggcatgcatcagatattctaattctctgttcttagaaatacaccccaaacacgaaggaaaaccaaggaaacaggctaagggatggcagtaggaaataaaatccttacttggaggtctcacaggttgtgcctgtggaatcacagggggctgagcccccggggctggtaaggctggctggttccccaagatgccttgtttatgtaaacgcgacctccgtttttcttctagttctttttgtatcttgtagattttctctgctaataagtgataatattcatcctaaaaagcaataatattcaatatgaaacagttaaaactgtaaaaagcaactgaatgatctgtgttgtaggttctaactaatgaacttcctcattgagtacactggcaaaagtagtatgcaaatacctgatacaccagaagcccacattcttgctgaattcccaatgactttataggacatatcaaatagtaggtacttaatacatgttccatttcattcaaatgaacttcttgaatattcactgatgctaacaatattacaacaccacctactatgaaaaatatatcccatggatataatgtaaatttatatactccatgcaccaatgtagctaatcaagagagttctgcaggagatttgtgtcttatctgggaagtctccttggtcagtggcctcaaggggaggagtctgtcccaactacatagattccactatttccagataacaaagcagacaaatgtagtgctgtctactacagatgctgtagaggccagagcacggtaaacagcaacctaccctgctgttggcagactcgtacatgtccccttccactttcttagcataggctaccaggttttccatgcggcgatcctttagagctgcgggatcaggtgttgggaagatggcttggacgctgaaaggataacacatctatcaaactacttttttttttcttcttttttttaaagacatggggtttcgtccaggcgcggtggctcacgcttgtaatcccagcactttgggaggctgaggcgggagaatcacctgaggtcagcagtttgagatctgcctggccaacgtggtgaaatcccgtctctactaaaaatacaaaaattagctgggcatggtggtggatgcctgtaatcccagctactcgggaggctgaggcaagagaattgcttgaacccgggaggcagaggttgcagtgagctgagatcgtgccattgcactccagcctgggcgacagagtcagactccataccaaaaaaagaagaaaaaaaaaaaaaagacacagggtcttgctctatcgcccaggctggagtacagtggcatgatcatagctcactgcaactttgaactcctgggctcaatgatcttcccacctcagcctctaaagtaagctgggaagtacaggtgcacaccaccatgcctggctaatttttaaattttctgtagagatggagttttattatgttgccccggctggcctgaactcctgggctcacataatcctcccacctcagcctcccaaagcactggaattacacgtgggggccactgcacctggcctgaagctacttccaatgccatcaaataagcactacaaaatcaggatcatgtatctctggtggcaatacagtgtggagagaaatgccaagcctctcttgcctcgcatgtcaatacatgaatgaagttaactccctggagacaatcctgacctatcaacttatctacacatcaaacacatcaatattttgctattaacaagtatgtgctgggtcatttccagaataacacgattttcaaatccctaatttttaaactacttattactaaaaaaaatttgatcaaaataaggaagggaaaaaactcaaagggaatgtaagtctagctcatttaaaataactagctcaacaacgttaggcttggtgtggtggctcatgccacccagcactttgggaggccaaggcaagaggattacttgaggccaggagtttgagaccagcttgggtaacctggcaagactccgtctctctctctcaacaacaacaacaacaaaaaggccgggtgcggtggctcataaccccagcacttcgggaggctgaggtggacggatcacttgaggtcaggagtttgagaccagcctggccagcgtggtgaaaccctgtctctaccaaaaacacaaaaagtagctgggggtggtggcacgtgcttgtaatcccaggtactcgggaggctgaggcaggagaatcacttgaacctgggaggcggaggttgcagtgagctaagactgtgccactgcactccagtctaagcaacagagcgagactctgtctcaaaaaaaaaaaaaaaaaaaaaagttaactgttaactttccgttatgttaactaactgtaaggtgataatgacatgccatctatactctaaacttttccaattctgaggggtctccacaactagaatctggaactacaaaataaggtgaggctcttgagctaaccccagccccctcacgcagcctaaagtgcagaagcacattaaggccgggctgcactgagggtctttgcctcggtgataggggctgcaagtcagtgcccctcggcagtacagagccaccaatgctctctttgtcacccccgctcaccgaggacatagagtgtgggaatctctggcctgcctagggctgccagaactctaccagcagtgagagtggctccctaaataagcacgtgacttgtataggctcctagggtactgtcatctggtagccaatgggcaacacaggaataaaatcaaacatctatgaaactgcaaaactgttacgtacagtttatgcactagatggctccgcaggtcctgagtgacatgttcgtgccagcctttccttacaccggtgctagaaggaggagctgctgttggtatagtgctgagggttccaatgttaccagagttggagccatcgttcatcagtgggctaaggaggaaataaagacacttcatccatctactgaagtgactcaaacacactttgtctagtaaggttcttctgccaccacatgtgacttttaaaagtttaagtcaggagagccaagtgatgtaaataaataaaacttaaactatgttttaatctattatctgctctacatttataattaaagaaaaaaaggaaaacagcattcacccctcaccaccccatttaaactattttctctgccacacatttagaaagaatcagttttgtgtggttctcagtccatgctcctgttggactgtcactcagatctgaaacagggtcttactttgtggcccccagggaagtcggaagagctgattctgaaatcaagtttgggggctgctgatctgttgttattcctcctgctggaatgttcattggattatttcctttaaagacagaaaagaaatcaatcaacagttaaattttaatatatacttcaaagttttgatgacagataaccaacatgccaccatataaacaattggtggttatttaaataagtgattctggccagttatagtaagcactgcggcaggaactctgagtgtcatattttcaataatggtaatcaacgtgcacaaataatcagtagacaccctccccactctactttgtaaccaaagtaaggtgtgtttatggaggttagctgctatctaagtgaaaaagttataaatgacccacatgcagcctcttactttcattctgcttcattagtatcgctcctgagtgactcagctgcactgacacacacctctgtgtctccacccccaatatcagaaaataaaatcatagaaattaagctcaggaaaaaaatatagaggtcaatttgtctacaatcttcctattaaaggaaacgaaagctgagactaaaaaaggttaagctagtcccaaattataccatcaacaggagaggagttagattaacacttgggtctcaggattctaactcagtctcctggccagtattagttagacattcattagggcagttgttttccagaaagcaacaagtaagatgactttagctgggcatattttaaggagtaatttttaagtgtaaaatagttactctattagggaaagaacaaaactagcacaactagtcagccagtcttgacttcacagacatcactgcttagcttaagcctaaatgtaaagggactgtgtccacttaaagaaaaatattaaggaaaccatatgcagaaatggcaaaatcatggcgatgtgtgagcaaacgatcaaaggctggcaaataatgggctggggtgacaaaagaaaccatgacatgtccagcagcctgagccaagagtttccaggactcctgtcattgtcattaacctgctgaagtccaggctggtcacttccaactgaggggtagaccctaaccaagatgtgtgagaaactggcaaacacaagtactccaacaaataaatgacaacagtcagcatgaggcgtccagtcagcatcctgacttgtgagatctgcattctgaggcacatggcacattctttatgaaaaccgtccagacagaagtggcacagcaagcaacaaaaacattgcttcatttgcaaatgctgctctttttataagcatgtaacattttccttgcatcagatacttcagctttttcctgggagattttttatttcaaccaccgtagtaaaaaacacaaaacaaactgaaaactgccttgggttccatcactccattccctttgctgcatgtggacaagtaagaacgaagttgagagttccttcacctacccagggggttgagagtcctcatctgctggtgggtttgaggctgtgctggttgctggccaggaacctgaggctgcagctgcgtctggggctggttcatgtaggggagtccgagagcagcataggctcgctgcatggagctggggtctatgggatttgggttacttaaagaagtggcattctgttgccctgtgccaacagaaccaattgtgttttgaattccactagctggagaccccaggatggctataacgacaaacagacagacagacaaaaacgagaggtaagtaaaagggagaagcccacgaatgatttaaaaactattgagaagcaaatacatttcatcaaaatactacacatgaatatcataaagcagtaaacaagcctagggagaaaggaactgtgctgaaggactcatttattctgcctagcagtaagtgaggaacaaaaagttaaagaaaagtcaagtttctatcttagcatgcaacagaccataaaatctcacagataacacttgaaaaaaattattatgtcttaaaacctagagactcctcaagaagtcagttccagggagtggcaaatgtatgacaagggaaacgtctgattctctggggaccagcagacacctctgagatgaacagaggagccccctcctgttgaccccaaccctgtccttcactgctcacctgcacaggtacagagggcttaagagaaggagcagagatgatacctggtcggtcagttttgattaataaatctataatgtgctcttccaaatcacataattgcaagtccttgaaacatacacaaacaatgacagcatggacatatccttctgatgggattcctatgcagcagagcaccatgctgagctctccggctacatgaagctgttcaagaaatactgtacttgattgattgactgactgagctgtttgaaattaaggttggagtgaggcttcgcaattctgcatgggtcttattatccaggggctacctcagcacctctgatattcaggaggtggctctgcctcacgtggccaaagtcagcttctgctactgaggcccactgctggctggcagggaagctgccccatccagctagctaaccccaggagactaaaggaaaaactggtgtcaacataaggagctccatcccaaagggcttccaaggtaatggagagacaactccaaacttgcatcaacttggacatttcaaggtcaattcatctacccacctacctacccacctgttacctgtttgcctgccccctcatctgtcgcaacaacccaaatgctgttgtgtgaaaatttatcatatggcagaagttctatatgataccatttattcctatttttgagttcctttctaacttccacaaattttagagtcatgttaaaaatagcatcttatagtgttgttgctataacacaccatttttgatacataaaacacgaccacaaagcctttctttcaaatcccaaccactatgtgtaacagtaatattctcacattcaaccatcagcacacctataataaacccaatacctaccagagcaacttaattaaactaaaatgtgtgaaaaaaaattcctggtaattatactttccatactattaacttttctaataatgatattcagatcaactcattaacactcatcagacacaactacatacaccaagcactcattaacataaatgaaaagcaactcccaaggtgcactttatgacaagtgtgtagctgaagtaagtcacgcacaatacctttaaaagtattctaatacttactactccccaaaactttaaacatgtgtccaccatacttctgaaaccgacatcctacatttttaagaagcactatggtatagaaatcaaagttaacagtggtaggatagtttatttttctacaaccttgcgctgtaaggaagaacagggctacactatatttaacacacatggtgatggactgtggagaagaacttaaaagaaacaaagtatggagccttccatttcccgtaaaccctttattgacttcttcctactacatttctcttttatccacacctccccaagtgccatctacttaactaaaatgccccaccttacagtgaatgccactcctaagctcacagcacttacagggcagccaacgcctcatactcacataggcctcccacggaagctgctgacacggtcactgcattttgtgttagaggcattcattttctaaacgtaaacattattatatttttattttaaaagaaaatatacctatgagaagcatttggaactcatcatttctaaaattcagaagcaaaggaaattaattatgaacaaataaagaaggtctctgccatttaagcatggctgaatttgaagtccaaatgatgctattacatgaaatgacacaaatactgaagggtaagggtgctcaggcattcactgcagggtgatggctgactgaaaggggagtcactatgtataagccaccatcaactgtactgcaacctcaaggtgctccaagtgctccatggtggtattcccaatccctctctgaaatcccacagtgactcctgtacccgcttgtctttagacactgacccttcgtgtattcactcactcacgtgacagactcagtgagtacactctgccaggctcccagacatggtgtgggcacaatctctgcattccctgagcctagggacaacagattatctaataatcacctaatgcacccaaactgcaccttggaaccctgggacagggaaaatcaggctcatgtcacgttccctgtgcatccctgaaaggtgggattaatgtcaaattcggttttgctcttcaccacctgccacatgggccacgtaacctgctgtgcagagtccaggggacgtgccagctatagcgcagcggccagcacatcgtgggccctcgcagcgcagcccatggagtgtcttggaactgaacagaaatgcacggagattggtccatctacctggcatccctaaggatgaagtttctctatttatcctttctgtattattgccacttaacttcttccaatgtcaaggccgtgtgctcatttggccatttttacatcttttttcctcgctagagcataaagctctaacttttaggaagtcacaacacacctgcaatgcactaacacagtggctgggttcttctgggcccatcaggcaacactcctgtcccggatatttacctctttaaagctccccaacatcccctagtctcaccaccccttctgatgttgctgaagaaggagcctatgacctatgaacaaaaggccaagttttatagcaggctctttctcggactcacctgccactcttcatgcacaaacaatgttccactaagaggccgggtacggccaagtgtaactgggtgcagtggctcatgcctgtaatcccagcactttgggaggccgaggcaggtggatcacttgaggtcaggagttcgagaccagcctggctaataacatggtgaaaccccatctctattaaaaatacaaaaattagctgagtgtggtggtgcgtgcctgtcatctcagctacttgggaggctgaggcaggagaaccgcttgaacctaggaggtagaagttgcagtgagctgagatcgcgccactacactccagcctgggcaacagagagactctgtctcaaaaaacaaaagaaaaaaggaatgttccactaagaggttttctgtacagtctatgttgctgatgcaaagaactcagttactcagacaacttaagcccctaatcatcctcaataaaactgaactccatttggaaattcagtgaaaacggacatgaatcaaatctccaaactttgtgagggtagggggagacagaccatgaagcagagcagtagttgctacagctgatgcttcaccagcacgagagtgagccacggggtcacccaacgcaggccagaaacacagtgcttgcgggaggcgaaacttgtgtatggggaaggccagctgtagggcttgagtccacctggttttggtatacctggggtgtcctggaaccaaattcccaaggataccaagacacttagatttctactaaaaaagcaatgctagaatttattcaggtggctcacgcctgtaatcccagcactttgggagtatgagggtggggagatcacctgaggtcaggagttcaagaccagcctggacaacatggtgaaaccccatctctgctaaaaatacataaagtagccaggcatggtggcatgtgcctgtaatcccagctactcgggaggctgaggcaggaatcacttgaactagggagacggaggttgcggtgaactaagatcgcgccactgcactctagcctgggcgacagagtgagacttcgtctcaaaaaaaaaaaaaaaagaatttattcagacctgcagccatctctacaaagttgctggtggcaccaccgtaccttgcgggcattgtgtgggccaggacctacttcctacctggcaccttcctatgcactgcgtggggcaccacagtgaagagaagcactgaggggaacccaggcactgccaggctggagactcagcctcctatcaggcacggccacaagccctcaagcaaaaggctttcttcagaagccaagtgacactggcgcagtgacactgctccttgctagcaaggagaaaagctgttcagatgaaacacatcacccacgaccctttggtgcttaagtcagggtcaatcaagcccaccattctctctacagccttcagattctgctccttgctgtcccccatcccactacagtctgtcaaaagaggtgaaaatctctgaagggccctcaagtgaacaaagggcctgctccacacacactcactgggcacctgatgggctattcgatgagtggcagttcaaaggacggagatcttgactccatataaaaaaaggaggtttttttttttgttttgttttggttttttgttttgttttgttttgtttgagacgtagtcttgctctgtcgcccaggctggagtgcagtggtgcgatcttggctcactgcaacctctgcctcccgggttcatcaagtcattctcctgcctcagcctcccacctcaggataccgagtagctgggactacaggcgcatgctgccatgcccagctaattatttgtattttagtagagacggggtttcactgtgttgctcaggctggtgttgaacatgagctcaggcaacccgcctgtctcactcagcctcccaaagtgcaaggattacagacgttagccactgcgtccggccaaaaggaggtgttttaaacaatctgaggcacctacagatggaacatgttgccaggtgaagcagtgggagctacactcatggagatgccgggcagcagctggggccatggctgacgcagccgggacagtgcgtgcattaggctggctctggggccgaccctgcacacttgcttcaacagtccctgggggactctaggttggaaaacccctggtctctctctcagagaatgactcaaaccctctcaccagcactggcccagatacctggtcttccaaggcatccagagcagtgcatctcagattttaatgtgcacactaatcacccaggatttttataaaaatgcaggttttaatataagaggtctcaaatgggggcccaatttctttattgcttacaacctgggagcacctctatggcttccctgaggcctacactttgagcagcaagaacttcacaagtgaggcagcataagccccaagaggggaacctgctcacgggtcccaaagcccagtcaaccatgccactctgtgcactgaatttactggaggtcagatgccaggactgacataagatacttatcttggcaagtcctaattattcaaaaaaaattgaatattgctataagggatggttaactcgagatcagtgattacagaatctttaaaaaacaattcaaggaaaaatcgaatgaggccaggcgcggtggctcacgcctctaatcccaggacttttgggaggtcaaggtgggaagatcacttgagctcaggagttcgagacaagcctgagcaacatggtgaaaccccatctctacaaaaaatacaaaaattagccaggtatggtggcagatgcctgcagtcccaggtactcaggaggctgaagtggaatgactgcttgagcccgagaggttgaggctgcagtgagacttggctatgccactgcatgccagtctgggtgacagagcaagactccgtctcaaaacaaaccaaccaaccaaacaaaactcaacacaggccaaaaaggtaatcaatggtctgggcttcatttcaaagaacctcagattagcgccacaggtgattctggaaggttctctcagtagagacattaatcacagaagttaagagagtggagcatgtgctgaccaaggaagtgtgcatcaggtaagaccagcgctggcctgtgggaaacactgcctaaaaagcagagtcccggggcccctaaggcagtctccacagagcgagcacaggtgggtctcggcagagtccctgaggcttccaggagctcatcacagtccacctttctgttcacctcgtttgcacaggaaccccagtccagtcaaatgcatgccctcacaagctgtgcactgtgcagacactgtccccactgtctgaaatgttcttcctttgttattctgtttgcactgggctccaccaagtcccacctttctctacaaagtagtcaggtgcgctccaattctcctcgaaaagaatgctgattgcactgacttgtctctacctcggtcctttgagggaggtcacccttacgttatttttaacatatatattgtcttcaaaacccaaccttaagccaacgtagggtcagattcacattttcctctctgggttcctaactcaagagttcacacacgataagcataatttgctttgggagaagagaaaaaacaataaaatttacaaaaaggatattgctgaaaccttgtcaatcatacttttgtaaaaaaaaactaccaaaaccttgcagcaagttaatctaaatcttccttgtgactttataaaatcatcctggtaatatcttacattctgactagtagaaaacctgtggtttaccacttgagagagcatgcacagaatcaattttcacaacactcaggccgttataaggatggtttaaaaaaaaaaaaccacatacgcttcttttttcttttaaaacaaaaaccacataagtgtttcttaaaaagagaaatcaccaaagtttacaactgtcatggtagtatgtactaaaaacaaaagatcctcaaaaagccacacccccaaattaaagttaagaataaaattctagctcattattcatagaatattgtataactacaaacttgacaatgaatattttggcacttaaagagcctattactgaaatgtgccctaaaacacaagaaatttagccatcacaatatactaaagaaaaaacttttacagtaatgtgggaggaaaaacagactgtattccattagaactactgtcccaaatatctggttctagaagacccaggattccagaatgtcactttatataagaaatgtccagggaaattgtttattaattcaaattttagtcaatcaaagaataatttaactgacttttaggaaactggctttttttttttttttttttttttttgagacggagtttcgcccttgttgcccaggctggagtgcactggcgtgatctcggctcaccgcaacctccacctcccaggtttaagtgattctcctgcctcagcctcccaagtagctggaattacaggcatgcgccaccacgcccggctaattttgtgtttttagtagagactggtctccaactcccaacctcaggtgatctgcccgcctcggcctcccaaagtgttgggattacaggcgtgagccattgcgcctggccaggaaactggcttttaaaggaaactcgttgtggttcttctgtagggaggcagataacaggccccattaccctggcatttctcttctctatgacagggacaccctgctttaaaggaagcagggtcagcgtcagctcgctgcctactccctcgccgccagagggaggtgggctggactcagtaaaaggaaaaccacgggggctgtcactggcacgccactccacagtactcttaggaacaaagcactttttccatctttccctgggccactcagaaacaaccagaaagaaaagcagcacatgttctccaggcagctgcggggtcttgaggaaggatgatcaagaagaatgagaggaatgaacacgtaatacacaaaacaggggagggtggcaagatggcacagacgagatggaggaagatgaggaagactgtgctgtgctggaagggtcgctaagggtacagctccagccagaggggacaggagactgaagggcacttcctagctgtccgaaactgaatgacacacccaaagaccacagttttacctctaaaatgacaggaagatggttgaaaaacgggagggaggttcatccttcttactgcctgaagcctacaaatggcagggagccccagagccccaggcggacctcccaacaagcagggatcgctgcgtaaccagccgtgccgagggctacagacaacctagacaacggcaaaacgactggggtgatcaggatgcagcagccctagggcagaggctctcactgtgaagcagagtgaacgtttagttatacaaagagttctggggaccatagctccacgtagagggaaaccttcataaatgtctgtgtgggattttatactgacccagactgactgacagagccttcaaaatttacttcaggataagggctttccaattccaaaagaagtatcccctctatccccctccctaagacgtcactgccattatagcgacatggaatttaaattctcacgtatggagtaactgtcaggaaataccatgtcttcgtgttggctcagtgaacaaagtgactctgctgttccatgctgcttcaagtgcatgtatgcagggggcagggagagggagaggcagtgagtgagtcagggtccaacattatcacagccgttcctgacacggagagcccgcctgccctctgagcttggctgtaccttgggctgctgtccgccctacctcaccctgcactccatggctcataacccctgcccactccctacctactctctgaattttctttagaaacaacttctattctcatctccaagcttctctgcccccgtgctcacttactttgttggtttcgcttgtcactggcatttttcaaagggaggcaaacaggacagtcatgtcgtgtgcagttcttccaatgagagatgatttgtcgtgaagatgcacaatgggcaactatgaccagaaaaacaacgagatgttatttttctatccaaatcgtcacactttcaattatacctaaattataatgccagattccataagaaaatggtaacaagtgtaaccataacacagtataggcagtcctcaacttacaaacaggctgttttccaaaaagtttgtaagttgactgttgagaaatccaaacaaaacttcccctagaagcaatgttatgaaggatgggtgataaagggcagcccacaaaacaaaacaaaaactattcaacctggaatagcgaacaactgcaatgaaaggtagaacaaataatagttctgtgatgtcactatttaaaataaaaatgttcaattatgtttcaagatgaaaccacctaaatactacagtgaagaaatacagatagagaagcaaatgagaagtctgtagagattctgaaagggactctgggcacttggtgaagaagtactcgagaggctaactgaccctggttattccgtcttcatcttctaaaggtctaaccttacccttctctgcttctctgttacaacagggttactctggggactcacaaatgtcacaacgggagacggggagaccagggggagattcccctaagtttatgagcataagcagagaaggaaagagaataaagattaaaggaaagtacagctgttaataagaaacacttccttcggtagaaatgaggtgtctgcggtaaaaggggagacagagggcacgtgaagtgcctagttcaccaccccccctgggatgatacagtgcatagttccccatgtcactgccagtcacccaggacaacttcgctgtcatccgcacttgcctcaagacacaggacagaggagcaaggccgcaggccaccaagacagatgttgggatgcaggaagggcgtgtgcctgcacgtgcctgtgctatgttcattgccccaaaagaaaaccacaatctagacattcacaacaaagacagtgctcaagaagtgaccaatgtcttccgtgacagaggaaggaggaaaagaacaaatacggggcacagcttcaagcagcagaagttcacagagtatcagaaaaccaaatcgcctttctcttcagcagataagacttcctggagcacctgactgtcgtcgcgtggggaacgtgagcgcaacatgtcttgccacacccaatggaaggcagcactcaggctgccggagccttatgaaccagagagctgctgtaagaacaataaaggcaaattcttcctgacctctaccactaggagttccaaaaacagcacttaccttggcaggctttcccagcctgacaatgcgtcatgtgattcaaaacgtttttcatggttcgacaatgcgggagcgagcaggcccgaacctctccgtttgcttgctctcgtctctgacacttatgagcatgaagcagtagaaccagctgctgctgtatcagtttgcgtttttcaggatctgcagtggggcctgttgcaattgcttgtgtgggtacaattcccactgatgtttgcatctgagactaaaataaagcaaaataataaaaatactttaacctctcagagttccaagtcatattcattaattatttctcaaacaaaagcaaaagctgatggataataccgaccacagagagaaggctggtgtagttctctaacccactgatgactttaagaagatccagcagcacagaaatcaacccaactcagcagcaaggctgattcaagttcacttgtatacaattatcatccaagcaagacaatggctggctcttcactgtagcaaccaaaatccaactcactctacaatatacacaactacaggaaaagctgtgtactataccagctggaccatatgaaactgctgtttctgtaggtcccaaatggccaaacactggcaatttcatagggtacaacctaattaaaaagattgccaaggcctggccgagcgcgttggctcacgcctgtaatctcagcactctgggaggccgaggcaggcggatcacgaggtcaggagatcgggaccaccctggctaacacgatgagacctcatctctactaaaaaacagaaaaaattaggactataggcgtggtggcgggtgcctgtagtcccacctactcgggaggctgaggcaggagaatggtgtgaacccgggaggcggagcttgcagtgagctgagatggcgccaccgcactccagcctgggcgacagatcgagactccgtctcaaaaaaaaaaaaaaaaaaaaaaaaaaaaaaaaaagatttgccaaggcctgaccaattgcaatgtactacaaacatttgatgtagcaaaaagaatcagagccaccttttggatttcattatcacatgactagaaggacaatgcgtgcagcttgatttcacagcaaccattacctctcctaaaagaataatgacagttagccttaatacaaccacccagtgcaatgggaaatgcattcttgtcctatgctttgtttttcattacaatttccactcagacagctgacaatttttaaagatttggtgatctgctaaaaatacagaaagggtttgctttcagttgcctgaaataacaagccagaccaaacaaaccttttaacagcaaggcaaatggaaaaggggacccatagagtcttcttctttacaaactataagcattcttcagataaacttactgaaaaagacttaggcagtaagagaagtgttcctaatgtgcaacagtatcatccacagttccgggatttccaattttctctagtactctgatatttccagcttgcttccacgaccctcattacctcccctaaagtacgccactcggattttttaaaaatgtatgaatcaaaactgtatattcacaaagaggagagaaaactatacaaataatttttaatgaatcaaagctcacttttaaaagtttatagagttttctgttttgattttacctttatgagaactagaaaataagtacgtagaaaagctgggtggctgggcttgggagcaaaactcttggaagtctgagaaggacccaaagcaattctgagaaggacccaaagcaaaatcagcatcctagctgagaagcagaacaccatgaatgcagggctcaactcctaagagaaaatagcctcttatgtttattttttcctgattataaaagtatatatatacactgcaggaaatttggaaagctagagaactactacagaaataattaacaacaattaaaatcccattatccaggagtccactactaaagcgttgataggtttttttcccttcttttttctatataaatgtttacgtatgaaccataatcaatagagcctcgtatctcccctgcaacacacatgttttgcttagtgttttttccatgttctgccccataccactaaactgtctcagatagtgggctggaatgacttgtaatgaacagcatgttactcttttaactttatactcatttaactagttcttgttatggggcataaactggaatccctggcccctcctttattttttataactgtaaataaagcttcagtaagcaaacaggccttgagctgcccctgcaagcatgcagtactggtgttaagtccactgctcaactggcttatccctgtggattggaaggtccatcgagaaatcaacaggaatggagatatggaggaatgggagaaacacaaaatgagcctcatttaggactctttcttttacgtttatgaaaatttcaaacatacagaaaaatggaaaggaaaggatatcatccttacacctaagaaaaagaaccatccttcttgggcatcagctaatactgagtcatatcccaatttctctggttgtccaaaacatgtcttttagagctggtgttcacaaatcaggaccccaagaaggcccacatcctgtatttggttgtttttaaggttcttaatctattgtatcttccctttttttactcctgacactaccttgttgaagagaccacacagttgtcctctcactgtgtcttaaagtacagaaatatcacataccaaaaaaattatataaaaattaggcaaaaaatttagctctacaagtaaattataaccagactgttcttaattcaccaacaattaacacactgatttcatttgggacttaaaaatattctttttttaaaatttcagagacaaggtcttgctatgttgcccaggctggcctcctgggctcaactgatcttcccacctcagcctcccatgtagctgggatcacagatgtgtggtgccacctaactggcttgtacttttttttttttttttgagacgggagtctcactctatcgcctaagctggagtgcagtggcgccacctcagcttactgcaacctctgcctcctgggttcaagcgattctcctgcctcagcctcccaagtagctgggattacagatgcccaccaccacgcctggctactttttgtatttttagtagagatggggtttcaccatgttggccaagctggtcttgaactcctgacctaaagagaccggcacacctcagcctcccaaagtgctgagattacaggcatgagccaccacgcccagcctggcatgtatttttaatagtgtcttttgcactacacctgaccatatgtcaaaacaggatggttggaaactatatggcaaatttaaaatttgttctgttatttgtctacctctggatggaggacaaatgcacagtttaatgagctctacatattgtttacaacatgcatctcaaaagccattctgagggtgaatcaacagtggaatggaaaatgtcttatgtccctgtctctgtctttccccatggaattctgtatatttgtctgggactagcttagttttgcaaagtacttacaaatacaggggcacacttaatttcctcctctcccaggctggtgttcaatgagccatgagagttagatgtgaactgcaggtggcccccaaatctgtcagaagcatccttcagactttcccaacctccctgcccagttcccactggcaggcaggcactgaggatggagggagagtacttcggaacctccctttaaagcacagaacaaagccatcgtggtggaagctgccccaaaagtaatctacgttttgtgtgattttgtttttctaagagccaagaaaattttgaaaaacagtaaaaataaaggggcaatctatattgccagatactgaaacatactataaagctaatttctttacttaagtccagaaacagacataggtgtatatcaaattagcatatagaagtccccccttatcctcagagttcaggttccaactcccagtggatgcctgaaacttcagatagtactgaatcctatatatactgtattatttcctatacacacacctatgataaagtttaatttataaattaggtatagtaagagattaacattaactaataatgaaatagaaccattactaacaatacactgtaataaaagctacatgaatgtggtctctctctctctctctctaaacaccttattgtactgcactcacttattttgtgattgctggtaagtgaaaccccagaaagtgaaaccccagataagagaggacgattgtctcctaaaggtggtgctttacattcaagagtggtgaggcatctttgatccttatcttcccttttatttaaaaaaaaaaaaattcacatgaactaaagtgaataaaaatggcttaaaatggagaaaaaaatttaaaaacttttaggacatgaggatgagaaagccttcttaacataaacacataatggagtttaaaaagtgaaaaactgcgagcaaattggttgatcttttatgcaaatgctctcaggaaagaaaggatactatcccactaaaaaattgggcaaagaaaatgcagacacctcacaaaacacaaagaaacgacaaatacaaaaatgttctacaccttggtgctgaggcaacacaagggagggagggatcgtttctcaatgacaatgaggaggagcacaggcactggacagcccaggcagaaggatgcaggcagcctcctctctacctcccactcaaaaatgaactcaaggtggagcaaacacttcaacgtaagagtgacaatcgtaccattcacagaagaaaaccgagaataaatcttcacgaccttggattaggcagtttcttactacgtcaccaaaagtgcaagtgataaaagaaaaataaactgatttcataaaaaattaaacttttatgcttcaaaggataccattacaaaataatgaactgtgaaagtggaaagtgaaagagaaaatatttgcaaatcataggtctgataaagcacttgcatctagaacatattttaaaaactcttacaactcagtaataaaaagactaatagcccaattaaaaaataagtgaaagctctgaacagttatttatgcaaagaagatacacgaatggccaataagcacatgaaaagatgttgaaccttattagccattagggaaatgcaagttaagaccacagtgagataccacttcacacccaccacatggctataataaaaagtcaaatgctaaccaatagcaacagggtggccaggacgtggagaacctggaatcctcatacattggtgtgggaatgtagaaggcagcagccactctggaaaacagtctggcaattcctcaaaaggtcaaacataaaattaccacatgacctctgcaattcctattttaggtatacaaccaaaagaactgaaaatgcacgttcacacgaaaactgtaaaaaatgttcacaacagccttttacaaatagccaaaaagtggatacaattcaaatgcccatcaagtgatgaagggaaaaacaaaacacggtgtataaccaaaacggaatattattcaaccgtaaaaagggaagtaaccacacatactacaacatgaactccgaaaacatgcttcgtaaaagaagccagtcacaaaagaccacatattctgtgattcaatttctaggaaatgcccagaatagatacatccatgggggtagaaagactagcggttggctggagatgggggttcaggggaaatggggaataactgctaatggtactaggtttctctttggagtggtgaaaatgtttcagaattgactgtggtgatggttacacaatatactaaataccactcaactgtacacttgaagcaaggactatatggtacatgaattatatcttaaaaagctgtttttaaaaagttcttactaatcactaaaggaatagaaataaaacaatgaggcatgtttaatctatctatatggccaagatttaaaaaatgctaattggtattgatgaggatataaagaaatggcaattctcaagtactctggcaattcggtgtaattttggaaagcaacatgtatcaaaaagaaaaacatgcatttcttttgacagtaactccacttctcatgattcattgttaaggaagtaattggacaagtatgttaaaatatgtgtgcaaagataatgcatcacattctgattaaatattgaaaactggaaaaaattctaaatgtctattaaaggtggactaattaaacatcctatggctacagacttataatgaaacaagaggcacccatgaaaaataaggcagacctcaaataacccctgtcaaagccatgtggagcaggggaatgggccagccaagccctgtctgaatttgtgggagaaaacatccaatgactgttatttaaggcaacgaattactaacaacaataaggcagacctttatgctttaacaaaaagctgtttaagtgactactattttaataccaaaaagcattccattttggggggaaattcccgagaaaacaaaatcagacgaatcagtaagaaaatgatgaggaactaaatataaaaaattaaattgtaaaagtatgggaaggtaattaaggtgggtactttgttacgtaaaggcagtaaaggctttagtcacagaacataaagcagtgttcctcactattaccagtaaaaattctttttatttttggagacagggtctcactgctacccaggctgaagtgaagtagtgcaatcatggctcacacagtctcaccctcctgggctcaagcgatcctctcacctcagcttcctgagtagctgagatgacaagtgtgcatcacgacgcccagctaagttttaaaattttttgtagagacagagtcttgccatgttgttcgagctggtcttgaactcctgggcagaagcaattatctcgccttggcctcccaaagtgctgggattatagctatgagccattgcacccggccttccagtaaaaattcttaaaatacagatcctctcatttttcccctaagagacgagcctgctttgtttttttaatttagacttttcccaatttttccaaaattaacatatatgtgcctttacaatgagaataaagacatttaagaagccaggagtggtggtacacctgtagtcccagctactcaggaggcaaaggtgggagaactgctggagcccaggagatcaatgctatagtctcccacgactgtgcttgtgaattgccactgtaccccagcctgggcaacatagcaagaccctgttgctaaaaaaagacaaaaacaaaatcaaaaacattgagaaaagagaaaaaagaacaaaagccccatgggcgactccaatgcaggagaagactgtacaattaaataggtgtgagaggctagattacataaagactggcattctttctatgactaaaatcactaggaacaagtgtaagggccatttatgaactaggaaaaattaaatctgaaagacacaagacaaaacaaatcatgatggagctattattttttctcctcccagtccatctttattcctcactctgtgccaggctctgtgttcagggtccaaggtacagcagttcattgaagacacacacatccccgagggaagagtactctggggactagccacacacgacaggtgaagtaactgaggccccaaggaaagggccttgcctgggtgatgagccaaccaactagcagcaaagccccaatcctgcagctctctgtgcccctcctccacagagggctgaccaccttgcattataaagtgttctaagagaatctgacaggaaaactggtgaacaacaggaccaaagcaactcaaataaatgcctatgtctctaaacataagcactttaaatcttactcatgagagaaatgctcatcaaagtaagatgacatcattttctcctattaaaggacagggtgggctgggtgcagcagctcacacctgtaatccagccctttgggaggccgaggtgggcagatcacttgaggtcagcagtttgagaccagcctaactaacatggtgaaaccccatttctactaaaaatataaaaaattagctgggtgtggtggcgcacacctgtaatcccagctactcgggaggctgaggcaaaagaatcgcttgaacccaggaagtggaggcgtcagtgagcagagattgcgccactgcactccagcttgtgcaacaagagcaacattctgtctaaaaaaaaacagaagaacggggtaacagtccctagccttgggaagatggtgtgatgctggtaatcgggtacatggcttttgatggaaagcactataatggtatctgtcagaagccttaaaatatatgcaatatgtgtttctggagcgaggatcatttcacatgcaatttgtaatgtggaaggaggaggtgagtatggtgtgagagccatactggtttaaaccttagtctcccctgcctgttactattttgagccactgagtaaagggaggttaacacaaagctcactgagcccactcaccccacccatcatcttcactcggtttagccacaggctctttgcatgtgttgcttattacataattggcagcctcaaccactgtgtatactccactgtcaaactacctttaaaagcaaactctttatatttactctggtattccttaatttttttttttttttttttttttttttttttttttgtgacagagtctcgctctgtcacccaggctggagtgcaatagcatgatctcggctcactgcaacctctgcctcccagattcaagcaattctcctgtctcaccctcccaagtagctggacttacagacgtgtgccaccacacctgactaatttttgtatttttagtagagacggggctttaccgtgttagccagactggtctcaaactcctgacttcaagtgatccacccgccttggcctcccaaagtgctgggattacaggagtgagccaccgcgcccagcctattccttaaattttaaaagaatctaacatgcatttttattaggactgttattgctacataggttttgggtaatttagccccaatgccatttttcctatagtgcctgtattctatgctaaggacataacagagatgtgcatacagaatgtggataataacgcttatcctcacattcctcacaaaaaaataagtcattttttactgtgtgtccaagagtaggttatcatgtcttcaaaggaccctgtgttccaaacagcaagagactgaccaagaaagaacaaggaaggacagtgtcacccctctgtgcagccaatgccccggatccacaccaggctgggattcttgctgctcgtcctcaaccttccacatcgcaacagggtccaaacctatgctcctcggatactcccccacccacctggaaacctgactcctccacaacctccacctagaatcagaaaacgataccaaagcgaacatcaggcagaacaagggctggctctgcaataaccacttgctcaggttccctcataaggacctacaacagctgggtatgcaaagctgtggcgccataaaacaaagaaaatgctcattaaatgtacacagctgccaacctgggaagaagcgataatcacctcagaggtgataaactggtaagaaacacaacatagctattttcatagaggaaatgtttcttgtgttttcttctttttgctttgtgtttattgattttttttaaaaaaataagattatcttaaaatttaagatctaaattcaggccgggcaaggtggctcacgcctgtaatcccagcactttgggaggctgacggcggggagggggggggggggggtggatcacgaggtcaggagttcaagaccagcctggccaacatgccgaaaccctgtctccactaaaaatacaaaaattagccaggtgcggtggcgggcgcctgtaatcccaactactcggaaggctgaggcaggagaatagcttgaacctgggaggcagaggtggcagtgagccaagatcgcgccactgcactctagcctgggcgacagatcgagactctctctcaacaacaacaacaacaaaaaaaacaaaacatctaaattcaatagggaaataatccagaatgatttataagtaatcttaaagctgtgatttaaagtagaaagcaaatggctaaggggagcaggaaagcctgagcccaaggccaaggctcagggtaagaaatgtggccaagggcgagggacttgccactccctccccactctcttcctggacccacagccacagccttcagaacccagcattctacctagaaggggtgggagttacttgttacagcacaaagaaaacctataaggtggccgggagaggtggctcacacctgtgatgctagcactttgggaggcccaggtgggtggatctcctgagctcaggagtttgagaccagcctcagcaacatggcgaaacctgtctctaccaaaaaaaatacaaaaaatttgctgtgcatggtggcacgtgcctgtggtccaagctactcgggggctgaagtgggaggatcgcttgagcctgggaggaagaggatgcagtgagctgaagactacaccactgcactccaaatggggtgacagtgagaccccagcttaaaaaaaaaaaatcacccgaccaaccaaccaaagaaacaacaaaaaagacaacctgcaagatagaagatagaaggcaccagatctattcctacggtcaaagtgactgctggaccagaccaggagtcgaatgaccaagttcaagagaattaccaatttactaaaaacttaaagtttttagaatactcttcttgaatactgttgatatatacatatgtattcttcaagaatacttacgacatttacaggttctaaggattagagggaaaaaaaggaacataaacaaaaatttacacaattttttgataacttggcaaattagttactggacagactgtctttttggtgacgtgaacctcagggccatctcaaagggttgtggaaaaggtaaaaggaagttagggtgatttgggctgtgcagagactgatgtagctcacaccgctccagaggaagtgaagtattatattcgcattactgctagctacgactgacctcacccagacccatgacctgtgctgtttactgagttgttgcttcttgcaggactactgcggtgtatttactcggttcttctaaaagtcacttcatttctcagaaatgcctgctatcctcattatacacttccagcaggcaggcagaggctgcaatgctggctgttagtaagtatgcagcacatcttgtgtagacaaaaaacaaaacaaaaaaaaccttctggctaggcctccactttacatgagtatctttgagatgatttatgcttccacctaggaggttttgctgaagaaaggattatactaatcagactctagaaaagatactgctggttaatgggaaacccatactggaaagtaagttaaatgaccttgactgaggccttgtaatatgtggggctacccctaataccaaaggactcgctactttctctcaatttatagtttcttctcatttgcaacacatcacgtatcattattttgtgcttaaattatgtttcccagctgatacttattgccaaaaccaacggggataagtttgaatagaagatttatacttagcggcatttgaaggccctgcatacatgttttctcagtgatcttcaagatacagatggagtcaatagatgtaaactcttaagaatacacaaacacttaaatcactaataattatagacaagggcttacttccaaaccttccccacgttttccagttcaattagtgagacacaattcataatcatagtgtaatttttctatagacactgttatggtaaagagatgacatgactattcacctgccgtctccacagaactctgtaaggactctctttagtcctaggatagagggaggtattagacaagcagtgattttacaatttctacttgtgcagtgaaaggagcttgtgtataatgttagggaacacaggcatttgtgcaaggaaaccaaaactaagaggagctcatcaaagacgacaacagagagagatcctggcgttcacgaagcttaaccctatgcagccagtttaagtcttgctccctcaatgatcacaatctagacaggggacagaaaattatgaaaatatgacaaacaaggttggggagtgggggaagattagtgaagccttctgaagtactaaagtggacatgaagaccaacaaagtaagtccactccacagtgggacagctggtcacaatgccaatggctcatggtgtcagtggacagtggctttcatgatctttattccacatcagaatcactagaccagctcatgtaaaaccacgagttccagcagaacacaaagaaccgcaagcccatgtatttaagaattatctgagttataattagagggaattaggtggaattgggaaattgagaaagaaaaaagctgaagtttcacaagttaagagtgactacaagacacagattctgcaccttcgtcctaagagattgtgaatcgggaggactgggtgaggcccaggaactgccagtcactcggatgcaggtggggccatggacaggtgctgagacacagcaatggaatgaacccctggacacagggggccctggagggcatcctagcacatggcttgccgctcaggtgctaccagtgtcactgccgcagctgtgatattctggcaggacacagaagaccactctcccatcctcccgtctacacagtcttccagccacaccacccttccattcagagacgtagatcagcagctgccgtgggccctgtccacaacctccactccaaaattctgaaactcagtcacaacaaatcgtaacatcactcatgagcaattttaaataagcagcactactgatgaatctcctgcatctcaactttaatggtgaagtctccataacgcagttcttaaaaaaaaaaaaaaatcacacctacgaactccacattagaaataactcttgcaggagaccacgtgggagaacctgaagatgaggcccctctggtcactgaatgttctcagtctaagacgtatcccacttctacacggcattttgtgaaaatgtcagaaagcccaatccaaagcttaagcaagacgtcaccaagaatcaggtgggttccacttccagaaggatcgcccttgaacttctcctcctcactcagctaaagtggcttcaacttcctgcatcacaccccaccctgtaagccgatggcccatcttccctccaaggccccctgaaatggttcctgctcaacccccaacttccactcacgccctgctcccttccctcatggtggcctttctggacttctaccagttcctacgcaagccagtgctgtcccaataccctggggtctctgtggcttcttctcaactttccaatcttgcctttaaatctccttcctcaatgtggccttctctgatggctccatctaaagaggtccctatgacaatctgaaccgctgagtgctacgcagacctcttggagcagtttgtaacgatttgttttccgtggccactacaccttccatttcacaaaagtggagtgagctctgtgtcactcccagttgccttctggggagccgactccagcacctgagcccacaaaaggctttcaacacatgtgacaaattaattgaatgatcatatccttcccttcctcaatgctacccagtgttggactcctatagaaactaggaggggagaggaacaagagctccctggcccaagaccacgtggctaaatcactccaggaaagagctgcagagggcaccaggtgatttggcactggagtcctgactgggattgtttgggacaccaaatttagttgggtaccccctaaagcatgacaataaatgcaaatatgtttgacacctcattttttcagtaaatagacctagatttctttgtaagtgtttgccctcagtatgcaaaagtctgtgggttttgaggccagatataattttcaaaattcaaaaagactacaaaacacatctgaggaactgcagacaaactgtgtaagcacgggctggtgaagcattcccggcaggctcagggctgcaaaaacatgacctcagaacataactgaagagtttcaggctttgcaaacaggaagctacatagctttgaacaacccaaactcctcagagtctcaacttgctcagctgtaaaatgggacctggaatgatgtctctcaagaggctattgcaggaatatgttaaaaattacctagaaagatgttggggagaccatgtgtgctggtaccccactttcccaccagcccctctggttcctaccactatgtggagcactgaaggctgttcctgggtcaggctgcctcacaaaggcacacgtgggcacagccccatctgatctgtgccctccagggtcagtggtgtcattcagtttacccccaacaggcatttgtggatctgtctcaaagtccacaggggttcttgtgagacagtggccaccaggcaaccaatgcagttcccatggacaaaaatgctttctcagtttaccctgagaagatcagagacagaccaagaaacaggaagagagggagagagaaagagagggggtggggagagaaggggagagggagggatgaaagaaggggggggcagcgggggagagagagaggcagagaggaaaagaagtggttctacttttgtcagatgtctggaagacaagcaaaaggatgagatgctgttgctactgcttctcctaattactctccagttctccagagcaggagtttttaactaggggcgactatgccctggagaacatatgttggtgccttgagccatttttgattatcatggcttagaggagaaggctgtaagcacccagtgggtagggccagggatgctgcccaacatcctctggggcacaaccggctcacagcagagaactgccatcagtgcagaggcagaggggagcctgccccagaccaaacggctccagccctgctgcaggtgaagggaatgagcagcctctttgcagtcccgggcagaaactgcccttgacaagcataccacatctgccaagttcagccctctggagcagcagtggaggcagcagaggggcccggagcacagattctgtcactaagttgtagataaaggagaggggatggggaagtggggctggagaatattttaaaagagaaaagggagcaaaatgttaggtcagggtttccctgactgtaaaacacaagaagtcttggaaaaagcaaatgctttcactatgaagccaaaatgtgctcctggttactgagcaggcataatcgatgacagctaaccccagagtccacactactgtcctttcggtgaggactggaaaaggaagcacaggagagaacgggatctgtgtggtgccagagcccagcattatgcaggtcagtaccgttccctgaacttgaggggctgacctagggtcctctgggctctgtttcaggttctggacctgcactatcaggaacaggacaatcctggcaacaaaaagttattggaaagaaagaagcatatcaaggaaagttacaaggggattatcagaagaaataaagaagtcctaagaactttaggttgttttcacagttttgagagcaagttttgttacttgtacatacccaaccaccttttttttttttgagacagagtcttgctctgccacccaggctagagtgcagtggcgcgatctccgctcactgcaacctccacctcccaggttcaagcgattctcttgcctcagcctcctgagtagctggaattacaggtgcccgccaccatgcccggctaatttttgtatttttagcagagacggggtttcatcatcttggccagcctggcctcgaactcctgacctagtgatccacccgcctcagcctcccaaagtgctggcattacaggtgtgagccaccacgcccggcctcaaccacctttttaaatggaggtaccatacagcagggagccagcacctgacaggacacctcattattcccatttcctgattttatcaaacaagtaaataaagagatctggctctctctgcttcccagcaacctcaaaacttctaagcactgtaagcaatgttaattacttagttttgagaaaagaccaaggttatgtaagatgcatcagaggaagctggatgaggtgaaagatatataggaattctctgtgctatctttacaacaaatacttcaaaataaaaagcataaaaaaccgaaagacaaaaagcaactttttctgaacataatcctctcactttcttgtgatcttcccaaatcactatggcagctgggaaggtcaggctctcagcaacaagcacagtggggagagatggctgcttgtggtcctcacccaccaccaagagcacaccagacatgcagcactgggggtgaacaagagaggctggacaaaagaacgcactacccctcagtgttttgaaataaaagagattctattatttggtggtgcaaaaggagatattttcccattaatatcttgattcatcaggttgagaagtgataaggataattcccattttatagatttcccatctataaaatcccttcaaacctcagggaggatgaagacacgtggaatcatctattgtgttggacgtaatatgcatctcatcaacagagtattgtctttggaagataaatgtccatcatctgacggtaatacaaatcaatgggcttctactgacatcatcaagccactaacaaacaggaagtgtaagaaaagccagtgtctctggttctcatgattctggagagaaaggtaaagtgattcgtgcacgtgaattctctccatcaacaaaaggagcctgggaagagcggctgaatcatcctcacctatctctcctgttgctagctcatcacagaaaatgttaaactcatttagagagctactcatgagaaatctgggttctcttcctatcacctactgacacacttttagttatagactttcactgtgagaatggtaaaaatccacagaccacagcacccaccggagagccataacactgagggccaagggtaacttaccatatttggcacgttggtgactgaagtattcttgatatctgtagggaaggtgggcaaactgttgaccatgctctgtttgctggctaactgggggttcactccagtggctcccattggctgccctccagcttgactaaagggctgtccaaatggacttgtgttcccagttattcccatctgaaacaaaaaagaggtaacatcagctgtggtgacgcagtcaatataaaaggaagggcctgggaaatgctcacacagtttcctatgaaatactcattgcaatgataaattcaaggttcattatcaggttcacatgctccaagcagaaggctcatgaagcagctcctagcagccactctctcctcaccctaaaccccatcccgcaagtagacgagctgtttccccccaccctcagccactctcctcactcaatccctcctgccccaacaatggcaccaacacccgaagaaagtcatttggaaaacaaaaccttccaaagctgctacccaaggggaattctttcagtttaatccttaattactctataggtatctagtttctgttaggttccccatcagatttgaactaagtttccattagttcaaaacacacagtggaaatattgcaatgaaatgatacaacacctgggatctcctttaaaatacacctgacccatgaccaacatgggtttgaactgcatgggtctacatatatggaaatatttttcaatctctcctgctcctcttcaaactcctcagcctctgccaaccaagagatcaagaccagcacctcctcatcctcctcaacgtgaagacaatgaggatgaagaccttgatgatgacccactttcacttaatgaatggtacatatattttcttttccttatggttttatttatttattttaatagagacagcatcttgctctgtcgcctaggctggagtgcagtggagctgtctcggctcactgccaacctctaccgcctgggttcaagcgattctcttgcctcagcctcctgagtagctggtactacaggcacgtgccaccaggtccggctaatttttttgtatttttagtagagacacggtttcatcatgctggccaggctgttctcaaactcctgacctcaggtgatccatccaccttggcctcccaaagtgctcggattacaggcatgagccaccgtgcccggccccttacggttttcctaataacgttttcttttctctagcttacttcactgtaaagatacagtatataacacataaaacatgaaatttgtgttaagcaaatgtgtatgctattggtaaggcttctgatcaacagcaggggattagtagtagttaaacttttatggagtcaaaaggttacaagcagattttcgactggcagggtcagcacccttaacccctgagttgcttaagggtcacctctaatccactgggcaggaggaggtggcaggaaaagggcatagatggagagagcctggtaaggtactgataatcactaaccaagcagtaggcgatgggtacagagaggttatagtatcctctctaccactgtacaggtgtaaaatttatgtatttatttatattttttgagagtgtgtcactctgtcacccaggctggagtgcagtggcgtgatctcggctcactgaaacctccctctcccaggttcaagcaattctcctgcctcagcctcctgagtagctgggattatgggctcgtgccatcacacccagctaatttttgtatttttagtagagacaaagtttcatcatgttggccaagctggtcttgaactcctgacctcaggtgatccgcccaccttggcctcccaatgtactgggattacaggtgtgagccactgcgcccggcctaaaattttccataataaagttttttataaaattaaagtgcactgaaatcaaatatatactagataaaggcaggaatgggaaagaggaaccctcagctatgcttccgtgagggcctgcaaccaactggaattccttccatcaacagatgtgggccaagttccctgatgacccccagctccagcctccacaggtcaattcaggaattgccatggcaatatcccagtgcttatctttctccctgtggagaaacaacgactaattaagaaactggatgcttgggctgcctgtctttgcttttttgcaaagctctaatattccaccttctgtctattgtgtgttctgtatttctggagtagtggtcagtttgatggactgggaaggtccccgcatagggaaaacctcccaggggtgagtttccagttaagaaatcatagctcagttctctccatcagcctcacctggtgactgccacgccagcatgtccactctgggtaacttaacattccttctatggacttcaaactcctcgcctgtaagatgagtgtcttgaacaagatggatcgtattatttctttcagctctaaaagtctaggctacaaacaaatcaacactcaacacaactggccctttctgctgaaatgcctgtacagaaacacaaataaaaaccaaaggagtataaccagaaagttctagctctgtgcatttcatacgcaggtgatttccttccccatgtagtcctcctaggtgacatttctcaccttttggaaagcaatcacattcttgtcaccactaggtgctctacttaagtgaactgagacactaattcttctgcaagtccacaaaccagactcaatttcgagttcaaatgacttaatctaggcaagatggtagctcgataaatattaagcacatttctgatttgcaagaagcttccttcaactgtcatctgaaacttaattgaagcaggaatttatattttcagaaaccactatactaaattaattccatggaacacttactactctcagaatttgtcttattacatataaccaaaccgctgaaacattgttcttagaagcctagaatttgaatacaacaacacgaacaacaacaaaaaatatagttttttttcccccagttcctaaatttctgacttcggacaaaatatgacagaacacccacactcattttccctcgatcaattcatcctcgaagtcaactggtattcaccaagtgcctggtatgagccaagcccagttctgaggctgcgtagatgcatttcccacttgtcacggagctcacaccttatgtcaaccaatttgacaaacaaacaaacaaaaaatcaacgtcttttggaagtttctaattaattaggcccagcattgacaaaccaaagtgggtgacagctgaaggggtggggaagggaacaggtaaccatcttccttccacaccaaatgcccaggcaccctggctccagagaagaggggacctaagtaccaagaggccagtgtgctctgtggacctcaaagttcacctgacttgcttcagaaagtttatttccaaaacttcccagatattttgacaattttcctaagatagccctgccagggtgagtatgagtgtgtgatcagatgggtaatacttgcctggcctggggcccttttctaactggtcaatgttgtttagtgtgtgtgtgtgtgtgtgtgtgtgtgtgtgtttgagacagagtctcgttctgtgtgtgtgtgtgtgtgtgtgtgtgtgtgtgtgtgtgtgtgtgtgtgtgtgtgtttgagacagagtctcgttctgttgcctaggctggaatgcagtggcatgatttcagctccctgcaacctccgcctcccagattcaagcaattctcgtgtctcagcctcccaagtagttgagttcacaggcatgcaccaccacacccagcaaatttttgtattttttagtagagacagggttttaccatgttggccacgctggcctcaaactcctggcctcaagtgatccatacacctcaagcctccccaggtgttgggattacaggtataagccaccacgcctggccataactggtcaatttcaaagggtaacccagtgtttggaagcgctctgacagatttcatcaaaaacgtgtttgtaccttttcttcttggccatcagataagagagtgaaggaaacagtctcaacaagtttttaccttgattctcacaaggtaaaaaagatggcaagtcaaagatcatgaacggtatgtaaggaacgtccagctcatagggatctacacaattctcaaaaataggggaaaaaattcccgtctttagcctatgataaaaacaaaacccaggctacatgcaggaggttagggttcaaatctctggcaccagggccagccccagcctctccttatcagagaaagttaataaccaggctaaagaggtcagctctctcacagggtatcactgctcattgcccaggcaaggctacctcctggtgccaaaccacctcctggcagaactcaagagccatgcactggtcctagcctgcagttatgaataaaaaccatttgcttctagagattctagatttctgaattcctagtatatatctattctccattaatcaaactgagcactgtggtcccccaccctaggctaacatatacttcttaggaccaatgcccaaaatgaaatactaaaatcaagatgtctaacgctaattaatgaaaatctacatttctttaaacgtcccaacaggtacttgataatagtttggtaggctgggtgctcatgcctgtaattccagcactttgggaggctaaggcaggcggatcacttaaggtcagcagttcgagaccagcctggccaacatggtgaaactccatctctactaaaaatacaaaaattagctaggcatggtggtgcgtgcgtataatcccacgatgagccagaataaactgcttgaacccgggaggcagaaaatgcagtgagctgagatcttgccactgcactccagcctggatgacagaggggagactccatctcaaaaaaaaaaaaaaaaaaaatttttttttttttttgtaaagctggctttattttcaatggaggttcatcaggatttggtttaatgctgctagagaacctctatataatcttttaaaaagttttttcatttttaattttgggaggtacatagtaggtatatatatttatgggttacatgagttttttttacaggcatgcactgtgtaataatcacacccaggttaaatggggtgtccgtcacctcaagcatttatcctttgtgttataaacaatccaattacagtctttcagttatttaaaaatgtagaattaaattatttttgaatagtcaccctgttgtgctagcaaatacaaagtcttattcattctttttttttgtattccatacactcttttaaataaaattaaaaaagcagaacagagaataggcaactgttcagttaatagtaaaatttatatattaacaaattaaaacccataaagtatttatattctgcctcattcaacaacagcccatacatattagaagtttcttttactctgttcttcctaacagaactcctttaagcatttaattcaagtttaatctcagaaaataggaaaagttaactatagtaagtacccaaaaaaagaacaagagcttccataatgaaactaaattaaacaatgcctcacagctctcccaggtttcccattaaaaagcattgtgaccaagcgtatcaatcaattaactgtttgagaacctacttctgttttctatcacttcactcagagagtaaaaatatgtaatgcatagtccctgtgtatgataagaaaaatattgaagccagatcctgaggtttccccaactccaaccactgcccccaagaaagaatgggggtgaaactggattagccttaacatgactgcagtgtgagctctgatgaggaaattcctctttaagttcagctcaaaacccaagaacaatacaaagaggcacctgcagcaaatcctggtgctgagcctagcccatccattaaatcctgtggctgcgggtctgaactgtctggcaagtaggtgagtgaccatgatcaacaaagaggagggaaaaggcagactgtgactgtccatctactccagcagacatgggtaccacggaaagtacaaagtaccacacggctctagaggattatctgtcacataaatgtttgtaataatctatcctgaacctgttttggtcacaaaactaggataaaacttctcaccttcctggaacattctctgcatcccctgcaacataccagggatgcagcggaaggacccaaatgaatgaacacgccaaagcaccaccatgccacgcagcccctaggaatagagccaggaaggaggtggtcaaagaaccacgaacaagtgaccaaagtcaaggcacaaagagggtcagcaatggctggagggggcatcggaagaggcagcaggaacagtgccctttctatcttcaaaacttccaaacaaggatctcagctaccagttggagtggacaggagtggacagctactttcccatgctgaaaagtcgggcagaacgagaacaggccttcggagttggttttcagaatggtgaaacgggtgtgtgtgatcacagcagatacacaagtccagtctggctataaaatgggtcctctgtgctacatctttgggccaggaaaaccctgactttggtacaaggccccactcatgcccttacccagagctttccacttgcacacagaattactgacccatcagcctccatggtcacttctggctgccaacagcctcctctgtttacctcagtgtgtgggacaaatactatcattttctacttgtaatgatatgacagctatcaaaacattagtaagaaaacaagctccaggctcagaaagaccagaaagattctctccactcactaaccaggagaatctctctactactcacctaactcccccttctctcaagtgagatctagtctcgtaaaaaagttagtaaatggaaatccaaaaactaattaagggtttaaggagagagaaaagtcaagtcaagtccttcaatatcatcagaaaaactcctgatattgaaaaggggtttagactgaaaggttatagaagaaatcatcaaaatagaagtatttccccagaacaggtttctacaatagtagcaagccaagcatccattttctggctcttctgtcgaaaaggtcagagaaacacgttctttgcaggccaaactccactggggggaggcaatgggccaggcagtccatgggggcaggggagggagcatttgggtgggcaccagttcacaattttgtgtgatgttcatttctgagggtcactctaagatctcctaaagattaagaatacctgtccttggaggaaggaaacttcctccatgcccctcattttcagggaagggcaagctggttcctcatctcacacaaccctgagccatgtatgggagcctttgcaaatagtccacttccagagacatcaaccactcataagaacaaccactccgacaaacaaactcccccagttttcatctccaaacgtcattttgaagtgcacactcacaagaaggggttgaccataaccacttatgagtatgcacctgagggggccaccatgtgaccaatggggggccggggaggaggacggccagaaatggcactgcgacgcagaacttgacctagagtcggccaggccatcagaaactctcagtgcaacaagtgccgagtttgatgtttaggttttcttttctttttttttttttttttttttgagatggagtctcactcttgttgcccaggctggagtgtagtggcaccgtcccagctcactgcaacctctgcctccctggttcaagcgattctcccgtctcagcctcctgagtagctgggactacaggcgcgtgccaccacgcctggctaatttttgtatttttagtagagatggggtttccccatctttactaaagaccacgttggccaggctggtctcaaactcctaacctcaagtgatccgcctgccttggcctcccaaagggctgggattacaggcgtgagccaccgcacctggccttaaggtggttccgaggagcccactaagtccatttttgcagcagctgactacttcagcagttttcctcacacctcaagacacgcctcaagccacaatacacagcagaccactcagaggaagtgggctttggggggtgtcactgatgctggtcaaaaacacacaaaaaggaaccaaaatatgatgttcagtaataagctttgcaaagacaagtggagaaataagactagctaaaacctaccactttataggtgaggaaggggccccccggaaagggcagggacacactaaatcagcctgagaactcagcagacgctccccacagcccccactagaggcttcacccttgcacgggggctcatcacctccccgcttaacgcaactctgtctccttcaagttcaccggcctcacgccagtagccgggacagagacaggatctgtctatgaaaacagggtggcaaagtgcggcctgtgggccaaaggcagcccaatgcctctttctgaaaaaaccaaatttttcttattggaacacagccacaaatacaatttcatccatagaggcaacatgccattgcggtcaactatgtgggctctggggatatctgaatggcgactccaccacttgctagggatttacttaaacctctctgcaccttggttttatcatctgtaaaatggagatcacagcacctcctctaagggttgcgtgagaactaaacaagttcctatatgcgaagcactaagatgagcagctgcgacagtgagtactaggggtgaggaggtgagagacagctttgggagcaatcattctacactacatatgatttctttcctgaccatgcttaaacagtaatgaaataaaggaatgctttacagagaacgtgtaatggtggagagtggttccaacatgtaggacgatagggagaggccggctgggattactggcatttggattatgggacattttcagaaaaacactgtgacaacaacaatcttgtgcatttgctatttgtagaaatactctgaaaaggccattattttctaattgtcctggtaaatcataagcgtttccagttttcattctacattgttttttagctttaagaacaataaactcagggtgtttatttcaaacttaaatcataagcaataatgacatatgattaaaataccctagcctaacattcttgggttaaaatttaaaccaaaacatagaagaactgaacatgaaagaacactcccacgaaaaaagaaatggatgcaactaccactcataagccagccacgacacagcaacaaacttccatttgatgtggcttcagcctaacctgacatatttttcaagctggagtttttttagcatctttctccacaagttggtatacatgtaaaaccacaaattcatataaggtgtaaaaaaacaacacagttcagtacatcaagagcaaaagtttgctaaataattgaatagccagaaatatttatcattttcaatgacataaagaaccagaaccaccccagactacggccagatcatttgtaaagccaaaagcattttctcttggcaacctaccattgttggaagaaagccaagaaaagcagttttcatggaaagacatgactgcattcagttgtctgctatcactcgcttgctcttggaatccttccagtatatcaacttggtaaatatagagtaaggagaaatacgccactgattacagtgccacagacagcacttggctgtccagggtgcacctggggcaggagagttgggctaaagcacctgggcaggtgaacagcccaccttccccctcaattgaagtcttatgtgctgccaacctggaatgcattcaggaaaatgtgcggcccccaggtctgaacatttgccctggaaggataagtcctaactggaagactagtaacaaagtatttagcaactctcactgtatttcatttggataatgtctttcaagaagcattccttgtcttcttgggttaagatcctcccaggcacgaggattgcttgaggccaggagtttgagaccaacctgggcaacgtagcaaaacccccttctctacaaaaaataattagccaggtgtgacggcgtgtgcttgtagtcccagctatttcggaggctgaggtgggaggactgctcgaacccaagaggttgaggatgtagtgatccataattgagccactgtgtacacacacacacagccacgaccagaatgtgacttagaagaagagtggaaatgcaggcctgtatcctcactgttagtcacccaactgctccagaaacttctagcagtgaaaccggcaccctaatactattggtacaccttggcaggtccctacagttagagacgctggttccccaaggtgcagtctgcattaatgcataagcaaaaacgacgggtcaaggtcactggagaaactatttctaatcctgtttctgcccctcatcagccatgtaactgggacaaacctcttggtccctcagttttccttatctataaaataggaagcatttagattatcattaggtgatctttaaagttctttctgattctaaaaatctgatgacattttttatttcaaaccatcagtgcttgattcacataaaggctacactcctgggagatgttgctactcgcagtgagtgacaactgagggttctgagtctgcagacttaactgtcaacccctggactgggaggccctcaccatggcaatcctccctgtggggcccagagtggatggccagcagcctttccaggagactggggagttcgtggagcaaggtcttccatccccactgcccagtgactgggattccatagccccgcaccctggacaccacttcccagagtattttacacaaagaacagctaatctgaggcaaaatgatccaagaaaagggagataaaatttgaaggcactgtttctcctaattcttttaagtcctaatatttttttttaggtagaagagtagactctcttcaggattaagtgcccctttcatgccaatccaagccaacttcacacgggcaatggaaaaagaggaaaaaagaagaaaaggtgataaaaaatgtgagaaaaattttattctataaagactgaatcttggctgggcgtggtggctcacgcctgtaatcccagcactttgaaaggccaaggcgggtggatcacctgaggtcaggagttggagacccgcctggccaatatggtgaaaccctgtctctactaaaaatacaaaaattagccaggcatggtggcacacacctgtagccccagctacaggtttaggcaggagaatcgcttaaggagaggcttaggcaggagaatcacttgaaccctgggagtaggaggttgcagtgagccaagattgcaccactgcactccagcctgggtaacacagcaagactctgtcacacacacacacaaaagagtgaatctttgtaaagacgaaattaatttacactgcaatccaactatggcccagcgggacagagggcctcaataagtcacctgacaaagccacccgatgttttccccagaccttccacatagagcgctcatgcaaggcagagaagcacctttttccacggatctacactccactcactcataaaaagggacgtcaagaacgcacagtaaaggaggcggcaataaaggaaggcgtgaatgtgtataggtaacgcaacggttcagagaaaaggagaaataaagatcggacagaactcacaaggctttaagacagacagccactgactatttctagtaaaatttaaaggagaaagaaagatgacatttcagaggactgtgttcctcctctactttggggcaggaaaacagaactaattcttgaactgggcaggccgtcagctctactgtgggagcaggaagaacagctcgtgggatgagccctgggaggtgacgtgaggctgcctgagggttctgtgtcatctcctcatggcgaatctcctggacctcagtggcaagaggaggactgcagcagccaaagaagatcttgcccagcttattaaatgccataaatctaaaagtgtaaagcacactcaaagatatattgttatcaaaaatatgtggctctacctcttaacaaaagctgaggtgtacagagtcctaacaaaaacataattagcaaagtaaagtgctcttaaatacagtcgtccctcctgactggtgatgtcagcgaggagacaaaacagggaagggtgctgagggagccaggagctggctcagtccgctgcagtctctgtgccttgtttcgagagaatacacaggaagcgcctagaaaagggagaggggtgaggtcaacataaggaaccgctggtaccacaaaggtgactctgattactgacagagaaaacgttccttctaagttacaaaattaaaaagaaaaaaaggacacaaatgtataatccccataaaacacacacctatacacagcaaggaggacagaacaccaaaatatttcatagtgatttctctggatggcttgtaagcaaatgttctttcttaatactttctattatgactcatattctctatacaaagcattattttaaggaggaaaagttgtttcttaaagtcgttctctactcaaacattctgagtgcccaaaatggcaagacgaccctgttaggctgcacaactctacttaaaacattaaactgtcattaaacactgaataaaactaggtagatcaaactgttggtgacagagattgccgctgagtggtaactgaaatcaaatttgccctggtcacaacgtggccgcgtaacctgtcaagctttgctcgaatgccttatacctgtggctagaagacatttcaaggagcctcagcacaggcccaccactctctgcagggagggcgggaggaaagaaaatagaaacaaacaaggtcgacacctactcaggacacaaaaagccaggcgtggctctaacagcttctgctttttctcctcagacatcccacgtttggctcttggtaccacaaaggtacaatgatccctgctgtttgaactctggttcaaagtttaggcagcaagggatgccccttcatcctgatctatctggcctgagcttcagggagcagcaagcaagagactggagcatgagggatggacctgaatgcatttagttcccaagtttccatggcaaggcacacttctagtcagacagttcctatcgagcagcagaccttcccagcaaggagaccactaggcagctatcacgttgccacccgcccctagctctcttcagcagtgatgctcttatctttaggacactggaagttgaaaaggctgtggcaacacacacacacacacacacacacacacacacacactcatctaggaacatgaagtgtgttaaagtctttcaggagggaggtactgtgcagtggtgacacacacagggccacgttctcccaagccaaaggtaagagacacaagccacaaggaaatcagacatgtgcggttaacaggtgccaccaacatcgactgctaaatggagtttcaaaagggagaggggtcctgactgggaggcaaacaagggggtcaagagctgggcctgcaaaggcgagctaaatggtaacagacacagttgaccgaggctacgcctctgcaacctcatcataaacaggaatggggaaaaacacctctgggatgggcctggatagccatgaatcttgcagtttcaaagtctatctctaatcaaataatctaaatgtccacaaaaaagtggtaggatgtgcagccacctggctgggggttaactgacagagctaaagtgttaattaaaatgaacacggaaactggaaagctcaggagagagctggttattcatactgatggttagtcacagaaggcaagcactgtctcagaagagcatcactcataacatcgacagacaggaacaaacgctgctctgatctctgcattcaaatcctgatggactcaagtcaagagtgatggcctcccacctctggccactcccatccccacacgcctttgcctcaccgagcccacacgcggcggcagcagcacgcctaggctgaaccatacccggtcaacttggagactacaactgccaagcaggccggtgcttcccgttctactgtaactctctaagcaaaatgtgccaggtttttaggggagaaaacacactcagtcccctccttgcactgtccccaatctctacgcctcaatcactccctgtgcctcaacagtgtgcccactcatcgctgatatatacactcctgtttgccattcacgcagggccgctctaacttgtggtttctggtttaaatgggatagcacatgggaaaatgctctgaaaactacaaagcactgtgcaatcttgaggtggctctaagatctctttgcaaaaatagagcacagaaaatctctaacatgagacaggattctataaaatgaacagactttctacagtacttaaaacaggcatgcatccttactacaataatttaaagtcaataactgcaagacaatgtctaaagttggcatttctcagtattatctatctcttgctttgttctaggaagagtttcaggtggcttgttttccagttcattcttcattacttggtagaaaaacatgaaatgaataatatgactcactgctaagggcattaagtttttacttagtaaataaaaatgcaatccctgcaatcacactacttcagaccatgcgccattttttgaaagccacaaaccacagtgccacattcttatccaaaaatatgtaataattacacagatgtatatctatggaagtatggccttggaattgcaattagttgataagcatttatacttgctggcaagaaaatgtcactgacattcagttcccagctctaagtggagggctctggacactttgcctcagtagagcactcagaaaaggggttcagtcctcttctgacaaaaaaaaaagaaaatgagatctacatcacagttagaaggcattttttatcaagtaatcaaagatgattaaagatgctggggggaaacctaatttgtgagtaactttgcctttattttaaaaattactaagacaaaatctcttgtttctgagattcagccacaccatttgaacctcttataagagacaaagttttcattaaaatgtcattgtgtatcttcaaaagcatagagaaaactgtaacggaaaaaaatacaaggaagaattcataatcatatgaacaggttagaataaatgaatcaaatctttatgtatgaattttaatactgttcttaaaaaagcaagatgaggccaggcatggtggctcatgcctgtaatcccagcactttgggagcctgaggcaggtggattgcttgagctcaggagtttgagactggcctaggccacatggcaaatctccatctctacaaaaaacagccgggtgcagtggcatgagcctgtagtcccagctcctcaggaggctggggtaggaggactgcttgtgccccagaggcaaaggctgcagtgagccaagataacatcactgcactccagcctgggtgacagagccagacccagtctcggcgggcggggagcaagatgaatacatatcatgtaaaagacactttcatttatcctgttaaaattgatttcatttagtaaaaaactatgaagagacagatctcccacactgaagaagtctaaataaattatgtagacactttgcctaaagaaggtagaatataaaccccctatccttaaacatagtgagtccttccaaagaggatggcatggaggagggaagcggagcattacagtggagaaacctgagaggcacgacctcaaccaggtggctgtgggcagcatcaaccatagtggtaaagtcaccatgacacaacgcaccctcaaagtgacgtggtaaaaatggcccttggctgctgagatcttcctttcaaaagcccataagcccagtcttaccatgagaaaaacatcagacaaatctgtacagaggggcatcctataatacacctgactcgttctcctcaaaactgtcaaggtcattaaaaaccaaggaaaggctgagaaaacgtcacaatcaagaggcgcctaaggagacaggacgattaaaagtaatggggtatcatggatggtattccacaacagaaggacattagggaaaattaaaggaaatttgattaaagtatggacttcagttaatcacaagtatcagtattggttcattacttatgacaaacacaacacaggaaaggtaagaggctaacaataggaagtgcgtggatggtggggaggagataaagaaccctgttgtactatcttttaatttttctgtaaatctaaaactgttctcaacatagagtctactcagtcagttgcaccgcctgtagtttcatctactgagaaagttgaggcttgaggatcgcttaaacccaggaattcaaggctgtagtacactataattgagcctgtgaacggccactgcttgggcaacataatagcaagatctatctctctaaaaaaaatttaagtctacttaaaaaatgaaaagaaaaaaaaaaactatgaaggaaatgtgataagtatcaacaggcattaattctaatgaaaacacagatgttggttatactatcctttgttcttgtgttgaaaatttaaaaaactcagaacataaaaatcaaacctttccttgctaccataatgtaagaaaaatatttttcaaaaagtgatcttgcttactttttattttattgattgattgactgagacagagtctcactctgttgcccaggctggagtgcagtgacgcaatctcggctcactgcaacctcccccttccaggttcacgagattcttctgcctcagactcccgagtagctgggactacaggcgcccgccaccacgcccggctaattttttatatttttagtggagacggggtttcacctagttagctaggatagtctcgatctcctgacctcgtgatccacccacctcagcctcccaaagtgctgggattacaggcataagccaccatgcctggctacttactttttatttttttagagacagggtctctctgtagcccaagctggagtacagtgatacaacaatggctgactacagccccggcctcctgagctcaagtgatcttcctacctcagcctcctgagtagctgggactataggcacgtgccaccacacccagctaatttttaaaatgttttgtagagatggagtctcactgtgttgcccacactggtctcaacctccttggctcaagcaatcctcctgcctcaacctcccaaagtgttgggattgcaggtgtgaaccactgcacctggccaagatcactttaaaaaataatgtttaagaaaattaattatgctggcctcttgcacataggccaaggcacatttttctagccagaaaagctgacttcttttttttttgttttgtttttgagacagagtctctcgctctgtcacccaggctagagtgcagtggcgcaacctcggctcaccgcaacctctgcctcctgggttcaagctactctcctgcctcagcctcccgagtagctgagattacaggcatgtgccaccatgcccagctaattttgtattttgagtagagatgaggtttctccatgttggtcaggctggtctcgaactcacgacgtcaggtgatccacccgcctcggcctcccaaagtactgggattacaagcgtgagccaccatgcccgtcgaaagctgacttctttatgggtcttacaaaaattgcttggctgaattagtatttcagattaagagccataacccaatcagaccacaggcaaagcttacagcatacaagggtatgtttctaaaaaggaataagcagtaaattctttcatttgacaaaaatactcctgggaaattagactcactctccaggttacctgttctataaatttcgtgcatgggggaaaacctgacccacacacagaaaataaggtcttatgtatttcaccatcatagtttgaatacagctgtattacagacaaaatgatgcagtcgaaaaaaatacaggcttggagtcaatcacaggtggattttaagtaaaattctaccactttcaaacatgtgtcgtcttgaataattttctgcataggcaggaaagtggttcagaatattttactccttgttataaaagacatatggcacccacctcacaggattattaaaaatgagaaaaagcaagatcatgtttgcaaagcacccagcacagtgcccagtacaataggcatgtccttttctgctcttcctcttactgttattcaggaagaataaatatagtaattgttatccttgctcatacctggatcacactgaaattttatgctatagtcatatacataattttgaaaaatgcaaaaaaaaaaaaattacatggtaatcaacataaaaacccttagatattttaacttggtgacagatggacagcaaattactgtctatggtaatttgtataaatataactctttttaaaatatagcaaaaatattttggaaaagttggtccttgaagttatgatttggacccatttacattaagaatgttagatgtggcacttcccaagtttctacagtgaacttaatcctcagacgattcagaagatgagagataacgtttaaagtgtgaaatacacagtcactacgggacaaccattatatatcataatgttacgttcacaccattaaaatggagagtatctcccagtgcgaccacacacaacaatcacatcaccaacacctcctagggcttactggagctgtaactaagtgtgcaggactacgaaggaattgtgaattgaacagattccagaggtggcacagtgctagagacatagaagttctgatcagtcggagtttcaagatcttgctgaacatcccaggaattaaactgagaccccaaggccatgtctaaggaacagggcttcaagacctgccctaagttaagtttaaaaacaagctttgagagaatcaaactgatctgagtaattaagagcctgccagaacaaaacaaactaataaaggacaataaaacccatattcaacaacattatcatccaccatttccactacacagtctaaaagtactggacatgccaaggagcaggaagatgtgacccataaccaggaattctatatttaaacaaacaagactgtaaatgaaacagatacagagatgacagagatgttggaatttgcctctacaagaagagcaggaagggagaaaaaaaggaacaaaacacagaagcagcaaacagaaaacaaataagatgagaaacctaaacccaacaattatcaacattaaatataaataaactaaacactacaattaaaagactaaggttatcagaataaattaaataagatctaatgctacgctgcttacaagagacatacttaagagacaaagttaagagtgggctgggtgtggtgactcatgcctgtaatcccagcactttgggaggtcgaggtgggcagatcgcttgagctcaggagtttgagaccagcctgggaaacatggtgaaaccctgtctctactaaaaatacaaaaaaatagccagacgtggtagtgtgtgcctgtggttccagctactcaggaggctgaggtgggaggatcacctcacccggggtggggggcagaggttgcagggagcccagactgcgccactggactgcagcttaggtgagagtgacatcctgtatcaaaacaaaacaaaacaaaaagagtgaaaaaaaaatgtgaatgctaatcataaggagtctacattaaatatgagaaaaaggagataaagacaaagaatattaacaaaaacaaatatttcataatgataaaaggctaaatttaccagaggcattacaatccaaaatacatattaacctaataaaacagtttcaaaacacatgaaacaagtacttacattttgttctgactaaatgaaaaaccagacaaacctaaaattgtaattgtagattttaataatcctctcttagtaaccaatagaacaaaaaaatcataaggatttgaacaccatcaaccaacttattctaatagacaattatgaaacatcacatcccacaactgtaggatacacattctatttttatgagacagagtcttgctccgtacccaggctgaagtgcagtggcgcgatctcagctcactgtaacctctacctcctggggtgaagcgatttttgtatctcagccccctcaagcagctgcaactacagaagcgcaccaccaagcctggctattaattttttttgtacctttagtagagacaggtttcaccacgttggccaggctggtctaaaactcaagtgatctgtccgccttggcctcccaaagtgctgggattacaggcatgagacactgcgcctgatcattcttttcaagtatagatagaatatttgtcaagaaaaaccatttgctgggccgtaagacaagtcttcaatttcaaaggacaaccaccatacaaagcatgttttctgaacacagtggagttaaaaaccaacaataaaatatctgcaaaattcctaaatatttaaaagctaaacacacttcagcataatccatgggtcaaagaataaatcacatgtaaaatataaacatattttaaactaatttaaaaaatgtattaaaatttgagatgcaattaacaacagtatttggggtacttttttatgtttatggatttaaaggattcaaagaaatggggaaataaaaaagatgcatagggtttaaggagaaatttattgcccaaatgttaatattggaaaagtctaaataaccagtgatacaaacttctaccccaaagaaaagccaacataagcagaagaaaataaagacagaaataaatgacatagaaaacaaacaagaaaaggctgacaacaacaaaagctggctgtttgaaaatattaataaaatggacaaaccccaacctagatcaatgagagaaaaacaagagagcacaccagacattattataaattctatccaaattaagaaaagagtacagaggccgggcatggtggctcacacctataatcccagcactttgggaggctgaggcaggcggatcacttgaggtcaggagttcgacaccagcctggccaacatggcaaaacccctcctctactaaaaatacgaaacttagccaggcatggtggtgtgcgcctgtaagcacagctacttgggaggctgacgtgggagaactgtttgaacccaggacgtggaggctgcagtgaactgagatgatgccactgtactccagcctgggcaacggagtgagactctgactcagttaaaaaaaaaagaaagaaaaaaaagaaaagagtagagaaatgttatgaacaccttcatgccaaatcaattcaagaacttaaaatggatatattactcaaaaatacaaattaccaaaattagcacaagaagcagaaaatttgaatagctaatacctattagctattcaaatttaaagtaactgaatcataattttaaaaccttcccacaaggaaaactccagacctggatcgcttcactggtgaattttatcaaacatttaatgaataaataatactaatcttaaatgaactttcagaacaaagggaacaattcccaggtaacttcatgaagccagtatattattgttatcaaaaacaaataagaacactccaaaaaaacagaaagttatagacccatatcactcatgaatataccaatcatgcttcgcccaaagacaaggacatcttctgagaaaagtgtcattaggtgattctggtcactgtgggaacttacactttgggtgtacttaaacaaacctagatggtgtagcctactacacacctaggctgtatggtatagcccactgcttccaggctacaaacctgtacagcttgttactgtgctgaatactggaggcaactgtaacaaaattgtaagtatttgtgtatctaaacatagaaaaggcacagtaaaaatatattatagtcttaaggggccactgttgtatatgtagtctgctgctgaccaaaattcgttatgtagcacattactgtggaagcataaatcctgaacaatattttaataaatctgatccagtaacatataaaaaagataacactccacaatcaagtggggttatctcacaggaatgcaaggctggttcaacactcagaaagacgtaattcacattcaaagaaaaaaaaaacaccctatgattcatctcaataaatgaaaaaagatgtggcaaaattcagtaatcgcttatgatcaaaagactcagcaaactagaaacagaattcctcatcctaatgaatgatacctaaagcctacaactaacattatacttaacgaaaggctgaatgcttttttcccacagatcatgaataagacaagggaagaacactgtcattggttttattaaacattgtgctggccaggcacggtggctcacacctataatcccagcactttgggaggctgagatgggcggaccacctgaggtgaggagttcgagaccagcctgaccaacatggtgaaaccccgtatctactaaaaatacaaaattagctgggtgtggtggcgcaagcctgtagtcccagttactcaggaggctgaggcacgagaatcgcttgagccccagaggtggaggttgcagtgaggcgagatagcaccactgcacttcagcttgggctacagagtgagagtccatctcaaaagaaacccaaaacaaacaaacaaaacattgtactagaggtcctaggcagaacattaaagccagaaaaatgaataaaatgcatacagatgaaaaaggaagaagcaagctatttttattctcagacaacatgtcccagaaaattctaagacatcttatagaattaataagtgagtttagcagggttacaagatacaacattaatacagaaacatttattatacttctccatactagcaacaaataatggtgtaaaacctaggaattaaacagaaatgaaaacgagaaactaagcaacctgactttaatacttactgtaaagctaaagtacaactatgaaagtttcatctatgaaacttttgtgattgataaaattgacttcattaaaattaaaactgccccttcaaagataatgtcaagagaatgagaagacaatccacagactgggagaaaatatgtgcaagaaacacatctgataaagatctatttacaaaaatatataaagaactctcaaaactcaacaataacaacctgtttaaaaaatgggccaaagaccttaacatacacctcatcaaagaagacacacagatggcaaataagcgtatgaaaagatgacccacatcttatcacagaaatgcaaatgacaacaatgggataccactatttgcctattagaacagccaaatccagaacactgtcaacacgaaatgctggcgaggatgtagtgcaacaggaactctcattcatcactggtgggaatgtaaaatgatatagacactttggaagacatttttgcagtttctcacaaaactaagcatactcttaccatatgatccagcaattgtgctcactggtatttacccaaaacaggtaaaaacttaaacctgcacatggatgtatatggcagctttattcataattgccaaaacttggaagcaaccatgaagtctttcagtaggtaaagggataattgccatgaaaagacccagaggaaccttaaatacatattattaaatgaatgaggccaatgagaaaaggctacacactgtgtgactgtaactttacaaaaaggcaaaactatggagacaatcagtggttgccagggttttgggaaggagagagggatgaagaggtgaaacacagacggcttttagggcagtgaaaatactctgcatgacactacaatgatgcacatcattatacatttgtccaagtccacagaatgtacaacaccaagagtgaaccctagtgtaaactacagacttcggattatgatgtatcaatataggtttattgattgtgacaaactgtaccattctagacagcggagttggggaggatgttgaaaatggaggagactatgaactaggagaacagggaatagatggaaaatctctgtaccttcatttcattgtgaagctcaaactactctaaaaaaacccaaaatctttaaaagcttttcttgggccaggcgcagtggctcacgcctgtaatcccagcactttgggaggccgaggcgggcggatcacgaggtcacgagatcgagaccatcctggctaacacggtgaaaccccgtctctagtaaaaatacaaaaaattggccgggcatggtggcaggcgcctgtagttccagctactaagggaggctgaggcaggagaatggcatgaacccgggaggtggaggttgcagtgagccgagaccacgccactgcactccggcctgggcaaaagagcgagactccttctccaaaacaaaacaaaacaaacaaacaaaaaagcttttcttaaaaaacaaactaaatgaatagaaaaatagatcaatagaacagactagaacaaaggtacagggattttttttttctatgaagggccagttaataaataatttagtctttgcagatgacctgcggtttccatcccagattgttttctttttaaacaatccttaaaaaatataaaacccatccttacgtggcaagccatataaaaacaggtcatggggctggatgtggttcatgggctatagtttgcccttagactacagagtccagaaacagacacctccttgtacagtgaatttcgttgctagttatttatctaagagaaatgaaaacttctatgcccacaaaaaaagctgtacaaaaatgctcacagaagatttcttctttttttttttttttttttttgagacggagtcttgctctgtcgcctaggctggagtgcagtagtgggatctcgggtcactgcaagctccgcctcccaggttcacgccattctcctgcctcagcctcccgagtagctgggactacaggcgcctggcaccacacctggctgattttttgtatttttagtagagatgggggtttcaccacgttagccaggatggtctcgatctcctgaccttgtgatccacccgccttggcctcccaaagtgctgggattacaggtgtgagccaccgcgcccggcagaagatttattcttaatagcttcaaactggaaacaaccccaatgtccattaatgggagaacggacaagcaaattatgctctagtcacaaaacagaataccatttagcaataaaaaagaactagttcatgccaacaacgtggatgaatctcagaaaacaagttgtgagcaaaagaagccttataaaaaagcacatactataagtcatcacactacatgattccattacgtgaggtctgagaacaggcaaagcaattcatggttacagaaattagcagctgggcgcggtggctcacacctgtaatcccaacactttgggaggctgaggtgggcggatcactaggtcaggagtttgagaccagcctggccaacatggtgaaaccctatctctaccaaaaagaaaaaagccagctgggcatggtggtgcacacctgtagtcccagctactcgggaggctgaggtaggagaatcgcttgaacccatgaggtggaggttgcagtgagccgagattgcgccagtacactccagcctgggtgacagagcgagactgtgtctcaaaaaaaaaaaaaaaagaaaaaaaagaaaaaaaagaaattagcagtaattgtcgggggatgagtggggacagaaaaagggaggcatacaaaggaactttctgggctaagagaaatgtcctgaatcttgataggggtgtgggttacatgggtaaagggttttgacaaatataagatctgtgcatttcatgctatataaattacaactccaaaaataatcaaagtaaaataataaaaatattttaaaaatataggtaggtctttaactccaaatcttaatagctacctttagttgataaagcaacgaagataatggtttttcgtacaagaacagtcatgtgttgcataacaacatttcagtaaactacagacctcatacacagtggtcccagaagattaccatggaactgaaaaattccaatggcctagtgacgtagtagctgttgaaactgtcatagcataaggcattactcaggtgtctgtgatgctgctggtgtaaacaaatcaatgcactaccagctgtataaaagcatggctcaattatgtatagtacataatagccgataatgataataaatgactatgttactggtttatgtatttactacacttattagagtataatccttctactttttcttaagttaactgtaaaacagcctcaaggcaggtccttcaggcggtattccagaaggcagcattgtcattataggagatgacagtctcccatacatgttactgcttctgaagacctttcagtgggacaagatgtggaggagaaaaacagtgatattcatgatcctgaccctgtacaggcttaggctagtgtgtgtgtgtctgtgtgtatgtgtgtacatttatgttttagcttttaacaaaaaagtttaaaaaattaaagaactggccgggcgcggtggctcacacctgtaatcccagcacttcgggaggccgaggcgggcagactgcctgagctcaagagtttacgaccagcctgggcaacatggtaaaacctcgtctctactgaaatacagaaaatcaggtgggcgtggcggcatgcacctgtagtcccagctactcgggaggctgaggcaggagaattgcttgaacccgggaggcggaggttgcagtgagcagagattgcaccactgcactccagcctgggatacacagcaagactgtctcaaaaaaaataataataataataaataaataaataataaaaaattttaaaatagaaaaagcttatagaataagtacaaatacgtttgtacacctgtacaatgtgtttagtgttttaagctaagtgttaatacaaaagaataaaaaagtttttaaaaaactgaagtttataaagtgaaaagttacagtaagctaatttattactgaaatttaaaaataaataaatttagcatggcctaagtatatagtgtttataaagtctatagcagtgtacagcaacgttctcagctgtcacattcactcaccactcattcactcatccacagcaacttccagtcctgcaaacaccattcatagtaaatgccttatacaggtgtgttttacacacacacccgcccacccctgccacacacaccaggatctatgctgcccaggctgttctccaactcacaggctcaagtgatcctccggcctcaccctcctaaagtgctgggattgcaggcatgggactgagtgtctggtcaggtgtactattttaaatcttttatacagtattttctactataccatttctatgtatagaaatgtttaggtttataaacacttagcattgtggcaccgtgttacaactgcccaagtatgcattacagtaacatgatgtacagatttatagtccaggagcaacagggtacactatatagcctaggtgtgtaacaggctatgccatctaggtttgcataactactctatgatgttcctagcataacataatcacttaatgatgcatttcacccccatcaagtgacacatgcctaagttactcttcaagatggtcccctgggagacatgtcaaatgaaaatcttcattgttgttattatgctaaacattcattccgtttgtgttacagaaaataatcagccaaaaagttaactggaaatactactccaactttgactttaaaaaagatacataattatagataaaagactggtagagaaaacatcaggagtatgttttctttagcgctaagtatgactggatgataggcttacaggcaagattttcttttctagacatttctgtgctaattttgtataacaaacatcaactttttaaaagttgatataggattttgatctgttgcccgggctggtgtcaaattcctggcctaaagcaatcctcccacctccgcctcccaagtagctgggatcacaagaatgagccaccaagctcaacagctactttcactaccaaaaaatgttttcggaaaacattagaaaagcagtctcattatcacttcaaatgttgtgtggctatctcaaatattttatgtggcacagcacctcgctagttcactactcaatattctctggaaggttttcagtaaacctatgcatatactaagaatgttacatacaccatctcatttaattggcatgcgattctgtaagatagagattattatccatttttaattgatagaacaattctcaatggcagctactattatcctcatttaaaagccaaaaaaactaaaacccagagagattaaataagtttcccatagctaataattagtgaaccctggatgtgaactgagtcagcttattccagagcccacgccaggcttgaaagcaattagccactacatctgcagaaggcagtctgagctgccgctattactactgctgctgcagtaagtacactaactactatgtgcgtgtcaatccatttaatatacatatgcaatctcattaaattaaaaagtttaaaaaagaaattcataaggctgggtgaggtggctcatgtctgtaatcccagcactttgggaggctgaggcaggcggatcacctgaggtcaggagttcaacactagcctggccaacatggtgaaaccctgtctctactgaaaatacaaaaaattagctgggcatgctggcgcatgcctgtaatcccagctactcaggaggctgaggcaggaaaattgctggaacccaagaggcagaggttgcagtgagccgagatcacgccattgcactcccacctagacaacaagagtgaaactatggggaaagaaagaaagaaaaaggaaggaagggaaggggaggggagggggagggggagggaagggagggaaggaaaggaagggaggaaagggaaggaagggaaggaaggaaggaaaaggaaaggaatggaaaagaaagaaaggaaagaaagaaagagaaggaaagagagagaggaagagtgagagaaagaaagagaaaagaaaagaaaagaaaaaagaaattcatgattaattatcatgggaaggtaggtacatcctgaatcatacattctataggacacctatgatcatctctcattagagtcataataagatccctgagccagtcctaggctacttaacatgtctactaaacagctgtgcccacaggaattatatacatcccacattaccctgtattaattcatggcactacatagtttcattctacaaactatttttgttgtgatcttttaagaggccaaattaagatatgcttaatataaaattcccttatttctttgtgttaagaatcagatgacttcacgtgaaaaagtgaaaagcaacagacaaatgtacagtattatttctcttgctattaaatattagaaattccagccaggcatgatagtttcacacttgtaatcccagcactttgggcagccaagacggcagtcggcttgagttcagttcaagaccagcccaggcaacatagcaacaccatgtctgcattaaaaaggaaagaaaaagatggttggagttcgggttttcaggctctttctggtctaccttgtggcaatttgagagtccagcaacagtttctgctgggtttcaaagatccaggagaagctcagtgttgtgttgagacacaatggacccatcacaaaagtttaatccaaccctggtcccagtcttcaaaaatgctcactgaagaaaattcccaggacgattcaggggcctctcaaaacttctgctctgagatgttgataaagaaccttagtaacttgactatcaaccctagtaccaaattctcttcccctctaccagaaggctcaccccaacaacagtatacgggagcaatgatcctcagggaaatcagagatgacttgctttacaggagaagatttaagaacactcctgtctatgcagaaagaaaggatggcaaaattgagatacctgttactcggcagagttcctagacttgaacgagaactaacaaacactgggcttaagggagttcagaatgaatcaagaagtggacatttcagatgctgctgcagtttctgcatgtgtaacagatggggtacttttgagagtgctagaatagggaattacaacactgagccacttcagccataaaccttattcttgtacttttttttcttgctggtaattttatgtagcaggttgagaaagctaccttatgctacaatagactatatatcaaaaattttgataatgagttctaggatgtatttttcttgtatcttttcctttctaccatgatactagtgatgtataaggggtctgtgtagtttgaacgtatctgaataacttcagtatacttcagctctactgcttaatttgactcgaagccaagaggacataagcatccccatgtgttttagaagcccaaagccagtgagatgaaacccaacaccgagaatttgaagcaaagtcacttgtgggtaaagaaagcattgggtagtttggctacagcgtaataataagaaaaatttgggttgcaataagaggaaactttgtgctctttttacaatttttagtacaaataaaggtgtatataagagaatcaattttttaaaaaaaatcaaaaaaattagccaggcatgatggtgcacacctatagtaccagctacttaggaggctgagactggagcactgcttgagcccaggagttcgaggctgcagggagccatgataacgccactgtactctagcctgggtgacagagtgaggccttgtctcaaaataaataaataatattagagatttccaataatctacccaaaatagagaaggtagattagtcatttcttagccaacttggttctattaattctttactgactatattctgctaatccattcctttagagcacagattctcagagtgtggtccctgaccaccacaattacggtcaccggtgagctggttagaaatgtaaattctcaggtcccaaccaaaatctgctgaatcagaaacttggtaagttggaggcagaaatctgtcttgacaagcctgcagtgactctgctgaatattcaagtttgggaatcactgctttatagtatctgaccaaaatgatggctgactgagtactgggagctgatctaatttaaaacttttactccaggaacacctccagtcaaaaatcaaccccggggttttctgaccactttctaaaaaagacgaatattccaaaaactttattcaaaaaataagccctaatctgaccccctatgaagatggattaccatacaaactattttggtcacgtttcagatttgttagttaaaagaaagtacttaaaagatttctaaggtcacaaaaacaaattcttatcaaccttaaaatcagaatgcctccggaccccttgacccgaaattacaccttcctctttctaccagcttctggcttccttctgtcatctctgtgtcaagcaacatctctcaacacccgtagccaggaaagagagtgtctgtacggcttctaaatcctacctaaattggtcttttttgctttctttctagaggacaagtgtatgagttattttcagtagaaaacaagaacatgctcccctcataagacgaaatgttaagttttgctactgttgaaataaagaaattgttttttctttaaaaaactcttatcatgccttctatcacaaaagtaaacaaaagaaaaaaatagtaatatcatgtattgttaatattgccatgttgtcaacaagggtcatgtttttcctactgtaaatattttcagagtcacataaaattagaaatgagatggcagtgcacggtggctcatgcctgtaacctcagcactttgggaggctgaggtgggcagatcacctgaggtcaggagttcaaaaccagcctggccaacatggtgaaaccccgtctctactaaaaatacaaaaaattagccgggcgtggtggcgggcgcctgtaatcccagatactcaggaggctgaggcaggagaatcgcttgaacctgggaggcaggggttgcagtgagctgagatcatgccactgcattccagcctaggcaaaaagagcgaaactcccatctcaaaaaaaaaaaaaaaaaaaaaaaaaaaattaggaatgagaagagaaataatcacaaacatcaaaaatgacaaagaactgcacacatttttgcacagctttaagttaacaaattttaaagattagatgaaaagaattttctactaaaacagaaactgtaaaacttacgaaagaacaggctgcattgcattagtgttaacaggcctctggccagaccgtgtggatgcaagcctggttctgccactcactggcagcctccacttcttaatctgtaacatgtgacttgcctacctcctatcctttttttaaacaaagattaaaagttaagtatcttttagtttttctcaaaatcaaagcaaatttagactttactaaataaaaacgatactgacctaagagactactaaaagcctaaaagagccaatatttatagaaaatagcaataaagttgtcaaagattttttttttttttttgagtcagaatctcactctgttggtatgcttgattgtagtggtgtgatcatggctcactgcaactttgcactcctgggctcaagcaatccacctgcttcagcctcctgagtagctgagaccacagacatgtgccaccatgaccagctaattcttaaattttttttaaagatagggtctccctatgttcacaggctggtcttgaactcctgggctcaagcaatcctcccacctcagcctcctaaagtgttggaattacaggtgtgagccaccacgcccggcactattgtcaaagatcttcagtcacttcctagggaaaaaaaggcttcaggcccacatcactgtaagggtgaagtctctcaattcttcatgtaatagataattccaaatcgatttaaactgtttcacagaataaatatgaaagactttcggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaagactttcaaactctttttgaccaagttaacgtaacactgatataaaaattgacaaagcacaaaaagagctatggatcaatttcatcactgataaatgagaaacaaaattctaaatgaagcactagcaattaaaactcagcattaacttttgattttacaattacagagatggttcaatttgatattataaaacctacacagataatctgtcacataaataaatggaaagtgaaaaatcacaggttaatcaacataggtaggtatcaaaaagaaatttgataaaacctaacatttagatattatcatttattttatgacgaacagattatgccccaattttaaaagaaatatactactgactacaaaccaaagctcacattattcttaataacagaacactaaatacacttccatttaagtaggatacgagacagggatgcctaagagcataaacactggcaaaaaatattggcaaggagaaaataaaagtatcaataatgcaaaagatgactatctccttggaaaactcaagagaatctcctgaaaacgtattagaataattaagataaccccataaagcagccagattaccagagtagcgtatacataacatctttcctatattaaaatagccagttagataatgaaatataactcatcaccaacagcaacaaaaaccacgtaatacctccagaaataaacttagtaagaaagatttattacacagataaagaaaaccatactatgcttccaagcaacataagacccccagaaaagataatttatatgtataagaagactcaggaagtcacaaaactgttaaaatgtcacatccctcctaaaatgacttataaagttgtagtgaatcttataaatccaaaatcccaaagattttttgtttttaaaatttgaaaaaaagtcctaaatttatctaacacagtggggttctcaaccctggctgccatgaaagtcatctgaggaactacacactatacgaatgtttctaccatatcccccagattctaactcaattgctctgtagtggggttcaggcatcatatttttaaaaattctccagataaatctgataaagtgtagacagagttgagaaccacctgtgtgagaaataactagtgaggtcatatactaaaagtcatcacacagctaggttaataggtttctggcacaggaacaagcaaaggtcaatggaactaaagaaaaagagttcagaaattagacccaaatcctatatgtttgaaaagagaataaagtgtataccaaaaacagcatatcgtatcagtgggagaaaagatggattaccaatactaaataaatggtactaagatgattataacaagaaaaaatatatactgctggatctctgtgtctcactccttatgccaaaataaattgagttaaagattcaaggaggccagacacggtggctcacgcctgcaatcccagcagtttgggaggctgaggtgggtggatcgcttgagctcaggagttcaggaccagcctgggcaacatggcaaaaccccgtctccacaaaaaaatacaaaaattagtcagttgtggtgatgcgcgcctgtagtcccagctactggggaggctgaggcaggcggatcacctgagaccaggaggcagaggttgcagtgagctgagatcatgctactgcactctagcctgggcaacaaactgagaccctatctcaaaaaaaaaaaaaaaaaaaaaagtcatgtaataaggagaaaaatacaggaaaatatttcttaattttttaataggaaaagcacttctaaaatgtgacataaaacctaaaagccataaaggaaataaatggataaatgtgtttctatacaaactgaaaacatatacttggtaaaaacatattgtaaacctatgtgaccatattcctggtgaaacagactatggcaaataacaaaggggaaaaacatgttttaagagacttaagaatataaattaatgagaaaaaatgacaaacaattcaagagacaaatggacaaagattatgaacaatcagtaaaatacaactgcctatgaccttatgaaaagacacacttaacaaagaagacaacttgcttaacagaatgtcaagtaagtaaaaggatggtaatattcagtgttggtcaagatttggacagaggctcaatcactcttgatgaaggtgtaatttgcacaatatttctgaagagtatctgagattatctatgctgatttaaaatctcagtatcttttaattcagaaattgcatgtccaataaattatctagcagatatggtcactcagctgtacaaagatatatgtacaatgtgttcaaagcaaaactgtgaaaacagcaaaatactgggaataacctaaatgctcagcctacatggcacaagtccttaaattacgatatacccaaatcaggaattcctattgtacctatgaagaatgactgacagctacgcggagcatggaagaatttccaacttgtattgttaagtggtgggtggggaggggaacatctacactcacaagaaaacgctgtgtaatgctactctttatgtctggggagatagcacacacatacccacacccctctctctacgcctctatacgcatacatcatcactggcaggacagataagaaataatagttgcctttggtgagaatttgggagaaccaaaattcaagaattaagaattaactctctggttcttactcttaagagtatttttatggttgtttgtcgttaaaccatgtgcatgtttactttctaaaaacaaactttaaacaagtctgtgacccattaattctccttttcagaatctaatccatgacacatgtgtacaggcattgctgcactagcaaaaagtcagaaacaatccaaatgttcatcctcagaggatgagatcaataaattatgatgtatcatataatggaatactttgctatcagtaagaaaaaaaaatctctgtgcagtgtcacagaggccatctaaggtacactgccaagtaaaacagtaaggtgcttatgtagtctggtttcattatgtattttaaatctttatctgtaaggaggatgttgctcttttcctactattttaattatttcataggatatacttcctgtgtaatcgttcttaaaacaaaattatcttaaaaaaagcgccttttccctgtgcatcttaaaatctagttggctctgctatcgtaaggttctagagagggaatggtttaaaatggacttgtctctccctcttactttctgcccaccactacttggtctttcattccacccaaaggcaacgacacatctttaaaaaaatgcactctatccacctctagtgggctgctttgagatacctataggaaacaagagacaactgtccccagcacgctaacgaggctcactttccagtgacatccacgagttgctgttggaaagaaagaccactctgtataaaggaaccccaggatggaatgaaaagcctgggtggacagagaagcatgaagtgttacaggtgtaatcagcaaagtccaacttctggaagacactctccaggataaatagcagacaacaaccaaaacatgtttcttcagtaaattgtaaggatcccacagaccaacagagaacagattcttaagaggcatatcaactaactgaaatgtagattttgagtaaaaatctataaaaactacttataggccgggcgtggtggctcacgcctgtaatcccagcattttgggaggcagaggcaggtggctcgcttgaggtcaggagttcgagaccagcttggccaacatggtgaaactccgtctctaataaaaatataaaaagttagccgggagcagtggcacgcgcctgtaatcccagctactcaggaggctgaggcaggacaatcacttgaacccaggaggcggaggttgcagtgagcccagatggtgccactgcactccagacactgggcaacagtgaaactccatctcagaaaaaaaaaaaaaaaattacaacatatgagaccactggaaacgtgactattctgtggatactggctgacatgaagttactgttaaatctgttaacatgtgataatggctttgtgtttaggtgtacaaagtctaacttctacatacatgttatcaaaagctcttgaagtgcagtccagggtcccagacctttcagggggaccatgatgtcaaaactatttccataaaatcctaagatatgatttgccttttccctctgattctctcccaagaacacagtagatctagttttctagttactttgtgatgtgtgattccactgcactggacggatgatgaaatgtgtttcaatattctgttttactatttaatatagtaaatattgagaggtatactgcacatgttaaagaaatctctttggggtcctcagtaattgttaagattattcaggagtcttgagattaaaaaaaagtttgggaatcattgctttatactattatgtcgacttcatatgatttaaactctccagaatagacagagttttaaaagtaaggagtagagtgatgaatgaactgggaaaaggaacaaggatcaatctctccaggaaccataaacccatgagaaattccttctcaattgacacactcatacagactcttcttaaaatgccaggtacaagtaaaacttaagttcacgttcctctctactaacatttcaaaaaagacaaatgcaatttaaacattgagcattacttcatcttcatttcttaagttaaaaaaaaatcctctcgtttccgacattcacagggttttgcatccgtcacccaacgctctcatcaaccttctggggaaactgtgttctactcttattctccctcacccctacttgggactaaacaaatccaaagaacagcccaaactgattttctgttctgggatgtgctgaattccactgcctgaagacgtgcctggtggctgctgttgagaagcctctggccgcagagcatccacagtgtttgtcacttcagtgggaataggctgcccttccttctctgtgctcctgtcagtcctgggcttttccagctgtctcacatctatccaggcatctgccttcccccttctccaagtccagttcctactctagaaggcagctgcaaggctggtggctgcaaatcccagtccaggcctttccctagcagagctcttggccgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgatgtgcgtgaccttggagccacctggaggctgctgctttttttttttttttttttttttttccaagagacagggtttcgccacattgcccaggctggtctcaaactcctagagttgagctatccacccaccttggcctcccaaagtgctgggatcacaggcgtgagtcactgtgtccagcacccatctggaggcttcttaaagcccaggccccacgccgagcttctgagtcaataaagaagtctgcatttctaacaagcttctaggggatgctgctgctgctgctggtccaggggaccccacttgaagaaccactgcactggtgtttcctctgggacccgaatgcctgtgcttctccccggctctgccacctcttccttgttaacatagcagggagtgagctgacaaccctggaacacagctttctcattcagtgaaatggatactgtgccaacagatacttcactggatggccacagaggagcatacagaccagtgatcacctcctcagtgggcagtacacaggcagaaagcaacctctaccaggttcacggacacattaggccctgtactttccaactgcctgacctgcaagctgtcctacttctttaagaattctcattttaaagacagaaatggggcagagatctttatcctagaaagaaatctgtctcttccaagcatgagtggcacgtggagagcccaagaggaaaaacaggagtgggccacgtggtcccattttacgcattactcggagggaaagcccgcggttaggtaggaagtattgaaagtgcttcagttcacttaccttggccatgcctcctgcctgtgcggtgttcagtcccgcgtgaccagtcatttgcggggaaacctgcgttagggtctcagccagcacgctgctcgaggcgccctgcatggctggagtagggtacggcattccagctccccttcctctgccagcagccccaagagatccattcatgacttgcgcctgcccttgtgaagcctgattaattaagctatggccagagttactattgaggaggcctgggtgggtctggttaaagttagcattcatgcagataccaggtccagtctgtgacgtggcagggctgctagtcgccagccccacttgcttttgtgcttgcggattcagtgcttgggaggcagcgggggtgggcccagaggtgctggctgcctgtttaggcaggctgggggctgaagaatctccctggctcagagggctcttgcccatggcactgaggctggccatgttagcactgttcggctgcccttgagcctggccacccaggccctgctgcacggggctgctggcgctcacatttcctattcctgggttgatactagagccgctgcctcctcgtagaagctccgacagttgtttatgtttggaagcagcatctggaacaaggttcccactgtttaaaaggcctaattctcctccattgggtatcagctcatcaggaagatcattttccaagtcaaacaatgatccaaaatctagaaattaaacagaaatggaaatgagaaactaagcaacctttacagctctccaactgccacgtttctatgatcttaacctaatggggcattcagcacgaacactagcatgtcttaagagtcatgtcattagctgggtgtggtagcgcatgcctgtaatcccagctactcgggaggctaaggcaggagaatagcttgaacccgggaggtggaggatgcggtgagccaagatcacgccattgcactccagcctgggcaacaagaccgaaacaccgtctcaaaaaaaaaaaaaaaattaaaaaaaaaaaaaaaaaaagagtaatgtcaaaatgatttacaagtttgtttgggaaaataaagaaaaaatacccttcaaattctgaagacagaaaagttaaacagagatgagaaggacagccctactatatttatcatattctaaaacaataattaaatagtgtggtgttgagggcaaactcagatatacaaattaaaagaaaacaatgggaagactccaaattcactgaattataattttaaaatgcttttaagaatgtatgtgtggccgggcatggtggctcaagcctgtaatcccagcactttgggaggctgaggcaggcggatcacgaggtcaggagagcgagaccatcctggctaacacggtgaaaccccgtctctagtaaaaagacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggcgacagagcgagactccgtctcaaaaaaaaaaaaaaaaaaagacaaaacattagccgggcatggtggcgggcgcctgtaatcccagctactcaggaggcttaggcaggagaatggcgtgaacctgggaggcggagcttgcagtgagctgagatcgtgccactgcactccaacctgggcaacagcgagactccatctcaaaaaaaaaaaaaaaaaaaaaaaaaaaaaaaaaaaaaaaagaatgtatgtgtgtaacaaagtaactgggcattgacttagatgaacagcaatttgaggacagtaaagccaatcttaaatttgtttttttttttttttttttttttttgagacagagtctcgctctgcggcccaggctggatggagtgcagtggcgtgatctcggctcactgcaaggtccgcctcccgggttcacgccactgtcctgcctcagcctcccaagtagctgggattataggcgcccaccaccatgcccggctaattttttgtatttttagtagagacggggtttcaccgtattagccaggatggtctcgatctcctgacctcatgatccatgggaggcctcagcctcccaaagtgctgggattacaggtgtgagccaccgtgcccggccgattacattatttaaaagttaaaatacaagaagtaaactagctttaacgcaaaatgaaatcagtgatttcttaaaagtgttgaagctgcagcaaatgataataaagacatacacagaaactacaaagagttaaaaataagagcctaaaagtatttgtagtatatgaaaggggtaaatgtcaatcatacaggaagatgagaagcacagtgactcccgactataaatggacaaaagacataagcaggtcttcaccccaaagggaaataaaacactaaacaaaataatccgtctttcctgataaggaaacaaatgggaactaaaacaaccctttttctggtccctttcaaagtaacttttctctgaagcgtggtctacacatgtcatctctaccctctcatttcccacgcactctaacccacaacggccaggctattcatgtatgtgcaaggaagaagtatgtagaaatatgttcatcttagtattatctgtagcatccaaaaaaaaaaaaaaagcacaaaaaatacccagaggcagtttttcctagtggttacagactctatactggggctgcccacactggacaccagctctgcctccagctccctattcattagtgatgtgaccttggtaggttactcagcctttctttgcctcagtttcctcatctggaaactaggggtaacaatggcccctacacctcataacgctgttgtgaggaccaaatgaataagtaagtgtaaaacacgactgagaacaaacagtgcctatgggtggtaaatgctaagtactgtctattattattactgctatccataacaggaggtttaataagcggctgtataatactttaaaacatcaggccgggtgcggtggctcacgcctgtaatcccagcactttgggaggccaaggtaggcggatcacgaggtcaggagattgagaccatcctggctaacacggtgaaaccctgtctctactaaaaatataaaaaatcagccaggtgtggtggcaggcacctgtagtcccagctactctggaggctgaggcaggagaatggcgtgaacccaggaggcagagcttgcagtgagccaagattgcgccactgcactccagcctggatgacagcctgggaaacagagtgagactccatctcaaaaaaacaaacaaacaaaaaacaccatacatcggccaggcacggtagctcatgcctgtaatcccagcactttgggaggccaaggcaggcagacgatctgaggtcaggagttcaagaccagcctggctaatatggcgaagccctatctctactaaaaacacaaaaatgagctgggcgtggtggcaggcgcctgtaattgcagctactcgagaggctgaggcaggagagtcgcttgaacctgggaggtggaagttgcagtgaactgagatatcgccattgcactccagcctgggcaacaagagcgaaactccgtctcaaaaacaaacaaacaaacaaacaaacacacacacacacacacacacgaaaaagaaaagaaaattaaaaccttttttctgcatggtggcagaccctaatgtctgctcacccaatacccctggccccatgctgctggcaacacccacatgatctgaagtggctgcctgggaggttcctctgaggaacgttccctggccacaggagggagagtaaccagataagcccaccaccacgatcacgttcccctttgcaagtgacacaatctcagctaagggaatctgaaggtacactgaaccaggaccattgtggaaaaggtgttccttcctcacagcaatggatgctcagaaagaaatctccctcctcttcttcaccagatctcgtcatgggcaggtgacaatcaccctgtagccaggagagcagacaccacttgcatgctaaggatggctgtagccaaaaacataaacacctggggtggggagatcatctctgaactgctgagtgatgcaaccctagtacttccccaccttcaaacttcatgttatgtgagaaaatacacttactatcacttaagccattttagctggagtttaacctcaccctaaccctaacagacccatcatgtctatggaagaagttcaaacaccttctcatggcacgtgaggctatcttcttggccttcctttacaggacaacaccagatgccccctactttccagccacaacactgagagctggcacaggcattgggaatctttcttcttgaatctctcattctaaaactcacctcagttcccactcagattaaacacagcaactatgaagactttctttgggctgcccctgcagaacagaccagtccctcttgtcagtctagaaaaccacgtctaacacacacttgttatcttcccacctgtctgtaaggaatgagatgtgatttaggagtgtgtacatgcatgtaacagtttttgaagaaaaaccgagactgagagtaagttgcagacgaaataacactgttctcctaagtacttcagtacgtatctcctaacaacatcctcttacataatcacagtatgcatgtgcaactcaggaaatgtaacactgatacaatactgaatatactgcccttactcaaattttgctggttgtcccaataatgatctttatcacacatctgtctcttcaaaatgacatgtcctatagccatgagattacaagatccaagatctaattcaggatcatggtgcatttaattgtcatgtctttgtcaccttgtttaatcgaaaaaggatcaaaggttccctggcctttgtctttcgtaagtgacattttattcttatttgtttattagacagagtcttgctctgttgcccacgctagatggagtgcagtggcacgatccaggctcactgcaacctttgcctcccgggttcaagcaattctccaacctcagccagaatagctgggattacaggcgtgcaccaccgcacccggctaacgtttgtatttttagtagagacggggtttcgccacgttggccaggctggtttcgaacttctgacctcaggtgatccgcccgcctaagcctcccaaagtgctaggattacaggcgtgagccattgcacccggccataactgacatttttgaagaatagaggccagttgttattgtagaaggtccttcaatttggggtacctcctcatggttacagggcatgtcattttgaagagaaaggaatctgatcccggatacagcagacagttccatgagggcacagggcctgtacctggtgaaataggtctcaacatgcttctgagggttccaatccatagtttttacgctattttgctatcctaaatttggagattcactgaggtgtccagacacaaactgtacaatatttattaaatatgtattaaaaagtcctctctatcataactactgttttgtttgttgccctccaggctttgtccacctgcacacacaaatttactcggtactccttaataaatatttttgtccaacccaaatgataaacgtttgaggtggtagatatcctaattactatgatttgctcattatgcattgcatgcatgttacaaaatattctgtaaccccttaatatatacaatcacatgtcaactacaaataaaaggaaaaaagaaaatatgtacccccccaaataacaacattttattttttattttatgttttagagatagggtcttgctctgtcacctctgtgcaatggcacaatcacagctcactgtatcctcaaactcctggactcaaccaattctcccgcttcagccccctatagctgggaccacaggtgtgccccaccacaaacagctcattttttattttatttttaattaatgaattaattaaataattattttgacagggtcttgctccggcacccaggctggagtgcagtgaagttgcaggctcaatgcagcttccgccctgcaccaaaacacccacctgatttttgtactgttttggagagacagggtttcgccatgtttcccaggcttgccagctaattaaaaaaatttttttttgtagagatggggtcttgctatgttgcccaggctggtctcaaactcctggcctcaagaaatactcctacttcagtctcccaaagcactgggattacaggcatgagccactgcagcccaaaataactacttttaaaaatgcagtgttccttaactgatgagcatgaaaatgaaacttcatctaaaccaggaactggagccattaccattagagatcagctctccttcctttctgtccagggcgaggatgaagagaccgtgtcaagcactgtaacccagaagcaaacaagggccaaatattttatatttaagtttggaaaaatctgcaaaaggcgacctaactggctattttgaacatccctaagcactcttcctaggagagggaggccaggccacagaagagcagataaactcagagagtacttagtgaaacccagggcagggctggcctcagtgtagaacaatgggaacagaacagctggaagctgagcacaggagttgaaatcctgcatccttaggcaaactgcttcatctctgcatcttcataccctcacctgtaaaacaagggtaccaacgccccagagttaaaaacttcacccatcatcctgccactctcagagctatcagttttcatttatggtttattctagttcttatcaaattcacaggcaagtttcaaagttgtaagcagggcttatgtcctgggctagtgtttttgtttttcactggtctgctacactctgaccaccgtgaccactttttcatcctatttcagtccaaatacatataccagctgtttgggtgaaggcagagttagacaaattcttcttctgtaattcaccatatgaatatgtgtaaaaccaaatatacaggtgtggctttttaaaaggcaagatagggcgcacacgtagtcgtaccatcacccttctgtttaccactgtcaccacatttccatattccctagttcagcaaaactgacaaaggggagtgaaggaggcaggccaggatattgcaacacaacacagctttgctttctacacaccaaagtgtcccaacacatgggttaagcaagagcaatctgtatcatcggaagttcctaaggttcacgattgacagcgatccagtcccaggtaagccctcttctctctgaccgttaccagggggcccgggagaatgcaaagaaaaggagactgtgggcaccctgcacccagagcatttgcacctcaaggaaacttcaccagccgatatcaaatagcgaacactgcctgtcatacttccatagctagggaaaggaattttcccttttgcagcttcctggctgccaaccaggaggctacccctttcattaagctgaaatgagagaaaagagaggctacacatttccccatttctatcacactcatacgaggctgggaagacccagtgaggaatgaggaaaatagtagggacttaggaaggagaaagttacagccaaactcagccagcctcaggaaaggcaactgtttaccaagcaaggtacagaggacattcacttctatactaggaaacccaagccggtggtctgcatgcagactgttaggtggggatcactcctaaacactgaaagacaaatggtacctacatctgttccaggatccattcttaataatgatgatcagaaatcagcatttcaccttaagcaaggaatgaactactagaatcaaacaccaggtgggtggctaaatcaatctgtgcagccaataacatttgaaaacagcctcatctgaaaaaaatttcaaagccatcagccaaagtatccacaaaacacacctttcttcaggttttctacagcctcctcttccataataccttattttcttctttgaattccacttggagccccagattatttgtactgacaggactggtctatcacaccttctcctggaaataagaactcttttatgctcctacagacacaatgcgttaaaattatgctaacaatttcacgttataacgtgcgtggggctgtaagctccctgaaagcagggatcctgtcttgcttatctactcagtgcctagcataaaatgcttcgtatgtactaggcactcaataaacccacgtgctgaatgagtgctcacattatagaggatacacagtatcaacaagctgcttgtctagtcaaagatataaagcagtaatcttaatgtttactactactttctgaaaacagaaacaataacgaattctctagaaatattacactgggtcatctttctctttaagactttttcctattgccctctttaccttttaggggaccacccaagtatatttcactctttggctacaaactcagcatcaatgaaccccaaccctagaattgatacacagattaaatggcataatgtaggatgagcaacagtagtgtaagaaataagcatgtaagagttcagatgctgttttgtgatgtgttcatacttctctgctttccctcccacacatattttctcttcctcacccactcctaatttctctctcacatccctatttcctgtgaaaaaggtctcctttctttagatttttttttcatggtttctttagattgtcttttgcattacttttgtaatactgtgactatgtatttggtcttccaccctgtctcctggcatacaactcctaaaatccttggaatctccaaaatagaatttttattttttatttttttatttttatttttttttggctctgtcgcctaggctagagtgcagtggcacgatcttggctcactgcagcctctacttcccggattcaaacaattcttctgcctcagcctcccaagtagctgggattacaggcgcataccaccacacccggctaattttttgtattttcagcagagacggggtttcaccatgttggccagaatggtctagaactcccaacctcaggtgatccatccgcctcggcctcacaaattgctgggattataggtgtgagccaccacacccaaccagtaatgtcttttcgtatgctcacgaattgactgatggctggcagctcctaggtagcttcggacaggagctggtcaccaggaagaccaaggcatgactgattagaggactgggactttcagcccatccttaatttccagggaagggagagatactaaagcttaagttgatcaccaacggccaatggtttaatcaatcatgcctatgtaatgaagcctccataaaaactcacaagtacagggttcagagagcttccagatagctgaacacatggaggttcctgaagagtggcacacctggacggggcaaaaaggctacatggccctctcacacgccttgccctatcacctgatattcagtggtatccttcataatatcctttacaataaaaaaccagtaaacatgtttccttgagctctgtcaaccgctctagtaaattaattgaacccaaggaggggcttgtgggaaccccatttatagccagtcagaagcacaggtaaaacaacttggggcttgcaaatggtggggggcgggggcagtcttgaggactgagccctcaaccgtgggatctgacaccatctgcctgtcagctggcgtctgctgcagcaccgagtgcctactcggtgtgtgtgtgtggctgggggcatctccacaaatctggtcccagaggtgttctgtgtcgactgttgacactgagtataggaataaaggagtataggagaaacctgatttttccctacatcctcagacttgtactatagccctgactactcaaatgcttctattaaatctttcaaaagctaaacatttttattcacctatttacctaccctcgaaaaacttccaaaaggaattttttttaagagatggggtctgtgttgcccaggctggagtgcagtggccattcacaagtgtgatcatggctcactgtagcctcaaactcctaaactcctggactcaagcaatcctcctgcctcagcctcccaagtagccaagactgctggcatgtgccactgtggctccaaaaagaatttttaatttctaagttaacggacacaggaagaggtaatgcacatgttaattggctcaatttagccaatccacaatgtatagatatttcaaaacatcatgttgtatatgataaatacatacaatttttatttgttaattaaaacaaaatttgaaggaaaaaaactacatacaaaaaacttgatccagcaagggcaaagcatcctggaaaagttcactcctagagatgaggaatctagagagtggtggaaggattcacagtgttgttattattattgttaaatgacctggaggccacactacgctctcggtgtgtttactgatctattactaattagacactacggacacaggaagtgcagtctggtgtagtgagaagagtactcaaccaagccctggttcagatcacagctgtcaccacagctactgcctccctgtgtacccctccttagctctaaaatggaaggacagctgggtgcagtggctcatgcctgtaatcccagcactttgggaggcagacaggtgggtcacctatggtcaggagttcgaaaccagcctagccaacatggtgaaaccctgtctctactaaaaatactgaaaattacaaaaaattagctgggcgtggtggcaggtgcctataaccccagctactcgggaagctgaggcaggagaatcactgggaggttgcagtgagccgagatcgcgccattgcactccagcctgggcaacaagggcaaaactctgtcccaaaaaaataaataaataaaataaaataaaggacagtagcacctgcttcgcaggatcgttgatgaaagaattaaaccatacagcatttagcactgagcttggcatgcagtaaggactcaaaaaatattagtcattactatcactgtcccaatcccatctcccaaggcacctatgagggctgaaccagccaaagcctttaagaacctggcactccagggttggtacagagcaggcgctcaacagccgccacttatcaatggtagtgacttgctaataaactcatccctgctgatctgtggcaattctagtagaattaaaggttactttgctttgaaagttcttggggattatgcaaataaatataatggaacaactctctataccaaaaaaaaaaaaaaaaaagaaagagaaaagctgttttattaatatttatgccatcgtaagtaatttttatctaggcatttaaacaagttcccaaaagacatctaacttttttttttttttttacaatgactattaggaaataattaaagcaacctccttctaaaatcttccgtaattcaggcttcttttatgcagacacaccaatccctaattagaacagaacaatgaggttgtacttcattctgaacagtgatcttatcttgagtaagtcttgcccctcctcagaatcactgatctgctgaagagccagagagctcggccggcagcccccaccctctcctccccaggagaaggaagcgagtcactgctcaggggccctcactcggtgcaggaccggctgggtttgagatagaatagaagtcggcctccccagaggactgtactctaattgaggaagacagccaatggacaccaagccacaaacttaaattaacacgtatgtcatattttacagccaagtggaataaggcagtgaacaaaagtaggaaaggcttcaaataagaggctctgagcagaagtttagaggaaaaggacactgacaactccaaagaggcagggacagaagacagcaagacaggcaggcagagatggctgctctgctgtggggaacttcaagggaaaagctccaagatggcaggagccccagggtaggtacaagttccatacggtgggaagggcctcactacggtaggcaggcttgctctgtcgcccaggctggagtgcagtgacacaatctcgggttattaaatttgggtttaataaaccgaattgtcttaaaaccctcaacacagcacttacatttatactagagcttagaatttgggttttcttgttttcctgtcatatgctgtgttttgtatgatgaacgatatttaagtggacattaacaacgaccttccccaagaagtccattcttcatatacgacattctagtggggttcttcctactgtatcagatccacatacctaccaaagtgacgcccttcccactgtatcgaattcgtacctaccgaggggctcctgccatcttgaagtttttcccttgaagctccccacggcagagcagccagctttgcctgcctgccttgctgtcttccgtccctgcctctttggaactgtcttttctcagtgtcctttccctctgaagttctgctcagagtttgcctcttatttgaaagctaaattacaggacaaatattcttcatgtcacagaagggtccatccagggggactcttttacacggaaatgtgcttagtaagttcatttaacatggaaacatgatgaacttcaaagtttgaattaaggggaaataaatcaagctatggtatcaggttaaactaactgcaataaaaattacagaaccttagaaactgtaatgtgaatcagaagggaaatactgatttatcaaaatgcacttaatacaatattcaagagtgctacctggaaaaggtaaaatctacttttgcataattgattataaaattttagcttttttattcattctcaaatgcacttgatggctgtactctgtatcaggtatcaaaaaacatcctgcttcgctgaatgattactatttaccttccatttaaaaaacccaagcaagacagggccaggcacagtagctcatgcctgtaattccagtattttaggaagcccaggcaggaagatcacctgaggtcaggagatcaagacccgtctggccaacatggtgaaacctcatctctactaaaaatacaaaaattagctgagcgtggtggtgggtgcctgtaatcctagctacctaggagggtgacaccggagaattgctgaactcgggaggcagaggctaccgtgagccgagatcgcgccactgcactccagcctgggtgacagagcaagattctgtctcaaaacaaaaacaaaaacaaaaaaccctagacagtccttattcaaagttctttgtcacctgggaccctaaactgtcctggaaatgcagccaagtctatttttatttggtgcacttagcagtcacagggaagtgccattcccagacagccaagacaacgttagtttcctcaacatggtttgcgtgctgcttccctcagccctgaagggtggggacaagggtggaatggaaggtgcctgtcatagcagccagctgccaccagaacacagtaatgacccagcagcccctgcacgttagcccaatcatctgggacaggggagcaaaaacgggttgtttaccaccaccacagctgagaggggcaccagaccccggagaggtgctacagtcagctgcctatccaccctgcttacagggagaggattctccagccaagaacagtcctggaggaagaagaatgtgggggctgagctaggagctagcctttgcagaagcagccccagaccccagattcccagccacctcagattccccagccatattgtaagaacaagcaaacagacatccagagaccaggtcctttgccccaaatgctgtgagatgtagctggcaggcggcaacaagaagtcaagaaagggggaaagagcatattccagacgtgaaagcagacttggaagtgccagtccatgtacaacgcgtggaggcgtgtgggctatttgagagccacaaacagaaaatgaatgccttaagtccaaaaagtatgccagtaccaggtatgttggctcacacctataatcctggcactttgggaagccgaggcagggggactgcttgggtccagtagttcaagaccagcctgggcaacatagcgaaacccggtctctacaaaaaaaagtacaaaaattagccaggcatggtggcacatgcccatagtcctagctgctcaggaggctgaggtgggaggactgcttgagcccaggagatggaggctacagtgagtcaagatcacgtcactgcactccatcctgggtgacagagtgagaccctgactcaaaataataataaaaaggtacaccataaaatgagagaattcagaaacaactgagaagcacaacatgatggagaatcacaagctgaagaacaaccttagtgttactcatcatagactatgctgataaagaatatccgtggctgggcatggtggttcacacctgtaatcccagcactgtgggaggccaaggcaggcaggtcacctgaggtcaggcgttcgaggccagcctggccaacatggcaaaacccctcctttactaaaaatacaaaaattagcggggcatggtagtgcatgcctgtaatcccaggaggctgaggcaccagaatcacttgaatctgagaggtggaggctgcagtgagccaagatcgtgccaatgcactccagcctgggcgacaaagcaagactctgtctcaaaaaaaaaaagaatatctgcaacacatctagcaatgtatacctggagaatatatgtgctgcctttcacattttaagactctaccaacacacaggctcttgaaggaaaatttgctatgatcaaaactataaatgcatatgccttttaaccactaattctatttctatgaatctgttccatagatttgcctgtccgcataactttacaaggctattcattaaagcactgtttgtgagaagacaagactggaaataacctaaatgtccaccagtggggagaggattaaagcaattatggcacaggtcacataatggaatggtagacaactgtaagaagacaataaacgtatgcagctgtgtgtacactatgctacctcagttaagaagaaaaaggcaggaagggggaagagagaactaagagtcaacagcgtctgcctgaatacagataaaccctggaagacagcactacttccagtggttacctgggaggagctaggtggagggaggctctctctacaggttttgtcctctgagttttctgagccatgtgaatgaactactagtttaagtaattaaaggaactaattttttttttttttgagatggagtcttgatctgtcgcccaggctggaatgtagtggcgcgacctcagctcactgcaacctccaccttctgggttcaagcaattctcctgcctcagcctcctgagtggctgggactacaggtgcacgccatcacacccggctaatttttgtattttagtagagacggggtttcaccatgttggccaggacggtctcgatatcctgacctcatgatccatcaactcagccttccaaagtgcagggattacaggcgtgagcccaccgcgcccggccaagaaactgatttttttttaaggcacccccactggggatatactggcccaggtgattaacttcagcaccaggtggtaacacctggaatggttcccagtgctccagtttccagttagggtccttatgatttgaggataaaatgtgaaatgggttcactattagttcaaaatatatttagtgtacaaataagcttaaaaggctagaaaagaaaagggcactttaaagaagaacttttcgaaagtatttttttctaaagggatgtgacaatcgacatgtaacattttgtacccaacgctcacacagggaaatctgacattatttcaaaatactcaaaaattagttggctgtcatgtcttgtggcttctagcaaatcaatgaagaaacctctaatataaagatgatgttaaaaatggagcttgtgacaaagcaagtgatgatcagacgccacactaaaacacaatccattttcctatctctggatggcgcctcttaggggtaatttgtactttgttcaaataattctcattagaggtctaaaggttttgcaacaggaattaactaaaactttgcttctcaccatttaacagattctcttaatcacaaatataaaaataaaacaatacaaaaacatatatacccccaaaatgttttgttttgaatttttttaactagtttttcttttttcactatgaaagtaaatacatttatggttttttgctttgtttgaaaaaaaaccctcagaatataaaatgaaaaacagcccccaaaacatctctagctcaaccccgaaaaacaatttctagagattcccttctagaaatttcctacatacaccattagcatatctttctacccctaaaagagatctaattatcatttttgctctccatcctttgtttattgattctcagtcttttctcccctcctaagtacccatcactctccctcaactggatctgcaatgccagggaactcagctactcttctgaaggaacttcactgattttaccctttcttttctaaaggatttctgagtcatactcagtgttttacaatctctacattaattaactaaattaacgaaaaggtctggagttaatgaaaatgttcttagaagtcctacccatcaagaaactttatctgcttggtgttgaagtaggttgctaacctacagatatttctatttcaactattaaggtgggtaataaaaaccagaagttttaagaatctattccaggaattgagaaacaataaacacaacttctgtgtgagctggctgcatgacatgcattttgatgacagtagcaaaacctctaatattctttgagatgacatggaattaattttaaaaaaactttaagcctaggcaacatagcaagaccctgtctctacaaaaataataaaaaattatctgggcatggtggtgcgtgcctgtagtccaagctactgcggaggctgaagtgggaggatggcttgagcccaggagtttgaggctagagtgagctataatctcaccactgcacttcagcttaagtgacagagcaagactccgtctcaaacaaaaaacaagaaaacttcaattattcctatttatataacatagagaaaacattaaaattgttttgtgttatttatctaaatgcagcaccaaaacattttaccgttaaaaaagaagacttaattaattaaaagaaagcctgggccgagcatagtggctcacatctgtaatccctaaactttgggaggctgaggttgaaggactgcttgagcccaggagctcaagaccagcctaggcaacataggaagaccccgtatctctactaaaaaaaaaaaaaaaaaaaaaattagccaggcatagtggcatgcacctgtcatcctagctacttgggaggctgaggtgggattgcttgagcccagaaggtggacattgcagtgagctgtgatcaaataaatgcacaccagcctggcggacagagtgagaccctgtctcaaaataaataaaaataaatttaaaaaaatagaacaaagcctgcatttctaatactaacatttccaacagctctgagatatgtatcagtctgaaaggcactgatagtagagttacataaaatgggctacttagggcaaaaagagtaagaagagaccatatttgcctggctacgcacagtccatctctagaatacgtaagaaacagctaacactggttgcctatggggaggggaatgaccagtgaccccagaaacagacaggaggaagagttttcaccaattactctgcttttttggaattctgaaccatatgaatatattatctactcacaagaacttaaaaaaacttttaaaagaaaattgtttgtacaaaaatttactaacatcttaaataagaacactagttccagttcttaagctgcttttcatggggcccttttcctgccaaaaacggggctcaggaggggaaagcattgtctactctccctacagacctgaacttggatgaaaaaacacaccttgaaaaagctaatctagacttctggaaaataaatcacaggagctcccccaatcactctggacacgggttttttaaagcttaattttgttttataagccctaaaaaaaaataataacctggactcctaggtctgacattcaaggcccttggtgatgttatctcgccttcagatgcccaagctgatgctctactcaccctcaatgagctctggtgtccttcctccaacaagcctccctgaccacccagcctgaggcatccacttccttccagtcagacatcgagctgagtgtgaaatgctataggccacggtgggcaccacgggactgctcacccaccacaccacacaactcagagttccatgaggacagaagcagcttctgccactactgtcatcaccacagcccagcagggtgccccacacgtaaaatgtgcttaaatatttgctgaataaaagaatgaagtggtaggagtcaagactggatcccgggccgaccaacccccgcagggcagaaccacacctttagtctccaccatctcagaagcaaaaccatgaggcctcctaaattctggtagcccagtgaacataacccaaaaactgtcacaagagccagacctccaccctgctatgagtgctgttccctctgcctggaacagtactatctgccatctcctattcaccctcaggtgtcagtgctaacgtcacagcccccggggacttccaatacccttcaaaacaggctcagtccccatctggtgcctcagtcaatgcacagtatgtcccctccaaggtcacacctgactgcagttacctgtccagtatccatcaccacccatgagggcagagatggggcctgtcacatccccactggatcgccagggcctacatcacagcataacaaatattttctaaattagtgaataatcctgaacagtgtgacctaagccgtgaatatttttgaaggagtctttcatcatttttaatttggagtcttgcatctttaaaagatgatcgttttaaaggaactttgtcataaatatctaggtgatacgtatcttaaagaaaactctagacaaagaggataagtaaatgtacttacagttgtgctgtccaataccgtagtgactaactacatgtggctatcttcatttactcaaaccaggtaacatttaaaatttagttcctaagtcacactaatcacaattcaagtactcaacagccacacgtggctcgtggttccagtactgtgtcatatagacacagcgtagagccgccctcccaataacgaccactggacagcgctggcttggagggcatcccgagaacacaggcatccccaaacaaggaaacatctcaattcaccctcttcctcctgggaaagaatccgttctcccctaaagtttcagtgactgagaaagccatcagtgaaagcaaaacacttgattctcttgccatcattcaaatgattccctcagagacttctcaacagaagttcaactacgggcaggtgtgctcttcaaacaaaaaccgattcccacagtagtagaggaacaaccacaatgacacagaaaacctatcaatatgttatgtctttttgttattttcaataaaggtgacgttctgaatatgtaaatcagatttaagtaaagatatccacaaatcggggaaaaattttgtccaccacggggtaacttttacttataaaaaaaaaaaatcacaccaaatctaggagaacagaaaaacagtaatctccattaaaagaatttcctactatagaatctgcaggaggagaaaagtcacacagtacagcacagagctgaatctgttcctttcaagatctgtgtagctgagcccgagaggcaattgagtttcactggtattcctttcaaccaacctgactaaactggacagtgatcccaaggccattttcttcccaactctgttttcaataaaatactatatttataatttctctgcatttacttttcccttttctctaagtcctaatctaaatcaagcccttgttctgaagcaataactagaaacagagttccatttaattaagagttcaattttccaataaaaaacagttgaactgcaaacacagacggagtaaaatgagtcaaacgattacccattttgtaagattctcgaatcttagttcgttttcttacaaactggttcccaaactgcactagagctggcactgaaagccaaacaggcaggggcagaagcttcccatgtattcagtgagaagcctcctgattccgggtcaggctacatcatcttagtcctcactggcccaagaagtaggtgatggctaatattttcccatacaattaaacaataaaaacagctgcctcaacctgctatatgccaggcaccctagtagccccatgtaccaagataatcaaagtaagcagaagtagagccaggcacagtggctccatctcacacctgtaattccagctactcaggaggccgaggcaggattgctgaaggatgggagttcaagaccagcttgggcaagcaagaccccattggaaagaagaaaagtaatgtaaagaaggggaggggaaggggaaggggaaggaaggaaaagaaagaaagagaaaaaaagaaggaaggaaggaaggaaaagagaaagaaagaaagaaaaaagaaagaaagaagagagaagagaaagaaaagaaacaaatggaatactgcagggtaaaaagccccttttagagatctctctctctctctctctctcactcacacacacacacacacacacacacacacacacaccccaccctgcaaaactcaaatgtgatgtcaccagcccaagtcacagcgctgccgagctgggagctgggactcacagtctactctgagcaggagccagggctccctcctcagcaccacactgaccgcctccccgtataaaaagctgacatttccttcaactgtgactcacagttagaaggttctacttttaatcaggtgacaaatactcaaaatattttaatccaaagcaactgggtcaaactcgtagagtctataattgtctaagcaaaccctaattacctgataaatttctatagctcctgaatgtcctcattcagtttgtaatcaaatacccaaatctccttatttaaatgttgtacaagccttctctacatgttatcatacagaacagtgacttatttttctatttcactggttattttaaccataaagttaaaacatgtttaggtggtgcagttttaataagaaaaatccaaactagggggaggagaagcagcttgtgaattataaaaagatttgctttacaacagaattgtacaactccactacacaactactttttctccttaccacagattatgcaaattcgaaaggttgaattaggtgcaactggaaaatatacctactgtatacaatatagtacaggcatattagaaaggcaaattaagacattttcaaacaatagcagacagtacaactagaaatgggaaagtaaagtcagatttaatcatgtagaattattttccccattagattttactattcttagcaatggttcaactaaacagtcttttgattaatggaaatgaaacaccggggaaaatgtcacacgggataatatccaaatctttcttaagggtaagttttaaaaggaattcaacttttagagacagagctcaaaaatagccttgcttcctaaatttagaaccagaaaacaccctaaaggcagtattttaaatacagccacagtcaccgcctatattgtctaggaacttaataaaaaaaactttaaaaagagaggggccacttttgtttacttccatgcctttcacacagccttgcccaatttgatttgtgtgcccttgctcaaatctcttcaagtcacagctcaaatggcaaagacctgaccactccaggacgccccggggactctgctcgtggcctattgtagcacccctgtcagcagagcacggccccagggaaaggagaacaggcaaaagcccccacaggcactgctcccaaggcttacacttctgcatcaaagactcatgcaataggagaattttgccgaaagccaagtttgagcctgactgagaagagcagcatccttttccagttaaagcaaggagtgtatccggagggatgcactgcaaggaaaagacctcagagaggactaaagggaacgctgagcgcatgtgctaaaaagcagacggcacggccaggagcttcagagcctaggagagacgggacaaccagaagaggactcagatgtgagcaagccatgggcctacaacgataccccaggaaacaaactgtcatggtcagggtgcttttcccaacaaccaggaatgcatggaaaacaggcaggcttccccaactcctggctctgtgctggctcagcagaagagctgtcacaggagcccaaggctcctcaaccatcccagggcctgcctcccactggggcatgcggccctggacttctgcacacggggacactcaggaaacaggggagggagtaaatgaagccttattcagatcaccctttctggttccagagtttttgcacttgactgcatttctgtaccctttccttaagttttgcctcgaggtttcatcttctcaagatggttctaagtactcacaggcatctatcagaatcctgtgtacactgctaatgcttaacaggtacctcaagataaattatacacagtaaacaaacagaatcacatacttgtctgctgcttaaacagtccatgaaatatgcttcaaaattatcaataattttcagtgtacatcctgatttgatttaaaagaaaaaataattcagaacacacaccatttaagttttcgtaattttaagctttcatggccatcacgttcctatttttaaaaatacaataaaaaatggagacagagtcaatggtatagatgacagaattcccggctatgtatctgctgaggtgctacactatcacacgcgtgcctgcacactggtttctgtggatacgagcacacatggcttctgtcctttccagaactgctgagaaacaggtcttgctccaatcagactagcactcccagtaagtcctaggacttacaaggtacgacaacgtccctggttaacgctagtgtcagttcccattgggcggatatgccagacacacatcatctcaggctaccctcataaccaccctgagatgggaattgttattatctccatgttacagatgaggaaactctgagctcagagagctgatgtaacttgccccaaacatgctctggcctcagcactcctaaggccagctggtttggtggccgggtgggagcccatgggtacggaactcggaagcaaataacagacccaattagaagataggtggcaatctgcttgaaagtaaaaccttaacaagaaaatgataagaactttaagggacaaatactatataattctttcactaattccctcaaatatttcctgagggcctactatgtgtcaggcactgcccctggggagggaagtgctgggaagagggccgtggaaaggctctggagttcttactgacgctcaccttctggtgtcacaggaaggggagcaagcctagagcctgagatgacaaagacggacgagaaatgccatgtgggccactggggtcaacaaaaagcaaaagaacaaagaaaaatgcaaccggtcaccaggctttctgataaattcgtctgattttaaatcaagtcatccatataactgttacagaggaacaaaaaagacagagagagagggccctgctaagctctgaagtgctccaagacaggagacccaagctagcctgctgctcacctgggctctcccgggctccacatcatgcagctcagaaaacttgccctgctgctgttttccttaaagctgtctgtgcagccgtggtaggccagtgctccccaacgggtgctcagagaatgaagtcccacgttatatcagtcaccaaattgcagcccatgggcgaagtcctcagatgccagtctttacaactagagttttactggaacacagccaggcccactcgcctatggctactttcttgctgaaatggcagccttgagtagttgcaacaagagaccatatggctcagaaagccaaatgcgtgctctctggccctttgcagaggaagtctgcggacccataataggctaaaaagagttctagcgtcaaacaggattgagagtggtccaactgtagcccctctctcacagtgcccaatcaggacaccaaggctctgggaaagtctgcagtcaaattcctcagctacaagcaacagcatctgagcacaaaccatttgttgagaaatacctcttagcatgccctctagtttcttggaatacatgtgaagagctggtttgagtaaggtaaagaggggtgccctcactaatgggaccccaaaaactaaactgacaagcttttgcaatcttcagaaactcacaataaggtacatttcatcttaactaaggtaagacacactttggcaaaatcattttcctaactgttttcaaatacatcaagtaaaaacacaagtcagcaattatggaccccccaggtaatcacatactttgccacacaattacaacacactacttagaagctgtgaaaacacaggcgactaatctaagcatcaacttccaactgcaggactcagtctctttgtaagttatgttcaattctgtttacagaatcaaatctgaatgttcagccaggagcgactttccatcttctgaaggccctctaaggcgccctgcacatgacttgtccttgcctaccttcatccctgacgacctttgaatggggccaccgctctcacccctctcagttattcaaaaacgaagcacggtcatgaaatgtcctagtcctaaaagtctctatgacaacttttattcctacttagccagaactcactgatggggtaacataaccgtttctcattctccctgaggtaaacaggaacacgagcccacacacgtcacgctgaggataacaccagaaccagagggaaaagggggacgccctaacccaggaggaagaatacactcctggctgcccccaccacaggtggttacaaacctcccccttagtgatctcattcatgtgcgggaaggccgctactgaaactcactaagcttggcaggttcctgggtcgattcaagtaaatgcattgtttacagatagagacttagaaaataaatatatagagctacggactttaacaatctagtttggatctggttttgaccctgtatcacctctcaagtccagttcctcacctagaaaatagcagtaacagcatcttcccttcctcacaggacgctgtaaggatcaaactgaggtgacgtggagaaaagcactctgatacataaagtaccagacatacataacagaccatttggttgacaaccatattcgccaccagctttctttaaataagcttccctattgcatttaaaaggattcacgtcataaaatgtaatcacaactgcttagagccacttatacagcacaggatgaaacacagctatgttcaatcttcagaatgtagtttttcttttcctttttcccccagagacagggtctcactctgtcacccaggccagagtgcagtggcatgatcacagctcactgcagcctcgacctcctgggctcaagcgatcctcctgccacagcctcctgaatagctgggattacaggattgtactattacacccaactaattaaaaaaattttttgtttagatggggtctcactatgttgtccaggctggtctccaactgctggcctcaagcaatcctcctgtctcagtctccctaagcactgggattataggcatgagccaccaccctggcctgcaatttcaaaaaactttataaacagtctgttgtgtgcaaattttgcaataaagctgaccaaaaaaaaaaaaaaaaaaaaaaaaaaacaacccagaaaacaaaaaacaaaagtctactgcttgcctggatatttgtcttatactgttaaatcatgaatctctgatgttgaaagacacaatatgctattttaacttggacatattaaataaagaagtttccaaaacacccaactaactatataccggtaatataaagtccccacttattgtaagggtgccaagtaaaggaagacctcatgtatgagaaagtgtaaaggcttctacataatacaagaaaatgctactttaacatctgaggccatcaaattctgtgcctctccagggctgctgcttcagtggggtgaaaggtaccgtttctctcttgctaccctcattcgcagcacattccgtatttctgcatcatctctgcataagcttcccaggcttcggcaacttgtttgtcatcagtggcagtgacattcatcactctgaggtgctgcatgaccttcgggagtgctgtttgcaacatccatgcccccagatgagcagcaccctggctgagcagctccccaatgtcgggtgcatttttctctcagctcactgccacccttcacagacacatctaagtgacactggtggccccacaggccagtctctacagacatgcactgcagtccaagtagatcctgtttctcaggctgccaagggctcctcctcctttcaacccctcagctcctagacagaggtcccctccctcaaatttgatcacatgcaccgggcacacaccctgctccactaggcccaattttcccctgggagcctcagagacacatcccgtcactaaaataagattgagttcctcaagaatgttattctcaggtctgtcccacctaaccaaatgccttcagtttttgaatgtatttaatgtaaaaactcaagccatttatttgtttaaaatacatccctaagatctctgtccatctcattactcaatttcttagtggagcagttacaacagacaaagtgtccctcgtttcttttggagacagcgtctcactccattacccaggctggagtgcagtggcgcgatcttggctcactgcaacctctgcctcccgagttcaagcaattgtcatgcctcagcctctcaagtagctggaattacaggtgcatgtcaccatgcctggctatgtttttgtattttgagtacagatggggtttccccatgttggccaggctggtcttgaactcctgacctgaagttgatccaccagcctccgcctcccaaagtgctgggattacaggcatgagccatggcgcccagcagccccttgtttaatgtgcttgataatgagcccttccttggtcccccatactaacagaccctttcacaatagtgtgatggtgatgaatgtgtaacacatgacccaacttaagtatgatgttgactttctactttggattaaatcggagccatttaaagctgacttttggtcccacgaaagagcccctgtgccttacaaggatcaaaattgtaaaggaagggggaaaaggtggttaagtgtggaaaatcctttctgatcaacttattaagcatctgatcatccaataatggacactactatggaaaaagctaacctttgggctccatcttggaaacagctggatgtacatataaggacatgcctttttgttaagtcttgtgttactaattgtccccctttttaagacaaaatctacaacaaattcattcaacaacagcaaagctacaaagccatccaggttaccagtttcagaagacaagcttcaaagctgaactcgccacgtatgacctacgtctcacagaactgaagactactcaaacacagcaagattaatgaagcaacggagatctgttttgcagtacaacggcatttaaactactgtttccaaatttctcacttcaataagttcattttataagattaacgtcaaactcaacttttatcagctaaaaagaaaagcattagtgatttttatataccatgagcatcatttactcctccccactgtttaacaaattttaactagataagaatctccttatgattgatctttaaaaatcgcttttcacttctacattaatattaaacgtcgcttatcataacttgattccaggaattgtattcaaacttaagccacaaaattcaggttttgtttcaacagcaatagcagttttttttaatatgctagtggtcggtcacagaactatttccacaagttgaacagctgtgtctagtgcaaatctgaaggcagcgatgtaattcaatttggactcattcattagaaactgattttcagatgctaccactgcaagactactggagaaatgcaagctgcgctggagatggaattgttcgcagcggcacacaagtttttgcggcaaaggagagagctctaaaagaggaaatacaactagttcatgttaccatgaaccagcgcagtgggacccagaattactgaattaatagaaaactaaatacttctcttaagcagctatgataacttaagaaagtttccagggaagccgtttaatgaaaggaaacaaacaaaaagatgatttattcagtatcctgctccatttttttgaaaaattggaattcctacattccttaattctttgtacatctacactgtgaaagcaacacaaactcaaatggagattgcagcccaaatgaacttaaacctgctgtttaactttcttttgaagttatacatggaaatgaaacacaccacagcaactttcatgacatcttgctaacgaagtttgggttttgaaaaatggaatgactagttgactaaaaacacacacgcgcgcacacacacacacacacacacacacacaaaacaaggagttttgaaaataagcactaagcatctttccaaggaactcactcattccaagaaacttcggttctaactcgcaagctggcggctgctgtgagtgtcctctgaatgcagcctggtcaatgtgtcgccaatccagaaaacacactgccctacctttggccgcgatcttgctttctctaagcatcaaaggtaccctccgctgtcattcctctggacggccacgcgtgtggacacggccgcggatggatgcgtaggacattaccaaacaaacccacacgctgcactttacttcttccctcctggagtgccactagggtccccgcgaggagggctgatcgggtgcggggaggccgagtgcaccgggcgtgtgctgaccaactcgggcccagtgacagtcctgcgacgaacttccaccctcccgcgcggggcgaggggaacgggctgcggggcctgctccgagctcccggctcgatcggtatccgcgaccacgacccccggacgctctctttcaggtgggggtgacagcgcgccccgggcccccgccgccccggaccccctcctcacctgtgctgtcattcgccgagaaaccgggcgagctgagtttggctcttttggggttgggcggtccgtccagcaagttctcagccattttcacctgctcgcgaaaacagccccgggcacgggcggccgggccggcgagggcccggacgggggtcgggggccctgccggctgcgagggagaggagcgagcgcgggccgcgagcgggcgggcgggcgccgagggagagggagggcgcaggccgggtgggggaggcggcggccaaatctcagccacagcaacagcgccccgcag

SEQ ID NO: 812 - DNA, 155067 bp, Homo sapiens; identical to SEQ ID NO: 811

SEQ ID NO: 813 - DNA, 80464 bp, Homo sapiens
ctactgttaaataatttctctttataaacatagtgacaacaagattgtacagtatcaattaaaaagacccaatgtgaccaggtccactgcttcctgcatcttgaagtaagacaagtgttcagcttagagatgagcacctttctttccagagggagaagacatgatgggagaaaaaaatgttctctctgagaatttacccagataaagagctgggtagtcggatctaaatggtcccacagcaatccttttctcgggggaggtgcgtagatctttgacaagtgatgaacgaactttgcttcgtgtggttaggcctgggactgaactttgtaaccagggatttggtgcgcggggcttcacaggctgcagagaaacatgaaaacatgagtgcatatgccaaacgtgtctcatgtgagcggcagagcccaagtgaaggcctctttggctatagggtgtctcctttttttttttctttttgagacggagtcccactctgtcgcccaggctggagttcagtggcgcaatctcggcttactgcaatctccgactcccgggttcaagtgattctcttgcctcagcctctgaagcagctgggattacaggcgcccgccaccacgcccagctaatttttttgtttgtttgtttgttttttttgagacggagtctcacactctctcccaggctggagtgcagtggcgccatctcggctcactgccagctccgcctcccgggttcacgccattctcctgcctcagcctcccgagtagctgggactacaggcgcccaccaccacgcccagctaattttttgtatttttagtagagacgaggtttcaccgtgttagccaggagggtctcaatctcctgaccttgtgaccagcccgcctcggcctcccaaagtgctgggattacggtgtcagccactgcgcccggcgtttttttttctttctttctttctttcttttttttttttttttgagacggagtttcgctcttgttgcccaggctggggtgcaatggtgcgatctcggctcaccgcaacctctgcccccagagttcaagggattctcctgcctcagcctcccaagtagctgggattacaggcatgcgccaccacaccctactaattttgtatttttagtagagacagcgtttctccatgttggccaggctggtctcgaactcaggtgatccgccggcctcggcctcccaaagtgctgggattacaggcatgagcctccgctcccggccacgcccagctaatttttttgtatttttagtagagacagggtttcaccatgttggccaggctggtcttgaactcctgacctcatgatctgcctgcctcagcctcccaaagtgctgagattacaggcgtgagccaccatgcccagagattattctttaattaatctcaaaagcctaacaccagggtagtctctctcagcctactctggcttgaaaagctgcccattaaaaaataaaaataaaagcctaacaccagagttcgatatatgttcactcacacatttgtagaaggaacacaatatctcttataatattctttacttcactaataagttataatttcagctatacattatatggcgttattactagttaagtaataaaaccaatgtattatttatcttgtttttcatttcttaaaaaatgaataattggctgggcacggtggctcacacctgtgatcccagcactttgggaggccaaggcaggcagctcacttgaggtcgggagttcaagaccagcctggccaacatggtgaaaccccatctctactaaaaatacaaaaattagccaggcatggcgcagatgcctgtaatctcagctactcgggaggctgaggcagaagaatcgcttgaaccaggaggcagaggttgcagtgagccaagattgcgccactgtactctagcctgggcgacagagagagactttgtctcaaaataaaaaaagattaatcaattataatggaccatattattttaattttaattttcaagatttattcttatatttgttatatttatttttaatattttattatgttttttgaatattgtatgtgaaataaaaaatgaagtcatgatacaaagtaagtctgacctgtacatgaatgtttgtagaagctttattataatcacccaaaactagaagcaaccaagatgtctttcaagaagtgaatgaacaaactggtgcacctacacaatggaagagtattcagaggtaaaaagaaacgatgcctggcgcggtggctcatacttgtaatctcagcactttgggaggccaaggcaggcggatcacaaggtcaggagttcgagaccagcctgactaacatggtgaaaccctgtctcttgtaaaaatacaaaaattacctgggcgtggtggcatgtgcctgtatttccactacttaggaggctgaggcagaagaatcgattgaacccgggggtcagaggttgcagtgagccgagaacacaccactgcactccagcctgggcagcagagcaagactccatctcaaaaaaaaaagaaagaaagaaagaaagaaatgagctgtgaagccagaaaaagacatgcattattttaattattttagtagagacagaactagtagagttaattattttagtagagacatgaacctcttcaaatgtgtattgctgccaggaggttggctgacgcctgtaatcccagcaatttgggaggccgaggcaggcagatcacttgaggtcaggagtttgagaccagcttggccaacatggtgaaaccccatctttactaaaaatacaaaaattagcggggggtggcggtgcacgcctgtaatcccagctacttgggaggctgaggcacgagaatcacttgaacccgggagtgagatattgcagtgaggtgagatggtgccactgcacttcaacctgggcaacaaagtgagactgtgtctcaaagaaaaaaaaagatatgtattgctaggtgaaagaaggcagccggaaaaggcaacatactgtataattccaattatatgacattgtgtaaaagacaaagctatagagatagtaaaaaaaggccgggcatggtggctcatgcctgtaatcccaagcactttgggaggccgacgcgggcggatcacgaggtcaggagatcgagaccatcctggctaacaaggtgaaaccccgtctctactaaaaatacaaaaaaaaaattagccgggcatggtggcgggcacctgtagtcccagctactcgggaggctgaggcaggagaatggcgtgaacctgggaggcggagcttgcagtgagccaagatcgtgccactgcactccagcctgggtgacagagcgagactccatctcaaaaaaaaataaaaaaataaaaacatcagtagttgtccagctactcgggaggctgaggtgggaggatcacttgagcaggggcagttgaggctgcagtgagccatgatcataccactgcaactccagcttaggcaacaggaggagaccctgtctcaaaataaaaaacaaaaacaaaacaaaaaaaggagaggaaaaaagaaaaatcagtggttgacaggtatttgtggggaggaaaggagggttgaataagtgaagcacaggccgggcacactggctcacgcctgtaatcccagcactttaggaggcccacgcaggcagatgacttgaggccaagagtttgagaccagcctggccaacatggtgaaacccagtctctactaaaaatacaaaaattaggccgggcacagtggctcacacctgtaaccccagcactttggaagcctgaggcgggcagatcacctgaggtcagaagttcaagaccagcctggccaatgtggtgaaactctgtctctactaaaaattcaaaaattaaccaggcatggtggcaggcgattgtaatcctagctactcaggaggctgaggcaggagaattacttgaacccagaaggcggaggctgcaatgggccgagactgcgccactgcactccagtctgggcgacacagccagacttcgagactccatctcaaacaaaaaaagggaagcacaggagactttttaaggtggtgaaactattctgaatattctgtataatatatgatggttacatgacattattcatttgttaaaacctgtagaactttacagcaagaagagtgaaccttattttttgagacagagtttcactcttgtcacccaggctggagtgcaatggtgcaatctcggctcaccataacctccgccttccaaattcaagcttcttttaaatgcctcagccacccaagtagctgagattacaggcacacaccaccatgcccagttagtttttgtatttttagtagagatgggggtttcaccatgttggccaggctggtctggaactcctggccctcaggtgatccacccatctcagcctcccaaagtgctgggattgcaggcatgaggcaccccacccagccagagtaaacgttaatgtatgcaaattaaaacaaaaacatttaggaagtaaggggatctaggaaggaatacggactgcatgtagcaagagaaccaaatgtatagagcaacttcagtgaagggagtaggaaaaacttcggaaatgtgtggaatctataagactaaatacaacaggaattgcacatagcactgtactctagttaataaaattgtttcccaggggagtgtgggttaatatttctgatttatgtatggaaaattggaacatgaagtatactaataataattgtaatgattacctgaaagaaatatagacagtcttctagtcatggagaataaattttaaaaccttcattttttacatcaggtgttttttatttgtttgtttgttttttagagacctggtcttactatgttgccccagctgccagagtgcaggagctagtacctattcacaggcacgatcatagctcactataaacttgaactcctgggctcaagtgatcctcctgtctctggcctcacatgtagctaaaactacgtgtaccatcatgccccaaccctcaatttaaatacagatttttgttgcagatgtgatgatgaaaaataaatactttcaagcacaattgtatattaggataaaattctgtgtggaagttacttcataaaggaaatgtgagcgtttttttttaagatgtaattttaattttaaagaagagcttacatattttatttttaaaatggatgatggtagttatcaaactgttatggcatttagattcaaatggatgcatttaaattcagttttgaacttaaaatatcaatatgtaaagctggaatacttacatgtttgaaattaaactctgcttctatttaaaatgaaaacattttagatgtcaattttttttttttgagacggagtctcatctctgtcacccaggctgtagtacagtggctcaatctcaggctcactgcaacctccgcctctcaggttcaagcgattatcctgtctcagcctcccgagtagctgggattacaggcatgcaccaccatacctggctaatttttctttattttcagtagagacggggttttaccatgttggccaggctggtctcaaactcccgacctcaggtgatccacttgcctctgcctcccaaagtgctgggattgcaggcgtgagccatcatgcctggcctcattttagatgtcaatttaagaaggtaaagaggtgacatcatttttcaaaattattttataggttatatgagcaagcaaaagagttggaaattcaacatcctagatagcatctgttacgacgtatagcaagactcagccaatttgttctgtaaaaggccagatagtagatatttcaggcttttggggccagatggcctattcaaactgtggttttttgtttgtttgtttgtttgtcattgagagggagtcttgccctgttgcccaggctggagtgcagtggcgcgatcctggctcactgcaacctctgtctcccgcattcaagcaattctggtgcctcagccacctgagtagctgggattataggcacatgccaccacacccggctaatttttgtattttttagtagagacggggtttcactatgttggccaggctggtctcgaactcctggccccaagtgatcctcccgcctcagcctcccaaagtgctgggattacaggcatgagccaccacacccagcctaaactttatattaacatcctaaagttaaacatgaaaattcttctataacaaataatcccattgcccagagggaacttctttctgtcttcagtttggtttatatctttccagatattcaactatgcaggcagacacacacacacacacacacagacacacacacacacacacacacacacacatatatggttttaaataaattttacataatgtaggctcatgcctgtaatcccagcactttggaaggctgaggcaggtggatcacctgaggtcagcagtttgagaccagcttagccaatatggtgaaaccttgtcactactaaaaatagaaaaattggctgggcatggtggcaagcgcctgtaatcccaactacttgggaggctgaagcaggagaatcgcttgaacctgggaggtggaggatgcagtgagccgagattgcaccactgcactccagcctgggtgacagagggaaactctgtctcaaaaaagaaaaaagaataaagaaaagaaaagaaaattatatataatgtatattggctgcattttttaagcaaaaaatgggacaacatattgttctataatttgattttttaacacgttatagacatttccttgtcattcctttaaataactattgattggtagatatttgagtaatttccagttttgaaattaaaagcaacaaccatctatgtgtaaatatctttgtacacatgggtgaattttttttttttttttcgagacagggtttggctctattgcccaggctggagtgcagtggcgccatctcagctcactgcaacctctgcatcccaggctcaagccatcctcccaccttagcctccctagtagctgggaccacaggtgtacatcaccatgcctggctaatttttgtatttaaaatttttcggcttggcatggcagctcattcctgtaatcccagcactttgggaggccaaggcagttggatcacttagggcaaggagttcaagaccagcctggccaacatggcaaaactccatctcaactaaaaatacaaaaattagttgggcatcgtggcacatgcctgtaatccaagctactcaggtgaggcacaagaatcgcttgaacctggcaggtggaggttgcagtgagccaagatcacgccactgcatttcaggctaggtgacaaagcaagactctgtctcaaaaaaaaaaaaaatgctgatttttcatagcaacagcgtctcaccatgttgctcaggctggtctggaactcttgagttcaagcaatccacctgcctcagcctaccaaagtgttgggattatcggtgttagccactgcacctggccagtgaatattttttaaggatagatttctagatgtagaattactactgggtcaaagatatcaaaattttgtattgatgaattgtcatctaaaagtttttaccagggtttctcaatcctggtactattgacatttgggcccagatactccttggttatggggtttcattgtacattgtagaatgttttacagcatccctcaatgctagtagcacccccactgttggacaaccaaaaatatctctagatattgctaaatgacccctgggggtgcaaaatagccccaggttcagaaccactgcctcggacatttgctttcttttactttccttttatttctctttctcaccatctccctttcaacaactcatgctatccttccttcttaaagaaaagaacttatgaggctgggtgtggtggctcacgcccgtaattccagcactttgggagactgaggcaggtggcttgcctgagtccaggagttcaagaccagcttgaccaacatggcgaaaccccgtctctagtgaaaatacaaaaattagccgggtgtggtggcctgcgcctgtaatcccagctacttgggaggtggagacaggagaattgcttgaacccaggaggcggagattgcagtgagccgagatcgtgccattgcactccagcctgggcaacagagtgagactctgtcttgaaaaaaaaaaagaaaggaacttataatttagtatatatcacccttccttcccagtatatttacactttagatatagatgaagtgaaagtgacaatgactaattcaagaataactatctaatgatgggatgaattttgatgggagagataatttggggtactttcctgataggctttaaatcatactatgtacacttaaacatcctgttggctctattcatcttcttttctgtagaagtttctctgaataacaatgattagcatctatattcagaatgtcaagttcctggcccagcgcgatggctcacgcctgtaatcccagcactttgggaggccaaggcgggcagatcatgaggtcaggagatggagaccatcctggctaacatggtgaaaccccgtctgtactaaaaataataataataataattaaaaaaagaatgtcaatttcctttgatttttttaaaagggaattctattgattcaaaacaaaaaaaaaaagaagagaaaggtaagcaatgcttaaaaatcaagaaaaatgagatgaattagggaaagtaaagtttattgtttaaaaaatactatattttggctgggcacagtggctcgcgcctgtaatcccagcactttgggaggctgaggcaggcagatcacctgaggtcaggagtttgagaccagcctggccaacatgggaaaccccatctctactaaaaatacaaaaattagttgggcatggtagggggtgcctgtaatcccagctactcgggaggctgaggcaggagaaaattgcttgaatctgggaggcagaggttgtagtgggccaagatagcaccactgcactccagcctggatgacagagcaagactctatctcaaaacaaacaaacaaacaaagcctatatttttagcagggcatggtggctcatgcttgtaatcccagggcagtgtgctaaatgcaagacgggatagaaaaaggcataaggaagtcttttccttgaattttaggaaggaatgtgacaagaacatgaattaccagcacaatgtgttaaattcatgtgaaagagtcaaaattctcttgagatgaaggagatggtagcgcctttggagaggagatggaatgtgaaatgggctttaattagggttttgacaaaagataattgggggacaatatgcagaggaaacagcctgagaaaacatataaaggatgatataggtaagcaacagcaaacagtctagcttgtagaagtagagtttacaggggttggggatgataggctgtaacattatgtgactccagtacctagctgaggaacttggatttgtcaatggggcacctaggtagattttgagtagggtgatgacaggtttggggcctcaacttgagaaaattcatcttgtagctatctgtggtataaattggcatgggggctgataaggtttggctctgtgtccccacccaaatctcatgttgaattgtaatctccaatgttagatgagggacctggtgggaggtgattagatcatgggggcagatttcccccttgctgctctcatgatggtggttgagttctcacaagatctggttgcttttgtttgagacggagtctcgctgtgtcgcccaggctggagtgcagtagcgtgatcttgactcactgcgacctccacttcccgggttcatgcaattctcctgcctcagcctccagagtagctgggatgacaggggcgtgccactatgcccggctaattttttgtatttttagtagagatggggtttcactgtgctagccaggatggtcttgatctcctgacctcatgatccacccaccttggcctcctgaagtgctgggattacaggcatgagcttgcttccccttcaccttccaccatgattttaagtttctttaggcctccccaaccatgcttcctctacagcctgaggaactgtgagccaattaaacctcttttctttataaattactcagtctcaggtagttctttatagcaatgtgagaatggctaatacaggagcaattaatggtaaagagacagtcgggcaccgcggctcatgcctgtaatcccagcactttgggaggccgagataggtggatcacctgaggtcaggaattcgagaccagcctgaccaacatggtgaaaccctgtctctactaaaaatacaaaaattagcttcggtggtagcaggtgcctgtaatcccagctacctgggaggctgaggcaggagaatcgcttgaacctgggaggtggaggttgcagtgagccaagattgggccattgcaacacagaggttggggtaacacagcaagaccctgtctcaaaaaaataaaataaaaataaaaaataaaggtaaagagactagttgggaggctatttgtaataaaccaggatttgtctgcctcaacactacactactgacattttgcatcagacaattatttgttgtgggagggttgtccttagtattgtagaatgtttagtagtgtctctagtgtctgtttactagatgttagacaacccctagccccctatatgacattgccaaatgtccctatggagacaatatcacccccagttgataactgtgtgtgtaacagaccatgtgagaaataaaaaagggtggatgttagacatgggtaaggacaaaatctaaaagccttggcaagtgtttggataggcttgcaactgagaaagagggagtgttgaaagctcaaacagagaaaggtcctagaggccatgtactgtagtctaatatgcttatcattgcttgaaacattgtaaaccctcttggaaggcagtttggtaaaacctattaataatcacaaaaagtatcttactttttgacccagcacttttatttctgggagtttatcttaaatgattcaaatgaagacaaggaatctttatgtacaaagcaattagttgcatgacagacagtgaccacgttctcaaaaattacacccgcatgccaccacattgcctgttaaattagaagccgatttaagatcctgagtttaagagccaaagaagttgtagctaaagaaacaaaatcccagaggggcaggaagggcagatatcaagaatgcaagtagagaaattcttaacttatttttcagagagaggacaatgaatttgagaatttgtattggagaaaagagggagagaagttaggtggaggaactcctagataaggcttcaatcagtgaattcatctgcagagcagaagtttctgcggaactcaaactgcctgggggcattccttgaaaagaagaattctgcactttttggtgggaacctgccggtggaacatcctgtttagaaatgaggacatccaaggaacactgcaatgtgcagagactagaaggaaaaaacagtcaagtagccatttctcctggggagtctctagtaacttgattttgtgcttcttcttgttttttgagacaagagtctcactctgtcgcccaggctggagtgcaatggtacgatctcggctcactgcaacctccacctcccgagttcaagcaattctcctgtctcagcctcccgagtagctgggactacaggtgcaagtcaccacacctggctaatttttgtaatttttaaattattatttatttttatttttttgaggcggagtctcgctctgtcgcccaggctggagtgcagtggcgccatctcggctcactgcaagctctgcctcccgggttcacgccatcctcctgcctcagcctcccgagtagccgggactacaggcgcccagcaccacgtccggctagttttttgtatttttcttttttagtagagacggggtttcaccgtgttagccaggatggtctcgatctcctgacctcgtgatccgcccgcctcggcctcccaaagtgctgggattacaggcggagccaccgcgcccggccaatttttgtagttttagtacagacggggtttcaccatactggtcaggctggtctcgaactcctgacctcaggtgatccacacacctcggcctccgaaagtgctaggattacagtcgtgaaccaccgcgcttggccgcaacttgatttttaaattgctctctgagtgtagattccttgtttgtttggcaagggttcttgccgctgccgctacagcttgaagccaaacatttaatgaaagagagcgggaggggccgaatagaagaatgatgggcgtggccaaccccgaggtggctggaggccgcgcccccttcccagagtgcaccgcagccgctgcattcaggaaccgctttagcttcgcccccggccggccgggcggggaagactggtgtggtctggccatggatgggctccaggccagtgcagggccgttgaggcgcgggcggccgaagcgccggcgcaagccccagccacacagcgggtcggtcctggccctgcccttgaggtccaggaagatacgaaagcagctgcgaagtgttgtatcccgcatggcagcgctgaggacgcagacgctgcctagcgagaactcggaggaatcgagggtggagtcgacggccgacgacctgggggacgcgctacccggtggggcggcggtggcggcgtcccggacgcagcccggcgagagccatacggccacctggggcccgcagagctgctggaggcctcgcccgccgcgcgctccctgcagaccccgtcggcgcgcctggtgcccgcttccgcgccgcccgcgcgcctggtggaggtgcccgccgcgccggtccgggtggtggagacctcggccctgctgtgcaccgcgcaacacttagcggccgtccagtcgtccggggcccctgcgacggcgtcggggccgcaggtggataacacgggtggggagccggcctgggactccccgctgcggcgcgtcttggccgagctgaaccgcatccccagcagccggcggcgagcggcccgcctctttgagtggctcatcgcgcccatgccgccagatcacttttaccggcgcctatgggagcgcgaggcggtgctggtgcggcggcaggaccacacctactaccagggacttttctctaccgctgacctggattcgatgctgcgcaacgaggaggtgcagttcggccagcatttggacgccgctcgctacatcaacggacgacgcgagaccctgaacccacccggccgcgcgctgcccgccgccgcgtggtccctgtaccaggccggctgctccctgcgtctcctctgtccgcaggctttctctactactgtgtggcagtttttggctgtgcttcaagagcagtttggaagcatggcaggctccaacgtttacctcacgccccctaactcgcagggctttgccccccactacgacgacatcgaggccttcgtgctgcagctggaaggtaggaaactctggcgtgtataccgaccccgagtcccaaccgaggaactggctctgacatccagccccaacttcagtcaggacgacctcggtgagccggtgctgcagaccgtgctggaacctggagatttgctgtattttcctcggggcttcattcaccaagctgaatgccaggatggagtccactctctgcacctcaccttgtccacgtaccagcgcaatacctggggtgacttcttagaggccatactgcctctggcagtgcaggctgcaatggaagaaaatgtggagtttcggaggggtctgccccgagacttcatggattacatgggggcccagcattcagattctaaggatccgcgaagaaccgctttcatggagaaggtgcgggtcttggttgcccgcctgggacactttgctcctgttgatgctgtggccgaccagcgagccaaagacttcattcacgattctctgccccctgttttgactgatagggagagggcactaagtgtttacgggcttccaattcgctgggaggctggagaacctgtaaacgtgggggcccagttgacaacagaaacagaagtccatatgcttcaggatgggatagctcggctggtgggtgaggggggccatttgtttctctattacacagtggaaaactcccgtgtgtatcatctggaagaacccaagtgcttggaaatatacccccagcaagctgatgccatggaactgttgcttggttcttatccagagtttgtgagagtgggggacctgccctgtgacagtgtggaggaccagctgtccttggcaaccacgttgtatgataaggggctgctgctcactaagatgcctctagccctaaattagtttcttgttgattgctggaaacaaggcagtagtgattctccgctgccactgctaccttttttttttttttttccttaaactcacgttcttaccttgataagcatcagtgtgctcacatttacctttatcactgcttcagtgtcacaaacctcggaaggtcttctaggaagaaccatctcatctaggtacaaaaggaaaaggagaagttggaggtggaaaaaaaacccttgatccgtgatcatttcagagcaccaacttcatcaccttcaggcttcagtgtactgggtaacactgaccatgtcgttctgcttgagacagatattagattttttttggaatttggatctttcatctgagttctttttcatgggcgggtcggggtcagtatcctgtttgttattgttaaatttgtatgaaccttagaaaagttattaaagtgccaaagaatgtttccctttcctaaggctagattattatgtgggatggttcgaagaaatgcaggagcgggaggaagatagggaaaatctataatggctgaagtgaaaagcaacctggggtggttgtagcatgtaaaaggagcatgttaatcaacctcttaaggaagagactctcaggctgggtgcggtactcatgcctgtaatcctagcactttaggaggccgaggcgggtggatcacctgaggtcagcagtttgagaccagcctggccaacatggcaaaaccccatctctagtgagaatacaaaaattagccaggcatagtggtgcgtgcctgtaatcccagctactaggggggctgaggcaggaggatcacttgaacctgggaggtggaggttgcagtgagctgagatcatgccactgcattccagcctgggcaacagagcgagactccgtctcaaaaacaaaaacaaaaacaaaaaagaatcttatctgattgggaccagttcactaactttggggataatttatgctatttaattatgcaacccaattctagtagaaaaattattttctaccagcttgttcagttttaagatcatggtatgtttttgctcactgtttgcttacatccatggctggcactgctgtcataagggcagcatgtcacctagttgtgccttcatagaccttaggcaaccaacttttagcaagctggccatgaaggaaggctactgttcaagttactttccactctcatttttattctggcagttcgaagaaacttccccaaatctgacaagtgaatattctcatggttggtggaaaagtgcctgatgtaccagaaagagcactggacttggaaccagaagacctgggtttggggtggtagctggtaggcagctggctgagtgacctgaggctgatgctacgctcaggcacacagattttgtaagtatattttggtacagtttgatttctgcaccctcatcatttaggttgcgtctgggactcttaagagtctgtcaccataatggatagttttctgttatttaaggttgagaactttacaaattctttttaaaaaagttacaaaagcatagacatacactaagtaaaaatgatagttctccctccaaccccactttccagagacaagcactattttttgtttgtttgtttttttgtttgagacagggtcccactttgttgcccaggctggggtacagtggtgagatattgggttactgcagcctcaacctcctgggctcaagcaatcctcccatctcagcctccttagtagataggactaccagtgtgtgccaccacacccagataatttttatttatttatttttttgtagagatggaggggtcttgctatgttgcccagactggttttgaactcctggcctggggtgatcctcccaccatggcctcccaaagcactgagagtccaggtgtgcgccaccacgcccaaccaccaaccactaccactattaaggttaagctcataaagcttttttgagtgcttagtcaaacatacatggtagtattgttttataaagacttgtgtttttctgatatgtccttttttgacctaacttttaagtcagttcaaatagagataacttttttttaagggagaaaataaatgaataaaaacccgagaaacaaacaaacaaaaaaaaaacacaaagactgagtggatggtagccaagagggaagagagtaccctttcctgactctttcatcctctaaggcttgctactaagtcccaaaacatccagatcctggaagaggcttattaaaggaatcaaggcatggaactcacccctaggaaacctaccctgaaaagtttcttggagtaaagtctggagtgttagtggtccttgttctcctttgggtttcaagtaaacacgttttgcttcctccctcacttttcccatgaccatctccagcttgagtattttgtgtgtcagcaagtccttttggcttagtgttttaatctaaattagaacaaataatgtttgaaaaacaaaacaaaacacctgtactaggcagcaaattatcaaaaaacattaataaagtgattgtaggaggctgaggagggaggatcacttgagcccaacagttcaaggctacagtgagctgtgatcatgccactgcactccagcctgggcaacaaagtgagaccctgtctctagaaaataaagaagtaactaattgcatatgcttatcagtagtaggtggtacataagtgcctgagaacattgttctcttatgatattggttggagattttttatacctgttcgtgaaaattttacttcagctttttgggcatgatgaacctgctaagaattgcttgcttgatgtgaagttggtttcttgaattacctttttaaagtcctttcccctctattccttcatcttatctaacagctttgaaaaattagaacaatccaggccaggcatgatggctcatgcctgtaatcccagcactttgggaggctgaggcgggtggatcacttgaggccaggagttcaagaccagcctggccaacatagcaaaaccttgtctccactaaaaatacaaaaaaattagttgggtgtggtggcacatgcctataatcccagctattttggtggctgaggcacgagaatcacttgaacccaggaggtggaggttgcagtgagccaagatcacaccactgcactccagcctgggcgacagagcgagactgtccccccctcaaaaaaaaaagcaaaaattatgttaatcctttcagctagagattttctttggtgagaaaacccagattaggaattcagaaaaattaagaagaaaatctagggggccagctctagtcccttattccttctctatgcctatttgaaaaaaaggaaaaataaacaacttgggtttggggttgatggggagaaaataggaagggagggaaatagtatttctgaaacaatgagggttacttgataggactaataggatttttgttttgtttttgtctttactagtaggaccttgtaacccaatcttgcacagatgctttgcatcttcaaatgatgtggcatctgtgtctggggttttagaaagtacttctatggtgggaaaaagggtatgtacatgtttgaggaggacagggtctgaggaactcttgagagtcctgaattttctcttgagaacagagcttgcacttatttaccctgttcttgatctcctgaagcatttcttggtttccttcatttcctaagttgagtatcttcattgtctggtacatttctctgaaagataagaagggcttcttagattattctaccctgccctttaaaaaagtatgggggtagaaaatataggacttggaatcaggtaagaatcccaagttccaatcctaactgtgcagttttgctgagccttatatgcaaaaatggtataatgcttagcttacaggaataatgtgcagtttttgagacaatatatttgtgggttttttgtttactttttgtttttgcgagatggagtcttgctctgtttcccagagctggagtgcaatggcacgatctcgtctcggctcactgcaacctccacctcccaggttcaagcgattctcctgcctcagcctcctgagttgctgggactacaggcgcgtgccatcatgcccagctagtttttgtatttttagtagagatggggtttcaccatgttggccaggctggtctagaactcctgacctcaggtgatccacccgccttggcctcccaaagtgttggggctacaggtgtgagccactgcacccggccatgcccgtctaatttttgtatttttagtagagacaggtttcaccatgttggccaggctggtctagaactcctgacctcaggtgatccatctgcctcagcctcccaaagtgttgggattacagatgtgagccacctcatctggccaagacaatatatttgaaggtgccaataggtaccatttactgaacacctttatgacaggcgctaaacatgtcatctcattaattatcaccacaaccctataatgtagactatcacctgcatttgatacatgaaaaaaatgggctcacagagtttaaataccttacacgggctcacatagctattgcatgccagagctggaattcaaaccctggtctttttgactctaaaacttgttgtcccaataggcatttgataaatgttagttgaatatatgaataacttaaaacccatcctttttttttttgagacggagttttgctcttgttgcccaggctggagtgcaatggcaccatctcggctcaccgcaacctccacttcccaggttcaagtgattctcctgcctcagcctccctagtagctgggattacaggcatgtgccaccatgcctggctaattttgtatttttagtagagacagggtttctccattttggtcaggctggtctcaaactcccgacctcaggtgatcctcctgcctcagcctcccaaagtgctgggattacaggcgtgagtcatcacacccggccaaaacccatcctggtggggagaaaagatgcatgaactacataagcttgactttcaatctaatttaggccagtttttcagttacctacttgggtgagtggtgaatgtgcaggtgaaccagtgcttttactgccattaggtagcctggaaaggcagggacatattcaatgagcaaagatgtgagagttggcagtataaggtcatggtgggagccagaggtttagtgcttactttagaacagcatcgtggttctccaggagcagcacgtctaggaaggtgtccctgacccggtccccttgaagtttcagggctaggatgctacggcaagcttccagccgtacacctggtgactcttcatagtggatagcccagagcagaagatccgtcagctcgggacttacttgcccaatctgtcccaaagctgcagagattagagggcagcatgtcactgaagactgagcttactatattctagcatccagaaataaattgagttttgcaaacaataccttcccttttggatggtaatcaccattagaattttagggataggtcagaatgggacattacctccaaaggattcctagaagagggatgttccatcccatccttgcctgttaggatatttgcctattttgggatgaaatatagaacaaataacatggaagacctgcctagtcccagcagggtgatggggaaaggaggcacaattatttatctatgtcaaaaagagaagcaatgccaaagattctaaaaagaaactaggcagattaaggggcagggttttaggtctgtagcagtcttgaaactgatctgacttttgcagagcgtaatagttgagatctccaaggaaagcaagatgcatccagcactggatacctacttggaacttatccttaattctgttggcagggactgtcttgtcagccctttctttaacttaagtttgacatatacctagactcaggatctttcactaaaaattgaagaaaattatctttctcttttcagacaaggaacttctgaaaagctaagatcattacctctcctgcacttcaccccattagagagtttcaggggatcatttctacttgcataggcaaaggtatttaaggttgaagagtttggggcactacttctataatacctcgaatggcaaaggccttgattttccagtaaggatctctctgcatcaggttcaggaggcattcaagcacctgggatggaaaaggcagtgttgagtggggaggaccagagcaagaatgaaccagaaacagctgggtgcggtggtgcacccctgtaatcccagcattttgggatgccaaggtgggcggatcacttgacatcaggagtttgagaccagcctggccaacatggtgaaaccctgtctctactaaaaatacaaaaattagccgggcatggtgtcacacgcctgtaatcccagctactcggaggctgaggtaggagaattgcttggacctgggaggcggaggttgtagtgagctgagatcgtgccactgtactccagcctgggtgacagagcgagtctccatctcaaaaaagcaaaaaaacaaaacaaagcaaaagaatgaatcagaaacagggaaaccacttatctctaaaaggagctataattgaaaaatgacctatcaattctggtgacaaatgagctggagcctaaagtaccaacctatatgcatagtgagtacattagctgaattatctgctattgattttctcagtctacagatctggggccatatggcttctcttgaacacttcaaacagatttttccctaataatggaattataactccatttatgggagttgatcctaaagcccatcagcacccaggtaatgagaagctagttaactgaggtgagaacaggattcaggggtgtgctctagaatcgaagtctgggctggctgggagctaaaccaagcttgtccaacatgtggcctaggacaacttggaatgcggcccaacacaaatttgtaaactttcttaaaacatgagatttatgccaggcgcggtggctcacgcctgtaatcccagcactttgggaggccgaggcgggcggatcacgaagtcaggacatcgagaccatcctggctaacacggtgaaaccccatctttactaaaaacacaaaaaaattagccaggtgtggtggcaggtgcctgtagtcccagctacacaggaggctgaggcaggagaatggcgtgaacctgggaggcggagcttgcagtgagccgagatggcgccactgcactccagcttgggtcacagagcgagactccgtctcaaaacaaacaaacaaacaaacaaaaaaaccatgagaattatgcacggaccttttttttttttttttagctcatcaactatcgttagtgttagtgtactttatatgtggcccaagacaattcttccattgtggcccagggaagccaaaagattggatgcccctgaaacagtcctgtttgaagtggcttatacacccccttcccagttccaatctctcattctgtgtccccacagaatgttgagcatactgtgcacaaccagggaaggtaatgccctcttcaggtcaatcaggtaagatgagaatatgtttccctgactcaccatcttgtcgcggatctgcagggcaccagctgccaaacaggctgcccgccgaactgctgtgaagtcatcagagaagcagtgcaggaagcttgggagaagcttggcggtcataagcttgagctcacctatcaggtagagagcttccacacgctcctgggaatttccttgacctagcttgaccctgtaaggcacaagttgctttcctttcacctccttaaactttcagtacctaacccccaacccccactaatgccctcatgataaaatccgggttctgtaggctgtcaatcccattcagccttatgctcatgagataagttttactgggtacagagctcgattgtcttctttacttgaatccctaatacatagctgttcagtaattaggtaatgcagggctttcagttacactgaatgactgaataaaggaaaatgtcaacttgcacctcttttcacagtcaagttctcttctccattgccctcacgtgtgccatgattatgtctgcatttggcttccagcctggaatgcctatgcagtctttttgtttgtttgtttaaattatttttatttattttattatttttttgagatggagtctcgctctgttgcccaggctggagtgcagtggctggatcttggcttactgcaagcgccgcctcctgggttcacgccattctcctgcctcagcctcctgagtagttgggactataggcgcccaccaccacgcctggctaattttgtttttcttgtatttttagtagagatggggtttcactatgttagccaggatggtcttgatctcctgacctcgtgatctgcccgcctcggcctcccaaagtgctgggattacaggcatgagccaccgcgcccggccttaaattatttttagagatggggtcttgctatgttgcccaggctggtcttgaactcctgacctcaagtgattctcctgcctcagcctgagtagctgggattataggcacttacccactctgcggctcctatgcagtctctctctcttttttttttttttttttttttgagatagggtctttctctgttgcccaggctggaatgcagtggcatgatgatggctcatgacagctttggacttcctggacccaggcagtcctcttgcctcagcctcccaagtagctgggactacaggcatacaccaccacactggctaactttttattttattttattattattatttttgagacggagtctcactctgtcgcccaggctggagtacagtggcgtgatctccgctcactgcaagctccaactcccaggttcacgccattctcctgcctcagcctcccgaatagctgggactacaggcgcccgccaccacgcccttttgtatttttagtagagacagggtttcaccatgttagtcaggatggtctcgatctcctgaccttgtgatccacccgcctcggcctcccaaagtgctgggattacaggagtgagccactgcgcccggccaattttttttttttttttttttaatttttagtagaggcaaggtcttgctatgttgcccaggctggtctcgaactcctgggctcaattgatcctcctgcttcagagtctcaaagtattgggattacaggcgtgtgccactgggctgggcctcctgtgcagtcttatccaccctctgtgaaacttggccttactcctctagccacgctgagtattccatttttctgctccagcagttatggtatatgccatttgttctagtttttaatgatttggtatttttaattaggtgtttgtatattttgcatgtggtcatcagaattgcgtcatacttttgaacaccctccagcaccgaaaccattgcctcacacctactgggcactcaatgcttctttccctagccacattgttagtttgtagggactgttaattttttacagtgggacctggtccagggtccgtacagaggagctcaacaaatgctgggtggctggatcccaggcctcctaagcactttttttttttgagacggagtcttgctctgttgccaggctggagtgcagtggcgcgatctctgctcactgcaacctccgcctcccaggttcaagcgattctcctgtctcagcctcccgagtagctgggatgacaggcatgtgccaccacgcctggctaattttttgtatttttagtaaagacagggttttactgtgttagccaggatggtctcgatctcctgacctcgtgatccgcccaccccgtcttcccaaagtgttgggagccaccttgcccagcctgcctcctaaacacttctaagaatttagaagagtgtctcctcatgttgactgggtcttacctgattatgtcgtgcacctctttcccgaggctcatttgcccaagcgcctgtgcagctgctctcctcacttccttattccagtcattccacatcagctggatcaacttatgtttcatatcctataaataggtatgatcattaggtatcatcacttaatgaatgttaattttgtgcttggcgttgtgctgttttttcttctttttttactcatcactgtactaatgaggattgtcctgagtgttttttcccatcgcttactctcccaaagaatccagtggggcagatattactaccatttacagatgatagaatggaggctttgatcagcttgtccaaggttaacctggtgagtgctggaaccaggactcaaacccaactctcccaagctcatcctttaaactatgtagtatcagtgccaacataacttgtacctgggagacttaaaatttgaaagtgatacttgatgaagtgactagctcattgcagtttgcctgggactctcctggttttggtcctgaaagtcccatggcctggacaaaccagaacagttggtcactctataagtgcacttctctcagagaggaatgggcaaagattactacacgatgatgtgtaaatgtgcccacgctgttcttcctgctagaagtatctcccttctctactcctacctggtacttgatgtctttgtagtcttcctttaggatttacctcaaaagcatctccttcctatctcttttattaaaaattttaaaaaataaaataaaaacatctccttagtgaagtcttctttgccccttgtaagcacaggaaatccccacaacaccttatagctgcttctgttctagctatttgtaacatttactaacggaagacttatccctgcacccccaggggtagcatagtgcctagtgcgtcggatgtggtcagaaactgcatgcttactgaatgagtgaaaagactcatagacatactgcctttcttagctccagcaatctgccatgaagtcctcatcatctttacctcaacccctgctagctctgcatgtctttttactttcagttgtcaattctaagtgacaagtgccaaggaggtgaaggtacaaatgaattggaagttgttaaaatgatattgttaagatgcagattctgattgagctggcttaagatgagatttttgcatttcttttttttttttttttttgagacggagtttcactcttgttgcccaggctggagtgcaatggcacgatctcggctcactgcaacctccgcctcctgggttcaagtgactctcctgcctgagcctcctgagtagctgggattatgggcatgtgccaccaagcctggctaattttttttttttttttgagacggagcctcgctctgttgcccaggctggggcgcagtggtgcgatctcaactcactgcaacctccacctcctgggatcacgccattctcctgcctcagcctcccgaggagctgggactacaggtgcctgccaccacacccgcctaattttttttatttttagtagagacagggtttcaccgtgttagccaggatggtctcgatctcctgacctcgtgatccgccctccttggcctcccaaagtgctgggattacaggtgcgagccactgtgcccggccgatttttgcatttctaataatgctcctaggtgacgcctgtgctgctggtccaggactttagcagcagggtgctatagcacttgagacagaactaacccaagtccaaaaccttttcaggtgattactgtactgagtggccagattttgtgcttcccatatcaaaatgtcagggttacagagtggaggttgttcacttatcatgggaatggcaatgttctgggctattctggagatatccaaagttataaggaaaagatgaagtagcacataggaagaagggaaagctcccatttggacagctgaagatgattgggaaataatggcaaaaacgaagtgttgcctggaattccctctttagttctagctgagccccaccatcttcaccgacagttggtttgtttttttttttagatggagtctcgctctgtcgcccaggctggagtgcagtggcacgatcttggctcactgaaaccgccgcctcccaggtttaagcgattctcctgcctcagcctccaagtagctgggatgacaggtgtgtgccaccatgcccagctaattagagatggggttttgccatgatgaccaggctggtttcaacctcctggtctcaagtgatccacccgcctcagcctcccaaggtgctgggcttacaggcatgagccaccgtaccggaccccttcacagaactttaaccaataaatttaacccacactaatctctctctctctgaaaagttttaaaagggtaccttatatttattgcttgttcttgaatcatttgtgtatattagtcttattgttcctaccatagtgttaattttgtgaaagttgggacaatggtttttttgttttgtttttttttgttttgttttttgagacagagtctcgcactgtcgcccaggctggagtgcagtggtgcgatctcggctcactgcaacctctccctcccaggttcaagcaattcttgtgcctcagccttccaagtagctaggattacaggtgccagccaccacacctggctaatttttgtattttagtacagataggatttcactatgttggccaggctggtctgaaactcctgagctctgatccacctgccttggcctcccaaagtgctggcattacaggtgtgagccaccgtgcccggccgggactatgttttatatgtgtgtgccgaacactctgagaagcagcacagacactcatttagatgggtttttgggtagtctaagtcagtgcttctcgaatgatctttgatgaagaaccaattttggcgggggggaaatatgtcattgactgataaagtctgttgatattgaggcaatatcaaattactataaacgtttcttttttttttttttttttgagatggagtctccctctgtcacccaggctagagagcagtggtgagatcttggttcactgcaacctctgcctcctgggttcaagcgattctcctgcctcagcctcccaagtagcagggattataggcgcgtgccaccacactctgctaatttttgtatttttagtagagatggagtttcaccatgttggtcaggctggtctccaactcctgacctcgtgatccgcctgccttggcctccccaagtgctgggattacagatgtgagccaccgcacccggcctactataaacgtttctaaactcctgtcagtttttgtgctatttcattgtggatcagttaccaacagtttatggaccaccagtgcactgagaagcattggcttccagacagacatattagcatttgaagataattctgggctagaagtaagaagtagtgatgtgggaacagagatctgtttggtaagaatggaataatacatagcagcaaaaagtagaaggcctctgtagctcagcctctcttaggctttctgtcctggaggcaaagaaagaggtttaccaagcagacatttccactgatccgggagaaagcctggcaggccacaatccggttcttccattgacagctgttcagctccacagcaagcatggtgtgtatcagggtctgaggaaatggaagacttgtatggatattcacaatcacttttagagatactagaaccttgaagttacattctgaaatggcatcctgcataattaatgtcaccagtgggcttacaagagatggggcatgtttccatcacagccaactgactctgggatcataaattggggaacaaaatacaaatttaataacttaaacagaaaactgggaccttcctttcctgactttaactgtttttttttttttttttttttctgagaaggttgtcccccaggctggagtgcagtggcacaatctcggctcactgcaacctccgcctctcgggttcaagtgattctgttgcctcagcctcccaagtagctgggattacaggcgcctgccaccacgcccggttaatttttgtatttttagtagaggcggggttttaccatgttggtgccaggctggtcttgaattcctgacctcaggtgatctgcctgcctcggcctcccaaagtgctgggattacaggcgtgagccaccgtgcccggccttctgtctttaactgtttttacccctaaaatgatttttatatgcctcaagcttatgactttcacatttctattgaaagtaactaaacacaaatataggcctctgcagttttcaatggtaaacttctagcagaagcaaattctacatgtcagaactcttcttgcatatgcaaatagagaccatttgcaacctaattctcacttttctctcagctaactattgtgacttccctttgtatacacctctacacccaggtttactcatgcttattctacgtttacttatgcttgagattgtcaacccaaccggctgcattttatctaattaattaattgtgtaattaattttttgaggcagggtcttgctctgtcgctcaggctggagtacagtggtgtgatctcagctcgctgcagccccaacctgccaggctcaagtgatcctcccacctcagcctcttgagtagctaggattacaggcacataccaccatgcctgactaattttatttctttttttgtagagacagggtctcactatattgcccaggctggtcttgaaatcctggactcaagggatactcccacctcagcctcccaaagtgctgggattacaggcgtgagcgaccatgcccagcccagctgcattttattttatttgtttgagacagagtcttgctctgtcacctaggctggagtgtagtggcgtgatctcagctcactgcaaccttcacctcccaggctgaagtgattttcatgcctcagcctcccgagtagctgggactactcagtgtggtaccactgcacctgtctaatttttttatttttagtagagatgaggtttcacccatgttggccagtctggtctcgaactcctgacctcaagtgatccacctgcctcggcctcccgaagtgttgggattacaggcataagccactgccccggccccagctgcatttcagattgcttacattcactgacctcaaagacctaattgctccccaaaactgtgtctgacccggtaatggacacatactgtcttctcactcagatagctcaggaggatataagactgttcctcagtgtcctcattcttctttgtaaacagctggtggaggatcctcttaatcacagggtaagtagcagtaccttccagagccaagcactgagctgcagcccagctatccacactgttacctgccacagttgggtgaaaaagagttcagaatggtgatgtgttttccccctagagaacagcctttggattgatacccaaggctgctaccccacctgatatctcacttccttgtgccccactcagtctagaaatacaatttcttatttaaaccatattgagaagaatcatattggctgggcacggtggctaacacctgtagtcctcacattttgggaggccaaggtgggcggatcacctaaggtcaggagttcaagaccagcctggccaacatggtaaaaccccatctctactaaaaatacaaaaatcagccaggcgtggtggcatgcgcctgtaatcccagctacttgggaagccgaggcaggagaattgcttgaacccaggaggcggaggttgcagtgtgagctgagatcccaccattgcactccagcctgggcaacgagagtgaaactctgtctcaaaaaaaaaaaaaaaaaaaaaaaaaatttagtccagctaccacttggtggcagtgtacctgttttgttaaagtacctagaaagagcaaattttctttttttccttttttttagagacagggtcttgctctgtcacccaggttggagtacagtggcaccattgtggcttattgcagcttcaaccccctgggctcaagctgactctgataagcatgtatatataggtctgcctcagcctcctaggtagctgggtctacaggagcacaccaccgcacctggctaattttaaaattttttatagagatggggtcttgttatgttgcccaggctggtttagaactcctatgctcaggtgatcctgtcgccttggcctcccaaagtgctgggattacaggtgtgagcgacagtgtctggtcctaattttcaaatggtctaacataaatctaaacccaatacagcagacattgcagagcatcacagtggagaggaaaggactgggaaagctgatagtgagatgtctatcccatatttccaggtcagaagtaacagggagttactcacccttcagaagggcagtctgcatgatgttccgggcaaggggattatgtgactgtatggcatattggcatattgctgctgccatccgcacatgggcattcttgtcacaaagagcagcctctagggcaggcagtagaacctccggcaagtcctggatggtcttgtctgtgatcaaaagagccaggtaagagagtactagcccctttgcttttctcacacacagcttccttcctacagccatgtggtggccaacctcagtcccagctgcagttgcttagtgctatgtaatataattacagtttagctgagcccttcagatgggcaggattttctgctcaaggtgttaaagctcacctgtgtgctggtatgccaattcccaatcctttatcatctggcctctaaacagctatatttaagccgaagaagaatgtttccagctaggctacagtgaactacaccattagttttagtgattaaaagcaaccaatttgccccatgagcccatatatatatatatatatatatatatatatatatatatatatatatatatatatatatttatttattttatatattttttgagacggagtcttgttctgtcacctgggctggagtgcagtggtgtgatctcagctcactgcaagctccgcctcctgggttcacaccattctcctgcctcagcctcccgagtagctgggactacaggcacccagctaatttttagtattcttagtagagatgggatttcaccgtgttagccaggatggtctcgatctcctgaccttgtgatccacctgcctcagcctcccaaagtgctgggattacagacgtgtgccaccgcccccagctgagcctttatatttgtaagaacaattatatttaggtagtgctttataatatagtgtttttacattatcttgttatctttcaaccttggttgaattaggcaaggtaggtatcattgtagagctcactagggagtcttttttggttcaactaaacagtaaggttcataagactgtcatgggccatgcatggcaccagaagaatatgggacaggagcatagtttgtcaacagggcagcagcatcaggcatccctgttggctggagtttttttgtttttgtttttgttttttttttgagatagagtttttgctctgttgcccaggctggagtacaatggcacaatcttggctcactgcaacttctgcttcctgggttcaggcgattcttctgcctcagccttccgagtatctgggactacaggcacctgtcaccacgcctggctaatttttgtatttttggtagagatgaggtttcaccatgttggccaggctggtcttgaacccttgacttcaggtgatccacctgccttggccttccaaagtgctggaattacaagtgtgagccaccacacctggctttggctgcagttcttgaggctgtcttgagcattccacagagtcttggggacagcacaggagcatgttgtttattcactgggtgaatttatgctttacaggaactaatatctcttataaaaactccatagacacaattctagggtccacaaagggcctgcctgttataagttacagtatccagggaggcccaaactatggtgtccctatcaagtatttatatttcacttatagctcttctcagtcccaatgtaatttatcaaacaggatttatatcataaccaatgttgcctataaagatagttcttatcaggtgtttaggggaacaggtgggcatttaactgaagttcaaattctcaagtaggaaggggaaaggtttgttatccctttgtctaccactagtctcattttatagataggtaatttgaagctcagagaggttagctgactgcccaaggagtggcacagctaagcccgtgaatcatattttaagattttgtcaggtgcggtggctcatgcctgtaatcccagcactttgggaggctgaggtgggtggatcacttgaggtcaggagttcaagaccagcctggccaacatggtgaaaccccatctctactaaaaatacaaaaaaatgagctgggcatggtggcacacgcctgtatgtagtcccagctactcgggagactagggcaggagaattgcttgaacctgggaggtggaggttgcagtgagcagagatcgcgccactgcactccagcctgggtgacagagcaagactctgtctcaaaaataaataaataaataaataaataaataaataaataaataaataaaataaaataaaaaagaatgggctcttggctgggcacagtggctcacgcctgtaatcccagcagtttgggaggttaaggtgggaggattacttgaggccaggagttcaagactagcctggtcaacatagcaagacacagtctctaccaaaaacaaaaacaaaaaagaatgggatcttcaaggtgggaaatgttaacttctctgcaggccactgagcaaacaaaaggtgatgaaatgtagttcaaaaattactggactagaagtctggaattttaatctcgtctctattgctgataagcatgtatatataggccagtctctaagtcttggtttccacatttgtaaaatgatctcagataagccctgggtccctaccagttcagatgttccatggctttatgagttgcttatgttctcaagcagttcagctttggctctcacctgagtctctctggctggtggcaatccggggccgttccaaagcagctgtggcacatgtggtgatagctttgatccgaacgtcatcatgcaggtctcccaagctctgaagcaggttctctactgtctcatggtgccactctatgactgagccgcagtgagggaaatgaaaagagaaccacctggttagggttagatattgtgctgcaggcaggtgacaagaagtctgcccttcacccagaataattcaagcaaaacattagctcagaagaataaagggcccagagatggggtctttagggagttatttctctgatgatccatgtaccctcacaagtaagttcccagacaaaacttctcccaaccccatcgtatctatctctctttctttaaatcacttttcgttgtaaccatctgggaaataaaagtgacaataaaacaaagtagttaagagtactttgttttcagacatacctggtttgggatcacagttattagctgtgtgactgtggataagttacttaaccctgagcctgagatttcttatttgtaatacaggcataatactagaacccacatattgagttattcttactgttaaatgagttaactagacaaagtgtttagcaaaatgcctggcaagataatgaaggttcaataaatgttaactattgtggttttcattaggttctttgtctttgagggcacttccatttggctttcaacatcttcctcattttagttgctaaatactcttttggcaggtatcagacttttatttcaaagctcctattatctgtaggtgtttccttcagtcttttttgttattgtttatctgatccagtttacctaatggattgcctctctttttcctgcactaactaagcttgtctatcatgttctgaaagccagcagctattgagttctcaaataccatagctttcaacagtccttgccaggccattactttgtcccaggcactcagacttctactctcctatctttgaaggcaaagtaggtataggatagccccaactctacgaatgaattttggagaggggttgctgataccatagtcaactatgacatggacaatggttggacagcatattttgttcttcccttcatacatcatttgctgagcataaagtttggaaaacaataagatagggtcgcctgggtgcagtggcttatgcttgtaatcccagcactttgggaggccaaggcggggagatcacctgaagtcaggagttcgagaccagcctggccaacatggtgaaaccgtgtctctactaaaaacacaaaaattagccagacatcatggcacatgcctatagtcccagctacttgggaggctgaggcaggagaatcgcttgaacctgggaggtagaggttgcagtgagcccaaatcaagtgccatggcactccggcctgggcaacagagtgaaattccatctcagaaaaagaaaaaagggctggcgcggtggccaaggcgggcagatcacctgaggtcaggagtttgagaccactctggccaacatggtgaaaccccatctctaccaaagatacaaaaagttaaccaagtgtggtggcgggtgcctgtaatcctagctactcaggaggctgaggcaggagaattacttgaaaccaggaagcagaggttgcagtaagctgagatcccaccgttgcactccagccaaggcaacaagagcgaaactacgtctccaaaaaaaaaaaaaaaaaaaaaaaaaaaaatggtctctgcctctgaagagtctgcagtgtaataatgagtttccacaaattactgaagtaatacccatccatgcaaaaagcacccagatatatgttaactgaagttcatctaacacccaatgtgtgaaaggctcttgtctagccttaatgaggcaaccagatttttacatttcacaaaggagggatggatttttcaaagactgagaaagcctagtcccagatgagaaccacttctcacaaacgtacagtatcacaggacctcccttcactcactcagagcccaggcagtcttccattccttcagcatcctccgcaggaccaccagttcccaggtcacatcctcctgcagtgattttgcctgcttcttcaatctcctggtcttaataggcacatccttctcacccacctgcagcagcatatccttggcgggggtgggcaaagcagtccagcgcagggctccttgcacaggtctgtaagctgtgcaacgtggcagtgtgaggtcttttcaccccactgccttaggccctgccacacagtggccccagcttgcatcccattcctattcctgactaataccaaagcaaaacaaaaccctcaagagtgaatttccccatgattatatggggaactgagtacatgtacacagggaattatggaaagtcctgactagacatggtaagccatgatgatgatgggggtgagagatttgtggggggaaattgagatatctacaaacctttctataagtttaaaggttatctttaggaacctaaatctttaggaacataaatatgtttatatgtaacgagatttgctcataatatttgatacgttgcaatttagtgtcattggccattatttctaaagtattaagttttccttttaatgtttttaatttggggagaataatagtgctataagctgtgaaattttaaagattttaacatctctgagtttttcctcaagacaacagaaatttgagaacagaagaagccgtaaatattagatatagttagaaaagctatagttggccgggtacggtggcttttgcctgtaatcccagtactttgggaggccgaggcgagcagatcacgaggtcaggagatcgagaccatcctggctaacacggtgaaaaccccgtctctactaaaatacaaaaaattggccgggcatggtggcatgtgcttgtagtctcagctacttgagaggctgaggcaggagaatcacttgaacctgagaggcggaggttgcagtgagctgagattgcaccactgcattccagcctggacgacagagtgagactccgttctcaaaaaaaaaaaacaaaaaaaaaactatagttatattttctgaacttaatgtttttcatggtgtcaaatttagaaagcctctttctcagaaaaaaagctctatggagaaggggaagggaaaaatgataaaaacatttccagatgtactaaattcattattcacactgcctattagtctcatgttctaatcagtcactatcagccatttctgtttttttccaagatttcattctgactcttaacacctttagatttgctctgaatcaattctttcctttgagcaaggaagacataacatttctttcttctaatgtaaaaagagtcctgtgaggcggggtgcagtggctcatgcctgtaatcccagcactttgggaggccaaagcgggtggatcacttgaggtcacaagttcgagaccagcctgaccaacatggtgaaaccctgtctctactaaaaatacaaaaatttgctaggcgtggtggtgggcgcctgtaatcccagctactcgggatgctgaagcagaagaatcacttgaactggggaggcggaggttgtagtgagctgagatcgcgctccaacctgggtgacaaagcgagactccatctcaaaaaaaaaaaaaaaaaaaaaaaaaaagagtcctgtgagactccagggcagtttagcaaagatgcccatacaatgcatctcctccaaatggtccccaccagcttggacgtgctgggggactcagccactctgctgaggcctccctcctttctggggtagggtgtgtgcaactaggagctgtggaaccacctctgacaggccagctcacactttgccatgtgacgctccccgacttctctcaggcgatttgaaatccctcctgaagagatgagaagtagctgaattaaccccatttctcctatatccctctgctcaaggagttaaaatggatttgcggtgagcaagtcttagatctctgatatttaacctcataggaataaaaaatacaactgccaacttttactttggttccagtcctttgggttatagctggatagaaacacatccactagccatcttccacatcaacagtcatcaaaaaaaaaaaaaaaaaaaaaaaaaagagtcctgtgagactccagggcagtttagcaaagatgcccatacaatgcatctcctccaaatggtccccaccagcttggacgtgctgggggactcagccactctgctgaggcctccctcctttctggggtagggtgtgtgcaactaggagctgtggaaccacctctgacaggccagctcacactttgccatgtgacgctccccgacttctctcaggcgatttgaaatccctcctgaagagatgagaagtagctgaattaaccccatttctcctatatccctctgctcaaggagttaaaatggatttgcggtgagcaagtcttagatctctgatatttaacctcataggaataaaaaatacaactgccaacttttactttggttccagtcctttgggttatagctggatagaaacacatccactagccatcttccacatcaacagtcatctaaagctggggtccctaacccccaggccatgggcctgtaccagttcatggcctgttaggaaccgggccaccacaacaggatgtgagtggtgggtgggcaagcattaccagtgagctctgcctcctgtcagatcagcagtggcattagagtcacgtagcatgaaccttactgtgaactgcacatgtgaggggtctaggctgcgcaccctttatgataatctaatgcctgatgatctgaggtggaaccatttcatcctcaaaccatccccaccccgctggtctgtggaaaaattatcttccacgaaaccggtccctggtgccaaaaaggttgaggactgccgatctaaagggagcacacaaagtaatgactcttggcagggtacagtggctcatgcctataatcccagcactttgtttgggaggctaaggtgggaggaccccttgtggccaggagttcgagaccagtctgggcaacatagtgagaccctatctctaaaaaagttaaaaattagctgagtgtagggtgcacacctgtggccctgatcctcctgcatcagcctcgcgagtggctgggactccaggtgcgtgccaccatgcccaactaagttttgtatttttttgtagagacggggtctcaccttgttgcctagactagtctgaaactgctaggctcaagcgatctgcctgcctcatcaaattgtatggtttaacaggattaattttatagtatgtaaattcaagctcaataaagctgttattgaaaaagaatcctctggctgggagagtggctcatgcctgtagttccaacactttgggagtctgaagagggtgcatcacttgagcccagaagtttgagaccagcctgggcaacacagcaagaccttgtctttacaaaaattagctgggtatagtggtgtgcacctgtagttccagctactcgggagagtgaggtggaaggattgcttgagctcaggaaggtaaaggctgcagtgagccatgattgtaccactgtgctcagcctgggaaacagagtgagaccctgtcaaaaaaaaaaaaaaaagaagaagaaaagagagagagggaaggggaggggaagggggaagagaggaaagggagacatgaaggaaggaaagggagaaggaaaggaaggaaaaaaaggaagggaggaaggagaaaagaaaaagaggctggacacggtggctcacgcctgtaatcccagcactttgggaggccgaggtggacagatcacgaggtcaagagatcaagaccatcctggccaacatggtgaaccccgtctctactaaaaatacaaaaattagctgggtgtggtggcgcgcacctgtagtcccagctactcgtgaggcagaggcaggagaatcacttgaacccaggaggcggaggttgcagtgagccgagatcacgccaccgcactccagcctgggcgacagagcgagactttatctcaaaaacaaagccaggttgtgtggaaatcctgtggctgtccacagctgtctggcgggtgcctccacagcaggcacagaatgtgcctgtgcctccaaggatagactgagcccagggaaggacttcttgccaagtggatgcaaaggcacaactagcaggccaggcaaccctgtcagccaggtgtggaggcatgcacctgtgattccagctaccctggaggctgaggcaggggaattgcttgaaccaggaagatggaggttgcagtgagcagagatcacgccactgcactccagcctgggtgacagagcaagactctgtctccaaaaaaagaaaaaaaaaaaaaaggaatgggtgacaactgctgttagtttctgcacaccactgggcccatctgaacagtaatcctacaaagagtcatgggaaatagagtcttgtggaagatgtgcacattttgtttcataagctaatttcttggtcaccttctttccctctttgtcttacagagtgaagaatgatgaacttgtgaaagttcaggtatgggtgggctgagtgtggagtgggagggtagagccagcccaagggaaaagggcagaatgctgggtcaggagtttgatgcactttccctgttaggtgcactttccctgttagcattgagataggagctgccttattggtaactagtggccctaaaccacttggttatacctaagttatatcagatctcaagtgattgtatgttcctgtgaggctcttcctagttatagttagtattttataattttgtgagattatttttagtacgtagaaaggggattgcctagatgctaatggtgcttcagcccatgaactgggagctctagcacatgaatagtgggtaatgatgggaagtagccacattcccgttattaacccctgccttccctgttagcttcctgcttacatgcttcaggaattgcctgggcactccacttttctggagtttcagggaagaccttagatagctgcttgttgtaccgatttaggttttccaggacaatctggtctctctttgcaccaatctggtggatgatctggacttcatctgtgaacagacaaagaaacaatgagtcccctataacctccctatttcctttctccctgggttcctaatcaccaggatcagacccaacttccttttgccctaatctaagcccctaggatccatgactgccatactctggggcatcccttgaaggtgaccattgcttagaaatatcacagtgataaatcactatagtgtctgtgggggaaaaaaaaaagaaaaaggaaatgtcatagctagtcacctcattagaggcctgggagccaaggatggtgatttccttcctaaggcagaacctatggccgggtgtggtggctcacacctgtaatctcagcactttgggaggccgaggtgggtggatcacatcatcaggagttcgagaccagcctgggcaacactgtaagacccccgtctctacaaaaaatacaaaaattagctgggtacagctactcgggaggctgaggcaggagaatcagttgagcctgggaggtggaggttgcagtgaagatagcaccactgcactccagcctaggcaatgggagtgaaaccatttcaaaaataagaaaagaaccggctgggcaccatggctcacgcctgtaatcccagcactttgggaggctaaggagggcggatcacaaggtcaagagattgtgaccatcctggccaacatggtgaaaccctgtctctactagaaatacaaaaattagctgggcgtggtgatgcgcgcctataatcccagctatttgggaggtggaggcagaggttgcagtgagccaagattgtgtcactgcactccagcctggcgacagagcaagactccgtctcaatagaaaagaaaacaaaagaaaagaacctatgtaaccacttagaggccttatcccttataaaaagctagatactaaaaaagaggcacctaattaatctcatcagtcatgaatacttagagtaattttgttaaacactttgagaagactttcagctgcagcagtttaggaacaagatggggcttgggaagaagaaacagcttggaacacgaagacctagattgagtatcctggaagcccaggcatctaagggacagcagtagggacagggaaggtggcaaacatttactgaacaccttaaacagacattgagcaagaagcattacagatgctttctcatctactctactcaaagtgcatttttgttaacatcacttcacaaataaggtacttgtggctcagaggaattatataatttactgaaggttactaaaaaaatactgagccaggatttaaacccaaatgtgcctgactccaaagccctgattttttccaacatagcaccttggtgggagaatatctcgaagtgggagaatatctcgaagtgagagaagggagaagggtagatagagaagagatggattgttcccaaagtcttgccaactttacagttccacccttcattgcctctttagtaagatagagggatagagaaagcggggagagagagcagttccctccctattagttatcactccccgacccaactcctgtgctagtgtgggtgctgggtcatgaacatgaaaacctgggtcatccagggcctcttgtccatacccacaactgtttccagcccccagcaatcttccaccttcctggcccatgtccccgtgtgcccctaccacaggggcccagctctattaccaaagtaaatctcctgttcaaaggtgttgtctgtggagtaggcaaactttccagctcggggagtcacctggcgaaagtagctctgggtttggggctgggagaggctcgtcttttcatggatatcctcagtgctcttgttgccaggcatgatctcaactgtctctgcttgttggaagtaactgggcaatcttggcaggggtgagaaaggagggaaaagggggaaagagtaggaggtggatccccctttccattaaatccacagctcgttccctttcctctttaagctcagctcctatacacgtgagcattgcagaacaccaatgtttaacttttagccttgtccccatggtgccagttgaatgtggagctgccagaagggcctgtctacagctgtcctgcctggctactaaaggatccatgccttctgcagccaccaagcagcagggcagagtggcggtgctccagcataacccttttttaacattcgtactcttagaggcggcatggccttggggaagggatcccacctccttcgtcatctcactctgtctattctgtgtgtggttatttaatgtccatccacctggtggtggacaggctgtaagctccttaaaggtacatatctgtgtctgttgcttttacattgtattcccagcactttgcagagtgcctggaaagtagcaagaacataatttatatttgtccaataaatgaataaataaatggatttccactgatttttagttcactcttggaaatcagggatagtgtaatagctccagtcttccctctagctataaatgagatagaagcaatctaagaaacatgtagtcatcttcttctctcaggttgtctggttctctgtcctgcagctagtcagtttttgagtcagtgacacactggttccttattcagagtaaggcaggaccaaacctcggtgctatgaggttcctgccttcctcactccaccaaggatacatttctgggagcacctggttggtaactacaccagcagtctgatggcaaagtctgctggagaaggttgagaaccaatccctttaagagcagtggttcccagctgggaatgactttgttcctcttggagacatctggcagtgtctgagacatctttggttttcacagctaggagtttgtgctctggtgggtatgagccagggatgctgcttgcatcccataatgaacagggcagctcccacaacaaaaattatccaacccagaatgtcagcagtgcaaattgagaaaccttactttgcagagctctcagagagcaggccggtggtggagaacatgaagttgatgggagagtgcattctgaaatcgggagtgtgagtccacctgggagtccctaaaggggagtcagggattatcaaaggtgcacttgaggccctggccagtatacctgtagtaaacgggaagcagcagttctggcttcttcttttcctgtgggggcaggatgacactttgatcctcaaactctgctgtctcttctgcctccagctgtttcaggagctccaggtcactggcagaggtaagctcatcccgaatgtgactccagtcgtactgctggcgcaggaagctctgccacttgttgggggatgccccaggccttcgaggacgcttgctctggatccatcgggctgtgcgctcgttcagcttttccagcacagtggcctcccacgctctggcctccttctcaggaggcagaagccaggcttctctttcctccaggttcacatctagagaaggtggccgacccagcatatctggatgcatgcagggatgatggatgagagggcggggtgcttcccggacggtgctggctggctttgatttcttcagcttcttttcgggattggcagagctttctgtcttcacagccagggaggtgtctcctgttaagggacttgaggaacccaggaacttgaagctaacaggtttctgaggccgggccttcctgatctggggagtatggatgatgtcattggtattgtagaggtggtcaaagctgtactggctataaggaatgctgggcaggcctcgctgccacaccacctcctgagagaaggtaaggtttgcagcagccattttcaaatattggctcttgcggtgtagacggtactgtgagctgaagaagaccataggcacactggagacagaggcacactcctccttgcctttcaattttgagtagtttaaaatcatgccccatcccagtcgtgggggcagtgactgatagaagcaatgggggagaaaggtctttcccttctgggtcctggtcataccgcgtcccagcaaatgcttccttccacactgcctggcctagaggaaaggcctggagatgagacctggcacctgttaagggaatgggaggaactgatgagaactctagagcagcagaaattggtagcccatagcagttcagaaagagaataacttgaaaaacagatggaaagggggtggggaagagccatgtgagttagaagaacaaaagaagaaaatggtgcaacatcctaaatatttcatgtatcagacccgtgtttttggttcttatacttgttcccaaagctcagaccctcatctccgtgtgagggatgactgcttttcagcagtatcccatgcttccagtttgtctttaaatgttgctttctttcattcaaaaggcttatagtgtaaagttcagactattcagcatggcattcagggttctccatgagtttggcctcagtttatgactttgtcctggcatgtaacctctgcttgagccagtccagtctcctggctgttctctgagtatcctctctccacataatgaagcttccttctgtgtcctctacatgaaatggcctttcgtacttgacacaaattctatccaatttccaggcccagctcaatttgtgctgctccataactctttcttgacctatccaggccaccaggtcatacccaagtttataaattcctcctggtctgtaccacttactttaactgttaatcctatgatacctcgcattgttaaatatttgagactctaattccattgcccagtgaccatgtctcccatttcttctgtctttcagagtcatccagcacacctattgctacatagtttttattgttaaaatatttaatagctgtaggccgggcgcagtggctcacgcctgtaatcccagcactttgggaggccgaggtgggtgggtcacctgaggtctggagtttgagaccagcctggccaacatggtgaaatcccatctctactaaaaatacaaaaaattagccaggcgcggtggcatgtgcctgtaatcccagctacttgggagattgaggcaggagaattgcttgaacccagggtgggggagattgcagtgagccaagatcatgccattgcacaccagcctgggcaacaagagcaaaactccgtctcaaaaaaaaaaaaaaaaaatatatatatatatatatatatatattatagctgtaacgtattttatcaaataggtaaatggttttgactcttcatgaattattggatgggttgtttccagattttagctagcatggcaaacactgtagataacaaatgcttagatttaatgttagtttagttttgttttgttttccttttgaagcattcccttggcctaataatgatagttttggaataaccttgctgaggattttacgtagggaagatattatgatcttcctttcctattttaagaagctgaggttcagagaggtaggtaaattgcttcagatcacatagcccgtaagcagaggagtcaggtttcaaatctagcctactagatcacaactctggagcacttaacctccgtgccacactggccttggcccaagcaccactccctaccactcactttgttggccttgcctctccaaggaacaggtaggcctccttatgtgtaaggatgaaggagagaccattattccatatgtttctatcctgctagtgtcaactcctgcccggtgtccaaggtgcccatgcagaccagatctgacttgtttctctttactccttaacacccagcacatagcctctctccctagggcatgatttctcttactgtcttccatgtgtaaaagtgaccgtattgtatttctttctgttaagggcaagttcttttttgtgtgttttttttcttttgttttgtttttttgagacagggtcttgttctgtcgcccaggctggagtgcagcactggcacgatcatagctcactgcagcctcaacctcctgggcccaagtaatcctcctacttcagcctcccaagtagctgggactacaggtgcatgcgccaccacacccagctatctgttttttatttttaatagagatggggtctcactatgttgcccaggctggtctcaaactcctggggtcaacaatctgcctgccttggcttctcaaagcgttgggattacaggtgtgagctacagcactcagcaaaggctcaactttcatctagatgccattaggccagaatcaataacctccctcaaattacgtgacacatgattaatatgctatcactccaggactttttgcacataaggctaaatgtaattgcttcatctcttcacaaccatgaaggcaacgtcttcatgaaggcaagttaagagaaagagggtggtcacaagatgatgttttctcctgaaacagtggctactcccactggctgaaaatagaaaggctagagcaagacggccaaacagacccctccagcgattgtctccatgcaggaacaccaaactgaacaactgtccccacaaggaaagcacctttaggccggatgcggtggctcacgtcagtaatcccagaactttgggaggctaaattgggcaaatcacttgaagtcaagagttcaagactggcctggccaacatggagaaaccccatctctactaaaaatacaaaaattagctgggcgtggtggtgggggcctataatcccagctacttgggaggctgaggcagaagaattgcttgaacctgggaagcagaggttgcagtgagacgaaatggtgccactgcgctccagcctgggtgacagagtgagactccttatttaaaaaaaaaaaaaaagcatcttcataagaaacaaaaaatcaggtgagtgatcacagtacctggttttcacatcgtatcaagaagaggcactgaagagggtgggaaagacggtcctgcatcgcctatgcccccctccctcacctctggcacaacagcttggagagagaatctgtgcatgtggtggagcgagaggagtgtgggattttgcattggaactcactgctgccctgtcacagcacagcactacactgagcagaattctgctggcacccacagaggacacatttagatcagctctgggccagaggagaatcctcaggtagagtgggacagacctgagtcccagctggttctgccaccagctgaccaaagtggcctggggccctgaatacatatgagtgacagtcaggtcacaaggactatattccttaggcaaaccctggagatgcactggtcatggaggcagtggactttgggtgtgtgtgaccgcgtgtgacaccaactgtggtgaacaagggagtgcctgcatcattcctcccccaactccagacagggcagctcagggagagactcctacttggggaaaggagagggaagagtactcaagttgcaagacaaagtccagaagactttgagtagcagctcagccacaggaaaataaagcaccaggcagaatcctgaggctcctgattccaggcctttgctcctaagctacatttccagacctaccctgcgccagaagggaatccactgctctgatgggtcagatttatcctggcaggattccccacctgctgactaaagtgcccttgggctttgagtaaatatcagtggtagctaagcagttctggccacaggccttgggcaggatccaatactgtactggtctgcaaagcttcaggtgtgacccagtgcactgccatctgtggtggccatgggagtgctcatgtcacccttccccccaactccagacagcccagtggggagagagattcctgactgggggaaagagaagagacaaagtgagagatgttgcctgggtaaccggggaattttcccttatcttacccaaggccaccaaagatacaggagtatccaggagttggcaacagttgcaggggtcataggcttagggcaccccctggtatacatcagctgcagagaccgtaggcttaagtcacagcacttaatcccctttgaatatatagaaagccttctcaaggaggatgggtacaaataagtccagactgtaaagacttggaataaatacctaactcttcaatgtccagacattgatgaccatccacaagcatcaagaacatccaggaaaacattatttcaccaaatggactaaataaggcaccagtgaccaatccaggagtgacagagatatgtgacctttccagacagggaattcaaaatagtagtcttgaagaagctcaaacttcgagataacaccgagaagaaattcagaattctatcagaaatttcaaaaagagattgaaataacaaaaatcaagcagaaaggctgctctgcctatggagtagccattcttttgtttctttacttctctaataaacttgctttcacttcgcaaaagaaaaaaaatcaagcatcacttctagagctgaaaaattaagttgactaaaaaatgcattggagtctctcaacagcagaattggtcaagcagaagaaagaattggtgagcttgaagacaggttatatgaaaatacacagtcagggccaggcaggatggctcatgcctgtaatcctagcactttgggaggccaaggcaggtggatcacctgagatcaggggttcgagaccagcccggccaacatggcgaaaccccatctctactacaaatacaaaaaattagccagtcatggtggcaggtgcctgtaatcccagctacttgggaggctgaggcaggagagttccttgaacctgacaggcagaggttgccaccgtactccagcctgggtaacaggggcaaaactccatctcaaaaaaaaaaaaaaaaaaaaaaaaggagtgatttaggatgtccccagataaatgccctttagcctgtgacgtaaagaatctttagttacaatgcaaacatcccagaaagaataccatattaccattatcaattattagaaattcttaaggaggctatgcgcggtggctcatgcctgtaatcccaacactttgggaggctgaggtgggcagatcacctgaggtcaggagtttgaaatcagtctggccaacatggcgaagccccatctctactaaaaatacaaaaaattagcgggtgtggtggtgggcatccgtaatcccagctactcaggaggctgaggcagaatcgcttgaagctgggaggcggaggttgcagtgagccaagatcgcgccactggactccagcctggacgacaagagcgaaacttcatctcaaaaaaaaaaaaaaaaaaaaaacttaaggaatagttattatctgatatgatggcttattaagaaggaagggaacacatgataggtctgttttgaaaaggaatggggacagaacaaaatattactaggtctgatcaaaagaggcttgttctggcttgtctttgtctgccttggagtcacgggacaggtgtaaggccaaattgtgcacttcccagtcatgttaccttgggcaaataatttaaaatctgtagtttcccaatctgaaaattgagtctgatacctgttctaatttagtgttgattgatatgaagctcaaaatcagaaacatgtatgaaagttctttgcaaactaaaatatatgtgtgaggaattgttattattagtttagaggatggactgttgtccttagaaggcaagtctctgggtcctacagttagatgcactgagcgcttcgggaagaatttagggctatggggtactcagcaattaaaagagagggtgcttagagaaggaagaaaggacttattaatggagtttggaggctccttattattgaaacttacacattacgtgaccagcattatgaggcagcacccacttccaacaaatagccctctagaaccaaaagcagagtggcaggtcctgggtccttttgtacacagcataaaaaattaagtcaatcggccaggcgtggtggatcatgcgtgtaatcccagcactttgggaggctgaggcgtgtggatcatctgaggttaggagttcaagaccagcttgaccaacatggtgaaactccgtctctactaaaaatacaaaaaattagccaggcgcagtggtacatgtctgtaatcccagctacttgggaggctaagacaggagaattgcttgaacccaggagtcggaggttgcagtgagccaagctcgtgccactgcactccagcctgggcaacagagtgagactctgtctcaaaaaaaaaaaaaaaaaaaaaaattaagtcaatcctggcataactgcagaccaggccctggaatgagcaacccaccagcattatctgcatttctaggaacttgggctagaaggggaggaatggggttggaagggttaggctacatgcctctagttaaaacctgatgaacttcctagatccccaactagaaaatgtaggagttggactaaattcctctcctgcctctaatattttatgaatacagaactcaactcaaaatgggtagtatctcagagattccaaatttagttctacttttctgtttgcttatcagtcgcttaccctcaccctctggtctgatacctttatcctgtacaagtggtcaaagtaggttgagtaacgtgtgctaaaaggagtaatatcttgcattctcccttgttattaaaatagaggaaactgccttgaaagaaaagactaaaaagcaataagccttagtatcagtatcttctgaaagctttaaaaaaataatactctcatctctaccaacagatttggattctgaagttctgaggtggagtccaagagtgtgcagtcagcttctggggtggtgtttgttagatacagttttttgtttatttatttatgtttgagacagggcctcactctgtcacccaagctggagtgcggtggcacagtcatggctcactgcagccttgcctcccaggctcaagcaatcctcctgcctcagcgtccccagtagctgggaccacaggtgtgcaccaccatgcctggctaatgttttaaaactttttttgtagagacagggtcttactatgttgtccaggctggtttcaaactcctggaatcaagcgatcttcctgccttggcctccagaaatgctgggactgcgcctggaatagatacgggtaaagaaccttttacatcagactcttgtgtcctactcccagaatgctgattcagtagcctgcaagtgaggcctagaaatctgcattttcacaagctctcaggtttaatacacaatacatttaaagaaagcacagcccaaagggtgtcagtggggtgtatgaaggaagcctggttagtggggagagtgggattagggaacagctgcttaacctggcttgtttcaagtccccctttctccctttttgccctcaaaaagttcccctcattttttcccctctactttctaatttctcaccatgcactcacacagctatacagctgtctccagagattactctggaaactctgctataaagatgacctggtctaatgccttgatttgttttttgtttgtttgtttttttgagacagggtctcactctcctggagtacagtggcgtgatcatggctcactgcagccttgacctcctgggctcaagcaatcctcccacatagctgggagcataggcacatagcacaccactctcggttaaatttttttttttttttttttttttttgtagagatagagtctcaccatgttgttcaggctggtcttgaactcctggactcaaacgatcctcccaccttggcctcccaaaatgctaggaatacaggcatgagccactgcaccaggcctaatgtcctgattttataaatcccaaaactggggcccagagaggagagaaatcattaagatcaccatactgcttggtatctaaagtagtactgacccttttgacacctaatccaaagttttttcagctacctcaggttgcccctcatcttccagctgacaccatccagcacctttcagatactggcaaaggagcagtgtttcaaaattactttccaaatggcctcctacaaggcagtcctcagagagaagcaaggttctgcatcttaaaccttccttggtttcttaggttccaaagctgtttctatcagtctccaagcaaccaactctttagaattccatgagtctactcagagaacttgtgggttcagtcgggggtatatcttcaaccatttattaaatttccttctttgtaaactgagctgtgagaaattgcatcttatttattgattatttattgaatggtagtttcatggagtttttcgtctttttttttttttttgcgagggagtctcactctgtcgcccaggctggagtgcagtggtgtgatcttggctcactgcaacctctgcctcccaggttcaagcaattctcctgtctcagcctcccattacaggccacaccaccacgccccactaattgttgtacttttagtagagatggggtttcaccatattggccaggctgttctcgaactcctgacctcaagtgatgcacctgccttggcctcccaaagtgctgggatttgcaactgtgagccaccacacccagcctcttggtcattctttgaaaaataaacctcagccaggcgcaatggctgacacctgtaatcccagcaacttgggaggctgaggtggcggatcacctgaggtcaggagttcgagaccagcctgaccaacatggtgaaaccccatctctactaaaaatagaaaatttaaaaagaaaatcagctgggcctggtggcgcatgcctgtaatcccagctacttgggaggctgaggcaggagaatcgcctggacccaggaagcagaggttgcagtgagccaagatcaggccattgcactccagcctgggcagcaagagtgaagtgcagtctcaaaaaataaaaataaaaaaaccctctagatgtatgcggctccatattctcccaccacaagggtttataaatcctgagaaagaggcaaagcagggaacacatgaccacatagctctggcaggcgtcagattaccaggctgataaaacagatggtaaagtagaagctgtccgttgacttttccattcccctttcagctcctccactgctacttaatctcctttgcccacacagttcaatcctattttccctgatctccaaatcctggctagattattagccattaacactagcttttacaaggagactcttcaatcttgtatttctagtagtataatttcacacgtacagaaattctttaagtcatagaagtcttacagatacagaaattctgatcttcaggagtcctgttgtgaaacaaactaatttatcctgacagcaggaaagatttctgggcctaaggctctgtctcgttgacccagctcatgctattcaggtggtccatctcttggttccaggcaagactgctgctgctgaccaacctgaatatggactttagcacttgggctcaagctgcactcagatggttggaccaccataaaagagcgagagggtacgtttttggtatgaaaagtaaagactaggccgggtgcagtggctcacgctcataatcctagcactttgggaggccaaggtgggcagatcacaaggtcaggagattgaaaccatcctagctaacacagtaaaaccccatctctactaaaacatacaaaaaaattagccgggtgtggtggtgggcacctgtagtcccagctacttggaggctgaggcaggagaatggcgtgaacccaggtggtggagctttcagtgagccaagattgggccactgcactccagcctgggtgacagagcaagactccatctcaaaaaaataaataaataaataaaaagaaaagaaaagtaaagactaaaaaaattaaatattataaccctgctaaggcaggaggatcctttgagcccaggagtttgaggctgcagtgagctatgatggcactactgcaacccagcctcagtgacagagggagaccctgtttctaataaaataaatcaaaaccctgttgaaggttcctcaaaaaattaaatatagaattactatgtgatccagcaattctacttctgggtacatatccaaaagaattgaaagcagggactttaacagatatttgtatacccatgttcatagcagcatactcacaatagccaaacggtggaaagaacccaaatgtccatcagtgaatgaatggataaacaaaatgtggaagatacatacaacagaatgttattcagccttaaaaaggaatgaaatgggccaggcgtggtggctcaggcctgtaatcccagcactttgggaggccgaggagggtagatcacctgaggtcagaagttcaagaccagcctggtcaacatggtggaaccccatctctactaaaaatacaaaaattagctgggtgtcctggtacgcgcctgtagtcccagctacctgggaggctgaggcaggagaatcacttgatcccaggagacggaggtttcagtgagctgagaccgcgccactgcactccagcctggggggacagagcaagactccaaaagttctggaaatggataatggtgatagttgtacaacaatgtaatgtacttaatgtcactgacttgtacacttaaaaatggttaaaatgggcttgttccagcagctcatgcgtgtaattctagcgctttgagaggccaaggcaggatgatcacttgaggccagagttcgagaccagtctgggcaacatagcaagaccctgtctctaaaaaaaaaaaaaaaaaaaaaaggttaaaatgaggccatgcatgcctacaatcccagcactttgggaagatgaggtggtagggtcacttgtttgggaagaggaggtgggaggatcctttgaacccaggagttcaaggctgcaatgaaccatcatggtgccattgcactccagcctgggtgacagagcaagacctagtctctaaaaaataagagttaaggccagacacggtggctcatgcctctagtcccagcactttgggaggctgaagcaggcagattacaaggtcaggagtttgagaccagcctggccaacatggtgaaacctcgtctttactaaaaatacaaaaatcagctggccgtggtggcatgtgactgtaatcccagctactcaagaggctgaggcaggtgaatcactggaacccgggagccagaagttgcagtgagccgagatcagaccactgcactccagcctgggcgacagagcaagactctgtcttgaaaaaaaaaaaagaattaaaaaaagaaacatggccgagtgtagtggctcttgcctataatcccaacactcagggaggccaaggtgggaggattgcttaagcccaggagttcgagaccaggcaacatagggagaccccatctgtacaaataatctaaaaagttagccaggtgtggtggtgcatgcctgtggtcccaggtgctcgggaggctgaggtgggagaactgtctaagcctgggaggttgaggctgcagtgagctatgatcgcaccactgcactccagcctgggtaacacagtgagacaccccgtcttaaaaaacaaacaagcaaataaacaaatactatgcataaaacctcaaggctcaagaaacaacagtttgaaatagttagatgtgtgttttttttaattttcatgtcttatcttttctgcttttttttttttttttaagggatgaggtcttgctctgttgcccaagctggtatcgaattcctcctgggctcaagcaatctcctgcctaggcctcccccctaacagctggaactacaggcatctaccactgcattcagctactgggggagtgtttgactagtctttttaaaaaatatgttaatatcttggtaaaaagtatatttatactgttctctaacctgctttttttcatcagtttcatggaagaatgctcatcatatattcttctgctttataactaaactgctttcatttatgacatcacaattaaactggtaaaaccaaatttatattgctaacttgtttctaattttttctctattaaaatgatatgattagcatccttgtagccaaatatttacacatatttatgaagttatacttaaaacaaattcctagacgtggaactgtgagtcaaagagaagggatcttttaaatatttttgcatagattgccatgaaaaggtcataccagtttatatatccaccaatatgagtttcttttccaaatcttcttcaacatcctgtgagagacagttaaacatagttgttcagagcccagccttgagaatcagatttcaaacatatgaaccctctccctttttcttttctttttcttctttcttttttttttttttttttttttttttttttttttttttgcccaggctggagtgcagtggcgccatcttggctcactgcaagcactgcctccagggttcacgccattctcctgccccagcctcccgagtagctgggactacaggcgcctgccaccacgcccggcgaattttttgtatttttggtttttttttagtagagacggagtttcactgtgttagccaggatggtgtcgatctgctgacctcgtgatccacccgcctcggcctcccaaagtgctgggattacaggcgcgagccaccgcgcctggcccctttttcttgttagagacagggtcttatccaggttggtctgaaactcctggccttaagaaaccctgccacctcagcctccaagtaaactgggattataggcgtgagccacctcacccaacttccacttcccagctgtatgatcttcagaaaatcagttaaattctctgggccttaatttactactacggttcttgtaagtattaacaattagctactattatttaccttctttagttcctgagacttctatgcacagaatatacttgatgtgtgccacagaacctatacaaaggtaattacaactaacagggagttgtatgataatgacatgggacatgggacatgagagcatttggaaagagataaaaaggcttaccttgaggacagccttattaggagcagaggcaaacacaggttttgtgagtttgaagcttacgcatttataggtttctctaattaccaagataggaaattatgaaatcaggtacaagggcttgggaggggcctaaagcttaagtttgatgaaaaaaaaaaaccacctctggttggaaccaatagcctatgaaaaagtagaaaaaagcccaatgcatggggagcgccggtagtcccttgaggtgtttgagaggctgaggcaggaagatggctttagcccaggagtttgaggcttgtaagtgcgcagtgatggtaaaccgccgctgtactccagactggcaacgtagtgagaccctgtctctttaaaaaaaaaaaaaaaaaaaaaaaaagatgagaggtaacacttgcctgactgggacaaaaatgagaaaccagtataagaaaataataactattggccgggcgcggtggctcatcgcctgtaaatcccagcactttgggaggccgaggcgggcggatcacaaagtcaggagttcgagaaattaataactattacctcatttggctatttttacacctgtaaggaataaagctcagaggtcacacagctagtaagaagccagcacccttcgatgtgggagtgatgtggaggataggcatatacagagaacacgaaagcaaaacaccatggtgcagattttgaaagaaaagccctaagattagtaatgagtgtgaattattcaacaaagtgatcaaaaccaactccagtcctgcattcctcttcgccatcaggagtttggagcctggagactgctagctgcctggttgttgttgtttttttttttttctgagacggactttcgctctgtcgcccaggctgtagtgcagtggcatgatcttggccaactgcaagctccaccccccgggatcacgccattctcctgcctcagcctcccgagtagccgggacgaaccagtcctggcccagcccattccgcgagccagcaagcttctgaaaagcaaacctaggaagttgctttccaacataaagtggaggtttcaacacaggagactttaagcaagttccagtgtgtctatatttggtctggctgatcggctggactctggccttccccgctcacattagcagacagctctgccctagtgggcgtttagcctgcgacggcagcccgagaggaagagttgggcagagttgcaggggtctccacagctgaggcagtttggccggattatttgggttcctgctcggatggcggcgacgctgatcctggagcccgcgggccgctgctgctgggacgaaccggtgcgaatcgccgtgcgcggcctagccccggagcagccggtcacgctgcgcgcgtccctgcgcgacgagaagggcgcgcttttccaggcccacgcgcgctaccgcgccgacacccttggcgagctggacctggagcgcgcgcccgcgctgggcggcagcttcgcggggcttgagcccatggggctgctctgggccttggagcccgagaaacccttggtgcggctggtgaagcgcgacgtgcgaacgcccttggccgtggagctggaggtgctggatggccacgaccccgaccccgggcggctgctgtgccgggtgcggcacgagcgctacttcctcccgcccggggtgcggcgcgagccggtgcgcgcgggccgggtgcgaggcacgctcttcctgccgccaggtgactcacctccgctaattgttcccctctgcccatccctgttcctgcgctttccactgtgtgtgtgtgtgtgtccccttcgccccgccccgctcttttcgcttgtgtgtgtgtccctcctcccgccccaccaccaccaccccgggctatgttgcccaggtaggtcttgaactcctggacccaagctatcctcccgcctctgcctccccaagagctaggattgcagggtgagccactgcgcccggccctttgaggggagttacacttatttttttatttttattttttttcgtccctgcgcttttcatacggagaaaggatgtagcttccaacattccggaggttagtgtaaggagacaggaatggaatggaaagttggttggggaattgcccctgccgctccaaaactgagaggtccctcaaacctagtgctcagttaaaagacattgtaagggctgggcgcgctggctcacgcctgtaatcccagcactttgagaagccgaggcgggcggatcacgacgtcaggagatcaaggccatcctggctaacacggtgaaaactcgtctctactaaaaatacaaaaaattagccgggcgtggtagcgggcgcctgtcgtcccagctactcgggacgctgaggcagaagaatggcatgaacccaggaggcggagtttgcagtgagccaagatcgtgccacgcactccagcctgggcaatagagtgagactccgtctcaaaaaaaaaaaaaaaaaaaggcattgtaaggaaagagaaaagacacataatattaaaaacaaacaaaacaaaacaaaaaaaacaggccggacgcggtggctaacacctgtaatcctagcactttgggaggccgaggcaggcggatcaagagttcgagaccagcctggccaacatggtgaaaccccgtctctactaaaaatacaaaaattagccaggtgaggtggtgcacacctgtagtcccacctactcgggagtctgaggcaggagaatcgctggaaccctggaggcagaggttgcagtgagccgagatcacgccattgtactccagcctgggggacaagagtgaaactccatctaaaacaaaaacaaaaacaaaaaacaaacaacaacaacaaaaaattttcaagtagtttcaatgttcttatttatgtatggaccaggaagtcacttttttttttaataaaaagaattccaactggttttctcactgtatttccatggcagctaggaggtgccaggtggctgggcctgtgacagtgcagaggttttggtgcctgcccgcccaccattgctccagctgcagctgctgccccctgcagggcctgttcgttcctgctgcctagctccctgctggctggctatgatctccgtcctgttaccattccaggagagcagccacctccctgtgcatggcaggaccaggtactgattgtggcctctcctcttggcctcgaatggtatccttgtcatcagtgagcaagtccccaaagaccacggtcttgtccattgtcaggataattcactccacaagctgggactccaggtgctgctctacccagcggtgcttctcacccacacagtggtcatactttggcaggggctggtgcagtgtgaagacctcggtgttttgcatgtgcttcatctcttgcaaggccctctggggttgggcttcaagactagggaaaagcctagggcttcacacccatgggccactttatccaccaggtccggcagcagggtgaggtactgcttccagaccaggaagctgcggtgctgctgcagtgtcacatgcagctccctgagaagcggcggctgaagccccacaggatgccgtctggaagctgccagcacgcggtccctgtccatcagcacacgcgtgggctgtgctcatcgctgccggggcactggggtttctcgggatcctaggggtatggggcccagaaatgttctttaaaagtttctcatttttgcaacttttctttcaattcacacagtatgttaaggtttatgtaaattagcatttacaataggaaagcctcttcctgtcaaatggaaatttgaggttactggatacttttatattacataaagagcaatcagccagtgtagaaatgatgcttatccttattaataatcaaagaaatgcaaaataaaacaacagagtacatttcacaccctcagaagtggcccacttttagaagctagcattatcaattgctgaccagtatgtggaggaaatgaaactcactgctagaaggagtcaacatattcatctgctctgggcaacaatttgtcttaacttacaaagttaaatatgttattctacttgtacatgtgcaccaggaggcatattccttataagaggaaagccattgcagatgagcagtctggattaatttaaaaaaagagcaaagtcaactggaaacagtccaaatgtccatcaacaatagaacagattaataaattgaggtatatttccagcagtcaaagtgattgaactacagctagaagaatcaacatctatcaagatatacaaaagaaaagaaaaaaataaaaaagaatcaacatggatgaatctccaaaccactgttgagtgaaacagtcaaacactaggagaacacattcagtatcattccatttagatacagttcaaaaaataggcaaaataaaatattgtttaaggtacataatctaagtggtaatactatgaagaaaaccaagagtgatacacagaaagtccaggatactggaaagagaggaaagggcacaggggtctgtgggacgttgatggtttgcgggtatcagcactgaactatgtcttaaaagtgttgcctgtaaggtgtttgcattctttttttttttttttttttgagacagtgtctcgctctttcgcccaggctggagtagtggcacaatcttggctcactgcaacctccaactcccgggttcaagcgattctcctccctcagcctcccgagtagctgggattacaggtggccgccaccacacccagctaatttttgtatttttagtacagatggggtttcaccatgttggccaggctggtctcgaactcctgacctcaggtgatccacccgtctcagcctcccaaagtgctgggattacaggcgtgagccaccagacccagcctgcattattattctttaattttgtgtgaaacacaaaacctttaatgtaaatgataaaaatattcagtaagtggagtcattcagaatgagtagccttttgagtctgtctccattgaataagtgcattctgttgagtgcactggagaggaatttgtgctcttctatgtagcagtctttctttttgtttcttggtggtgcaccattaaatggattcattcaccagttaaaggacatttgggttgtttccagtctttggctacaatgaataaagtcactataaacacttgccagaagtttctggacgaacacaggttttcatttctcgtgggtagatacctaggagtgggattgctgggtcacatgtgtggtaagtatatgtttaacttggtaagaaaccatccaactgtttcaggaatagcttagttttgcattttgttttgtttcttcccaagaacctgggccctttcctggcattgtggacatgttcggaactggaggtggcctgctggagtatcgggctagtctgctggctgggaagggttttgctgtgatggctctggcttactataactatgaagacctccccaagaccatggagacgctccatctggagtactttgaagaagctgtgaactacttgctcagtcatcctgaggtgagttcttctctcagatttatgggctatgatgtatcaggtctcttcttaaatggtctgggttttcacagaagttagctcattcatgacagccattccctaccccaacacacactaccttttttagtcacttcttatagacagtttctttctttcttcttcttcttctttctttttttgagatggagtctcactctgttgccaggctggagtccagtggtgcgatcttggctcactgcaacctccacctcccaagttcaagtgattcttgtgccccagcctcccaagtagctgggattacaggcacctgccaacatgcctggataatttttgtattttcagtagagacggggtttcacaatatttgtcaggctggtcttgaattcctgacctcaaatgatccacctgccttggcctccccaggtgctggattacaggcatgagccactatgcctagcctaatttttgtattttttttttttagtagagatggggtttcgccatgttggccaggctggtctcaaactcctgacctcaagtgatctgcccacctcggcctcccagagtgctggaattacaggcatgagccaccacacctggcctcttatagacagtttctattcaattctatattactatatttcctgctagtaaagatatttgtagttggtattatgcaattttaaattccagtatgttttttctttctttttttttttttttttttaagacggagtcttgccgtgtcaacgaggctggagtgcagtggcatgatctcggcttactgcaacctccacctcccaggttcaagcgattctcctgcctcggcctcctgagtagctgggactacaggcgcatgccacttctgcctggctaatttttgtatttttagtagagacagggtttcaccatattggccaggctggtctcgaactcctgacctcaaatgatccacccgcctcagcctcccaaactgttgggattacaggcgtcagccaccacgcccggccatgagatgacgtacttgttgatgacgactcagtttagttatgacagtgggaatgggtggctcaggtgggagacagaaaaagatcatgggagataatgagattaaggaactgagaaaccagagtaattgatagatcttccacatggttatcaccaagagtggtgatggacaaattgtggaaaggaagagatagaggggaggtaaattcccaaagctgcaaatctgggtaaatggtagaacccagattcagactcaggttcaactaacttccagggtgggcacaactcaccatattccactgtttgtggagccattcttcttctttttcctttgtccctttctcaggtaaaaggtccaggagttgggctgcttggaatttccaaagggggtgagctctgcctttccatggcctctttcctgaagggcatcacggctgctgtcgtcatcaacggctctgtggccaatgttgggggaaccttacgctacaagggcgagaccctgccccctgtgggcgtcaacagaaatcgcatcaaggtgaccaaagatggctatgcagacattgtggatgtcctgaacagccctttggaaggacctgaccagaagagcttcattcctgtggaaagggcagagagcaccttcctgttcctggtaggtcaggatgaccacaactggaagagtgagttctatgctaatgaggcctgtaaacgcttgcaggcccatgggaggagaaagccccagatcatctgttacccagagacagggcactatattgagcctccttacttccccctgtgtcgggcttccctgcatgccttggtgggcagtcctattatctggggaggggagcccagggctcatgccatggctcaggtggatgcttggaaacaactccagactttcttccacaaacacttgggtggccacgaggggacaatcccatcaaaagtgtaaattttatttgatcatgtggcctctctgttgctaatctctcctggaaacatctgccacatttagtgtgtgtatgtgtattcattctttctcataacttcttaaagtttcttcccctcattattaaaatgaatttaccagtaagaatgagtttttaagatttttataaactgtatactttatcagtttgggaagggagtaactgtaggaaacacaagaagtggaaaaagtctcctcttcctatctcaacacacaactgataaggctttagttctgaaaggaaaagtgagtaacatcaattaacagtgtctggtacgtaaatggagttcaataattatttgctgaatgagtataagtgagccaggcgtggtggctcacacctgtaatcctagcactttgggaggccaaggtgcgcggattacttgaggtcaggagtttgagaccagcctggccaacatggtgaaaccccatctctactaaaaatacaaaaaattagccgggcgtggtggcgcatgcctgtagtcccagctactcaggaggctgacgcaggagaattgcttgaacccgggaggcagaggttgcaatgagctgagattgcactactgccctccagcctgggtaacacagcaagactatgcctcaaaaataaataaattaattaaataaataaatgattacctactgtggaagaaaagcacataatataaaaagtatatcagatttgagtttctcctttaagaatggaagttaacatcttgcctataaactgattactagttagatataaaactactaaaacttttcaaaaccaatacatatttagttctttgatatcttctccttggattaataaggattctcctagtgcaaataaattttatgttcctgtttatacatatggacctttaggatttaattgtttcaaaagctgataaaacattattgagatgaattacataagcgattttaacaatgacaaatgtgaaattcaataacaatttaggcttggcatggtggctcacacttgtaatgccagcactttgggaggccaacgctggtggattgcttgaacccaggagttcaagacaagcctgggcaacatggcaaaaccccgtctctacaaacaaataccagacattgtggcggatgcctgtagtcccagctactggggaggctgaggtgggagaactgcttgagccctggaggcagaggttgcagtgagccgagattgtgctactgcgctctagcctgggtgacagcaggatactgtctcaaaaaaaaaataaagaaaaagaaagacaatatttatatcacttgatataaatagttacacaataaacttgattttttcttaaaccttagttgtatttaaaagaaaaaaaaaaccttaatttattattattttctttccttttttttttttggaggcagggtctcattctgttgcccaggctggagtgcagtggcacagtcacggctcactgcagcctcaacctcgtaggtttaagctattctcccacctcggcctccctagcagctgagaccacacaggcacacaccaccatgcctggctaatttttaattttttgtacagatggggtctcccaatgttgcccaggctagtcctgaattactgagctcaaacaatcctcctgcctcagcctcccaaagtgctgaaattacaggtgtgagccaccgctgccagcttccggcaccttttttctaaaggaattcatggttttgtagcagtagaatataaccagatctacagtagagagatgataccctgagatgaagctacctcctgtgttactctgcaacccaggaatgcagctggtgccatgtctccaaacttccacaagaatgccagtgctgggcatggagccccatttagagtacacatgacctgaggctctgaaaactcttagagatgatgcaatctgggacagttgctcatagctggcctggccaagtcccaccccaagatgccaggccacaacacaaaatttcaagtcatattgttttatcttttcccttgcaattatatagtatatgactctcttagaaaagtgcaatagttaaaacttgttttagtagatgctagatcccaaacttgagtctgctgaagcccttttgagaccttagggaccctattctccattcttagaaattcaggctggtgaatattagattcaaaagcaccacagatgagccggtggttgtagaagtacatgcctgtaatcccagctacttggaggctgaggcagtagtagtattgcttaagcccaggagttcaagccagcctgggtaacatagtgggacaccatcttataaaaacaatttttttttgagacagtctcgctctgttgcccaggctagagtacaatggcttgatctcggctcactgcaacctccgcctcctgggttcacgtgattctcctgcctcagcctcccaagtagctgggattacaggcgcccaccaccacacccagctaaattttgtatttttagtagagatggggttttgccatgttggtcagctggtctcgaactcctgacctcaggtgatacacccggcttggcctcccaaagtgccaggattataggcgtgagccaccgcacttggcaaaaaaatgttttaataacatgaaaaattttaaaaagcaccacaagggttcagattacctatcagcctcttgacatttcgtattttttttttttttttgagacgagatctaactctcacccaggctagagtgcagtggcagtaacatgatctcagctcactacagtcttgatctccaaggctcaagtgatcctcccacctcagccccctgagtagctgggactgcagacacatgtcaccatggacagctaatttttgtatttttgcagagacaaggtttcaccatgttgtccaggctggtctcaaaactcctgggctcaagcagtctgtccatcttggcctaccaaactgcttggattataggcatgagcaaccgggcccagcctagttagtctttattagttatttgaaagacatttttcttttcactttcaacccatgcacactgtgaacactgtgaaatacacagaaaagttcattaaactaacatgctccataatgattcacttatttatttgaaaacagaggttgggtgcagtggcttatgcctgtaatcccagcactttgggaggccgaggcgggcagatcacctgaggtcaggagttctagaccagcctgaccaatatgatgaaaccctgtctctactaaaaatacaaaaattagccaggtgtggtggcatgtgcctgtaatcccagctacttgggaggctgagacaggagaatagcttgaacaaggaggcggaggttacagtgagccaagatcacgccactgtactccagcctaggcaacaagagcaaaactccgtctcaaaaaaagaaaaaagacccggtgcggtggcttacgcctgtaatcccagccctttgagaggccgaggtgagtggatcatgaggtcaggagcttgagaccagccaggccaacatggtaaaacgccatctctactgaaaatacaagtattagccgggcgtggtgctgggcgcctgtaatcccagctactccggaggctgtggcaggagaatcacttgaaaccggaaggcggaggttgcagagagccaagatcgtgccactgcacgccagcctgggcaaaagggcaaaacgctgtctcaaaaacaaaatagagatggggtctccctatgttgcccatgctggtcttaaactcctgggctcaggcaatcttcccaccttggcatctcccaaagtgctgggattacaggcaatcaccactgcacctggccatcatgaataattttaaagggaaccacaacataaccaatacccaagtccaatcggcatggtttttaaaagcatatttaaagtgtataacatggaccaggcacagtagctcacgcctgtaatcccatcactttgggaggccaaggtgggtggatcacttgaagtcaggagttcgagagcagcctagccaacatggtaaaactccatctctaccaaaaaatataaaaatttgccaggggtggtggtgtgcacctgtactcccaactacttggcaggctgaggtgggtgaatcgcttgaacctgggagtcggaggttgcagtgagccaagattgtgttactgcactccagcctggacaacagagtgagaccctgtctcaaaaaataaaataaaaataaagtgtacaaagagatggttgtggcgggttgtttttgtttttgttttaagagacaggctctggccaggctggagtgcagtggtgccatcatagctcattgtagcctcaaactcctgggggcccaacccatcctcccacttcagcctcctgagtagctgagactataggcacttgccaccatgcccagctaatttttaattttttgcagaaacagggtcttattatgttgcccaggctggtctcgaactcctggcctcaggtgagcctcctgtaatcagtagaagggtccagctgccagccacttgtaaaaagaagccaatataataagagtgaggtgtgataaagagagtgagttttattatccatgctagcaaggggagaagtgagtgtagttatttgcaaatatttccactcttcaatttgtggagggaatccaggagcttttgaagagagagtttggagtgcagaagaggcagcggaactaggagttgtcgggtggcgtgacctgctccactggcttgttttgaagtattgtttcatctggtgaaggagccagtgccatcattgtggctagaggtgtctggtccatatccagatccagtccctgaagctgaaggaaatatatgaccaggtaatggtgtgtacttaacaagcatctaggtaaatacatgtgcataaggcacggaagcacagaatgggaaaagaaagggcgtggaggttcagcacattctgagggtgtatttcaagatgaaaggaaactcatatgcagatggtctcagagttctatcttgagactcactgggggaggagaaaggggaaaggaaaaaaagtcttaaggtttgaggctaagctgctaacctgcttagttacactcccaccttggcctctcaaagtgctgggattataggcatgaaccactgtgccaacccaacatggtgttttgatatgtgtatattaacacactgtgaaaggattcacaggtaattaaccaggtaattccaggtaattaacctatccatcgcctcacatctttctctctctctctcttttttttttttctggtggtgaggacacttgtcttagtctgttcaactgcagtaacaaaatgtcttataccgggtaatttataaacaacagaaatgtattgctcacagttttggaggctaggaaatccaagatcaaggcaccagcagatctggtgtctgctgagggcctgttcctcatagatagcaccatcttgtgtcctacctagtggaaagagcaaggcagctctcttcaacctgttttataagggcaccaatcccattaatgagggttccaccctcatgacagtcacttcccaaatgcctcgtgatgtgtgtgtgtgtctgtgtgtgtgtgtatctcaggggcgtcaggcctcaatttcctcatctatacaatgggtataacaacaatcccatcttgttgggaggaattaacaatcatgcatcgagccctgggcctcaggcttcaatgtattagttattagagctaatcattatttaatgttttaaacacccccaggaagtagagaacattcctgtcacattctgcagaaaaagaaattgaggcaaggggcaaagccatttgccaaggtcatagatcctgcaagccaatggcaaggcaggatctgaacctggggcttcagatcctggggctttacctgattaaataccaagagagagtgctgagatttttttggtggtggacagtccctgaggcaagccatttttagagcatctgggccacttggggaattgaatctttaccagggcttcccacctcctgttgccccttctctgaaggtgacccccctcccacagtagcaccccaaccactcagaacccccaagccaccttctttgcacatgctgaagctaatattgccctccactccaccccaacatcagggaccctggcccaagcccttccctgggagcccttcctcctctcatgaggcctccttcccagcccctcagaacagcctcctttatgagagtggccaagatcccactgaaaccttccctatcaactttataaaattaatcaggggagaagggaggggcgaaatggaaatcagcccagcttgcagcacacacagcattggtcatgaggtcagctgctctctgacccacttgctcagagttgtttgctgcctgttgctccagagtctcatagaccctgtcacaaggtcatagttccccttcactgctcatagataacaactggaacattataaaacattaacttttccatttgagatattctttcaggtcctgcatagcaatgaaactgaggcaggataggtagctaagggagtgaccgtgttctcgggatgcagcgaccatggcacccatacagtcaacacagtgagcctcagcattcgcattgtcattgcgctcattcaagcaaagctgtcttcattagggaatttcccccatagacagcatgagcattttgattttacctgtcctcaaactgacattttgctcattataatagtagaagacagccctacatggagatgtaatatgctaatgagacatgtgacatatgaacaagcatgtacagctactgtgcatgtgcacacagaagaccacccggaacatgcttattagcaacacctcttcccaccaccttatgaataatcatgtaagactcccataaagggagtctccctactgccagtctctgctgtctcacccttatgagcagcctgccttgaaccctctctctcacagtatacagtccattctgcatgtaaatttcaaaatattcttcttcctttgcaataaattactctatgctgcacttctttgctgtgtgtctcttgtttaaattcttttaaaccaagaagacaagaaccgaggtgtcacatcagccgccaaagaaactgctgatgccagcctgaatgaaagaccccacaggaactcactcactaaagaatgcagtttttgctgggcgcggtggcatggctatagtcccagcactttgggagacagaggcgggccgatacgaggtcaggagttcgagaccagcctggccaacatagtgaaacaccgtctgtactaaaaatacaaaaattagccgagtgtggtggcatgtgcctgtagtcccagctacttggaggttgagaggctgaggcaggagaatcacttgaacctgggaggcacaggttacagtgagctgagatcgtgccattgcactccagcctgagtgacagtgtgagactccgtctcaaaaaaaaaaaaaagaatgcagtttccacctcctgaaaatttaatcccctttaccccaactagtcaatgagcccaattttctagccctttaccctccatgatccctttaaaaaccctgttacaggtagttagacatgagcagggaaggagagggcttttctccctcacccactaggaatgtcaggtggtggttgacagttatcacgttgcctctctaaactgaaaattcgcagttggtgccagagggccagagtgagacaagctcctgatgatccacaggtgttaacattaaagtgttaattgaatgcaggtgccagggagaagcaacttcctgggcacgtgcattaagagacaaaatggcaggccaggcgcggtggctcacgcctgtaatcccaacactttgggaggctgaggtggatgggtcacctgaggtcaggagttcgagaccagcctgaccaacatggtgaaacaccgtctctactaaaaatacacaaattagccgggtgtggtggtgcgcacctgtagtcccagctactcaggaggctgaggcaggagaatcgcttgaaccccaggaggccgaggttgcagtgagctgagaccacgccattacactccagcctgggcaacaagagtaaatctccgtcttaaaaaaaaaaaaaaaacagacaaaatggctatgtatgacctctccaggacactccactggaaaagggaagaaagcctcagatgggcacgtatacaacttcctacacacactgtgcatgctcacttccgaaaggtaaagagagcacagagcatgagggcagctcaccctcagagaagaatcatgagaaagaggcgagcctataaagtcctaggatcacagttaaacagggctcttgaccttcaggtgcccggtcaggtctcttccaagtgaactttcctttctttcatgtcctaaagactttttaaataaacttccactctgctctgaactcacctccgtctctttttctgccttatgcccctcagtcaaattctttcttctgaggaggcaagaactgaagttgctgtagacctgtacagattcgccaccagtaactcagacaccttccactggtaacaaccccagcccagaattcttcaaggagatggatttgagggtctcctcccatctccttgctaggtgccctgtgatcatgaagctctttctgtgctgcaaaccctgctgtctcagtgtaattggtctgtaacagcagagtgggcattctgcagcctcttccttgcccggggcctgttgggagcccccagcactgcctgtaccatcataaacccaccctggcccctttcccaggctccaagctcagaggaggcagaggcttcattctaaactacagcatcccctccctaatcctcatttgccttctccttctgagcttgggccccattttttgagaccctaccagcccccattcccacaatcccctgtgccgacacaaatcaacctccccatgtcccaaccactgtcaaccccaacttagaccagtgcatcccacagctattctagcaccccataaacactccagtgtcccccacttcctgatcccacaacaccttgggccctccagataacccgctgctccagcctggcagtttgtcaaccccctcacccagacccccaacacctcatgcctgtcttatgccatgagtctgaggcccctgacccctacacctcttgggtgccacccaggcctgtctgtgtgggcagctcccccaccagctcccttccatcccccatgggtcctatccagggtttccccgacccaagcacacactattcggcattcctgactcccactgttcctggctcacggcctggccaccttgtctcgctcatctgccatagcccctgcctggcccagcaggacaggcctaggtcagggcaaggacaggtcagcaccagggctggtgccccaccccgaaggacacaagcctcctgctcaggacactttctggggtcctgtgcctccccttcttctcccccaggtgccaagtccccactttttaatactatcgcattgaggctgggcatggtggctcacacctgtaatcccagcactttgggaggctgaggtgggcggattacctgggctcaggagttcaagaccagcctgggcaacatggtgagaccccatctctactaaaaatccaaaaaataattagctgggcttggtagcactcgcctgtaatcccagctacgggggaggctgaggcaggagaatcacttggaacccagaaggtagaggtccagtgagccgggatcgcgccactgcactccagcctaggcaactgaacaggactagatctccaaaaaaaattaaaataaaaaagtattatcacattgggtattaggtttgttaaataaaaattattgctgtggaggatacacttgaagggaatgaaaaaaagtataggagactattgttttgctttttttttgttttgtttttgagatagagtcttgctctgtcccccaggctggagtgcagcagcgcaatcttggcacactgcaacctctgcctcccaggttcaagcaattcttgtgcctcagcctccctagtagctgggattacaggcatgcactagcatgccccgctaaggccattgttttggactaggctctagcactaggccccaatagacaagactaaaaaccaaaatggcgtcacctgtgctaaagtttcacccaacctaaactgaagtgttacctggccttctgagaaatcaggagagaaataacagccaatttcccaaacatgccagttttgatctttaattatcatgacaatgaggttcccctctgctttaatctgtacacaaaagaattagccagctgggcatggtggcttactcatgtaatcacggcacttcgggagcccaaggcaggcagatcactagagaccaggagttggagaccagcctgcccaacatggtaaaaccctgtttctatgaaaaataaaaaaaattagcaggcatggtggtgggggcctgtaatcccagctactcaggagacagaggcaggagaagcgcttgaaccagagaggcagtggttgcagtgagccgagatattggattaggcagtcaaaaaaaccaagcaagcataaaaggtcaataagttgtaatcttgatagtaaaagtggaaaacttattataaatggaaagaaagttttgatttccttttttgtttgatgggcagtatgccatattatacccaaagttcgtttaaaaaatatttccatcaactatttttatttgaaataaatatttgaggtaagttaccaaggcagcttttttcctcaaaagtaacctgttcctctttggaatagcacattttaggggcatggttaatacctgagatttttactcagtaaatcctgatggttactatgtgtaaaatatctttaagtaggattgaaggcctctgtggggaataaaatattaccaaagtctataaaaataaattttacatgttctcctttatgacagagagcagcactggttctgctacttttaaaatgaataattgatttcttgataggtgtttgatatttcttccctcactgctgattcttagatagaaaccattctttatatttgatagactgttttcagaaaacccttatcaacaagtgtacaatacttatctgaaactatacgtttagaatggagcagtttaatactagatctcagaaatttgaaaaatagcaaagaagactggatttggaaagcatggtctacaattgcttgtcaaattctgaagctatgaagaataaatgtttcaactttggattatgaaaccccatttatgattttttaaataaacttgaaataaaaatgattaaactaaaaaaaaagaatgtagagggagagatcaatgtaaaaatttatttaaagaaatagtaacagagaactttctaaaactagagaaagatatgaatatacaggtataagaaggtcataaaacaccaagccaactcagcctcaataagactacctcaaggcatataataatcaaactctcaaaggtcaaggctaaaaaaggatcctaaaagcagcaagagaaaagaaggacatattaataacatcataaaggagctccaatatggctggtagcagacttctcagcagaaactttacaagcagagagtggggtgacaaagtgctgaagcaaaaaaacttccaatctagaatattatattcagcaaaaacagccttcaaacatgaaagagaaataaggatattcttagttaaaaaaaaaaaagtgagagattttgacatcagacctgtcttataagattcttgttaagaggagttcctcactggttgagtatgaatggtcaaatgaaaagaacattaatattctcctgccttgcatattcttctaaaacattttacattcctaacacatcagtgtgtccacatcttgcttctaaggcagggggcaatttgatcctaaacagttgaaaaatgggatgaggactcatttcatccccagatgactacctataaggagtgattggctaggtgggtggctcacgcctgtaatcccagcactttgggaggctgaggcgggtggatcacccaaggtcaggagttcgagaccagccagcctgatcaacatggagaaaccccatctctactaaaaatacaaaattagccaggcatggtggcacacacctgtaatcccagctacttgggaggctgaggcaggagagttgcttgaacctgacaagcagaggttgcagcgagccgagatcgtgccaccgcactccagcctggataacaagagcaaaactctatctcaaaaaaaaaggagtgatttagggtgtccacagataaatgccctttagcctttgacataaagaatctttagttacaatgcaaacatcccagaaagaataccatattaccattatcaattattagaaattcttaaggaggctgggtgcggtggctcacgcctgtaatcccaacactttgggaggctgaggcaggcagatcaccagaggtcagcagttcaagagcagcatggccaacatggcgaaaccccatctctactaaaaatacaaaaaattagccaggcatggtggcaggcacccgtaatcccagctactcaggaggctgaggcaggagaatcgcttgaacccaggaggcggaggttgcagtgagccaagatcacaccagtgcactccaggctgggtgacaagagtgaaacttcttctcaaaaaaaaaaaacaaaaaaaacttaaggaatagttattatcatccgatatgatggcttattaagaaggaagggaacacatgataggtctgttttgaaaaggaatggggacagaacaaaatgttacacaaggtctgatcaaaagaggcttgttctggcttgtctttgtctgtcttggagtcacgggacaggtgtaaggccaaattgtgcacttcccagtcatgttaccttgggcaaataatttgaaatctgtagtttcccaatctgaaaattgagtctgatacctgttctaatttagtgttgattgatatgaacctcaaaattagaaacgtatgaaagttctttgcaaactaaaatatatgtgtgaggaattgttattattagtttagaggatggactgttgtccttagaaggcaagtctctgggtcctacagttagatgcactgggcgcttcgggaagaatttagggctatggggtactcagcaattaaaagagagggtgcttagagaagaaagaaaggacttattaatggagtttggaggctccttattatcgaaacttacacattacgtgaccagcattatgaggcagcaccccactcccaacaaatagccctctagaaccaaaagcagagtggcaggtccggggtccttttgtacatagacggcataaaaaattgactaagtcaatcctggcataactgcagaccaggccctggaatgagcaacccaccagcattatctgcatttctaggaacttgggctagaaggggaggaatggggttggaagggttaggccacatgcctctagttaaaacctgatgaacttcctagatccccagctggaaaacgtaggagttggactaaattcctctcctgcctctaatattttatgaatacagaactcaactcaaactgggtagtatctcagagattccaaatttagttccacttttctgtttgcttatcagtcgcttaccctcaccctctggtctgatacctttatcctgtacaagtggtcaaagtaggttgagtaacatgtgctaaaaggagtaatatcttgcattctcccttgttattaaaatagaggaaactgccttgaaagaaaagactaaaaagcaataagccttagtatcagtatcttctgaaagctttaaaaaaataatactctcatctctaccaacagatttggattctgaagttctgaggtggagtccaagagtgtgcagtcagcttctggggtggtgtttgttagatacagttttttgtttatttatttatgtttgagacagggcctcactctgtcacccaagctggagtgcggtggcacagtcatggctcactgcagccttgcctcccaggctcaagcaatcctcctgcctcagcgtccccagtagctgggaccacaggtgtgcaccaccatgcctggctaatgttttaaaacttttttttgtagagacagggtcttactatgttgtccaggctggtttcaaactcctggaatcaagtgatcttcctgccttggcctccagaaatgctgggactatgcctggaatagatatgggtaaagaaccttttacatcagactcttgtgtcctactcccagaatgctgattcagtagcctgcaagtgaggcctagaaatctgcattttcacaagctctcaggtttaatacacaatacatttaaagaaagcacagcccaaagggtgtcagtggggtgtatgaaggaagcctggttagtggggagagtgggattagggaacagctgcttaacctggcttgtttcaagtccccctttctccctttttgccctcaaaaagttcccctcattttttcccctctactttctaattttttaccatgcactcacacagctatacagctatctccagagattactctggaaactctgctataaagatgacctggtctaatgccttgatttgtttttttttttttgagacagggtctcactctcctggagtacagtggcgtgatcatgactcactgcagccttgacctcctgggctcaagcaatcctcccacatagctgggagcataggcacatagcacaccactctcggttaaatttttttttttttttttttttttgtagagatagagtctcactatgttgctcaggctggtcttgaactcctggactcaaacagtcctcccaccttggcctcccaaaatgctgggaatacaggcatgagccactgcaccaggcctaatgtcctgattttataaatcccaaaactggggcccagagagaagagaaatcattaagatcaccatactgcttggtatctaaagtagtactgacccttttgacacctaatccaaagttttttcagctacctcaggttgcccctcatcttccagctgacaccatccagcacctttcagatactggcaaaggagcagtgtttcaaaattactttccaaatggcctcctaaaaggcagtcctcagagagaagcaaggttctgcatcttaagccttccttggtttcttaggttcc

SEQ ID NO: 814 - DNA, 80464 bp, Homo sapiens; identical to SEQ ID NO: 813

SEQ ID NO: 815 - DNA, 52708 bp, Homo sapiens
gttaaagagagatcggaactttattgagactgatgaaatcagaaccaaaagaacactggaaaggttctgccactgtccaggcacagatccttccagacactcctcttgggggaatctctggatcattaagtttcccccagttcctaatcccccaccccaaagagtcagaattctgcttaaagccccctccacggagctggccagaaaccagacactgagtatctgtactgactgatgggcaggcctgtgagcagcagagacaagagaaatcagagaaggaacacgaaaaggaaaacatgacggaaagaaaagcccaaggcagggagagcatgctgataacgcagccccctgaaaatataaatattgcatgaatgtattagcctcatcccagccatttcccccaaagcagtggtgacaccaacagctatgacaatgcccacacagttgtgcatctttttttgtttttcccctgactacacagaaaaacagatctgccaaagcagctcacagcatggaggagcaggcaggggaaagtgggagggcccatcccccaagagggcagacagtacagagatgaggcgaggggttctggggtttgcggagggtggttaatgagaagaaaagtccaggacagattccatctcatcagcccctatcacaggctccgtggatgccccttgcagaactcactgttctttcctggtcgactcgttccttggaaacattgtcctgagtgccctggaacctcgggtgttcttgtggaagggtccaggccctccacaaagccaaacgcaacggcccctgtgacagcatgcaccagagtgataacaattctgagaaccgggaattcctaactcgaggttctcctcatagacctaacctgactgccaactggcttaccctgcctgacctcagagtgcctctccctctgcctgcctttccactgtcctgggtccaggatgacttcctggtgctgagctggtgcatcctgactcctgcctcgtgggtaaggcccccaggacagcttgttcccaagagaagcggctggctgtgtacaaaggagcccctcgaggcagcccgggctgggtctcctgggcatgcacagactgtgcaccatgcacatttcaccatccaaaggctgcttcttccctgcaggtcctgcccctctgctccccaccacctgctgtggagccgtgcatgctagccttgcaagactgttacaagttctctactccctagagtctatgtgatctccctaatctctcttggacaacatacacacatattcacacttattggtattgaaggccctggctttcctgcggtgtgttcagtggacatctgcatcaaggtcaggcgggaaggtcaatgttaagccttggtggccaccgacaccgagtggctggtgctggttctgactcctaggaaattgctccaagtaagtgttgatgcatcagggaatggagaagaaaggaaaggaaaagccatggtgtggaaactgcaaaggagcaactccgctgccaagtgtttccacaggggagttgtggaaacagcctcctctgaaatttgagagactggcggcctaaggaaaaggagcaaggtctccactgtcctctctgaaacccagcgcctttgggatctgagttttccaagacatgcaatagacaaagacgcactgcaaaccaattaaccctctgagcccttccacgaccttcactacagtcacttccaagagtaaattacctggatacaccaaccagtcccctcctgggtccgatgaagggatcgagccctcgagccagctttgaggaacacatcagagaagtggcagtgggggaggcagatccttgtccttcctgggaactcctgttcttagttgtcgagtgtcctaaaccactgccccaccccttgaggaaaccaggagcaagtccgggggattggctcaaaacccaggtggaggccgggtgcggcagctcatgcctgtaatcccagcactttgggaggccgaggcgggtggatcacttgaggtcaggagttcgaggccagcctgggcaacatggtgaagtcccgtttctactaaaaatacaaaaattggctgggcatggtggtaggcctataatctcagctactcaggaggctgaggcaggagaatcgcttgaacccaggagggggaggttgcagtgagctgagattgcaccactgcactccaacctggccgacagagcgagactccgtctcaaaaacacaaaaacaaacccaggtatattcagacccaagagactattcactgttgaaagtcaacccaaagttaagaggcagccgagggctggggaacaaacgcgagactgtgggtgtggaaagaagccaaaatggacctgacaatctctacgactcaggccttcgctgttttcccagctcacagggaacaaaggaatttcagctgcttttagcttatttgaccctcactgatttaagatacactagaatttagctgctctctgtccttccaagacaggacccaggaaaagcaggtggaggctgacttgcctcaatcaggcctcctcattgaagcaacaagacaagcacacaggaattcacagtttccactctcctccctagacccacacacctgccccgacccctggcctcaatgaactcccaactctccactgtgtaataattcctgccagtgtggctcaaagggttaataaaccaggacctctcagacagttaggacacaagctgattcaccaacaggaacccaaggaccgctccaccacctagtgcttcctgtagcgattttttggtgtttcgctacaccctgttttgtcacagttgagagcacctggattcttcccgagcccgaggctacccaggaggcccggaagctcctgagtgatggcccgctcaatcttctccagaaagcaacctcccatgtaggagcactgctgggagagcagtttgaaactggaaatgggattgatgccgaagaagtccttataggcctcgcggttgggaaggtcaaatttgctgacattggtctttgccaggatggtcttgaagatgtagaatttatcgggatcttccacaatgtccttaaagaccagttctccatcactgaagaaggtcattttgtccttgtaagtctgcaggtagcggtcaaccaggagggcgtggatgcggacccggatggcgtgctggcggatgaaggcaatcttgttctccagtctgttctcgatcacctgattcaggtcttctaggagggagatctcttcttggaggaacagttcctgatgggtgtccggcttatactcttgtggccagaaggagctgacgtaaacccttgggggctctgtgacattgatgagaggggccaagctccagaagagggccccgtaaacccgcatgagcatttgggtggccagattgtcagccttgttcaggatgatccttatctgggattcacgccccttcaactggcggaagagcatctccagctctagacccacatccagctttgttgggtcaaagacgacaaagatgaggtcagctctgtcgatgaaccactggcacacgtcgttgaaggggtagcctttgggagacagaagtgagaagtcaaactgagtaggcctccctcaaagcccgcgcacctcctttcagaactaaaccattctgggggttgaaagaaggaacagcgctacggattttctgggtttctacagactattaaaaaatcaattgcatatctcctgtcccttgccaatcttcaaccaagaacagcctgatccttgtttttcttgttggtttgttttttgagacagggtctcactctgtcacccaggctggagtgcagtggcatgattatagctcactgcagcctcaacctcccgggtttaagaatcctcccacctcagcctcccaaagtgctggggtaataggcgtgagccaccatgccccacctgatcattgttttaatctactgtgaaatccaagtttccaagaaagctaaatacctgttcaaaatggagattgtcctattgtctaaaaggatctggggcaatggcaaagatgctgagggagagaaatgaggaattagaagaacatgaaagaatgaatgcattatttacggggaaggaatgtgggcttagcattgagacctggactagaatttgagctttgcccctggcgagctgtatattaaatgcctctaagctctacctttttagctccaaaatgacaagaagaacaatatcaacatctgaactgatataaagattaccatgttgctgtaaatataggacagcacctaaaattccagtcatacagctggtgcagaatacattttaattccattagcttcttatttcctagttttctttgcaaataagaaaactgaggagatgaggactacctgtcttaaaaacattgaaatctttttttttttacaataatgtataaaattatccaacgtgtagtaggggtacaatttactattataattattaacattattaacattactaataatactactaatgtcattataccataataatataattaaatatactataatattattactaatattactactaatattattaattgcttctaatattactgctaatatcattactacaagatctatttataaccacaattggagttgtaaccataaactgagatccaccgtctgctcacacattcctgcactgccctgttcaggactcactgcagacagccttgcctcatggcaggactcagtggcctactccatagccacatgcctggtggatctggcttctagtcttgtggcctggttgtcagccttgttcattaaatacattcacactgttgcacaaccatcatggccatccctctctggaacttattcatcttcccaaattgaaaattctgtacccattaacagtaactgcccatctccccttccccccagcccctggttaaaaccactctggtttctgtctttctcattttgcctactctcatgtaagtgaagtcagacattagcattcccctgctacctgagggcaagtagggctttgaagaagcctgctaaaggcttatggggaagcaaccctggaaaagcagaaaccgggaataggaggagttgaaggtcaggttcaacctacagcaggcccaggagcaccaaacccaatttagccagaagtcaaacatactggtactgggatccaattagtccaggcccttggctacacaggacacacagggcctcccaaagacaactgagccccagcttgaacctctcagagctgcttgcagagaggactaggcccccactttggaaaatattgccgtctccaaaccaaatcagtccttggggaggtaggagcaccaggcactccaaaacccagatggcatcgcagtaacgacaagaagggtggaagttaagaatgcctctcctggtcttaggcaacactgggcacacttcctctccctgcctgcctaccacccactgtcaaaagtagttttcttttcttcctttttttttttctgagacagagtcttgctgtgtcactaaggctggagtgcagtagcatgaccacagctcactgcagccttgacctcctgggctcaagcaatcctcccaactcagcctcccgagtagctgggactacagtcatgtgccaccatgccaacctaatttttatattttttgtagaggcggggttttgccatgttgtccaagctggtctagaacacctgggcttaagtgatccacctgccttggcctcccagagtgctgggattacaggtgtgagccactgtgcccagccttatttattcatttatttatataagttagggtctcactcttgcccaggctggagtagagtggcacgattacggctcattgcagcctcaacttcctcagctcaagcaatcttcccacctcagcctcctgggtagctaggaccataggcacatgcgaacatgcctggctattgtttaaatttttttgtagagatgaggtttcactatgttgctcaggctggtcttgaacctccggcctcaagggatcctcctgtcttggtctcccaaagagttgggatcacaggcatgagccatcatgcctggccaaaaataattttttgaaacagagcttacactgttcagaaatgagggctaaattacctctttcttgctgcttgcggttctcgatgatgcctggtgtatccacaaaagtgaccctctccagaagtttgtggggaacctcaatgccaatcagcttctctaggaaattctggccaaacttctcaaggggtgagaaggaacgggcgctgtcagcagccatgacgatgccctcgatggttttcagcttaggcccatgcatgaggaccgtgaactcagaggtggtgggttcagcgcctgggcacacggggtgagaggtgaaggaatacatgatctctgtgaaacagatctactgagaagcatgtgtatatgcctggtgtcacagggagacttttgcaacagaattggatatgtttgccaagctattggggctttcttttaattgtggtaaaacatacataacataaaatttaccttttttttctttttgagatggagtcttgctctgtcacccaggctggaaagcagtggtgcaatctcagctcactgcagcctccatctcccaggttcaagcgattctcccacctcagcctcccgagtagctgagattacaggcactcgccaccatgcctggctaatttttgtatttttagtagagacagagtttcaccgtgttggccaggctggtctcgaacttctgaccttaatgatctgcccaccttggcctcccgaagtgctgggattacaggtgtgggccattgctcctggcctaaatttaccattttaatcattttaaagcatgcagttcagtggcattaagcacattcaccctgttgtgcaaccatcgccaccatccaggtccagaatgtttttatcttcccaactgaaaactctgtatccattaaacagtcattccccatttcctcttcccccagtccctggttacaagcactctggcgtctctctctctgattttgccttctttttttttttttttttttttcctttttggagcagagtctcactctatcgcccaggctggagtgcagtggcatgatctcagctcactgcaacctccgcccccgggttcaagcgattctcctgcctcagcctcccaagtagctgggattacaggtgcccagcaccatgcccagctaatttttgtatttttagtagagacaaggtttcaccatcttggccaggctggtcttgaagtcctgaccttgtgatcaacccacctcggcctcccaaagtgctgggattacaggcgtgagccaccgcgcccagccgcctactgtcatataagtgaaatcagacagtatttgtcctcttgtgtctgtcttctttcttttagcataatgtcttcatggttcatccatgtagcagatatcagaatttcattcctttttaaggctgaataataatttatgtatgaacagaccacattttcttgatcctttcatccattgatgaacatttgactggtttccatgttttggctattgtgaataatgctgctatggacattggtgcagatgtctttttttgttttctgttttttccaaattttcttttttttttttttttttttttttgtgagacagagtctcactctgtcgcccaggctggagtgcagtggcgcgattttggctcactgcaacctctgcctcctgggttcaagcaattccgctgcctcagcctcccaagtagctgggactacaggcacccgccatcacacccagctaattttttgtatttttagtagagacggggtttcaccatgttggccaggctggtctcgaactcctgacctcaggtcatcctcctgcctcagcctcccaaagtgctgggattacaggcataaagccaccatgcacagcctttttcaaattttgtattttaacacgtgcatgtggcataacttttctttccttttttttttttttttttgagacggagtctcgctctgtcacccaggctggagtgcagtggcacaatctcagctcactacaatctctgccttctaggttcaagcaattctcatgtctcaagttcctgagtagctgggattacaggaacgtgtcaccatgcttagctaatttttgtattttttttttagtagagatgggtttttgccatgttggccaggctggtctcaaactgacggcctcaagtgatccactgccttggcctcccaatgtgctgggattacaggcatgagtcataatgtccggccagtgatttaaattttcatggtgcttttacatacaacattcaaatcccaacaatcacacaagaatattgattacctgtatagagctgatagcgagtattttccagcccaaggaggtagtttatcatggtagatttaccaacactccacggtcccaggaacagtaccatgggcttggaggtaatctctccatctgtgggcaacaggaagtagaaatggaataaaactaacaaaagttcacacaaggggtatggcaccgtactccaaagcatctcaccgtccatccaactgagttgtggaattctccatgaatcagacgtgtgtagcccccagtggcgcttctcttgctacgtaagtgtgatcacccagtaaaaagacacagaagtcacttttgggccttgcccagatccttggcacgtctgcccccaccacaagaaggatctcagtgaattcaacaaaccctgactccgaactcactctgggtgaggtctcctggttaaatctggaggagaaaagcccatagagaaaggaggacggagcttccacatggagagaatctgggttgagaatggaggatggatgtggagcagcttgtataatcttgggtggtctggactcagacccttcctgtctccagcctctgcagctctcctctcctccagcctggggctccccaaattcccaatacagcctaatcctggactctgaggccagtgtctctctctctctttctgccctcttttgtttagaatcagggtctccgttgcccaggctgaaatgcagtggtgcaattgtgccccactacaattactgggctcaagcaatcctcccacttcagcctcccaagtagtagctaggactacaggcatgcaccactatgcccagcaaatttaaaaatttttttttgtagagatggggtcttgcaacgttgctcaggctggtctcaaacttctgggctcaagcaatcttctcacttggctccccaaaatgctgggattacagctatgaaccattgcacttaccctcttctagggccactctcaaacactagcctctaaagtccatgacaaatttgccagtgcccaaaaccaaacaatgaactggcaattcttgggtcctgcatccaatgtccttccgaaggccatgttggggagatgaccctgcaagggccactccaggtgggtccctaagaggaaaaatagaatgctctcgtgctttcaaatccagtggacagggagggaaggggagaggctttcaacgtggggtgtggtcagtcttattgcagattttcaggcctcagctcttccagctcttctctggactacagcacagagggccagtcctgcataactcagcactgaagttctccagactcgtctccctgaggccagcaggccaccctaaaaacactaggcactccccttttgtttcatttatttatcatgattttaatttatttaatttcttggttcaaagatcaggaatataaaaaggtaaacagtgaaaagtctcccatctccatcccagtctgcctcagccctgacaccccctggaataggtaaccactgctgacttcttacatgttattttagacattttaatgcatatataagcaatatttgtagctaacatattccccatctttttttttttttttttttttttttgagacagtgtctcactctgtcgcccaaaccacagtgcagtggtgtgatcatagctcatatagcctcaacctcccaggctcaagcgatcctcccacctcagcctcctgagtagctgagaccacaggcatgtaccaccaagcccagctcatttttgtatttagagtagagatggggtcttgccatgttgcctaggctggtctccaactcctgggctcaagagatccacccaccttggcctcccaaagtgcttctattgcaggcatgagcccggcacccagcccctccccatcttcttttcttttcctttttttttttttttttttttgagacagagtcttgctctgttccccaggctagagtgcagtggcacaatctcagctcactgcagcctctgcctcctgggttcaagccattctcctgcctcagcctcccaagcagctgggactacaggtgcgtgccaccacgcctggctaatttttgtatttttagtagagatggggttttaccatgttgcccaggctggtctcgaactcttgacctcaagtgatccacctgcctcggcttcccaaagtgctgggattacaggcgtgagcccccacacccggccccatctttttacagagagcgttgccatatgcttcctcttctgtatcttgccttcggatgctctggtcttccttctccgaggctaaagctcagtcctaaccaggtggtgtcttatacatggcaggcacatgtacgttgcctgaaagcaacaccatggccctgccccatccctccctgtctgtgaatacacaggagacactcacatctctgtggaagtcaagccctggctgggggccaggaagggataaggaggctgagagggtggcaggaatccccagttacagccacagagatgtcacagtatcttaacaccggcccaggcgacaccaaggagagccctagatgttccggttctccgagacaaaccacaaacagggccctttcctggtgctgtggtttcggctcctcacagcagggggcaccgctggcctatacaggaggtgggaggtgagcctgggagaggttacaaggaagctggccagagactaggagttaagaaccaagcccaaaaggtgagtgcaggggcaaggaagcgggacctccctgcagagcgccatgccctggggactctggagctcctggccctgctgctgtacacacaagtttcctaggagggccaagactccgggtcttagggccaagagagaaagaaaaacccttcgggaggctctgcaagctcataccaatagctgtgcatccactacaaaggggggcgataattggctgctaggctacaaaaaatagtacaggtagctgtggaacagggtattccctgcttccagctgtgtgatcctgggtaacccagcacgtctctgggcctcaggctcccctctgtagagcaggaagaatacaaaccctattacaccctggccacttacagccatccagagcatcaaatgagatcatatagaaacagcccaattaacacagggaaagatttctaatctcattcaaaaaacaataagataccactgctaaattttttaaagatgagtaacatttttaaattgcattgctgttgggaaacaaggactctcatctactgttattgtgagtacaaattggtatcatgggagacaatatggcaacaactagcaaaatgtttaattccagggttccaatttttttttttttttgagacagggtctcactctgtcgcccaggctggagtgcagtggtgcaatctcagtttactgcaatctctgcctcccaggctcaaatgatcctcctgcctcagcctcccgagtagctgggaccacaggcgcatgccaccatgtccagctatttttttctttttttgagatggagtctcactctgtcacccaggctggagtgcagtggcacaatctcggctcactgcaacctctgcctccccagttcaagtgattctcgtacctcagcttccccagtagctgggattataggcacccaccaccacacccagccaatttttggatttttagtagaggcagggttctgccatgttggccaggctggtctcaaactcctggcctcaagggatctgctcgcctcagcctcccaaactgctgggactataggtgtgagccactgtgcccggccatcggattgtttttaaaagtgctatgagccatcacgctgggcccaatttttgtgtgtgtgttttgtttgtttgtttgtttgtttgtttgtttgttttgagatggagtcttgctctgttacccaggctggagtgcagtggcacaatctcagctcactgcaacctctgcctcccgggttcaagcaattctgttgcctcaccctcctgagtagctaggattacagccgccagccactaggcagggctaatttttgtatttttaatagaaacggggtttcaccatgttggctgggctggtctcgaactcctgacctcatgatctgcccgccttggcctcctaaagtgctggtattacaggtgtgagccaccacgcccgcccctaatttttgtattttttgtagagatggggtctgactatgtttcccaggctggtctcaaactcctgggctcaagccatcctcccacctctgcctcccaaagtactgagattacaggcgtgagccaccaggagggtgctggttttccagagcatggcgtggtcacgcaggggaggagcacacagctgtcagagggaaggagggaggtttccacacacacagctcacctaacaggatcccatgtttgtaaaaacaaaaaacaacatccatctatgtgctcacacatgaagaggaaatgcttggaaggcttcactataacgatgtgtttctctgggagtcgaattaaagaagttggaggtcggctgggagcggtggctcacgcttgtaatcccagcactttgggaggccgaagcgggcagatcacgaggtccgcagacagagaccatcctggctaacatggtgaaaccccatctctactaaaaatacaaaaaattggccaggcgtggtggcaggtgcctgtagtcccagctattcgggaggctgaggcagaagaatggcgtgaacctgggaggcagagcttgcagtgagccgagattgcgccactgcactccagtatgagtgacagagcgagactccatctcaaaaaaaaaaaagctggaggtcaagaatataatttttatttttcaacgtataccattctgcactatttgaatttttgcaacaagtgtgtcttatttttattattttgaaaatcaattttgtaaagaatccaggcccaagggaagcagagtggaagggcaatagcaggaggggaaggaacggagtgatcagaggactcaggcaccacccatgagtagacagggggcacctgtggcctctggagcacaggagggattgaaataggcatcatcgcctttgaaaactcaaatgtgcatgactgaagcataaaggcttaaaaccaaaatgcatctgtaacaccctggtaaagcatcgcgctgtgctggtgaaagggtagttccgtgatggaggtgtcgtcctttccaactcccagggggagcccagacccagacccacaagtccttgcacacatcatgaatgagctcctgaacctgtgtgggtaccgggagagtccaggccggtcagcagtgtggccccgccgacaggcctgcgccgtacccgtaatctcaagccctacctgttatctcaagccctacctgtgatctcatgctgccggagctcattgtacttgtaggactgctccagaggcttgatggatgagtggtagatcttccgaagccgctgcagcaccgctggagacagagagggccgggggaagagcatcacgcaggtgcgatccaggcagctcctccattgtggaggggcctcaccacccagggcagctccacccctgcctggtgggcagcaagtgctgtttgcagcccagcgactgtgcaatgtatttgcatatggggagctggcccacatctcaactcgcagaaacctccaaatgaaaaggcattctcctacccacccccaaagcttcctgaactgtttggttattttattttattatttatttatttatttagagaaaggatcttgctctgtcacccaggctggagtgcagtggtgcaatcatagctcactgcagcctctaactcctgggctcaagtgatccacccacctcagcctcccaaagtgctggaattacagacataagccactgtgcccggcctgagctgtttttttttaaaacctctctcctccttcctcacctcagtagtgtgtctgaaaccttgtctcggcctgctgcctcactgcaagccctttctttggtggatgagaattccatctctgttgcccacctctgtgtgtgctccctgaggcttagaaggcaaagaggcccagcacccagcaggcgcgcagaacagcaccctggccctggcgttggcctgtcagtgtactcccagacactccccggaggggtggggtcagataacccaggtggcctctttctaagagttagctccctgctgggagcccacagtgggaaggcctatggggtgacgagtcaggctagcgagactctacccctcgatccgccaccctctagccgtgggccaggagcaaatcgctgctagcctgagctccagttaggtggctcattgattaagaggagacaagccctgctgcaatccttgggtttcaaagataaaatgaaacagcacacatgaaacggctttataaactaaaaatcacagcgagggagatggcatcagcacagcatggggctgcactggcttcgcccacaccaggccgtctacttggatggcccttcctcctctgtgcccacctggaaccccaaggcttggaccttgctcacagagcctcctccacgaagcctcccaccttcagggctctcctcttccccaacgtcccctccagcctccaagatagatacagccccggcctccaagatacagccccggcacgccctggctctcaggagcctccaggagtctgcccgggccctggtggccgggctctcccagccctgggcatatctccctcccctggttaccagagtagtcatcggatggcttgtcctcattcagcatgagggtcttctcgatgtgggagcggtccctcaatggggcttcttcatttgcatcctccgtctcttctgtggagagaagcagacagccaagtgagagcaaagctaacagccagctgagctctgggccccggcacagcagacgagggctgggcctcaagcaggggctcaacagggtcttgccaagttacactggactgagctctgcctttaggaaggaatttgatcatccagactctatgaagttccatgtgtagtgtattcgcattcggggagctggtccacagctcaacctgcagaaaccttcttatctatttatttcatatattcaacaaatatgcattgaacaccttcgccacgccaggcactgagcatcatgctgggaatacagtggtgcccaaaacaggcacaactccttaggcagctgctcttagtccagtggagtcagagatgatagtctttaaagtaacgctagggccgagtgcagtggctcacacctgtaatcctagcactttaggaggtccagatgggaggatcactggagcccaaaagttggagaccagcctaggcaacatagcaagaccccatctctaccaaaaaaaaactttccaaggagtggtgcacacccatagtctcagctcaggaagctgagacaggaggattctctcagctcaggaggtcaaggctgcagtgagccatgaccaccccactgcactccagcctaggtcacacagcaagaccctatcttaaaaaattaaaacatcaaacatctcaggaggctttagggctaggtaggagaatgccttttggcttgaaccccagcctgggcaaaagagggagaccctgtctcaaaaacaataaaaataattaataaaatgtaatcattacagatgatgaggtggccacagaaggaaacattctgaaagctaagtgcggctcaggagtgtgcctgcaccagtggtctcagcagcacggtcagagaaggcctccccaggtctctgctggggggagtgagttaggtgaccagtggagagaagcgttctgcaaaagccccagacgagccttatttagcaagaagcaggagaaggggtgtctggctgcagctggggaggcctgggtgctggggagctgctgaggtcctcagggctgaccgggcaggaccttccacagggctttgggtttcatcccaagagcaatgggagccagtgaggggctctaggcaggcagcctagcgtgatagtgcatgcctgtagtcccagctactcaggaggctgaggtgggaggatcgcttgagcacttgagctcaggagttagaagctgcagtgagctatgactgcacgactgcagcccagcctgggtgacagagtgagaccttgtctcaaaaaaaaaaaagtatgtaaattaattcttcaacgaagcctgtggggaagccatcttggagagtgaagacttgacctcgacctctaccctgaaagccccactcctggtctaagtccatgtactaagcagatgcagccatgaaggtgcctgaccgaccctcgtattggctgcaattctcacactgcccgagagcttagcccggcccttccccctctgctcctggccccgagccctttgagggcagctttggctgctttaggtgggcacttgagagtcaacagcggtcacagcctgagttctcatctcatgatcctgacccctcagtcctggttctgcaatgcttcctacagcctagtcttcaaggggagaccccagtcctagcccactaagggaatcaccagggaagttcccaacccacccccatccattccctgcacgtccctccacccgctggccccggggcaccaatcattccattagctcgctgctcctttaggctgaggcactggcatgggctacggcgcatcagggaccctaaggggaggttctggggcccctgactcggaagtaccagggcccctctgacccctctcactggcccctccaagctggaggccagtggccaatgcacagcctgaagccacctccccgggccgggactgtgaaaagggcctgccaccctctgccaccttctgtccctgcctgtcccctacacacaagacttccagggagaatgcagctgcccaagggacggggttgctgttagggaattaattcctaccctgggcaacaatgatgggactctccctccccctgatgtccctcctcgggctcctctgccttcatatccagggtctcactgcccatggactctgtattcaattcctccgggccaggctgggcccctctgtccctgtgacttgtggttcctgtggcttccggaagctctgcaccttcctggggttccctggcttcctggggctccctggcttcctggggatccccaccttcctggggctccccgccttcctgtggcgctccaccttcctggggctcctcggcttcctggggatccccgccttcctgggactcctcggcttcctgcagatccccgccttcctggggctccctggcttcctggggctccccagcctcctggggctccgtggcctcctcggaggcgccctctgcttcttctgagctagccccatcgccgctgtcctcttcggactcctcttcggagggaactcctccttcttcctcgcttccacttccatcaccactttcctcttcagaggaggcttcatctgcgtcctcctcagtcatctctggggactggttctcctcagtgtcccctgccttaacgctttgggcgcccccaggctctgcactggcctctgcagctgggccgggctccccctggtcctcggtgccctcactggcttgtgtgtcaatatctggctccgactctcccccaacagccgcgacgtcaggggctccctctggcactgcaggctcctcgccaggcccagggctgccctcggcctctgcgttcagtgggccgaccccatcaccctctgagtgaggagaggccccctctgcctttggctctgctgtccctgctactgctccctgcaccaggctgtccccttggacctcctggacttcctcggggagttcatggcccccagcctgtcctcctgcctctccactggcagttccctccgtggggagcccaaacccagtctcctcctctccttgtccctctccagaactgggctccggccactcctcttccacaggccccttggcccctcctggagggagggcgcttgccactggtgggccattcttttcctccccaggccccgcagcgtccctgtcgtccctttccccaggtggaggtgactctgtggctgaggcattggagaggctggcttcaggatcggggcccgcgctggcggcagacgcgggggtcttcttggggctctcggcctccctgccatctgggtagtgaaggagcagtttcttgtcttgaggggctgtgtctgcataaagcgccctttctttctcctctagacttgcgtctccagcagagaaatgattctccaacaaattgccaacatcttctgtgccacccgacgcggagacttgcagttctaaatgattagaacatgattggtcagtttcacagggttggcaccggctctgtttctcaagagtctataataacctagctcccgtcttctgggatgtggtgttggcctggtgtgcagtgttacgcccaccaacctgggtcttcaggactacctcgtgcgtagcgagcagaataggtgttattctgcctccctcccaagatgtagaagctgtggatcagggagttaaaggactgacccgttgtccatcactaacgaagtgagcagctgtgctaacccgagaaccgcccccgcaccgcgaccctggccctgaccttcaagcttccgggcttggtcctgatgactgtatatggagggaaagttgggcgagcccttccagtccctcaaccttgctcacgggcgtgtgcagctgggctcaaccttggagatgcttccaagaagggacaaatgcttgtgcatcccacctcatggcagttcctactgtcattaaccagcaggcttttaatactgctctcagcgaaggagtgaaaacaggtgtttgcaggccggataatcttaggttacacagcacggtgcttaagggattacttgtggctctcaaccttattaagtcacacatctaaccctgtcccagtaagggcaggcatttgctggcccccctaccttagattagagggtacatggcctgaggaggagatatctaaaacaggccgggcctggcttcccaaaggctctggccaaccccttccaaggggatccccttgtaagggactgcagcttaacccagagagcagagggcccaggaagagagaagagtaggggcctcatctgtgccagagacctctgtcaaggatcaagtttaatatgtttggaaaatggggtcagaaaaggctaagtgtggtggctcatgcctgtaatcccagcactttgggaggtcgagataggcagatcacctgaggttgggagtttgagaccagcctggccaacatggtgaaaccccatctctactaaaaatatgaaaaattagctgggtgtggtgacacacacctgtaatcccggctactcaggaggctgaggctggagaatgacttgaaccgggaggtggaggttgcagtgagccgagatcgcgccactgcactccaggctgggcgacagagtgagactccatctcaaaaaaaaaaagaaaaaagaaaatggggcccattaggcccacccctctgccccctgcccccaggctagggtctgtttatgggggacattgcaggctcatggagatgaggggaccacaggtgtcctgccttggagcagctgaggcagcctctgttcttccttgactctcaaggcccctctccgaggaagagtaccccacctatctgctggatgcagacaacccccctctctcaggccaccacttgctactcccatctctccctcccacaaagaaaagccacttcttggagtaccccttctccctcagggtacccacccttgttccccaaaagctgggtggcctccagggatcaggagcaaatattttctcattagttcccatagacagctagcctgttgtcgaactcagaaagatgtgaagcttggtgccttttattatagaggagccccgtggattgaaatatacaacttttcccccagcactttcatatgcatggccatttaaccttctttacgactgtcagagagatttcagagctgaataagtgaaagtccagagatctttgccctgccctagatacatcaccactaggtagttaatgggtgaccggaacccagaactgcccagtccctgtccaggcttccatgccatgctgtgcttagcagggcacaggggaccccttcctgctggaatctcagctcctgcctgcacgtgccttctcttcaggctcaagctccgtactggtcctggctcctgatttgcaggaatccaatttaattctgtgttcccagggcctggcaccctgcctgacccacagaaagtgctggaagaggtccgcggtcagattggggtaccaaaacgaattcctggtcccttagtgggggacaggacagggagctgactgttgctcagtttaatctcctttcatcaccacctacatacctgtaagtcctgactccttcacctacatctctatctctccaccttccacccctgcagaaaaatctatggtgggaatttggtttaatcagaagagactgaatgtcctctgaacagcaggatacgtataatgtatatgacatacatctgtatgtacatatctgagatacagcctgccaggcaatgcttaagcactttatatataaaacagtatcttcatcatactgaattttcttaatcttacttgttttggtaaaatgagtattactcatatctttttttttttttttttttttgagacaaggtctcactctgtcacccaggctggagtgcagtgaacgcgatctcggttcactgtaatctccacctcccgggttcaagcgattcttctgcctcagcctcccgagtagctggaattacaggcgcatgctaagttaatttttgtatttttaatagagacagggtttcaccatgttggctaggctggtcttgaactcctgatctcaagggatccacccacctcagcctctcaaagtgctgggattacaggcatgagccaccacacccagcctcatatctctatttttacagatgagaagtctggaaccagagacattgaggcccttgttgaatgtcacacagctaataactggcttgggccatgtgacttcagagccacagtatcccccgggagcctgttagagacgcagacttttaagccccagcctggacccattgaatcagaatctgcattttaacaaaatggccaggtgattcctgtgcacattacagtctgagaagcgctgggctacactgcctcacaaactgcccctcagccagcgactctcagcattggctgcatattgaaatcacctgcttcttggtcccatgcttccctttctctgcagttttgatttaaataatccagggtatagcaccagcatcatgattaaaaaaaaaaaaagttcttaggtaacacacaaagttgcaaaccactgcaactaccaaatcaaataatcttgacccccaggcttcagctcccaggccctccctactcgcaggcccaccccactaaggatccccattgtgggctcccacgttggggggggtctcctagggcctggcatttgcctttggaacagcagtagttaaggcttctcctctgggaatccagccctttccatgggctcctgttgtccttcaatgatgatggtgatgaccgtgccgatgatgaggatcgtgatgatgatgatgatggtgatgatggtgatggtgatgaccatgctaatgatgaggatcgtgatgatgatgatggtgatgatgatggtgatgaccgtgccgatgatgaggatcgtgatgatgatgatgatggtgatgatggtgatggtgatgaccgtgccgatgatgagggtcgtgatgatgatgatgatggtgatgatgatggtgatgaccgtgccgatgatgaggatcgtgatgatgatgatgatggtgatgatggtgatggtgatgaccgtgccgatgatgaggatcgtgatgatgatgatgatggtgatgatgatggtggtgactatgctgatgatgaggatcgtgatgatgatgatgatggcagcaatggtggtgatgatgatgatggtgatgacgacgatgacgacgatggtgatgatggtgagagtgatgatgacaatgatgatgagaatgatagtggtgataatgatactgagttgaatgaactctaggtctgatgtcctataacatttctgacagtctcaaaagccgttttccctggtaaaggtgagagggccacacagtcccaagggggatgaaagttccaaatgttggaggttcaccgtgaccatgaccttcacactgctgtgtgtttccactcctgcgccctgggcaggaagcaaggtgtgtgcatatgtgtatgcacatttatattcaagctcttccctggttttcacaacttagggctgagcttcccctgaacttctgctaaacaatttggagtaaaaaggactgaggataatggcttcttacactgtgacctttctcccaggctaaaaataactgctccaacagaaagtctctcaatgaaacaagctgtcccattgggccccagagctcactccccaggaagcagctgtgccactggacccagttctcctcttggaggcgcagacagaggtgtgggagcctccgattacactcacttccatcgcatgacatctcacttcaatcctgggaaatcaaggctggtgtctttcccacctcccttgcttcttgccgaagcaccctattggccctggagcagggaggccgcagaggacccaggacaccctggagaggtgaatccccagtaagatgagtcttggtctatcctgggacatgaagtaccgcactgtatgtgctgctgccagggtggcccccccgactccggccaggccaggcccgggactgacgtcagggcacaggaatagcaggccccaactctgcccagagaccatgggaaggccccaccccactcacacccagtccaagcacaacacacaacaatcctgcttctcccaccagcccctctgccaccagcctttctcggggggccagctttccagcaggtcccaccagccccacagcctcagggcaggcccaggctcagtccctctctcctctctccatcaccaaccaaatgccctgattttgtttcttcagccctgtctctttccaaagcacttctacatggactcagaggactatggagttgccaagggccctcgtgagtccaactgtaaaggaggacgctctggccagataccttcagagacttgcccaagattggggcaggggtgggacagagtccaaatatatgaaccttagtctggagttctttttgcccccatggagttcacaaaccatgtcccatgaagtgctagggttccatagaagtgactcatggggtgaggaaagatcaaacagcagagacagccacccactttgtacttcctgctctccttgaatttgtctgccccagtgtccacagagaaagactgcagggagattggcaagccctgctcctttactctcctcgcttcttccttcaaaatattagtatctgccttgagcctcctatccattattttctccaacgtcccaagacatcctgcttacagcatctttttttttctttttctttttcttttttttttttttttttttttttttgagacaggtcttgctgtcgcccaggttggggttcaatggcacaatgacacctcactgcagcctccacctcctgggctcaagggatcctcccacctcagctcccccaaacagctggaactccatgtgtgtgccaccacatccagctgatttttttcatttttgtagagatgaggtctcgctatgttgcccaggctggtctcaaactcctggcctcaagcgatcctcccacctcagcctcccaaagtgctgggattacaggtgtgaaccacgcttacagcatattttcactttgccagtccacacgtgccaggctctcagctgggtcatctcctgccctcacgtaggactccatctttccaaggtagtttcctgtgcttattcttctctgatgctcctagcagccctctgaggcagaaaaagcaagggttgttaacctctcttgaaatgaggaaacaaacacacggaagtcaagtcgtttgcctcacaagtcattccagggatgggctggaactcaggccaagagacagaacaaagctccctgggagcgaccatgacctgctgagctgttcaagcccagatacccagcttctggggctgggtcaacgtgtacctgtgtgtttcacaaggggattctacagaacaccagcatttcggaccctctgcactagccatcctcagtaccaagggccaggaagctctgtcttgaagttgaaactagagatggagagaatagaggtcaggacctgttttcagcccacctctgggtgttgaatgtattcagtgccttcgtgcaatcaaatgtagattctattccagcccgtccaagtctccttagcacatgtttataacaagtacctgccaaggttattcttccacatgacttctcatccatttgaactagagctagcaagtccaaagtcatgcgtaagtaaaatacctctgaccattactcatacacagttatgcaaatcagtcattagtaacagaatccccagcgggggcaggaatcactctccaaatctctgcctggttcatctgtcccagagagtgaggagcaccagccatggcatacatgtgagccccatgtcttgcccccatccaccccccgccccacgttttggctctcattggctgtatattaagtgcagcagggagcaattcagaaaacagagttcatgccgcagagcaggcagcctgcccccttccttgttctagatcttgtctctgaacactcgtggaccgggcaaacgtgggccagcagcctcttctggtgtcctgtttttccttgactttatcctactgggtaaacattcactgctcaggaccccttgctcttccacttttttttttttttttagacgaagtctcattctgtcgcccagggtggagtacagtggtgcgatcttggctcactgcaacctctgcctcctgggttcaagcgattctcctgcctcagcctcccgagtagctgggattacaggtgcctgccaccactcctggctaatttttgtatttttagtagagacagggtttcaccatgttggccaggctggtctcaaactcttgacctcaggtgatccacccgcctcagcctcccaaagtgctgggattacaggcatgagccactgcacccggcctcttccacttcttagatgaagtcttaggacaactttgcagaaggctgttgcccataaggacccgagaagagaaattctggctggaggaaggcttgtctgcattctcccaggacccctgaggtcctcttctgccattctctcagcctttccctcttctcccaacatgggcgaccagagtgcaggggctgaggcagccattcttggaaggcttctttggcttcctggccatgctcctaaagtcaaggctaatcccactgggacagcttgtccctggctggactctagcccttaaaatgattcatccagggaatcagatacaatgacaaaagtatgacagggtacaatgacaaaggtagcaatcagaaagaaccttgggatttgggggtccagagagatcttctgatagaccaactggcttgatttcactcatgaacaaaaccccaaaaccctggtaagtgcttgtcccaaggccatggggctagttaaggtagtaggcagcagtctgcttctagaactcagctctctatggacgctctcccagcagtgggccagccaataagagggtctaagtctaccctaggacagtgatttcttagcccaccctcttctactcttcaataacaactgttttaggctggacgcagtggctctgagagcccatggctcacacctgtaatcccagcactttgggaggccgaggtgagaggatccctagagcccaggagtttgaaaccagcctgggtaacaaagcaagacctctgtcttgcttactacttgctttgtcttactactggcccatctttccaaaaaattttaaaattagcttggcatggtagcgtgcgcctgtggtcccagctactggggaggctgtggttgacggacctcttgagcctaggagtttgaagttgcaataagctttgataacaccactatactccagcctaggcaacagagggagaccctgtctcaaaaaaaaaaaggattaagacttcagcacaattgtttttaacccatagagtcctgagaattgacagaataacttcactcctcaccccacctccaattcctgggaattcttggtttgggaggtagaaagaaattaccagaaatcccacaaccatcatatatatacatgcttgtcactgatgcctggaggagtcatcagtataaatgactattcacttttattttattttatttttattttatgtatttatttattttttgagacagcatctctgtcactcaggctggagtacagtggtacaatctcagctcactgcaacctctgcctcctagattcaagcgattctcctgcctcagcctcctgagtagccgggaccacaagtgcacgcaaccacactcggctaatttttgtattttttgtagagatggggtttcaccacgtttgccaggctggtctcaaactctggacctcaagtgatccacccgcctcaagttcccaaagtgctgggattataggcatgagccacgatgcccagccactattcactttaaaaagacaaatacctcagaaagagcaaaacattatatcctaacccctcagtatgagtcaatcactagcagggatactctatagagcactcagtttttccagagatcagccgtgcctgcagtgaacagaaatccttgcagaaggccttgggcctgctgcctcccttcagaggggccgagctggggaggaaagggaaaggaaggggaaagggatgcaggctgggttctgagacagaccaaggcaggtggctggcttccccccacatcccagtccgaagaaatccaatctccctgggatctgtggggatgaggtgctggtctaacttttgggccccagacaggaaaagacttactggaagccaagggagcgtggctcccgcaggtctcagtctaacagctatcctgggttaaagtcagagccatctccagcttggcaggtgaaggggtcaaggaatctgggcccaccccatccccaatccagggaagctggagggaatcttcttgagaaacgtgggagcttgggaaatgggtgtgacaccttccctagcctgagccaggcccacggctatgccttttctttcttcctggggctgaggctccagcctcctagatagtggctggtctctctgaatgcacctggaagtcaggaaagctgggttctgccccttactctttttctttttttacagaccctgtcccttagagacagggtcttgctctgtcacctggactggagtgcagcagtgtgacgaaagctcactgcagccttcctacttgtcacacttcagcctccagagtagctgggactacaggcacgcgccaccatgcctggctaattgttttattttttgtaaagacagggtctcactatgttgcccaggctggtctcaaacttctgggctcaagcgatcctccagccttagcgtctcaaagtgctgggattacaggcgtgagccactggcccctcccctgctgtcttaccactggcgcccccaccccccgctgtcttactacccagcgaagtaaccttgggttgctccttactccctctgcacacaactttattcgcccataaaatgtagataacaatacctgctttgccagccccatcagagcgttttaaacatcaggtggtgctcagaagcatttcaataaatgtcagctatgagcatcattctttcctagaagagcaaagacaccaggccaaatcccaaatttgctgagtgggccacagcagagccagcttcggacaggagccgagccagctggcccttcacgctgttcctttagccctccgggtctgggggctcagtcagggggcccggagccatccatccttctgccagggactcctcctccctggctgccagccagaggcagctcaggcgaggagctgcagggtgcctgggggtgagccctgcgctcttggtgaagttctggctggtctgggaacggagcaggctgagctgtcaacactcccaggggccaggagctcgttctgctgatcccaaagttaacccctgcagtccctgactccagcctcagtcagccctgattcaccagcaacatctgaggccacatgtggcctcccctttccccaccacgtcccatcccttctgtccagtcactgaagtgaggtgaccccgcacttcaccccaacgcaaacgcgcactcaggaagtttaaacagacccattctaagggccacgtctttctgagaatgggagggaagccctttccgaaggcagaggaccggtaagggcccttcaaagctctctgaaacagcaacacggtcggagggaggtcattagcagtgctgtgtggcttcctcatcctcatggtaagtgagcactgggagtaagacaatcagcccttcagaaaccactcgggcctggagaacgcagccagggctgagccacagagatggggcaggagcagttctggcctccaatatacagcggcgctttgctcctctcgcacaagtgaaatcacagctgatgtctccatggctttgaagagcctcacacacaggcccgctggaccacgtgggccctgctcctccatcaccagcagctctgtccccattagcagagcaggtgagaggaaatgccacacccagagtgccagacaacagggcgcacagcccccaacctgctcagccggggaggtgtcctcagccatctctcctacaactgccaggaagaccacagaagccggcggttcccaagtctacgcagagttagttaaggaggaaggccaggcctctggcagagctagggcagcaagaatacacaaatgtcctgcccatgtgccccagctcatagacctctctggaaaaacttctgcctagacaccaaaaggccagatttttcaaccttctttcccagagggtgtcaccgaatccatgacagatgggccccaccgccaggtcctggcattcatggccccaggtctcatcttatttatccttatggttatttttgcattcaaggctctagaatcagaaagaaacttagaaagtaactagcccaactctttagcccaactctttcttttcacagaggaggaaaccaatgcccagagaggaaaaaggagcttgccagaagtcgccagtgcactgggacaaagctagaactagagacaaggtctcctgaccccgcagccgtagtcttcccatagggggcccagacaaatacaacttccccttctcccagacgtttctaagctttggatgctcacatcctgccctgtccctgggagctggggcccctggattgctcatctgtccccctattgttcctacaaaggacagccccttggtgagtctcagagggctgtgtcggggcagccacagtagtgtcaggctggcgccctgagcacagctttttttttgagacagtctcgctctatcacccaggctggagtgcagtagcgcgatatcggctcactgcaacgtccacctcccagtttcaagccactgattctcctgcctcagcctgttgagtagctgggactacaggtgcatgccaccatgcctaggtaatattttttatatttttagtagagatggggtttcaccatgttgcccaggctggtctcaaactcctgcactcaagtgatcctcccgccttggcctcccaaagtgctgaggttacaggtgtgagccaccacgcctggcctgtatggagattttaggaaggacccagggtgagggttagctccctgcattcagcattaagtctgtggtattcctggcgtcagcagaggcatgcaggaatggttgtcatcaccaccaagagacaaaggacagttggttccatgagggctgtgtgagatcagctcttagctatctgagttcaaggtggcagaggccaaaagaagatgggaccagaagagcattccagcgtctgggtcattagagaagggaagaccctcccagcccaccttgccgctccgtgaacagtacaaactctggatgcctccagagcaaatctgaccattaccctgaattttcactccagagtacaggtgtccagaacacccagccaccctaaggggaaccatcctagaaatctcacgtctaggccaggtgtggaggctcatgcctataatcccagtactctgggaggccagatcacttgaggccaggagtttgagaccagcctggccaacatagcgaaaatctgtctctactaaaacacacacacacacacacacacacacacacaaataaccgggtgtggtggcacacagctactcaggaggctgaggcacgagaattgcttgaacccgggaggtggaggctgcagtgagccgagatcacgccattgcactccagcctcagtgacaggagacactgtcctagaaaaaaaaaacacacacacatctcatgtcttccctgggagcagccttgctagagcctctgatttacatccccagaccccttaaccccagacacatggggatgcactttcctgggtgagctgcaggctccatcccgcccctcaggccgggcctccaagttgcctggctccctctctggatatcccaccccagggagaaatcatcattcaacccaacagcagctttctctggtgaactttgtgtcactgagagcctgggctctctgcatctgtctcatctagtcaaacactgaaataactctgggtggctgaggcagggggatcgcttgagcccaggagttcaagaccagcctaggcaacatagtgggaccccgaatatacttaaaaaaaaattagctgggcctcgcggtatgctcctatagtcccagctactcaggagactgaggcaggtggatcgcttgagcccaggagttctaggctgcagtgagctatgattgtgccactgcgctccagcctggcaacagagcgagatcctgtctcaaaaaaaaccccacaaatactgaaaccagatgaggccctcatcgcctgggaccatgggctattccattattttttttttttcgatacggagtctcactttgtcgctcaggctggagtgcagtggcactatctcaggtcactgcaacctctgcctcctgggttcaagtgattctcctgcctcagcctcctgagtagatgggactacaggtgcatgccaccatgtccagctaattttttgtatttttagtagagatgggtttcaccatgttagccaggatggtctcgatctcctgacctcgtgatctgcctgcctcagcctcccaaagtgctaggattacagacgtgagccactgcacctggcctattccgttcttttcttttcccttggcagcctcatggccacacagcaggccaggctgcctactccctagttcccaaaggactcccctgaagagaggaaggctgaagccacagcagggctagagcaagtgtacattccacactcgctgtccccaggctgaccctccccggtcaacactgagagccacatggggccacctccagcccatgtctgaggagcttagtgggccggcctggccaaagggtcccactcagccctggtcaaaaaaggcccagatccctgcactgatgcctgaatgtggttttgtatttgttctatggggctgctgtgacaaagcactataaacttagtggtgtaaaacaatggaaatgtgttcactcacagtcctagaggccagacgtctcaaatcaaggtgccaagagggccacctcctctgaaacccacaggagagactccttcgttgcctctctagcttctggtgtttgccagcaactcttggcttgtggctgcgtcactccagtctctgcctccactgacacaaggccttctctgtgtgtctgtgtcttttctcttcccataaggacaccttcatattggatttatggccagccccactccagcatgacctcatcttaactaactacatctgcaaccaccctacttccaaataaggtcacattctgaggttctggggttaggacttcaacacatccttttgggggatgcaatccaacccataacaggtcccccaatagcccacaccaccacctgcctaacccactgccactcccttcccccagcctggcccctcgctaatcccagctcacatttcagatctcagctttgagtcccatcccttgggagtcgtccccgacccctcctctggtctgtgtccctgcagcacctgtcacctatgtgacatcaccctatgtgacggctttttttaaaaacagggtctcactcttgtaacccaggatagagtgcagtggcacgatctcagctcactgcaacctccacctcctgggttcaagtgattctcctgcctcagcctcctgagtagcttggaatacaggtgtgcaccaccatgctcagctaatatttgtatttttggtagatacggggttttgccatgttgcccaggctggtcttgaactcctgactcaggtgatccacccgcctcggcctcccaaagtgcttagattacaggcatgagccactgcacccggcttttttgtttttttcttttaacctgtgtccctccatagatgagcagctgctagaggctggtgcctgtgacttgtccccactggaggctgcagatatcccctcaccataagtaacctgctggctgcattgagagcacctgacagtaaggagccttgctcctggccagcacttctcaaggtgtggctcgagggctatctgcaaaaggaccacagaggagcttgattaaaagtacaattcctggcgagatgcggtggctcacgcctagaatcccagcactttgggaagctgaggcagatggatcacctgaggtcaggagtttgagaccagcctggccaacatggtgaagccccgtctctactaaaaacacaaaaattaggctgagtgcggtggctcatgcctgtaatcccagcactttgggaggctgaggcgggaagatcacttgaggtcaagagttccagactagcctggccagcatggtaaaaccccatctctactaaaaatacaaaaaaattagccgggcatggtgacgggcgcctgtagtcccagctactcgggaggctgaggcaggagaatggcatgaacctaggaggtggagtttgcagtgagcagagatcatgccactgcactccagcctgggcaaaagagcaaaactctgtctcaaaaaaaaaaaaaaaaaagcaaaaaagcaattcctaacgtttggggctcgatgattgaaaaaaaagaaagaaaaagaaaagtaccattcctaggcctattctcaggcctccagaacaaaggagtgggcaggaggcctcaggaatccaccttttttttattttaagatacagaatcttgctctgtcactccagctggagtgcagtggtgcaatcatggctcactgcagcctcaaactccagggctcaaacgatcctcccacctcagcctcccgagtagtgggactacaggtgcatgccatcatatctggctaggtttttaaattttttttttttttgtagagacagggtcttactctgttatccaggctggtgtcaaactcctgggctcaagtgatcctcccacctgggcctcccatagggctgagattacagaaagatgagccaccacatccggcaaggaatctgccttttaaacaagctcccagaagattctcacacacactaacatccgagaaccaccatccttggaccttgattatgggagccaatctaagcccatcttcccagagacctacgggttgcaaagggtggaggaacctgcttgtgtgaggctgcaccagtcctgcccctgggacccccttcctagctacgatccacttccagggccacaggcggccaacaaaagctgatgtccatcagccctaggcccatcatgggtgggggcatagctggccctgctccctgcccgataatattcctgggaggagaaagaagagagaggagcagctggtggtcgggggccctcacagcaactaccatggatggaactctagtagccagagctgcccagggagcacagtgatggaacagccctgggaccccgggcatctggaggagggagaggagaggaggagggagagagagaggagtagaaagatcagtgttaggagcccaagtgttctcccctaatcagcagtgggacctcaagcaagtatttaaacatttctgggcatgtttcattagtaataaaacagaagagaaaaacaccaaccctgcccacccctcagacttgcagtgccttcaccccactactattgatggagtgcctatatactgtcacacagtgggaggaattctgaaagctggagagtactagaacgtacaagatatttctaattataagataaagtgaggccaggcacggtggttcatgcctgtaatcccagcactttgggaggccgagacgggaggattgcttgagctcagcagttcgagaccaacctgggcaacagggtgaaacctcagctctataaaaatttttaaaaattaaaaaaattagtgtgatggctcacacctgtggtcctacctactcaggaggctgaggcgggaggatggcttgagcccaggagacggagtttgcagtgagcggagattgcgccactgcactcactgcactctcgcctgggcaacagagcaagaccctatctcgagaaaaaaaaaaagaaaaaaaaaggataaagtgtccccagaatgtatatccacacaaaaaactgtacactgatgtttatgagcagtgtgattcacaatagccaaaaggtggaaacagcccgactgtccatcagtagatcaatggataaacagaacatggtctatccacacaatgcaatatttcccagccatggaaaggggtggagcgcttccacctgctacaacacggctgaacctggaagacacggtggtaagtgaaagaagctggacacaagagaccacatcttgtgtgattccatttatacgaaagtccagaataagcaaatccatagacacagaaagcagattagtggttgctgggggagcagggaggaatggatggtggaggagaactggggagtgtgtgctaaagggcccagagcttctttttgaggtgataaaaaatgttctaaaattgactgtgttgatggctgcatatatctgtgaatatactaaaaactactgaattgtatgctttaaatgagaaaattaaatgacatatgaattatatctcaataaacctgttttcaaaaataataaagagccgggtgtggtggctcacccctgtaatcccagcactcggtgaggctgaggtgagaggatctcttgaggccaggagttcaagatcagcctgggaaacatagggagacctcatctctaccaaaaatacaaaaaatgagctgggtgtggtggtgtgcacctatagtgccagctactcaggaggctgaggtgggaggatcgcctgagcccgggagtttgaggcttcagtgagccctgattgtaccagtgcactccagccggggtgacagagtgagaccctgtctctaaagtggctgattcttttctttctccaaaaccttaattaagttgtttacctttaaaatataccctcaatccaaccatttcttaacacccctgcccccaccggctccctggcccagccactgtcatctcccacctggattgttgatgtcaccctttcccgagctgcctgcttctgtcccccatcccctgtgtgtttcccacacagcagcagagcaacaggagacccccactccacacactccctccggtggctcccacctcatgcaaagaagaggccaacatcctacggtgacctggaggcccacaccctctagccctgcttcacctgtaaccccatctctcccatgtgccccctcgtccactgtgtccagccactctggatttgctcttcagggcccctcctgccctctgtgcttgctttgctttttgctgagaatgttcatgcttcccagacaaccgtctgtctgactcactccttcctcttctaagtctgctccaatgtcaccagctccataaggccttccctggccacctactgaattattgaatattgtctcccagtcagtcttccccatcttccatccctggtttttctccatcgcatctaccaccttctaataatctacataacttactcagtttcctgtctgtcagggattgtgtagcccctgcacctagggcagccattggatggatgggtggatgaacgaatggacagctggatggatgaatgaatggaaggatggatggatgaacagacgaatggatggatgggtagatggatgaatggaaggatggatggatgaacagatgaatggatggatgggatggatggatgaatggatggatgggtggatggatgaatggaaggatggaaggaaggatagacggatgaatgggtaggtgggtgggtgagtggaaggatggatggatggataaatggagggacagatggatggacacatagatggaaagatggatggatgggcagatgaatgggtgaatggacagatggatggataaatacatgaatagataaataaatgggtagatggatggaaggaaggaagggtgaatggaaggatgatggatggttgaatgtgtggatgaaggaatggaaggatgaatggaaggaaatatggatgaacagatggatggaaggatggaagaatgggtggatggatgaatgatagatgaatgggtggatggatggctgaatggatggatggatggaagaatggacggatggatggatggatggaggggtagatggatgaatggaaggatggataggaagaagatgaatggaaggatggatgaatggatgaatggatggatggaaggatgaatggatgggtggatggatgagtagatgcatggacgggtggatgaataggtgtgtgggtggatgagtgggtggatggatggatgaatagatggaagaatggactgatggatggatggatgaatggatggatggatggatggatgatggatggatgaacagatggatggatggataaatgggtggattgatgaatggaaggatggatgaaagcaaggatggatggtggatgaatggaagggtggatagatgaatggacagacggacagatagatgggtggatgggtggatgagtggatgggtgggtggatggatggatgaagggatgggtggatggatggatgggtaggtggacagataaatggatggatgacggatggatgggtggatgcatggatagatgggtggatggacagacagatgggtgaatggctgggtggaaggatgggtggatggatagatgaatggagagattgatggatgggtagactgatggatggaaggatggatgtgtgggtgcgtggataagtgaatggatgatgggtggatgaatggatagatgagtggatgggatgaatgggtgggtagatgagtagatggatgatgggtagatgatggatgggtggatggatggattggtggacagatgggtgaatggaaggatggatgaatggatggatcgatggtggtggtggcaaaatggaagaccttccgtcaaccccacttgcgttccaagagacaggagaggacccagattcagaaccagggaagtgcttgcctaagagtaggctgtgtcctcaggccatgtcacctaacctgtccaggcccgcttctcattattaaaaggccccagaggagctgctttccacacctttcatcatgtgacagctacatgaactgaactgctgagttgcagggcctcctcttaaagaccttaagatcttattggagggaaaggcaagcaggcagaaagatggaactaacttcagggcagctcctgagcaggaatgtgaacccaaagggctgagcgaaggagcccatgaggaagtgaagtcatttggggtgggacactgcaggagcccagccaggtgtgtggggacagtggctgtggttaggacagtgggacacagccaaaggagagcctgggatgctggtctaaggagggcagcctgggattcctggaccgggcctccctgaccattggtggccacttctgaaaaggcctgaaggccgggagcagtggctcacgcctgtaatcccagcactttggaagactgaggcaggtggatcacgaggtcaggagttcaagatcagcctggccaagatggtgaaaccccctctctactaaaaatacaaaaattagctggatatggcggcgcatgcctgtaatcccagctactcgggaggctgaggcagagaactgcttgaacccgggaggtggaggttgcagtgagccgagattgcaccactgcactccaacccgggcgacagagcgagactccaccttgaaacaaacaaacaaaaaggctggacgcagtggctcacacctacaatcccagcactttgggaggccgaggcgggcggatcactaggtcaggagatcgagaccatcctggctaacacggtgaaaccccgtctctactaaaaatacaaaaaattagtcaggcgtggtggcgggcacctgtagtcccagctactcgggaggttgaggcaggagaatggagtgaacccaggaggcggagcttgcagtgagccaagatcatgccactgcactccagcctgggtgacagagcaagactccgtctcaaaaaaaaaagaaaaaaagaaagaaaaagtgaaaaagaaaaggcctgaagaccccggggctggggaaaggtggggaccagtctcctcactcttgttcccctccagaactggactgagccacagccacaagcttcaagggctgcccaaacaccccagactctgggtttgggacccctaccacccacagcgagaagacacagccttctagtgggggacccctccttctagagagggagaggtcatgagaaagtgaacttctcagcaacattcaagaaggttccacacacacacttatgtgttcactgcagcgttactcacaacagcaaagacacagaatcaacccagatgcccaccaacggtggcctgaatcaagaagatgtggtacatctacaccatggaataccaaccagccattaaaaaaaatcatggctgggcgcagtggctcgcaactgtaatcccagcactttgggaagccgaggcgggtggatcacaaggacaggagatcgagaccatcctggctaacacagtgaaaccccatctctactgaaaatacaaaaaaattagccaagcgtggtggtggggacctgtagtcccagctacttgggaggctgaggcaggagaatggcgtgaacatgaacccaggaggcggagcttgcagtgagccaagatcacgccactgcactccagcctgggcgacagagcaagacaccgtctcaaaaaaaaacaaaaaacatgttgtttgcagaaacatggatgcagctggaggtcattatcccaagcgaattaaggcagaaacaaaaaaccagagactgcatattctcacttataagtgggagctaagcattggagacacatggacataaagaggggaacaatagacactgtggactactagatgggggagtgagaaagaggacaagtgttgacaaactacctattgggtactatgttcactatctggctgataagatcaacaaaagcccaaacctcagcatcatgcactacatccatgtaaaaaacctgcacacgtcccccctgaatctaaaataaagttcactcagaagttcttcctctgaggagcttctgcagatgaggaggtgcttccacatcctgcaccatctcctgcttggctgctgtgcccaaggccaagactttgaggggactgcgtgctggggcctcgtgcagaagaagagctgggcctcaggtcacagagtaagctggtcctgggcttccagcttcttgctcccttactcttttcatcacacaggcagccaggacccagacctccatccctttcccctctctacctcaccctgcgtcagagacacaccccctaggaactgggcaattctggtcaattctccccacccgggcagccaccctcctacctaccaccactactaggccgggctacctcctgagattctctgcctgagccagtcctccatctgttcattcaacacacttgcccgggtgtgtctgcagagctccagatcagccagggggggcaacccatgagctgtggaacaaagtggaccaaggaaacaggtaccccctccacccagtggaagaccatcccctaggagaaagccccccaaaattagtgtatctctaaaattcatatccacctagaacctcagaatgtgatttttttttttttttttgagacagagtcttgccctgtcgcccaggctggagtatggtggtgcgatctcggctcactgcaacctccacctcccgggttcaagcgattctcctgcctcagccccccaagtagctgggattacaggcgggcaccactatgactggctaatttttttttttttgtatctttagtagagacggggtttcaccatgttggccaggctggtcttgaactcccgacctcgtgatccgcacccccttggcctcccaaagtgctgggattacaggtgtgagccaccacacccaggaagaatgtgaccttctatggaaacagggtctttgcaaatgtaattagttaagatgagatcatactggattaggtgggccctaaacccaacatcttcaatgtccttaggtgatgaggagaggacacagggacacacagacaagggagaaggccacatgatgacagaggcagagagtgcagtgatgaagctaccactcaaagaatgccaggaattgctggcaaccactggatgctggaagaggcaaggaaggatcccccttagacctttcaaagggaatgtggccctgccaacaccttgatttcagacttttgggctccagaattgtcagagaataaatttctgtggttttggccaggcactgtggctcacacctgtaatcccagcactttgggaggccaaggtaggatcacttgagcccagaagctcaagaccagcccaggcaacatggcgagagccctgtctctacaaaaaatacaaaaattagctgagcatggtggtgcatgcctatagtctcagctacttgggaggctgtggtgggaggatcacttgagcccgggaggcagagattgcagtgagcagagattgcaccactgcactccagcctgggcaacagagtgagaccctgtctcaaaaaaaacaattgctgtggctttaagctactgactttgtggcaagttgttaccgtggtcccaggaagatcaaataggaaccaacacctaagcctggcgctgtgagagcttcctgacaccatttaacactgagccaatcgttttcaccatccccatggccgcagaccctgtcgtcaccatcctggggcccacatgctctgaaacccagctcgagccccccttccaggaagcatgccccgacaaccgctccccctttctctgcactctcaggctgcttatttttagctgctgattacgtctaccttatatggttctctattcatgtcatgagcaggggctgtctcccctcctagtctgtaagctctttgaggacagagaatcccaaggatattaacagtcctgagcaggggaggcgtgttgatggattcccctggttggtcaagtttcatgatatttcaggaaactggaggcaaatatcaagttgccgcatactcacaagagtgataacctgtcattcttgtcatagtccttttaagcttagaaagtatctattatcaaaaaatattttaagcatccgatagccattttcttattatagtcacgaaacagccccatgctggaaatagagcaagtatcattatccccattttatgggtgaagaaacaaacgcagagatagtcagggacttggcggctgatttgtgacaaaaccagcatttgctctgcccccgggttccggtgctcccgctgggccccaccccaggccagccgctctgcctctgtgtagacagcgccaagcaaggagggacttggtggagtgctcaccagcttaactaccaattcggaaaggaaacaaaggcaggaaaggaggtgggctggtgtcttgggagcccgaggccaggatggtctccccaggacagggtgagtacttgacacttctccagttcttttccagattcttcccaagtcctagagagcactcccggtctcttgatctccttgggtaagtgcaagaaaaataagtaatcatctactacttgacactaagtaatcaacaaattggctagaggcctctctggtggacacagggacacaggtggtcacatcaggccctaaatgctgtgtaagttggaggcccatcagtggcatggcttccaaaggaatggcttggtcaagcctttacctattgccatctagacgaatttttttttttttcaacagagtcttgctctggcacccagactggagtgcactggcacaattacagttcaccgcagccatgacctcccgggctcaagagatccacctgctccagcctcccaagcagctgggaccacacgcataggccattatgcctggctaattgttgtatttttttgtagagatggggtttctccatgttgcccaaggtactcttgaactcctgcggtcaagggatctacccgcttcaacctcccaaagtgctgggattgcaggcaagagccaccgtgcccagcctaggggaaattctatgggagaaaactgagctggcctaggtcctagccaaatgactacctgaaggaggaccgggggctgcagttttggcagcaatccagtggtggggggaggcgggggctcccaaaccccgggactctcccctgagctcccagcacaagccacttcctacaagcccagaactccaggccagactttgtctgcacctgtttgagctcagagtacagtccctgctctagaagcatccaaaaatatctgagagagcggggaatagggaggggctatctggaagaaaacaggctagagtcttcagagggctgagagaaagagccacttggctcagcattcaaggttcttcccaactggccccaactcatcagggtggcctaatctcccccgaacacgagccccacactctagccagagctagtctcatcctgtccctggcagtgccgtgctctgagcttcctcacctcctggcttttgtcaccatcttcaggtgtctctgcctgcacaaatcatctgtcattcattagaccttgttgactgccttgaatgagccaagcgtcatgctacactgttcgtgatgaaatacgggcaaattaaacaaaggcacagcttccaccctccccaagctgaccgtccagcaattgtcccctccctgcacgttgggctgaaaccctgtccctctgcacagccaaccttcccaaccatcttctgaacttcaaccagagtgagcatagactgctggtgggggggtgttagttacatttttttttcagtgcgtgtcatctccccaaatagaaggtcagctcctgagggcagagacacaactcattcccgcctgcacagtgcagctggccaggacctcacagggctgacaaggggctgagagatgggcctcacagggagggacccacagctgccttacacctctccctgctctcatcaaatgccccactctctctgctccctgcagtctctgaggcatctgagtctgagattgtgccataccctcatgcttctatttgatccttttgtgccttcatccctaacccgagtccatcctgcttttccagcctaaagggggactccctttagggagcatctctcatttcttcaggatttggcacccaatctctcctctcctgccagggctggccatggcctgcattcattctgtgttctctctctcttttttttaaatatggggtctcgctctgttgcccaggctagagtatagtggtacaatcttggctcactgcaacttcgacctcctaggctcaagccatccttccacctcagccccctgagtagctgagaccacagtgtacccactacatccagctatttttaaagtttttttgtagagacaagatctcactgtgttgcccaggctggtctggaactcctgggctcaagcaatcctgccgccttagcctcccaaagtgccgggattacaggtgtgagccactgtgcctagcctattaattaaatttaataaattattgctttaattctgatttaatttggtgctttcattctgattctgccaccttccctgagatggggtggctcagcaattgctgctctgggagtccctctgtgacagacaatgaggaagtcacaggcaacaggcatgtccccaaggtaggggggcagctgggaccttgactccgagtaaaaccaccttcagggctgcagagggatgagggaggctgaaaatagatggaacaggacttctctgatattagagaaggatgacagcacaggctgccgccatcgaggaaatgaatcagtctctagaaactcagttaaatccgtcccatttgctaaactgcacccacccctgtcacgtcctactgaggatacccagctagggatgagcacaggggactgggacctctcgagcactgggcagatcatgcttagcagccgtgctcgccatggctccaattcattcattcattatttcacccattcaggacccagaagagaaacccctgctatgtagctcagtccctctgcgctcagaaccggtgaactatttaccacctccgtgttgagatttaggaactttgggtgagaccttgcctgccaaatgggaaattccatcttagagatatcttccttgagctgaaatcttctgaatcctctgaaacacagacagacttgagcaaagtgcccatctgtgctgcgagtcaccagcctccactgcaatgagctgcagctccccccatgaccagtgtcttggtagcagggacaggggtcggagcaggggcccagcctgagtagggaagggagacccaagagggaatgaaggagccaaatagggcggaggcagactctgaagatcaacttttagctctaagaagacaggtgaggccaggggcgaggtccctgagaagacaggactcccagagcaaactcgggagagaacagaagccagcccaccaccttgagccaaagtgagtcctcatgccaaagtgagtcccaccaatgggacacgagagggcacaggcctcacagccaggaacacatcatgaaggggacctgaggctggactcccatccccagtccacaaagaagaatgaaaaccaaagtcagctgcgtgcagtggctcacacttgtagccccatcactttgggagaccaaggcaggagaatcacttgagcccaggagtttgagaccagcctgagcaacatagtgacatagtgagaccatgtatctacaaaaaataaaattagctgggtgtggtgacacatgcctgtagtcccagctactctgaaggctgaaatgggaagatcacttgaacccaggaagttgaggctgcagtgagctatgattgcaccactgcactccagtctgggagactaagtgagaccttatctcaaaaaaataaataaaaattaaaaaaagagagaggactacagtcatcatctgagtaactcaggccacatatccaccgcgccaatttccacttaaaaaagctagccctgggccgggcacggtggctcacgcctgtaatcccagcacttgggaggccgaggtgagcggatctcgaggtcaggagatcgaaaccagcctgaccaacatggagaaactccgcctctactaaaaatgcaaaattagccgggcatagtgtagtcctggctactcgggaggctgaggtgggaggattgcttgagcccaggaggtggagactgcagtgagccttgatcaaccactgcactccagcctgcgcaacagagtgagtccctgtctaaaaaaataaataaaaagaaaacgtaaagaaaaatattttctctacctcagtaaacccatctgcttttaagttactgttgctggcctttatttatcccaaacttaatttttaaaggtttctatgtctaaagatgttgcctcctcatcctcactaaataccctcaaaccctcctcattggtcagtgacctcctggttgtcagaaggaacagctcctctccctcagcatctctgtgatatttaatcctgctggccactcgcccttcttctagaagacctgggcttgcaggtcactgtctcttcttgggtcccttcctatctttctgaaattcatttatcttcttcctcttcctactcctcaaacttagcgttgatcaaggactggtccttgaatctttgtctctccctggtacagctccatgggtgacctcagagcctccctctcatctttacgtaaatgaatctcactcctaaatgccctgacctgacttccctcctaagctccagtcctgcctaacccctgccacctccttccagatgccccacgagtaaccaatcttcataatgacccaaactgaactttttttttttgagacagagtcttgctctggtgcccagactggagtgcagtggcatgatctcagctcactgcaacctctgcctcccgggtacaagcaattctcctgcctcagcctcccgagtagctgggattacaggcgcatgccactacgcccggctaattttttgtatttttagtagagatggggtttcaccctattagtcaggctggtctcgaactcctgacctcgtgatctgccctcagcctcccaaagtgctggaattacaggtgtaagccactgcacccagccgtgaacttttttttttttttgagacaaggtctcactcagttgccgaggttggggtacaatagtgccatcacagctcactgcagcctcagcctaccaagctcaagcgatcctcctgcctcaacctcccaagtagctgggactacaggtacccgccatcatgcccagttcattttttctattttttgttttattttctatgttgtccaggctggtctcaaactcctaggctcaggccatcctcctgcctctgcctccgcctcccaaagtgctgggattacaggtgtgagccacttcatccaagcccaaactggactcaaaatctgttcctctctcttatgttcccagtctatttttctggcaagatcattctcccagtgacctcaatggaacctgtaagggccccctcccctggcctggctcccaagctgggaaggccagggattctacaccagctgtcagctgggtccaccccttctctccactcccaacccctcgcccaggtccacactccctcacctacctctctggcatggctgactaatcagtctccccctccctactcttcctacaaacaactgccagacggatcttccctgagcccttggtagtgacccgctgcccacagagcaaagccctgcttagcctaacaaggcccttcacacttcagccccacccctgccttccgaacacgtcccgccaccccacttccatctgcccgccttcatgcaagacagaacaatgctccccttccctgggtctcaccagagccccgttgctctggcaccgtgagtttgctcatcttgttccctcaactcagaattcccttcctgccatctttctgttctgaatcctgctttcttcaaggcccagctcaaatattccctcatccgtaaaaccttttctgatccgatccactcagctcaggatggtctcctccctgccttcagccccaccttgcttttcctgtgcctccccagtgacactgatgtgtgtcccatttgactagattcagctacgtgcaagggagaagacgcctcctctcccctactggactataagcactgaggacaaaatgcctgtctcaattcccctagtaccatacttcaaaaacagcagggatgcagcaaacgagggatgggttcacgaatgatggaacacgttgaggtgtttgaatgacagggttgcacatacgagcgatgtttacaggtaaggacttatgctgcgatgaggcctggatttgggtttggagcagggcatgtgcccaggagagagagctaagtaagcccaggcgctccatcccacagccatggccctccctgctccccactcccccagccacctgcctcattccagccaggatgcacagggcctagctctgtccttagcctgcaggccaggtcagagaacggaaacagctgtccccctcctgagtccataggctgactctccccagcccactacacccaagcaggcatcaaacggccagctagatgctaccggcctcatctggacctccctctgggggataagcgggtaaaagcactggccaaggagtggaaaggactgaattccagctctggcctgccatgaactcactgtttgaccttcactgtaatacctggatgtaggaaaaaaccagcagttcctaaacagcagttccacaggccaccatgcccggtgccactttttttttttttttccttgagacaaggtctcgctctgtcacccaggctggagtcagtgatgcaatcacaactcactgcagcctgaccacccaggttcatgtgatcctcccccctcggcctctcaagtagctgggaccacaggcatgcacccctacaccgagctatttttttttttttttagagacagggtctcactatgttgtccagactggtctcaaattcttagcttcaagcgatcctcccaccttgggttcccaaagcgctgggattacaggtgtgagccactgtgtccgaccaccgtgttaccttcttgagggatgtgttcattagcaagacccagtctagtgcattccaggctcactgtgggaccagatgtcccctacaggcttgcccggctgcaccaaatgaggagtcagggaaccagctgtggggaaaaggcttctggggtctgttctctccccaagacccctgagcttgctacattttctcagcagccctgccacagctaggctgccctgatgaggaaactggagtgctggcctctttccagaaataaccagccaggggtgggagagaaaggggcggggaaacagcttcctgaccgtcactgcacccttgtctcacatggcgggcactgagctgtgggcactcacagaggggcagccccagcatgcaccagccccttgccattggggtggccgggtggggccagggcagatgggcaagtctgaagctagggctggaggtggaggaaggatgagatggacaggaatccccagatccccaatctccgtatcaagcaacaagagggacaacaggaagcaaagaggtcccaaattctgcctttagcagtaaacaccaatggcttaaacccgaagaaatgaaatgctttctcagcagacttcgctctccagggaaaccaaaagcatagctcttcgccctgcaaactagggaaactcccccaggacggtcttatccactgcaccctttctcctcctttcacactcaccgtacagggagagaggggcttgggagtgcaggcagggtctgtcacagagagacgggctgaggaaaggagaggaccctggcccgggtgtgcctgtcactgacgcgctgtctgacctcggaaaagttttcctgtttctctgggtttccttcccttccctggatggtggggagaccgatcaaatcattgctaggggcgtttcccactgctttaaggaggaacagccccaagccaggactcccaaagaggagggcccagtgggtggtacaaaggcctgagtgcagcagcaggtcgggaggtggaaaccgggtaaggccccacctggctgctccttccccgtcctggcatgggcacgggcgacgggtggttggtaacagaggggcgcttgtctcctcacagggaggcgagaaggagggctgcagagcccaccaccccagccagagctgcacacgagcaacaaggaggagaagccggaggagaagctctgtggggtccctggcctaggaagcagatgggagtggtgagcgagaatatctgccgccacccagccaaggagcaagcatgatagggagggaagttagcacacagcggagagatgagggaaagaggtcaggagccaagatgtgacctttgggtggggtggtatttaccggggtggcacaattctgaaggggaaatcacccagtaggaaggactgtcatgatgggggcgtgaggaagccaccttgtgggttagaacctgccggtggatgcaggaggaggcctattctggggtatacagtccacagtggggcagagtcctgataaaatccaccacagtggatgaaacccacagcccaagtgctgagcaggagcagggacagagggaagctttacgccggaggttgggccaggggcagacgcacgctgtgggacccaggaaggaaagacagcagagagaagggacctttgcacaagcacctgcctgcgtcctttccccacgacaagagcccccagcgaggcctgcagaacattccagatgaccagttccctcggtgggaggaaagataaaggatgtccctaaaaggccaaaaattcctggggcccagtgtgtagcagcccagcagctggggctggggggcagcacaggagcggccacgaagggagagggtggcagcggcttggggctccggatccaattacgcggctgtttccatacttagccgcctgacagccgcctggaatactcagcactcaagccgctgcagccctgcagagcccaaattaactcaaggacagacaagggcagggcccagcagcacatgcagtggctggagccccccaccttacatcttgagtccccgagaaatagcttttgttcccacccactgcctgctctccctgcagggactgtgcccctgcaaccccctattcaacctcaaagacctgagaggctggactctgggcctctccagtcccaggtacggacctaggctcagagcccagcttgggggaagactgccgagtcatgaaaagactcggtgggcagtccggatcctagggggatccccggagcacctccctaaaagcattccctcggggaacctggcctcaggaaccttaggaacaagagaggtggcaaaacaatctggcatctcctccatagcctatagataacccccatgctgcaacccaagccaccacctctgctacccaaagtgctgagatgtcaaagggaagcctcagcacacagagccaagccccttttctgatggaagcccccaccccgagcagaggctctactccagaacgggccccgttcctcttctgaattgcatccaatgctgtttccagcccaaccgccaactctatttccgatcttatcccaaaccaattccaattctatctcactgctcccaaaacggtccccacctttgcccactgtatccccttctgtccacgcaaacccagttctcttacccgagtggggcctccgccttatatcccaccaggtgggagggtcacctcaacgacctccagctcccagactgtgctattttgtccgtctcagaggctcccccgtctcgactttgagggccctctttcccacatctactggccagactcctctctgaccctggctcacagctcagctctgtttgccgttcccacttcctctggccttcctgagggccccgcaactgtgctgctattctccagcacccagctctttctctgaggccccaggcccggggaaaagagaagggtaagaagacaccagccaagagccagggtttgccatcagccccgaccccctacccaacccatggtagacagaaaaccttggaggaagcgtgggggaccagtctgggctgggtcatgctgggaggggccctacctgcttgtcctgagaacaggagcgaggccaggaggcagccgagcaggaccagcgccctcatggtgactgccaag

SEQ ID NO: 816 - DNA, 119493 bp, Homo sapiens
tccaaactccatgtaatatttgttttatttataataagaggaaatacatttgaacaaagaagctctcatagtattggcaattttacatatatctctgttattgtaattttttttacttgctgggcttggtaattcttcaatggacatgaaagctatgacctagagagactatagagtcgctggtaagcgtacgcccgaggccctgggcgtccccactggtagatggtggcgtgtggacgaacagcttagtccttgggcaaagcttgtgctggtcgagagtggcgagtctgggacagagacccaggctgctccctgctgcttccaggctcctctctcttagacttaatgcccaggaaactgagtattttcatcagcagcaaatctacgatctccccttcctccgacagctgcaagagaaagaaccaggcaatgcccatagaaccatcttctttgggggcttttctttctaaggggaagtcatagtttttatttttatttattttattttattttattgtttgagatggagtctcactgtgtcgcccaggctggagtgcagtcgcacaatcttggctcactgcaacttccgcctcccgagttcaagcgattctcccgcctcagcctcccgagtagttgggattacaggcacccgccaccacgctcagctaatttttgtatttttagtagagagagagttttaccatgttggccaggcaggtatcaaactcctggcatctagtgatccacctgcctcggcctcccaaagtgctgggatgattacaggcttgagccatcgcatcatccctggccgaaatcacagttttattgtccagtttggtctcaacctaggttacttcactgttgagagctgttttagggcagaaaggcctccctctgggaatgccaagggtgtgtgctccatcctttatcctcagcgggctccctccacctctctgatgaggatgactgagttttcactgccacatttcaaattcccaagccagcgcagagtaagcctcggctgggcggctgagcctgaagttaaacagcacatgggcccccttctgagatgagtgtctccccttttcctctaggtcagagtgttggtggtggctccttctttcgttctttttttttctgagacagagtctagctctgtcgccgaggctggagtgcagtggctcaatctcggctcactgcagcctccgcctcctggattccagctattctcctgcctcagcctcccgagtagctgggattataggcacacaccaccacgcccagctaatttttgtatctttggtagagacagggtttcaccatgttggcggggctggtctcgaactcctgacctcaggtgattcacccacctcagcctcccaaagtgctaggattagaggcgtgagcctctgggcctggccttgtggttctttattattattccttctgcttgctctgtttacctcctggcctagcctggtatgggaggaagttctgggaatgaaaaaataaatagatgtttctctctggctttcccacacttctcaaccatatacacatatttaagagtgacttaaagcaaagaaagaacaacttctaggaaacaggaatggcagactataggtaccaatgaggcacgttcagtaaactcgtcagaaaatgctctctaccaccccaacagaggctgttaagaacttatgtacaggctgagcacaggggcttattatatttataatcccaggattttgggaggccaaggtgagacgattgcttgatcctaggagttcgagtccatcctggacaacatagtgagaccccatctctacagataattttaaaaatcacagctgaaagtggtggctcacacctgtaatcccagcactttgggaggccaaggtaggcagatcacctgaggtcaggagtttgagaccagcctgaccaacatggtgaaaccccatctctactaaaaatacaaaattagctgggcatggtgggcacatgcctgtaatcccagctacttgggaggctgaagcaggagaattgcatgaactcaggtggcagaggttgcagtgagccgagatcgtgccattgcactccagcctggcaacaagagcaaaactccatctcaaaaaaaaaaagaagagtgtttaaaaatcaggccaggtgtgacggttcacacctataattccagcaatgtgggaggctgaggcaggcaggtcacttgagcccagaaatttgagaccagcccggccaaaatggggaaaccccatctctaccaaaaatacaaaaaaattagccaggtgtggtgcagtcccagctactgggtctaaggtgggaggatggctcgagcccaggaggccgaggttccagtgagctgagattgcaccactgcactccagcctgggtgacagagcaagcccctttctcaaaagcaagcaagcaaacaaacaaacagaagaatttatgtgcaaaggtcctgcacattgctgctggggatctaaaatggtacagctgcttcagaaaacagtgtggcaggtcttcaaacaattaaacagttactgtgtaaaccagaaatttcacttccaggtatatgcccaagagaagcgaaaacacatgtccatatgaaattctgcccacagaatgttcatagcagcatcgtttgttaaagccaaaatacagaaacaacccaaatacccatcagctggggaatggataagcacatcgttgttttacccacacaatgaaatatgactcagccgtaaaaaggaatgacgtggatacacgctacgacatggatgaatcttgaagacatgatactaaatgaaataagccagacataaaaggccacatattgtccgagctcatttatatgaatatgaatttccagaataggcaaatccaaagaaatagaacgtagattagtggttgccaggggctggaggcatggatatgggaggtgattattaataggtagggggcttctttgtggtattgaaaatgttctgagcccaggcacggtggctcacacctgtaatcccagcactttgggaggccgaggctggcagatcacctgagatcaggagttcgagaccaccctggccaacatggaaaaactcatccctactaaaaatacaaaaattatctgggtgtggtggcaggcacctgtaatcccagctactcaggatgctgaggcaaaagaatcatttgaactcgggaggcggaggttgcagtgagccaagatcacgccactgcactccagcctgggtgagagagcaagactctggctcaaaacaaaacaaaacaaaacaaaaaacaaaacaaacaaacaaaaaacagaaaagaaaagaaaaaaagaaaaagaaaatgttctagggctgggtgtggtggctcacacctgtaatcctagcacttcgggaagccaaggtgggtggattgcttgagcctaggagtttgagaacaacctgagccacatagcaaaaccccgtctctattaaaaaaaaaaaaagaaggccgggtgtggtggctaatacctgtaatcccaacactttggaaaaccgaggtgggcaaatgacaaggtcagaacttccagagcagcctggctaacatggtgaaaccccgcttctactaaaaatacaaaaaattagccaggcatggtggcgtgctcctgtagtcccagctgcttaagaggctgaggcaggagaatcacttaaacccgggagggggagggtgcagttagccgagatctgccactgcactccagcctgggcgatggagcgagacgctctctcaaaaaaaaaagaaagaaaaaaaatattctggaattagtgacgatgtttgcacaactctctgaatatactaaaaaacgtttaattgtatgatttaaaatggctaattttatggcacatgaaatatatcttcattgttaaaaaaataatttatttacaatggacaagttcaatcttctgatagaaggaacccactcggagaaagtaactttaattaaaggtggctacttaattgcatctccaaattaaggtacagttggagtacctgggcatcagacctagcaatgctctctgcttccttgctaaaatgaaaacatttccccaacactacaaaattgtttttaaaatatcaaatctttttgcaggacaaaggcattgtggtataatatgaaccatagttgatctttgacctcggttcccatcacagagctcctgaaacccttagaatttactaataataggagtgtcttttttttttttttttttagacagagttttgcttttgttgcccaggctggagtgcaatggcgtgatcttggctcactgcaacctccgcctcctgcattcaagcgattctcctgcctcagcctcccaagtagctgagattacaggcatgtgccaccatgcccagctaatttttttgtatttttagtagagacggggtttctccatgttggtcaggctggtctcgaactcccgacctcaggtgatccgcccgcctcggcctcccaaagtgctgggattacaggcgtgagccaccgcgcccggcaataataggagtgtcttttgctattcatgatgagccccctttcatcacatctgagtttttgctaatgagtgacttagggcaggcccctagatagcttcaggatgaggcaggtcaccagaaaatcctcggatggtcaagtctctgataaaaaaaaaaaaaaaaaaaaagccataatatttacatataacccacacacattctcctgtatactttaagtcatcatctataagtacctttttttttctttttttttgggatggagtttctgctcttgttgcccaggctggagtgcaatggcacgatctcagctcaccgcaacctccgcctcccaggttcaagcaattctcctgcctcagcctcccgagtagctgagattacaggcatgtaccactacgccgggctaattttgtatttttagtagagatggggtttctccatgttgaggctggtctcgaactcctgacctcaggtgatcagcccgcctcagcctcccaaagtgctgggattacaggtttgagccactgcacctggcctataagtaccagtaagtacttataatacttaacacaatgtaaatgctatatataaatagttgttatacagattgagtatccctcatccaaaatgcttgggatgactagtgttttgtgtttcagattttttcagattttggagaatgcataatgaggtatcttgggaatgggacccaagactaaacaggaaatttatttatatttatatacaccttatacacatagcctggaggtaatttcatacaatatgtgtttttaatttttatttatgttttagagatagcatcttgctctgtcgtgcaggctagagagcagtggtgcaatcatggcttactgcatcctgggctcaagctatcctcccaagtagccagaagaagaggcacatgccaccaggcccagctaatttttgtattttttgcacagatagggtctttctatattgcccaggctggtcttgaactcctggcctcaagtgattctcctgtctcagcttcccaaagtgctgggattgcaggcgtgagccactgggcccagcccagtatatatttttttattttaaaattatattaaaaatatgaaacactttgtgaatttgcacgacctccttgcacaggggtcatgctgatcctctctgtacaaagtttgtattaagtatttatgtgtggaattttccatgtttcacctcaggtgagcatgcaaacaattttggattttggagcattctggatttctgatttttggattagggatgcccaatcggtataagatacccagttggtgtctgctggagaattgcttggtgtgtgcagaaaatctccacacatttggtcacagaagtgttctgtgttaagtgagagtttagtgaaataaaaatttgtatttcctttccaaacacagatccgggacacacgttacaagcgtaccagagaccatttagcaacagaagaggggcagcattcttagcattcttgaatcctgtgggcaataatttcctggtttccaggaaaaataactctttacaatgatccttcaacatgatggagtatgtcacctttatgaaatcttttgcaatttagaaaaacaacaataccaaattgctgctcttgtatagaaatggaaaaattcaaagaagagtgtcttaacaaaggtttctttgttagacgtgcagatttttcttttttttcttttgagacaggatcttgctttgtcacccaggctggagtgcagtggcatgatcacagctcactgcaggcttcgtctcctgggctcaggtgatcctcccacctcagcctcctgtgtagctaggactacaggtgtgtgccaccacacccggcttaggcatacagattgaaagaatctttcaactgggacaggaagggtgagctgcataatacgtcaccgttcacacagtcatacctccagaagggcaggaaaagaaaacaaaacaaaaccatacatccaagtcagacagatccaggttgaaatcccacctttcctactttctagctctgtggttctaggtaaatgatttcatctctgtgagccttggtttccttctttgtacgttgtgaataattatacctacttcagagagctgttttgacgattaaataaaacacaacttcggttgtgaagagagcgctgtgtgggtggtgctggtggctgttattaacctgcagtctgtgtgctcatatccctcttcctgcaggcagcccagcacgctgactcttccatgggtgggaggtcgatcacgagtgcccagcttgttgccctccgagccatgacgacgtgggttgaggttttggagtgtagtatgtgttttcaaccttggctgttcattaacctgaaaattacccaaagagatggctgggcgtggtagctcatgtctgtaaccccagcactttgggaggccaagattggtggatcacctgaggtcaggagttcaagaccagcctgaccaacatggtaaaaccccgtctctactaagtacaaaaaattagccaggtgtggtggcgcatgcctgtaatcccagctacttgggaggctgaggcaggagaatcgcttgaacccaggaggtggaggttacagtgagccaagattgtgccattgcactccagcctgggcaacaagagcaaaaactctgtctcaagaaaaaaaaagttacccaaagagatttcaaacataccaaggactggctcattctcccagagattctgtcggtgttggtctctgttggtattagtctctgttggtgttggtctctgttggtgttggtctctgttggtattggtctctggctgggcagccgttgtttccaaaaggccccaggtgattctaaggtgcactcagggtggaggtcactggtgtcgcgaacagagtctcacattgggaatcaggagacacagctctggtcccagccctgcccctcacttgcttgtgattttggggaattaatgtcctctgtctatgcctgagtttcccctcctgttaaatgagggctctgagctacaatgatctctcaagttccctaaagtctaacaccgctccagcctcttcatagttcaatgactgatgaggaataggccaaagcgactcacctgatagtatttttgctcctcactgaaggccaccaggatgacagagataaacaggttcagcaccacaaatgtcataaaaacaatgcaggatccaatgaggaaggagccaagcactgggctatagtccaggacctgtcagaaagaaagccagggtcatccagtgtcctgggtcccagtagccacttcccctactgggaaccctcagagggaaaatggtcctcagagttaggcagagcctagagcctggaaggtcccctctgcctggggctgagagagctgggcaaggagagaacgggcagcccctcactttccacggctgccacctccaaagacggctgccctttctgcccagggtagggggtgtttcctttgggagacccctgtacagccctcccctgagtagccagcacccaatgttcctctgtgagcagggatcccaagggcaagctgtgggctctagcaggggtgtctacctagaggagggggaacatttctgtttgtccagacttgcccggtgcttgccaggccatgggcccaagggatggcacggggcggggtggacagggagtgctttttctaatcttcacagaggctccgtatagatggcagcaaccgtgccctcaccccgttacctcctcgtagttgaagattcccagctgaaggctgaccatcgtctccgccgcatcaaagagggttttgtaggaacggagtttccaaccaaatatcaagtttgactgtcatggaaagaattctcatgaacagggaaggaggctgccaaggcccaaacagcctgctgtttcacagtggagtgggtggtctgtgtcagccactgccctggctgggctggtcaagctactgtacctacaggggtgtgcaagtgggtgtgtgtacacaacaggtttttgtttgttttttttgcgagatggagtcttgctctgtcacccaggctggagtacaatggttcgatctgggctcactgcagcctccgcctcctgggttcaagcgattctcctccctcagcctcacaagtagctgggactacaggcacacaccaccacgtctggctaatttttctatttttcgtagagacagggtttcaccatgttggtcaggctggcctcgaactccggatctcaggtgatccacccaccttggcctcccaaagtgataggattatgggcgtgagccactgcacccggtccacaactggttctatgtggcatgcatgtgtttctctctgtgggtctgtgcatgcgaggccacacgtgtgtctgtgtgagagtgtacatgtgtatgcctgtgggcatcaatatctgcacatatgcacttttgtgtatgtatatgtgtgtatctatgtgtagtgtatttgtgtgcacatgcatgtgtatatgtgtatgtgtgtgtatccatgtatagtgtttatgtgtgtgcatatgtgtgtgtatatttgtttgtgtgtacgtgtatgcgcgtgcatgtgtgcatgtgtgtaggtgtgcacgtgtgtgcatccatgtgcacgtgtgtgtcaagtttctggaagtgctgcctggatgaccttgtccaggacctttattgtgtccatggcctgttgatgatgcctatctctgtgcccaccaggatgagggagtgcccagggtgcctctggggctcaggcagccacctgctaagccaccgcagtgttccccagatgcggtgcaaatacctgacaatgagtctgggcactctgcggctccaaacccttcgctctggggaactgggttgaatggatgatgggcttctgcctgggtgaggacctcccctcactgcattttccctcaccacaacccctcactcccaagactttcccagggctgcagtgtcagagggaggcccagcagcccctggctctgtctctgagttgatgacttttggtcccatgggacactgcaatgtccctgcagcccagacactgcatggaagtctgaagaaattcacattaggatttagaggggagctttcaccaaaatcacagactccaactttccagaacacacccccatcactccctcagtgcaccccacctgtttccaggggtgggagaggaagatcgggtggggctagggatggaaggggtcaagcctgaggtgacagggaggcagagtggggtgagggttggggtggagtggggactaggatgcgatgggctggtggataggatgatcagggaggagaggaaggcaagagactggatggagccagggtgaggatggggaaggccctggggtagggagtgggccaggattgtgctaaaggccagagatgaacggaaggccagggcttgcatgggaacatggtgggcagtagggggtgtatttagaaggacatcaggatgtggtgggggccaggatgtaagaggggctttgtttctcacatgatcataaaaaagaattgaaaatttaatgtttttggctgggcgcggtggctcacgcctgtaatcccagcgctttgggcggccaaggtaggcagattacctgaggtcaggagtttgagaccaacatgatgaaacactgtttttaccaaaaatacaaaaattggccgggtgtcgtggcacatgcctgtagtcccagctactcaggaggctgaaacaggagaatcgcttgaacctgggaggcagaggttgcagtgagccgagattgtgacactgcactccagcctgggcaacagagtgagactctgtctccaaaaacaaaaaaaaagccacacacggtcgctcatgcctgtaatcccagcactttggaaggccgaggtgggtggatcacctgaagtcaggagatcgagaccagcctgaccaacatggtgaaaccttgtctctactacaaatacaaaattagccaggcatggtgctgtgcaccagcaatcccagctactcaggagaatgaggcaagagaatcgcttgaacctgggcggtgaaggttgcagtgagcctagatcgtgccactgcactccaacctgggcagcagaacaagactccgtctcaacaacaaaaaagaaaattcaatgttttcatttatgtttttctacacagggccatgcttgtcaatgtgctcttaaagtgctgagtgaagtggcattggccctcccaagctcatgagtcatgttttggacaacaagcactggcatggcctgtggatgtatctaccttcacatccccacctctgccccaactcaaggacgtggtggccccatccatcccccagcacagcagcagtgctctgtgtgtgtctaggagttagccctgtgccttctgaccagttgggaagccaggataactggcacatccaggaggggtctagagccagaaaggaattcttcccaaacctggatcctttcagcactagagcctatgcctcctcaccctatccacctgagctctccagcctttgccatttgagatgactggtgcatgagctcacagcaaagacaccctgtacttacaagagccaccaccttccttgagttcccagggtctccctaaccctaactgtccactttcccaccaccaattagccttggtttctgcagagaccctccccgaacttttcccaaagcagatacttaccgcgatggagtaagccaggagcatggtaaggatgacaatcataaagcctgaaatgtcgccccaggcacggcgtagggctgccgtgatcatgttcattttgggattcaacctgagcagatgccaaagcttcactgtggacaggagtaccaggaaggcaatgatgtagccaagggcggcatcggctgctgctgtctcactgaagctgatgcctctgtgggaccaaaatgcaaaggctgggtctcagagaccttgagcagttcagccagaactcatctggatgcaagactggatttatcggcatttcgggatgtgggattagttctatcatcatctcataggccatcaggtccagaaacaggtctgggaaagagagccatcccagttcccccaggtaggtggtgatgatgatgatgatgatgagggggaggaggaggaggaggatgctgggaattgtggtgtgagagtgataatgacaatgacagtgatgatgatggtgatgatgctgaagatgatggtgatggtgacaaagatgataatggtagttggacttcatggtgtgcactggtaatcctagctactcaagaggctgaggcgggaggatcacttgagttcaggggtttgaagctgtagtgagctatgatcgtcatcagtgagatggcagcaggaccaatcaccatgtggttttctctgggatgttggactcaagacatttttttttcctgatctgtttttaaaagttttatagtccaggcgtggtggctcacacctgtaatcccagcactttgggaggccaaggcaggcagatcacctgaggtcaggagttcgagaccagcctggccaacatggcgaatccctgtctctagcaaaaatataaaaattggccaggtgtggtggcgcatgcctgtaatcccagctacttaggaggctgaggcaagagaatctcttgaacccaggaggcagaggttgcagtgagccgagatcatgacactgcactctggcctaggtgacaagagcaaaactctgtctcaaaaataaaaaataaataaaaataaataaaagttttatgacgccatatggtatttcttgttaactgaaaaactttgcagccacaaaaaggaacaaaaccacgtcctctgcagcggcgtggatgcggctggaggccactatcctaagcgaattaacacaggaacagaaaatcaaatactgcgtgttctgacttacaagtgggagctaaacattagctagttatggacataaagatggaaaaaacagacactggggactgcaagactggagggaggcaggcaagggttgagaaactatctactggtactgtgctcactacttgggtatcgaggtcattcgcaccccaaacctcagcatcacgcaatatactcatgtaacaaacctgcacatgtaccccctgaacctaaataaaatttgaggccaggcgcagtggctcatgcctgcaatctcagcacattgggaggctgaggcaggaggatcacttgaggccaggagttcgagatcagcatggggaacaatgtgagactcctgtctctataaaaaaaataataaaaattgaaattgcttaaaaaagaaaaacttgtgaggcctgccttctagctattctacagaagaagccttttcaaacaggttcaaggtgacactaccttcccgaagctctgtgatctggagagctttccccgtgctctcctccaaggttggactcactcagggcagctctctacagggccacaccgagggacacaaagcacagactgggtttgccaccttgggtactggccaggcctcagtgagaaccatccttttacccaaatctcctgccttccagaatcttccttccctttgagcagactggagttgctggtacaaactgttgcttccgcctttgactccagcagctcctttctcctgtctctcttaaaagacctaatgctgcctgggcacggtggctagcacttgtaatcccagcacttttggaggccaaggccagtggatcacctgaggtctggagttttcaaccagcctggccaacatggtgaaaccccatctctactaaaaatacaaaaaattagccaggtggggtggcaggcgcctgtagtctcagctactcgggaggctgaggcaggagaatcccttcaatccgggaggcagaggttgcagtgagtggagatcgcgccattacactccagcctgggcaacaacagtgaaactctgtctcaaaacaaacaaaaaagaagacctaacactgtctcatgccatttaattgcttatgtatgtggaaaaaataacaatacataagccctcttttatttttatttttttcttgagatggagtctggctctgtcacccaggctggagtgcagtggcacaatcttggcttactgcaacctcctcctcctgggtacaagcgattctcctgcctcagactcctgagtaactgggactgtaggcgtgcttcaccatgcccagctaatttttgtatttttagcagagacggggtttcatcatgttggccaggctggtcttgaactcctgaccttgtgaaccgcccacctcagcctgccaaagtgccgggattacaggcataagccaccgcacccagcctggcttcagtatttttactgtctccttggagttattcttatatgtagccaaggttgagaaccatgctttaatacggctaactgccttcataaaggagggctggctgggcatggaggctcatgcctgtaatcccaacgctttgggaagccaaggcaggaggaatgcttgagaccaggagttcaaaaccaacttgggcaacagagcaagacctcatctctacagataatttaaaaattacctgagcggccgggcgcagtggctcatgcctgtaatcccagcactttgggaggccaaggtgggcaaatcacgaggtcaggagttcgagaccagcctggccaacatggtaaaaccccatctctactaaaaatacaaaaattagccgggcgtagtggcgtgcgcctgtaatccagctacacaggagactgagggaggagaatcgcttcaacctgggaggcggaggttgcggtgacccaagatggtgccactgcactccagcctgggcgacagagtgagactccatctcaaaaaaaaaagaaaattacctgagcatggtagcgtgagcctgtggtcccagctacacaggaggctgaggtgagaggatcgcatgagccctggagatcaaggctatcgtgagctgtgatcacaccattgcactccagcctgggtgacagagcaagatcccgtctcaaaacataaataaaagaggccataagccctcttttattaggcatgagccaccatgcccagcccgaagccttcaatacttaaaagagaaaagcggtctagagaggaaagagggagggtctggtgacactattgaatccacatgttgccagagaaaaggagcaggtaagggaatagtcaatgatgtatttgtctcatgctcagttaagtgggcactttacataagataaggtgaacctggagctgctgtctgcagagatcaaccttttagctgtaactctctctttacgaacaaaatgaaaggcagtttcttgcatgactcaactttcagcttaatttttctttttccttttggcagagtggattggggtcccaagattttattttcccttcatgcagcttaacctctccaagcctcattacatgtgatttcctcatttgtaaaaaaaaaaaaggatgatgaggctgggcgcggtggctcacgccagtaatctcagcactttgggaagtcgaggggggcgaatcatgaagtcaggagtttgagatcagcctggccaacatggtgaaaccccgtctctattaaaaatacaaaaattaaccgggtgtggtggtgtgtacttgtaatcccagctactggggaggctgaggcaggaggatgacttgaacccaggagggagaggttgcagtgagctgagatcatgcaagagtccgtctcaaaaaacaaaacaaaaaaagggatggtgatatcatctcttagaggtctcaggaggattcaggtgtaggtgagatgagacactgcttgtaatgtggtgtttttatgaaagtgtatgacatttagcaataactcaatacatgttagctatatctataaaacgaatgagtgagtcaagaaacccgatgattccaagcaagggaggggaccctggagccacacaagctaggcttaaattacttgtctgccacattttagctgtgtggccttggggaagtcacgtgacctctctgagcctcagtgtctttgtctgtttttttgagacccagtctccctctgtcacccaggctggagggcagtggcgcaatctcggctcactgcaacttttgcttcccgggttctagcgattctcccgcctcctgagtagctgggactgcaggtgcatgccatcacgcccagctaatttttgtatttttagtagggatggggtttcaccatattggccaggctggtctcgaactcctgacctcaaatgatccacccgccttggcctcccaaagtgttgggattacaggcgtgagccaccgtgtccagcaatttttccatttttagtagagttagggtttcactgtgttggccaggctggtttcaatctcctaacctcaagtgatctgcccacctcggcctcctgaagtgctgagattacaggcatgagccaccacaccctgccctcaatgtctttgttaaatggggcgatgataacactgaccttcatcaatcctgatgatgattccctaggtgaaaacatcctgcctaccacatagtggacacttagtgtatggtagcagaggtgagcttactggggccataatacttgcaaagggcctcccctttgcaaggttttggagagcctaagcaggatgccccatggtcctatgttttgggaagatttgcacaagatgttctattttgtctgagtcctctccaatcgtactcacttgcggctggccccacacctgaatctaggtggcagctagagttatgtctactaggagtgcccctttatcccttgagggtccacagcattccaaaacctccttctgacccctgggcctcaaacggagctgtaggaagaggggccagtgtggggagctggggggctgaggagacagccactgactcctccctgtggttccggcagcgctggaggtccctttcggccaggacagccctcttcacaaacaccgccagggcgctccagctggccaggatgatggccagctccagaaggttccacttgctgcagaaatagccccacgtctctttactcatgcgcttgccctggaaaaggagcgtgaagttgcggccgtgactgcccccgccccacagggctgctccctccccatcccggagggccctctggcaggaggcttccccagctctggcccccatgcacagagtgcccaggcctctccccaaccttgtgcacagacccattgaggcgggataatagggcctggaggcagggaacctaagaactaaatcaaatggaaacacttcagctatgacaggaaatatcctcttcattcacatagggtgtaccccgagtaaatgactttgtaacttcactttaacctcttcatttacataggacatacaccgattaaccaatggaaacctctagaaggtatttaaaccccaggaaattcttttttttttttttttttgagatggagtctccctctgttgctcaggctggagtgcagcgggccccatctcagctcaatgcaacctctgcctcccgggttcaagcaattcttctgcttcagccccctgagtagctgggattacagacgtgtgccaccacacccagctaatttttgtatttttagtagagaaggggtttcattttgttggccaggctagtctcaaactcctgacctcaggtgatctgcccgcctctgcttcccaaagtgctgggattacaagtgtgagccaccgaacccagctggctgtagtttgcaacatggaaagagttcatccttctggagatggacggtagtggcacttgcacaatgatatgagtggacctaatgccactaaacacttaaaagtggttaaaatggtaaattttatgttacgtatatttcccacaattaaaaataaataatttaggctgggcacggtggctcacgcctgtaatcccagcactttgggaggctgtggctggcagatcacaaggtcaggagatccagaccatcctggccaacacggcgaaaccctgtctctattaaaaatacaaaaattagccgggcgtggtggcaggtgcctgcagtcccagctactcaggaggctgaggcaggagaatcgcttgaaccctggaggcggaggttaaagtgagccgacatcgtgccattgcactccaacttggtgacagagaaagaatctgtctaaaaaaaaaaaaaaacaacaataaaataaataaataattttaaaaattgctgagcgtggtgactcatacctctacaacactttgggaggctgaggcgtgacaatcacttgagcccaggagttagagaacagcctgggcaaaatcacgaaaacgggctgggcatggtggctgacgcctgtaatctcagtactttgggagaccaaggcagacaaatcacttgaggtcaggagctcgagaccagcctggccaacatggtgaaaaccctgtctgtactacaaatataaaaataagctgcaaatctcttaaacccaggaggcggaggatgcagtgagcagagaagtcaccactgtactccagcctgggcaacagagcaagactccgtctcaaaaaaaaaaaaaaaagaaagaaaaagacaaagcctcatctctacaaaaagtacaaaaattagctggatgtggtgacacatgcctatagtctcagctactcgggaggctgaggtaggaggatcacttgaccctggggaggttgaggctgcagtaatctgggactgcactactgcactccagccagggcaacagagccagaccctctctctacatagacagacaaatagatagttaggtagttttctttcttttctgcccttgtggagaggttttctggataggcacgagacttagttttaagtaaacttccccaacaggtgtcacaagttcaaaagaacgatcctgcgtgtgttcttcatcttcctccccatcttttccctttcactcaagagaatcttctatttttgtaccagtttcccctcctgccccttcttttttcctcttctttcttcctttctttcctttccttcctttccttccttccttccttttctttcttttttttgccagggacagagtttcgctcttgttgcctagtcctggagtgcagtggcgcaatctcagctcactgcaacctctgcctccagttcaagcgattctcctgcctcagcctcccgagtagctgtaattacaggcatgcgccaccacacccggctaattttatatttttagtagagatgggttttcaccatgttggccaggctagtcttgaactcctgatctcatgatccacctgccttggcctcccaaagtgctgggattacaggcgtgagccaccgcgcccagcaattttttttttttttttttttttggagacagagtcttgctctgtcatccaggctggagtgctgtggcaggatctcagctcactgcaacctctgcctcccaggttcaagtgattctattgcatcagtctcccaagtaggtgggactacaggcgcctgccaccatgcccggctaatttttgtatttttagtagagatgaggttttgcaatgttggccaggctggtctccaactcctgacctcaagtgatctgcccgtcctggcctcccaaaatgctgggattataggcttgagccactgtgcccctcctacccactcttaagaaggaaggacttccatttggctggtggcaggctaagttcacttttacaacaaagggatggagagtggggagatttttaaaactgcccaagcagcattttgcgagagatttgtaggttttggagagcagctttctgaagcagctgcaggcagactgtggaggcagttggaggagggcagtgaaccgtggaggcgggtggtgaacagatctgctgtgaggttcttggacaggtgcatggattgaagttgctgtctgatgactgttggccattgggcttgaactggtgatgctcaagaccaggcgagtgcgctgcttcatgaggctgatgctgtggataggggtcgagtgtgacggtcaggggtcagactccctgtgttcaaattctgaccttggataaatgacttaaagtctctggactttagtttcctactctgaattagagcccataggacctttctcctgttgttgaaagagaaaacacatacgttcttagcacaatgcctgctatgcagtaagcactcaaaaatatcatccttgctttaaacagggtgttggagaagacgatggagggccaagatgccccctttcggcaatctggtttgcatttttgtcaggaggaggggagtagcttccggtgtgttcccatgatcgtccagcctttagcgtcatcaacatctgcacgtttggatgcaacatggcaataaaggtggcaaaggggatgttgcctaactcccagtgaccgtgggtgggaacaaaagatgctaagaggccccacaatctaagttcagaggacttccacacccagctgtagggtcacttccccgtaccatcgccctaccctggctctttggaaggtctcagttcagtagaaacaggacccatgctcctctcccttccccacccatgaaagaccccactttgagttctcaattcctgaggagtaccaaccttgggtccttcccatgccctgatctagcagcctagatcagccctaggaccaatggaaggaccaaaggttgctcccagcaaacacctaaggcaaagccctttcccggccgggtgcggtggctcacgcctgtaatcccagcactttgggaggctgaggcaggcggttcacgaggtcaggagtttgagaccatcctggccaacatggtgaaaccccatctctactaaaaacacaaaaattagcagggcttggtggtgcatgcctgtagtcccagctactcaagatgctgaggcaggagaatcatttgaacccaggaggtgggggctgcagtgagccgagattgcaccactgtattccagcctggtgacagagactccatctcaaaaaaaaaaaggaaaaaatccctttcccatcccacttacaaggaagaggagaggtgttggtgaggcaccaggcacccctgcaccccaaaccctgctcatgagctatgagcatgccccttacctgcaccaccatgtagtagaggaggaagaggaagtagatgagctctgccgctaccacgaaggggtgccagccgtcggtgaaggggtacaggcggaggctctgcagggccgcgtgcgtaaaaaaggtgcctggggagcaaagtgcgttctgctcactctgggccacctggttgctcagagccatggcttctgacaggagccatcaggtcagatgactcaagctcaaccccctgagggctggctgtggccaaggaaaagccaaagttatttcagacccgaaggactgaacgtggacacgtggtagacaccgaagacagcggatgcaacagaaggggcggaggggctgcagtggaaggttctcccctcccctcggcatttgatgttggccttttgggcacagacacctccagataaagcacatccacccatataatgacaattgactcccacttggctcatttaaagccattttgggccgggcccaggggctcacgcctctaatcccagcactttgagaggctgaggtgggcagatcataaggtccggagattgagctcatcctggctaacgtggtaaaaccccgtctctactaaaaatacaaaaagttagccaggtgtggtggcaggcacctgtagtcccagctactcgggaggctgaggcaggagaattgcttgaacccaggaggcagaggttgcagtgagccgagatcacaccattgcactccagcctgggtgacagagaaggactgtgtctcaaaaaaaaaataaaaataaaaaaagatacacaggtaaacccaaaaaggatttggaagaaactattagcaatgcggaatgacaatggaaattgaaagcccttcagttttcacagttctgaattttgtttttaaaacacaaacatatattcctttttttttttttttttttttgagatgcagtcttgctcttgttccccaggctggagtgcaatggcacaatctcggcttactgcaacctccacctcctgggttcaagtgattcttctgcctcagcctcctgagtatctgggattacaggtgcccgccaccacgcccagctaatttttgtatgtttagtagagacggggtttcgccatgttggccaggctagtcttgaactcctgacctggtgatttgcacccccccccacccggccaatggcctcccaaagtgctgggattacaggtgtgagccaccattcccggcctatattacttttatcattaaaaacgtaatctaatattttctaaaagtttggtattcactggagaggaggttggcttttaggtaaattgaccatcagctgaatagactatagattggtttttagaagactgtgatcagcattttaaagggggaaggaggcatgaggaagaataaatagaatagaacacaaaatatgagagcccatcacatgtagttttttgttttttaaattttatagagaccaggtctcaccatgatgcccaggctggtcttggactcctgggctcaaggagtcctcccaccttgacctcccaaagtgctgggatcatgggggcgagcccggcctcatggagttaaagtacatgttatttgtgaacatttcatcttggttgcatgtgtgctggattatgttgtaaaacgtactttgtgctgtgcactgatgtatggtgaaatatatattaggtgatatgatctgttacatcacattctccctcgccgtcactgccaggtcaccacccccaaccccagcagacagggaagctcgggattaggcaatggataagctgcctttggactctgaataggctgttttacgataacttgggcgactaggccagaaagatgggaagaattagggtggagggccctaatgctttgcctttgggggcccagggactcatggctgcaaggataaccaagatccacacctagattcactaaataagtatttgctctggagctctggccctggggtggctgcacctaggtaggtcaggagccccagcccaggggaaggagtatatgtcttctggagccctgcagagggttcccaggcgaggctgcccacccagagcgctggtctctagcgtcagcgtgacaatgcagaacaggttgacgttggcgttgtagacagtggactccacaaacacagctctggtcagggcgtccagccaggtgttgtcaaagagatagcggagaattctgcaggaaagagtggcattgggtcattgctatcctgcaggggctccatgtcccggcagccccttgactgaggccagtacttcctgtctcaacttctccctctgtttctgctctgctccctgggccaccaggccaacagagctgctgctgggagtggtcacattttgtagcccacgctgtgatatggtggcacccctcatctcctggccatcagagcagagattctcaaagtgtagtgcccacaccagcagcatcagcatcacctgggaacttgttggaaatacagattttcaggcccgccctagacctgctgagtcagacactctcaggggagcccagaatgcgtgttttgatgagcccgccaggatttggatttttttttttttttttttgagacggagtcttgaactgtcgcccagactggagtgcagtggtgcgatctcggctcactgtaagctctgcctcctgggttcacgccattctcctgcctcagcctaccgagtagctgggactacaggtgcctgccacggcacccggctaattttttgtatttttagtagaggcggggtttcaccgtgttagccaggatagtctcgatctcctgacttcgtgatccgcccgcctcggcctcccaaagtgctgggattacaggcgtgagccaccacgcccagccttggatgctttttacggtttgagagccatggtgttagaagaatcatagtccgggtgcggtggctcacatctgtaatcccagcagtttgggaggctgaggcaggtggatcacctgaggtcaggagtttgaaaccagcctggccaacatggtgaaaccccgtctccactaaaaatacaaaaatacaaaaattagccaggtgtgaccgggtgcggtggctcacgcctgtaatctcagcactttgggaggctgaggtgggtggattatctgaggtcaggacatcgagaccagcctgaacaacatggtgaaattccgtctctattaaaaatacaaaaattcgctgggcgtggtggcgcatgcctgtaatcccagcttctcaggaggctgagatgggaattgtttgaaccagggtggcagaggttacagtgagccgagatcacgccactgcacctcaacctgggtgacagagcgagactctgtctcaaaaaaaaaataaaaaagaaaaaattagctgcagtggtgtatgcctgtaatcccagctactcaggaggctgaggcatgaaaattgcttgaggctgagacaggagaatcatttgaacccaggaggcagaggttgccatgagtcaagatcatgccactgcactccagcctgggtgacggtgtgagactgtctcaaaagaagaaaaaagggccaggcatggtggctcacacctgtaatctcatcactttgggaggctgaggcaggcagatcacctgaggtcaggagtttgagatcaacctggctaacatggtgaaacactgcctctactaaaaatacaaaaactttagccaggcgtggtggcacacgcctgtattctcagctactcaggaggctggggcaggagaattgcttgaacctgggaggtggaggttgcagtgagctgagatcacatcaaagcactccagcccgggcaacagagcaagactctgtctccgaaaaaaaaaaaaaaagaaataaagaaaaagaagaaaaggaggctgggctgatggctcacgcttgtaatcccagcactttggcatgctgaggtggacggatcacctgaggtcaggagttcaagaccagcctggccaacatggtgaaactccacctctactaaaaatacaaaaattagctgggtgtggtggcgtgcacctgtaattccagctactcaggaggttgaggcgggagaatcacttgagcccagaagcagaggtggcagtgagctgagatcacgccattgcactccagcctgggcaacaagagcaagactctgtctcaaaaataaataaataaataaataaataaataagaatcatataaaacatcaggggcttaggcaagcagctcccatgagctcctggagatctgtcagcctggtgtggtggaaagagcacatgccctgaaggtggtggagggacctgggttcaaatcttggctgcctcctggacaagctaataacttctccaggccttggtttcctcatctgccatggtgtggttttttgttggttttttgtgtttatgagacagggtattgctctgttgctcagaatggggtgcaatggcaatcatccctcactgcagcctccacctcccaggctcatgtgatcctcccacctcagcctcccaagttgctgggaccacaggtgcgtacccccatgcccaggtaatttgttatcttttttagaggcagaatctcagtatgttgtccaggctggtctcaaattcctgggctcaagcaatccccctgtgtcagcctcccaaagtgctggaattataggtgtgagccactgtgcccggctctacaacggtgttaacaccagtgccttcagatcatttagagaacatggagggatgtgtgtgcatgtgcgtgtgtgtgttgtgtgtgtgtagtaatgatagttgttattacttccagtaataatgatgggcctgtaatatgctgtgtccccagtgggtctgcatcctgcttggtacatagcagcagatagagagagaatatgttttttttttttttttgagacagagtttcgctcttgttgcccaggctggagtgcaatggcgcaaccttggttcactgcaacctctgcctcccgtattcaagcgattctcctgcctcagcctcctgagtagctgggattacaggcacccaccactaattttttgtatttttagtagagatggggtttctccatgttggccatactggtctcgaactcctgacctcaggtgctccttctgccttggcctctcagagagctgagattacaggcatgatcactgcacccagccaccagagagagaatatctgcagtcagtccaattagcaggaaaaatgcctcttattccgaaatcgactattcctggcctttccttaaccccaggagaccctgtttgtagacagagtacaggctacaccatcataaaccaccttggtgcaatgatcatacaatggaggaaactgaggttcacgcgggtctgctgatttgcttgggctacacagctaaaaggagcagcgccagggtttcaaatctaggtctcttgtctcaagggcatgttgagtcagtcttcacggaccctgagcatccctgcacgttcttactgggtattctaggaatgcaaggccgtggctgtgctttagccaagtcacttcttagggctgtatttgcagtgtgcaaccttgtgggatgaggtgatgccttcctttggacaaagagtaggcttctttctgctgctgtaaaagcatcaaatgcccccaggctctgtattgcaggcacatgcaggcatctttcacggccctttgtgggcaactgactcagaccagtgtaatgttctgctatgacttttgctgtaacaaaatcctttgtctctgacccaggaatattgcgtattctgccagcatccgtgaaacagttaacaggctagcttgttggcttacaagtagggtaaaacctcaaattttgcataattcttgacagatccttaactaattccctcttgcctaagggtggactgctttgagtggtagtgagctccccatctctggcctggctctagcagaagcaaccaggctgtgaatgctagagagagactttccttccaattctgagatggcttagttcccagggacctgaaaatacaacctgcatgattctgtatcctacaagccctcccacaaggacctgaatgaacttggctcagccctgtttggaagactacattccccaagcagatgtggactctagcaaaagactttactcagctacaaatgaatcaagtcaaccttaccttgacgtgctttggcgatcagtccccaaggggaccacgtagcctcctccccggtacacagtgagtttgccccagatgggatacccttgacgttggtcctggctctggtactgccattactgagggtggtggcattccagccttccccatagtctgccatgtcttcagcatccagggaatatggtgcacggcatccgttgagatatgcctgcggctgctgggcaagagggcaagagctttcctggaccctcacttgacgaatctgggcactgccaaccagcttggagttcccatcagtgataaagcctaaaaagaaaaacaaggtgggtaaatctagcaatcaaaataatcttaacacattccaagctccccggcctgaggctaatgtgaaattcagcgtacccattatagagacagcccagagaagtttatcaccaactataggctacatttatccaaataacctcaccatctctcctgctggaatctactgtgcttccgcacaacttctcttagggaatggaacctgccaccccgtcatccatctggatgtgcctgtgccctttctcctcaatcctccatcccactggtcaccacatcctatccatcctacttttttcatgtcttatgtgcccatcccgttctctccatcaccactgtccctggtccctccctgcaccagccctcatcctgtgtcctcagcatcctaacttgccacctcctccacctcttttttttttttttgagacagagttttgctcttgttgcccaggctagagtgcaatggcgtgatcttgtctcactgcaacctttgcctcctgattcaagcaactgtcctgcctccgcctcccgagtagctgggattacaggcgcatgccaccatgcccagctaattttttgtatttttattagagatggggtttctccatgttggccaggctggtctcggactcctgaccttgggtgatccactcacctcggcctcccaaagtgctggaattacaggtgtgagccacggcgcccggccaacttgcccaccctttactccaacttccacatgcttccagagtgatccttctacaccacagatttatgccatagcctcatgtagaaattcagtggcgcctcatttcctcaaggatgagatacacgctcctgagatccttcatgatctggcccgttcatctttcctgctttgcttctcactgatccttaactcacatcctacacgagagtcacacccaacacgctgtggttccaagaacacgcatcccatggcaagaggctgggcttttctcgtgttgttcattctgcctggtgcactgtttttgcctagctggttcaagctctgttatcactcacttaggaggttctccactctgcatcgggggaagggaaggtggagagtccccccttgtgcacacccagccttctgagtccctccttcatagcatctggtcctgtggttattgattggttttctctcttccttccttccctccttccttccctccttccttcctctctctttctttccttccttccttccttcctttcctcccttccttcctcccttccttcccttccttccttcccttccctccctccttccctccttccctccttccttccttccttctctctctctctctctctttcttgacagtttcactcttgtcacccaggctggagtgcaagggcgcaatctcgactcactacaatctccgcttctcaggttcaagcgattctcctgcctcagcctcctgagtagctgggactacaggcacgtgcaaacacacccagctaattttgtatttttagtagagatgggatttcacgttggccaggctggtctcaaactcctgacctcacgtgatccacctgtcttggcctcccaaagtgctgggattacagccgcaagccaccacgcctggggttttactggttttcttttcttttccctccctccctccctccctccctcccttccttcctctctctctctctctctttctttcatggagtctcacttcttcacccaggctggagtgcaatggcgtgatcttagctcactgtaacctctgcctcccaggttcaagcaattctcctgccccagcctcccaagtagctgtgtttacaggcacgtgacaacacacctagctaatttttgtagttttagtagagacggggtttcaccaggttggccaggctggcctcaaactcctgacctcaagtgatccgcccgcctcggcctcccaaagtgctgggattataggcgtaagccactgcacctggcctctttttttttttttttttttttaagacagagtcttgctctgtctcccaggctggagtgcagtggtgcaattttggctcactgcaggttctgcctcccgggcttaagcaatcctcccacctcagcctccagagttgcagggactataggcatgaggcatcacatccagctaatttttgtatttttcaaagaggcagggtcttgccatgttgccaggctggtctcgaattcctggcctcaagcaatcctcccgcctcagcctcccaaagtactaggattacaggtgtaagccaccacacttggcctggttttcttatgaggctgatgctgacagtgccccacgtctgttcctagccagaaggcacaaggaggctgacacagccccagggcttcaggacttacctggggggtgaccatacaggttactcacgagggtggtgttggcccacttgaagaactctcggaagccgagcacacctgaaaagcccctggtgaagctgtgctggaggtgtctgttgaggtggtaggcgctggggtccctctgcccgtaggccacgagcagtagcatccacaggaagcccaagtatgctggggagggaggcacagtccctgctcaggcaggatccacgactcccacccagtccaagtcaggaaatggaaaggcctcctagaccagcccctcgccactgtggtgacaatggaaccaatctttatagaggcagcggagaggagtaaagtcacagaccatgggatctcctgcctgggtccaaatcccagctctgcgacatctcatccaggcgcccttcacaagtgagtctatccttccatgcctcactctccccatctatgaaatgggaataacaattctgtgatgaggggatcagttaatattagaaagtactggccgggagtggtggcttatgcctgtaatcccagcactttggatcacttgacgccaggagttcaagaccagcctggccaacatggtgaaaccctgtttctactaaaaatacaaaaatgagccgggcattgtggcgcatgcctgtaatcccagctactcaggaggctgaggcagaagaatcgcttgaacctgggaggcggatgttgcagtgagctgagatcatgccacagcacttcagcctgggtgacagaacaagactccatctcaaaaaaaaaaaaaaaaaattagaaatcacataaaacagtgtctgcaggccgggcatggtggctcacgcctgtaataccagcactttgggaggccaagacgggtagatcacctgaggtcagaagttcgtgaccagcctggccaacatggtgaaaccccccctctactaaaaatgcaaaaattagccgggtatggtggtgcacgcctgtagtcccagctacctgggaggctgaggcaggagaattgctctaacccaggaggcagaggttgcagtgagccgagatcgtgccactgcactccagcctgggcgacagagagagactccatctcagaaaaaaacataaaaaaacaaaaaacaaaaaaagagtgtctgctacattaagcatttcttaaatagaattttaaaaaatggggcatttgccacgttgcatggctgagggtatggtggtgaagacaaacacgttcctgccctcatggtgctcacctgtctcgttggagacaggtgagtgtgacgtagaggatcctttaggtgcagatatttagtgtgggggggtggacatcacaataacatgagggatcaggttcttagtgaaccggaacctctggttcctgggcctgggaatctgtattccaagactctcccctctccctgcaaccacctcagaagacttgaatggatgccaatgagtaggacactttgggggcgtgcactatatgctctctccaaggtccacagtgggactgaatcccagtggcccacctaaaacccacctgtcaggtaccctctgttggcttccttccctctctgctgccctttctcctccaaccagtgctttccaggactacctcccaaatcagctacttgcacccaaatctgctctgggaaatccagactcagaggctccctgaggtgtgaaggcttttgaccagctgggccggggaagccacgctgcagacacagtgtttaggctgagatttaaagaatatgaggaattaggccaggcccagtggctcacgcatgtaatctcagcactttaggaggccaaggagggcagatcacttgaggtcaggagttcaagatctgcctgaccatcatggcaaaaccctgtctctaccaaaaaaacaaaaattatctgggcatggtggtgtgcgtttctggtcccagctgctccggaggctgaggcaggagaatcgcttgaacccaggaggcggaggttgcagtgagccgggattgtgccactgcactccagtcggaatgacagagtaaaattgtatcttaaaaaataaaataaaaaattaaataaaaaatttaaaaatcttaggccaggcgtggtggcttatgcctgtaatcccagcactttgggaggcggaagcgagtagatcacctgaggtcgggagtttgagaccagcctgaccaacatggagaaatcccatctctaacaaaaaaaatacaaaattagctgggcatggtggcgcatgcctgtactcccagctacttgggaggctgaggaaggagaattgcctgaacccgggaggcggaggttgcattgagctgagatcgtgccattgcactccagctcaggcaacaagagcaaaactctgtctcaaaaaaaaaaaaaaaaattaaaaatctttaaaaaggccgagcatggtggctcatgcctgtaattccagcattttgggaggtcaaagcaggcagatcacctgaggccaggagttcgagaccagcccggccaacatggtaaaaccctgtctctattaaaaatacaaaatttagccgggtatcgtggcgcacgcttgtaatcccagctgctcaggaggctgaggcgagagaacggcttgaaccccggaggcagaggttgcagtgagccgagatcgtgccactgcactccagcctaggtgacagagtgagactctgtttccaaaaaaaaaataaacaaataaataaataagaataagaggaattaggcagaagaaaagctggggaggaggagtgagcagactccaggccgatgagatggaactgcctgggcagaagcctggggtggggacagggtgcaggtcgcaggtgctatagaagccaatgtgaggacaacgtgggtcacgggagccgggagcgggcacttgaagcgggtagagccacaggagccggtttgagttttgtcgtaagggtcatgagaggcgaccgaaggattttaagtgtaggggagaagctggagtgtgctgatatccagagaaactgaggcccaaaagacgagcgggacttatcaaaaatagcaccgtaagggtgtctgtctgtttcaggctgtgctgagagccagcgagtgggaaggatgcctacccaggatttctctgatgagggcaaatgctttctgttccttgaggtgggtggttttcatcttctcaatggcagcggtgagaggtggctggtagacatccctgctgctgtttcttcgtgctcggaacaaggcataggggtctgtggagggaaggacaccaggacagcccctacgtgtgcagaggaggacaggctctgcgtttgcaaccataggcccctctctcacctgctgcaatgggctctgcgttcctcttccttgggagtcgtttcccaactctaccctccacacctctgtccatgttctcccagggcctagagtcccacgcctcctccatctggaggactctccatagagaaagcacagaggtgtcttcccctccctgaaatctttctggcccctgcactgccttccccgacactccaaaactgatggattcgaggatgagggtgacaaatatctcaaagtcctctcatgtctgttacctagtatcttcattttttcaaatttagcttcaattttaatttttttttttttttgagacacattttcactctgttgcccaggctggagtgcagtggtacaatctcgggtcactgcaacctccacctcccgggttcaagcaattctcctgccccagcctcccgagtagctgggattacaggtacgtgccatcatgcctggctaatttttgtatttttagtagagacagggtttcggcatgtttgccagtctggtctcgaactcctgatctcaagtgatctgcctgcctcggccgcccaaagtgctgtgattacaggcatgagtcatcgtgtccagcctcatcaatttaaattaaatttttaaatttttatttatttttcattttaaggccagtcatggcggctcaagcctgtaatcccagcactttcggaggctgaggcaggcggatcacctgaggtcaggagttcgagaccatcctgaccaacatggtgaaaccccatctctactaaaaatacaaaaattagccgtacgtggtggtgcacgcctgtaatcccagctactcaggaggctgagacaggagaatcacttgaacccaggaggtggaggttgcaggtaagagaagagagacggatcctctcatattgctttatattgttttatactcaaaaaggaaagagaagcgaaactaaaggcaggtagcccggcgcctaagaactagacccgaaaccaaggaaccagacctgaaaccaggcctgggcctgcctgacctaagcctggtagttaaagatcgacccctgacctaaccggttatgttatctatagattccagacattacatggaaaggcattgtaaaaatccctgtcctgttctgtttcgttctgattactggtgcatgcagcccccagtcacgtaccccatttgatcaattgatcaggaccctctcacacggacccccttagagttgtgagcccttaaaagggacaggaattgcttacttggggagcacggctcttgagacaggaggcttgccgatgctcccggccgagtgaaccccttccttctttaactcggtgtctgaggagttttgtctgcggctcgtcctgctacacagggagccgagaccataccactgcactccagcctgggtgacagagcaagtctctgtctcaaaaaaaaaaaatttttttaataaaaaaaattaaaaaaataaaaataaaatgtttttcattttacttgttttgtagagatgcagtcttgctgtgttgcccaggctggagtacggaggtgcaatcacagctcactgaagccttgacctcctcgggctcaggcagtcctcccacatcagcctctcgagtagctgggtttgcatgcatgcaccaccatgcccggctatttttttgtattttcggtagagaagggatttccccatgttgcccaggctagtctcaaactcctgaattcaagtaatctgcccacctcagtctcccaaagtgctgggactacaggcatgagccactgggccttgcctcctgttctttcaaaacagtctgggcacggtggctcacgcctgtaatcttagcactttaggaggccaaggcgggcggatcacttgaggtgagaagttcgagaccagcctggccaacatggcaaaaccccgtctttactaaaaatacaaaaaatagccgggcgtggtggtgggtgcctgtaatcccagctacttgggaggctgaggcaggaaaatcgcttgaacctgggaagtggaggttgtagtgagccgagatcacgtcactgcactccagcctgagcaacagagcaagactccatctctctcttacacacacacacacacacacacaaatcataaaacagatcatcattctcatatgtaaagcccttccacatcccagccttgccccagctcctataagaccctgacaacctgctgcccaccccctctacccttatctctaaccattctcccccacccccaactcaacatgctccagacacactgtcaatggttgctataaaatggctgcaataaaacgacaccactgtcccacctcgcggcctttgcaggtgctgagtgtgcagtccttcccttcccccgttctcagcagagaggttaggcaccaccgcagcagagaggcctgccctctcttgatcttccccaaccctatttcttaccataattcacacttatatgtctacttgtgcatttacctggttgatgccatctccccaaatgggctgttcattccaaaggcagcaacctgtgctgtgttggcagggactggggttggaagtggggattgactttacatgggcaacaaagaaccttttgggctgacgaagctcttctaaatgtgaattgcagtgatggttacataaccctatacatttactgaaatcaacaaattgtgcacttacaatgggtgaattttatgtaaattatattcccaagccatcacaaggcctggcccgcagccagtgctccctgaggacttgccaaaggggtgactgaatgaatatttaatggtctggagcctagcatctctgtggagaattgagaagattttaatggacctctcagatctgcaaatctaaaacgctgtcctggaatggaagaatacaggccctgaagaggtagccacattgcactgtgaggcacgtgcatggcatttggtttgtttgtttctattttattttccctgaaaggcaagaccattgcctcaatgattccacgttgattcagttttatttgcatgtttgttttgtcattactgtcaccacccttgggaattttggttgggaagtgagaagtcaggctgggaggatggggactggccagtggcctcctagagcaggggtgagtgtggccgtatttcaacaaacctctatttacaaaaacaggcagcaggagacatgtggccccccagctgtagtttgcagagctttgtcctaaaattctaatttgcggccactttttgcagcctcctgtaaaccgattcttgttttagtttctgttctaaagcccagggccctgagtctcggagaagaaagctgcttgcttggaattacacagagaaggaccgcccatgtggacagcttcgtccctgaggcaactcttctagctggcaggtcatacttgggtgtcatggagaaatgccagggaacgaacaaacacagatactcaggagacaatggagtcacttttttcctggctcttttggggatggctcacaaactgggggtgaaaagctgatgaggaacaaaggtctggggagctggcccaaggcccaggacccccaacaggctgcactctgcagggctcactgagcctcatcagggccgcagctggccagaccctgcctccagccaccgaggcacattacctgggcccaacagatgtcctggcagcggggccacagtatcctcctcatcgtccactctcttcaagaccagtgcaaagaaagcagcgaatcccagcacctgaaaaatacccagggaggtcctcgaacccactctggtaactctcaacccctcatctgcgagcacgtggggcttggggccacgtttgtatgttggggagggccctgtgttttgggggaatgcagctcccttctgcagagatgggaggtggtcatgaagctggaccgcaaggccttggctcgcagaccagatgggggactggccagtcctagaactcccctgagccttcccacctactaccgctcacctgtctgaggggtctctgatctctccgcaaggagaattgctctcccccagggctttcagcacagggatcctgccccaccctgctccttccctttcctccagtattaagtaatgcgctcaggtgcagggtctcagctgcaaggcctcagccacgtgatctctgcgcctgctccacacaaacacaggaggatcctgtggttcacttggggaacagaaaggctcaagacgcagccctgttcttagtatcctgcgagcctagtgttgaagggaggtgtcggatgctttttgagtcttatggtaaaggctgttcagggaagaatgggggacgagaggggatttggcaaagtcccataggtgtaaagatgagctttgttttttttgagatggagtcttgctctattgccccagctggaatgcaatggcatgatctaggctcactgcaacctccgccttctgggtttaagtgattctcctgccttagcctccctagtagctgggattatgggcacccaccaccacgctcgactaattttgtaatctttttctctttttttttttttttgagatggagttttgctcttattgcccaggctggagtgcaatggcgcaatctcggctcactgcaacctctgcctcccgggttcaagtgattctcctgcgtcagcctcctgagtagctgggattagctgcgattacaggcatgcaccaccacacctggctaactttgtatttttagtagagacagggtttctccatgttggttaggctggtcttgaactcctgacctcaagtgatccacatacctcagcctcccaaagtactgggattacaggcgtgagccaccgcgcccaaccaagatttgctttaaatatctcctcctttcggtggcttcccctacaccccaatccagtatctcttccccttaggggttccccagggattgcccactgcccgactccttccaagggaaactgtgccccttgcctcctctgctctacacctggatttaggatttctttctttctttctttttttctttccaccatcccaggctaacagatcaccaggagctggtctcatgggagctgcctgaccaaggattttttttttttttttttttttgaggcagggtcttgctctgtcgcccaggctggagttcagtggcgcaatcacaactcactgcagcctcaaactcctggactcaagcgatcctaccacctcaacctcccaaaatactaggattactggcattgagccaccatgccgagccagaatttcttcaactctaacaagttcttttgcgtaattttacatctcagaaataggagtgtagcttctaactcaggcacacatataatgacttggtgttttttccaaagggaaaattcctttaaattgctgtcttttcccttgcaagcagactcagaaaaaaaaaaaaaatgaataactagctacataaattgttgtcttgtctcaagatcaaatggatgttaacattgaggaaatagggtattatttatacatatatatgtataccctagggcaagggtaacctcgggtaatatgatagggctatttttcctgccttgggcctgcccagagggggtgctccaggttcatttgttgaatatataaataaaggaataaaagcccagggactagactgctggcagtagggaagggatgggtggaggggaggagggcgggtgcctgaggcagggtcctgaccttcaggggctgggtgacgaacatgctctccacgaaggagacagccatggagatgagccacctgagggagctggccctcccgtagtgcaggccgtagagcatggtgaagaaggccgccacgccactggtggccgctaccaggagccagcccaccaggatgcaccaccagggcaggccttgagggggtttgctcacctgaagagcgctgcaaaggaggtggacagacatagttagggtggccacacccccaggcaatctcaaggtcaaaccccactctactctgatcagcatgaccttggccaagctcctggacctctcagatcctctgtttccttctctgtaatctatacctatctcaaaggtctatgccatagtctgtggagtaaaagcagttacatttactcagtgcttagtaggggcaagtccccgcactaaatgctacacacagatttgctctgttattgctcagggcaagcctagaaggcagataccatagaatcttgttttaagttttctccccccgggtgcagtggttcatgcttgtaatcccagtactttgggaggccaaggagggcggaccacaaggtcaggatttcgagaccagcctggccaacatggcgaaaccccgtctttactaaaaatacaaaaattagccgggcgtggtggcgggcacctgtaatcccagctactcgggaggctgaggcaggagaattggttgaacccgggaggtggaggttgcagtgagccgagatcgtgccattgcgctccagcctgggcaacaagagcaagactctgtctcaaaaaaaagaaagaaaattctcatcatacaaaaattagtgagcacagtgaatacccaggtgtttattagctggcaaccactatcaccccttgtcacacttatttcatctgcccctcagccctgttttgtttttgtttttggctggaaaatttcaacataaattccagacataatacaaaataattcctagtcacttcagaatgcatctcaaaagtggccatttttgccaggcgtggtggctcacgcctgtaatcccagcactttgggaggctgaggcaggtggatcacttgaggtcaggagttcgagaccagcctggccaacgtggtgaaagcccatctctaccacaaatacaaaatttagctgggcgtggtggtgggcacctgtaatctcagctattcggggaggctgaggcaggagactcacttgaacccaggaggcagaggttgcagtgagccgagatcacgccattgcattccatcctgggtgacagagcaagactctgtctcaaaaaaaaaaaaaaaggcaattttcttactgaattacgatgctgttttcacacagctaaattaacagtaatttttaaatgtcacctagtaacctgtctgtattcaaagttcactggttatcttaaaaaatgcattttgttttaagtttgaatcaagagataggcgtcatcattcccattttaaagatcaggaaactaagcctgagaagttgaggagccggtccaagagtgaagtgcacagatgggaaacagcccacaggaacaccgttgtgactgtagcatgcggtacaaagggccctgagtgccttccagcaaacagacctgttcaaacccggcctccctgaatgtgtgcaggaatcctgcattgtttctgcctggcaaggtctgggtggacatccttccaagattgttcagaatgccctttccagacggccccaggctggggcaggcaggcacccactcagcccccagggaagtggattacctggcatgtgcaggggcccaggtgcccggctgtacccccaggccgcccttcagggtctgcagctgcctgagggcctaggcatggctgtggggctgggagaagcctcggggccccaccagccgcagctcttgctccacgtgttccagctgaaggtacagacactgcctgtaggcgctgtccttccaggggccactccgtgccgccttgggcttgggacactgtgatttctctggaggacaaagaagaaagcgatcagcttgtgctgagtcacagagcaaaccagctgcaatacaaacaacagccaggtggggcggcatgcgcaggtggtcccagctactcgggagactgaggcaggaggatcgctggagcccaggagggcgaggctgcagtgagctatgatggcgccacttcactccagccagggcaacaaagccagatcctgtctccaaacaaaacaaacaaacctccccccacaaaacacaacagtaatagtaccagcttctgagtatgaaatgcttgctatgtgccaagccctgagaaatctgaggttcaaagagacggagtaaggttttagggtcacacagccagttaggattcgatgtttctcttttagatttttatcagagtcattcttcaaatttccctacacatcaagagaacagaggagaatcccatactcatcactccagctacaacaatgaccaacatttggccagtcttgtctcatctcttttcttctcctggagctttttttttttttttttttgcagtgaagtctcactctgtctccccagctggagtgcagtggtgttatctcagctcactgcaacctccacttcctgggttctagaagcagttctcttgcctcagcctcctgagtagctgggactacaggcgcacgccaccacgcccagctagtttttgtatttttagtagagagatggggtttcaccatgttggccaggttggttctaaactcctgacctcaggtgatccgcccgccccggcctcccaaagtgctgggattacaggcgtgagccacagtgcccgccctcaccccccgactcccccaccccctgggcccagagtattttaaagcaaatactttaatatggtaagacttgaatttgaacccttttttgtctagtgccaaatatagtgtaatcctgtccctttgtttttttgttttttttgttgttgttgttgagacggagttttgctcttgtcgcccaggctggagtgcagtggcgcaatctcagctcactgcaacctccgcctcccaggttccagtgattctcctgcctcagcctcctgagtaaccgggattacaggcacccgccaccatgcccagctaattttttttttttgtatttttagtagagacggatttttaccatgttggccaggctggtcttgaactcctgacctcaggggatcggccagcctcagtctcccaaagtgctgggatcacaggcatgagccagcacgcccggccaatacagtgtaatccttaatcttgtgtttttagcttttttaaaaattatgaaacatctcaaacatataaaattagagcaaatgatgagatgaagccacacagcgacacagcgtcaaaatgatcaaaatgacgcagcgagactccgtctcaaaaaaaaaaaaaaaaaagaagaaatgcagttataatcttgtatcttcccttcacctacaggacaagcttttctaactgtgcttagcatctccaaggcagagcactatcccacctggaggttgccttgagagacagcagtccatctgcaacccaaagaacgcctccgacgaaactgtctctcatgttgagagtttcagccacttgtacaggctagccctgcccaggaaggtgcaagctggacctcctggtagataattctaattcactgaagtgcgttacgccgacccccactggcttgcttcctctcctccccgccattcatgccaagtctccttttaaaatccctgctttctgcctcagaggtgtagtgatatccttaagtcaggaagcctgtacttcttcccctaagctagctttggaataaaaagttacttctctttctctctccacccaccgacctctatctctttttgagacagggtctaactctgtcccacaggctggagtgcagtggcgtgatcttggctcactgcaacttctgcctcccgggctcaagtgatcttcccacctcagcttcccaagtagctggggctacaggcacatgccaccatgcccagataaaaaagtcactttttttttttttttgagacagagtctcactctgtcgcccaggctggagtgcagtggtgcgatctcggctcactgcaacctccgcctcccaggttcacgccattctcctggcacagcctccctagtagctgggtctacaggcacccgccaccacaccggggtaattttttgtatttttagtagagacggggattcaccgtgttagtcaggatggtctcgatcgcctgacctcgtgatccgcccgccttggactcccaaagtgctgggattacaggcgtgagccaccgctcccggtcaagagtcactttttaaataccagatctcactctgattaactggactctgcaaatggcaagcaactatatctgcattttggttacagccaggtatatgcatctccagccctgactcagataaggttagggtgttgggtaaatggctatggtgaggtcaactcctaccttcctctgactcacagcctcctccctcaccctcctgactgggctccctcactgaagcctcagctgaagattccaagtcaacactttattttgcagggcttctgctaatgtttctgaaagataacatcactgccaatcataacaccacttactgtatacctgctttgtgtcaggctgggatctaaatactttacatgtcttacaatcttattcagccctcacaataagccaacgagctaggtggatcaatacccctattttatattttttttactttgagacacggtctcaccctgtcaaccaggctggaatgcagtggtgcaaccttggctcaccgcaacctctgcctcccaggctcaggcagtcctcctatctcagcctctcaagtagctagaattacaggtatgtgccaccacgcccagctaatttttaacacaccccctttttttttttttttttttgagacaggagtcttgctctgtcacccaggttggagtgcagtggtgcaatctcagatcactgcaacctccacctcccaggttcaagtgattctcttgcctcacctcccaggttcaagtgattctcctgcctcagcctcccgagtagctaggactacaggcgtgtgccaccacatgcagctaatttttttatttttagtagagatggggttttgtcatgttgaccaggctggtcttgaactcctgaccccaggtgatctgcccacctcggcctcccaaagtgttgggattacaagcgtgagccaccacgcccagccaacacctctattttctaagggaagaaatgaagtctcagagaggttgagcaacttgtttaaagttgcaccgctgctactgcagctgggagatcccaaggttctggccgactccagagttcatgttcttaaggtccagtgtgtccagctgtgaatgctaaaactcccaaactcaaagtcaaggatctagtggaagcagggatgacctccataagcagcccaaacccagctctctggggcaaattcttttttttttctttttttttgagatggagtcttgctctgtcacccaggctggggtgcagtgatgtgatctcagctcactgctgactacacctcccaggtttaagcgattctctgcctcagcctcttgagtagctgggactacaggggcaagtaactctatcaggggtggggccaagaattatgaattcaaattgcttattctataaaccatactttcgtgttctaaacaaggtttagatagtggccacccttgtgtattaaaaatggtagcattctaaacccacataactatccaccatgttccacagaacatttctgtcactgtagaaagttctattggatggcaccgctctaaatgggaagatggacaggaaaggggcatgaagggaaccaggagactagttgaaaccggaataatatgccatatatacatttgtttaatgaaaagaaaacaatgttactgggttctagctggatattgttggaaaaacctctgaatttgagatcttttatctctgtcaaacagattaaggagtgttagagaggcattaaagacatagtcgcaccaaactgagactttctcccttttttttagagctagggtcttgctctgtcacccaagctggggtgcagtggcacctgtaacctcaaaccagtttgctgtaacctcaaactcaaaaaaaagactcaagggatcctcccacctcagccttccaaatagctgggactacaggtgcccattgagaaggagtcttgctctgttgcccaggctggagtgcagtggtgtgatcttggctcactgcaacctccacctcccgggttcaagtgattctcctgcctcagcctcccaagtaactgggattacagatgtgcaccaccacgcccagctaatttttgtatttttagtagagatgaggtttcaccatgttggtcaggctggtctcgaactcctgacctcaagtgatctgcccaccttggtctcccaaagtgctgggaatacaggcatgagccaccgtgcttggctaacacctggttaagttttaaactctttgtacagacagggtctccctatgttgccaacgccggtctcgaactcctggcctcaagcaatcctcccgcctcagcctcttaaagtgctgggattagaggcgtgagccagtgctcccagccatttgcttaattaggaggattgaaaacgaatagagaaaggaataacttttccagtctgcaattccatgttccttaatggtttttgctgccctgactgtgatcttgcttcctgccccacatattcaggcacggatcgagttcagctttgcaccccagcactctacagaagaaggcaccgaggcattgagaatggaggtcacctgtccacggtcacacagccggctagtggcagagccaggacccagacatggttcttcctagtggagatgagacaaaagacagatggacggctcccacctcacggagtttacattccaggaaggatggcgcaagctttaaacaattttcacctgattcattagttggccacaaacaggttgaatgcaagaagcttagggagttggccgggcacagtggctcacgcctgtaatcccagcactttgggaggccaaggcagatggatcacgaggtcaggagattgagaccatcctggctaacacggtgaaaccccgtctctactaaaaatacaaaaaattagccgggcgtggtggcaggtgcctgtagtcccagctattcgggaggctgaggcaggagaatggcatgaacctgggaggcagagcttgcagtgagctgacattgtgccattgcactccagcctgggcgacacagcgagactccatctcaaaaaaaaaaaaaaaaaaaaaaaaaacttagggagctaaagagcgcgtggtcagaggccctagtgtaggttagaggcttgggttgctcccctgaagaaggaatgcttaagccaaaactaaaatttcagtaggtattggcctggcgaagagaggagaaagaacattctagactaaaggaccagcctgtgtgaaggctgttagtgggaaggcagcttggcattgtagggacagtaggtgcctgaggtatacagagggaggggatggccggtggttcaagcagaggctggtgagggagacctcttgttcccctagtgatgctgatgtacccctttgctgtgtctccacccggccccaaaatgcggcttctcttggcacagacatgtccagggcttacctttcatttctgatgaccccaaagtgagtgttacagggtcctctctctttttggcttcctcccagaacacctgccctgatgtgttctgtggataaatgacatcttccaccaaggcgaggagactgttgatgtccatcaagttcactgagtcccagcccaaggcgggggatggcaccttgagagctttgaagagggagctgacgattcttgacacatcctggtggggaaaggggccataagccaaggtgaggggtgcagcacaggggtcaagagcacacgccctgggcctggcaacctgtgtagggacccctgctctgcccactgagatgtgatagtgacctccctgagcttccatttgtcagctcttgaatccctcttctagggtttgaactcattccaggctgtactcctcaaagcgtggcacacagtaggtgctcaatgaaagcttactgaatgcatcaacgcagagcggggagtctcgtccatgggcttccagcctgggagtctaccatgaaggcataattctttgcacacagtagatactcaaaaagtatgtgggtgtatgcgtgtgtgcacatgtgcatgtgtatgtacatgtctgtgtgtctctctgtgtatgtgtgtgcatgtatgcatatgtgcacctgtgtgtttgtgtgtgcatgtgtgtacagatgcatgggtgcatgcatgttgcatgtgtatgtgtgtcttcagttgatgaattttggcacctcacgttgccaggcaacacagggctgctgggtctcaagccccaggcctcacccccacttctgctgaggctacagcaccccccaggctagctgaggttgaggacctgccttggtcactgcctcaggtgtcagaaggccgtcctccatgggctgtggggagggagtcaggttgggggacccccggtcccattttccagtgttctgctccttcgcgacccggggacgggtgttctgaaagatctgaacaatcaggaggttgatggggaacatgaggatggagctctccaggccaatcatcacctcctgccaggtgaattcaattttacctggggaaagggaaggaagggatcaaagggagaggccaccgcccggagcccagtcccttctgccccttgtggaagctggctgtgcagtgaagggttaaccctgcccaacgcctgggaggtcaccgctcagcccttggaagttcccaactgctaagaatgtctttgtttccctagggtcttgggtcacaccggatggtctgtgctaatgatgagatttaggtgggggcctagaccatatgatgtcagcttgacctctagaggggctggaggcgaagggcagccaagtgggtgtcagccatgcctatatgttggagccccagtaaaagctctgaatagtggctgggcatggtggctcatgcctgtaatcccagcactttggaaggtcaaggtgggtggattacctgaggtcaggagttggaggccagcctggccaacatggtgaaaccccttctctactaaaaatacaaaaattagctgggcatagtggtgggtgcctgtaattccagctactcgggaggctgaggcaggagaattgcttgaatccgggaagcagaggttgcattaagccgagatcataccactgcatttcagtttggatgacaagagcaaaactctgtctcaaaaaaaaaaaaaattgtgaattgcaaggctggagtgagtccccctggttggcaatactccatgtgcactgtcacacatcctcaggagaagtcagcaccatccacgactccactgggagaggatgctggaagctatgtgcctggtctcttctggcccctgctccatgtgtctcttccctttgctggttttaatctgtatcctttctgtgttttttgttcttttggtttgtttgtttattttttttttttttgagatggaattttgcatttttttacccaggctggagtgcaatggtgagatctcagctcactgcaatctccgcctcctgggtttaagtgattttcctgcctcagcctcctgaatagctggaactacaggtgtgcaccaccacacccggctaattttgtatttttagtagagatgggttttcaccatgttagccaggcttgtctcaaattcctgacctcaggtgatccacctgccttcgcctcccagagtgctgggattacaggcgtgagccaccgtgccagctgtatcctttcactgcagtaaaccataactatgagtacaatgggttctgtaagtcctgctagtggatcactgaactggagggcggtcttggggactctggaatggcagtggcattgctggagcagtgaaggctcaggtccaccagccactaaccctgacctccatgacactgggaattacccaagtccatcttttgctcagctgggtccttggggaccccccagaacatgatgctggtcagcatggtgcacagcagcagggagaagcagcaggacaccctctggacgcgggtgaagctgctgcgagcgcagcggctgaagatcgaataccagatgtgtccatcctggaagcccgcggaagtcttcatgaaaaacaggtggctgcaggcaggcagggagagagggacaggcatttagggagacaggaatgggggaaactggtctctgtgggtcgttcttgggatgagaagcaggaagagcggcagagatttgtttctaagattgttcacactttttttttttttttttttcagataatgtcttgtgtcttgctctgtcacccaggctggagtgcaatggcacgatctcggctcactgcaacctctgcctcccagattcaagcaactctcctgcctcaaactcccaggtagctgggattacaggtgcccacaaccacgcctggctaattttttgtatttttagtagagacatggtttcaccacattggccaggctggtttcacactcctgatctcaagtgatctggccgccttggcctcccaaagcgctgggattacaggtgtgagccaccgcgcctagccacatttttttttcggatggagtcttgctcttgccaggcaggagtgcagtggcatgatcttggcttactgcaacctctgcctctggggttcaagtgattctcctgcctcagcctcccaagtatctgggactacaggtgtgagctattttttttttttgtatttttagtaaagacggggtatcaccatgttggccaggatggtctcgatttcttgaccccttgatccacccgcctgagcctcccaaagtgctggtattacaggcatgagccaccgtccccggctccccccccaatttttttttttttttttaatagaagaaacacagcatcttagcagcatcacttagagttaacaatgaaggctctggaagtcagattagaattacagacggccctcttcccagctgtgtgacctcgggcacgttactttgttctttgtaccttagatgacttgtctgtaaattggggcaagtaataataacagaacctacctcactggattgttgaaaggaataaaagtgatgattctgtaaagcatttggggcagtagctggcatataggtcaatattcaatcagtgtcagcattgttatttttgctgtaattttaatataataatatagctaaaatactattagttttgttacagttagatcattggagtacagtggttaaaaatcccaggcatgacggagtgcagtggctcattcctgtaatcccacgactttagcagggcaaggagagagggttgcttgtggtcaggagttcaagaccagcctggccaatgtggtgaaaccccgtctctaataaaagtacaaaaattagccaggcatggtggcatgcacctgtaatctcagctacttgagtggctgaagcaggagaattgcttgaactcaggaggcagaggtcacagtgagccaatatcgtgccaccatactccaacctgggtgacagagactctgttcaaaaaaaaaaaaaaaaaaaaaaatcccaggcatggccaagcacagtggctcacacctgtaaccccaaaactttgggaggctgatacggaggatcccttgagcccaggagtttgagaccagtctgggcaatatggtgaaaccccatctctacaaaaacagttgggcatggtggtgtatgtctacagtttcagctactcaggaggctgaggtaggaggatctcttgagaaggtcgagaccatcctaggcaacatagcaaagattcgtctctacttaaaaaaaaaaaaaaaaaagaaaaagaaagtgaggcatcgtggtgcatgcctgcagtcccagctgctcaagaggctgaggtgagaggattgcttgacccaggggggtagaggttgcagtgagctgtgatcgtgccactgcactccagcctgggtggcggaacaagaccttatcttaaaaataaagaaaacaaaaataaagtacctgaattgttttctgtcctgctccgtggccacaggaaacaccttatcgaggacgcaatctccaacattgatggatagccaggagttgcacaggaaataccacttccggtccatcaccaggtcatagaccagcacccggctcacatacctggagaagggacccagagttttgaggataaggtggagcaggggaggagacttcactggacatcaccaaggtaacagttttgcaaacatgaacccaaagaacaagagctcctcagaaaaagaaaccatatttttctttgttcttggtgccttaattaaaattcgcgtcacataaggaggtcagctactgtagagagccaactctgggaagctgccatgtttccacaaagatgctgcaaaaggatgcattcggagaccattaacctgtacacatggcaccaagctcagggccagcgtccaggcatgagcaagtaaagccaaattgtgtaaagtgtgcatgttcaggcaggtgcaggctggggtacgcagaacatggtcctctcttgcgtttctttctttctttttttaaattttagacagaatcttgctctgtcacccaggctggagtgcgatggagtgatcttggctcactgtaacttccgcctcccaggttcaagcgattctcctgcctcagcctcccgagtagctgggattacaggcatgcaccaccacacccggctaattttgtatttttagtagagacagggtttctccatgttggtcaggctggtgtcgaactcctgacctcaggtgatccacccacctcggcctcccaaagtgctgggattacaggcgtgagccaccgcgcctggcctcctctcttgcgtttctaaccaaagaatcaccgtctatcttgggctgaggactttgtgggtatcttctaacctgatttaggtctttgaggtatggggaagaattgaaattatcttgcctatcctgtgatgtcagatcgagcagcagttttccctgttgctatacagccaacaagaacagcaatgatggctgggtgtagtggctcacgtctgcaattgcagcactttgggaggccaaggtgggcagatcacttgaggtcaggagtttgaaaccagcctggccaacatggtaaaacctcatctctactaaaaatacaaataaataaataaataaattagctgggcatggtggcgtatgcctgtaataccagctactcaagaggccgaggcaggagaatgacttaaacccaggaagcagaggttgcggtgagccgagattgtgccatcactccagcctgggtgacagagtgagactctgtctcaaaaaaaaaaaaaaaaaaaagaacagtagggatagcaatagccgctcttcactgagaatttactacatagcgggggctatgctaagatgctcttgatatgcattttctcatttcaggaagggcagccccgtaggaatgcaaaagccacctatgtcaaggtcacaggcttttctggggcagctgacatccagtgatgcagtacctacagggatcaagacctgggtatttcaacccaacttgggacagctccagagctccccagtggtggaccacactgttgctgggctgcatcacagcttgacttttctgccatcctgcctccttccctctgttcccaggtgctggtcccagggccctgtaataaacaccctgcatatgcaactccatctgagagcctgcttcccgggagcaacctacagcggccacgcttaaaatattaatgcttaatcccataggtgaattaaagtgctattgtttttctaaagccgccagctactgatgggtggtcagactggacaccactcatctgggtcactcattttggcctcagaatgcagagaaccttgctccaaacttgccagctgtgtgaccttgggcaagtcacaggttgatgctgcaaaagggccaagggtggggctagcactgaagatggggctagctgtagcttccagtccttttcctagctaccgatccagtttgtgtggaccatgaaccagtgggcttttctgaccctcagtttcctcatctgtgaaacagagatcattctatgtgtcttgcggaggcttgcgaagatcaggaaggaggcaaatgtacagtgcccagccctgggcctgtcactctgtagattctcaaggtttgtctgcccccaactcaccacgatggccggtcccctgagttgtcatgccacagccggaggctccgcagttctcccagggggaacagggtggagaggaggaaggcatccactgctcctcgctcaaaaaccggagtgtcgggatcagccaggtggtggggctctctctctccatccaggccatacagggtgacagtcacctgaaatccagagaccagaagtggccaactccacagtggcatagcagggctgggtgggatgtgctgattaatcagtggatcttgcataggcaggtacctttgaggacgtggctgcccctcgtcggtgtcctgtgtagactgtcaccaggtagtggtactgagcaaagggatcattgtcttccagcactgtgaccttcacctgaagagaaggacagcattaggaaggccttgctcagtgggttcctgcatcacccaccagccaagaaggagctgatgatttgtgataatcatgaattgggcaaagcaaaattacatgtgccatttattcatcccctcgggtgagaactgttctttataaaagcagggtttcaagtgcaaaacgctcggaaaataaaaaaacacaaagtacatttttttcttcttccttttttttttttgttttcagacagggtctcgctctgctgcctaggctcgagtacagtgccgtgatcttagctcactgccatctctgcctcccgggttcaagtgattctcctgcctcagcctccagagtagctgggactacaggcgtgtgccaccatgcctggctaatttttgtatttttagttagagacgaggtttcaccatgttggccaggctggtctcaaactcctaacctcaagtgatctgcccacctcggcctcccaaagtgctgggattacaggcgtgagccaccacgcccggccccaaagtacattctttatgagatatgacccccatgtagtccaattggaaatgaacttgataagctgagaacattgaatgtttgacctggtgaaccatacatactctgtacatgtataatttctcataacatttggaaccaggtggtgtttttgagggaatttaaaagaaatgaaacgttaagatagtttagcgacaaatgaactcatggagataggaagtagaatgatggtcagcagaggctgggaaaggtagtgggggcgggaatgggggggaagatgaggtggttaatgggtacaaaattagaaagaatgagtaagatgtctgccgggcgcggtggcttacacctgtaatcccagcactttgggaggccaaggcgggtggatcccttgaggttaggagttacagaccagcctgaccaatgtggtgaaaccctgcctctactaaaaacacaaaaattagctgggcgtggtggctggcacctgtaatcctagctactcgggaggctgaggcaggagaattgcttgaacccaggaggtggaagttgcgtgagctgagatcacgtcgctgcactctagcctgtgtgacagagcaagactccaggtcaaaaaaaaaaaaaaaaaaagaatgaataagatgaataagatctagtattttataccacaacagggtgactacagtcaataataattgtacatttaaaaataattaaaagagtataatcggattgtttgtgacacaaaggataaatgctcgaggagatggataccccaattatcccaatgtgattattacaccctgcatgcctgtatcaaaatgtcccatatatctcatatgtatatatacctaccatgtgcccataagaattaacaaaaatttttaaagagtttggcaaaaagaaaagaaaaagaaattagccagagttagccagagttggccagaggctatagtcgactctgaatgcgctgcccagatccccctcccacgcagggttcgttgcctcagttaatggggtaaaaaatgcaacacctacctctgttgagattgtgcccccttggggcagccagcacccaatgaccaataggcggagtgtctgggtgtggtcaagacctgggtatctcaacccgacttgggacagctccggtgctccccagggtctgggccgggctgtcactgggctacatcacagctcagcttctctctctgcgcatgctgcctccttccctcccttcccaggtgcaggtcccaggcccccttaataaacaccctgcacactctgcatgctcacctttgcatcggagtctgcttcctgggaaccaacctacagcagaggcacttcaagtattaatgcttaatctcttgggtgaatcaaagacagcagtatcaatgctgaaacattatcttattaaatttaacccacatgaaatcctgagtgatgttgcttcgggggaaggggtaggaacggatagagtttcacagctctgtgacaatgcaaccttgcattcattcattacctcttcttcagatagccataaatattggctgaaggcctactatgtatgtgtcaggcatactgcatacattggaaaacaattgttttttttgagatgaagtcttgttctgttgtccaggctggagtgcagtggcataatcttagctcactgcaacctccacctcccaggttcaagtgattctcctgcttcagcctcctgagtagctgggattacaggtgcatgccaccacgcccaactaatttttgtatttttagtagagatggggtttcaccatgttggccaggctggtcaactcctgaccgcaggtgatccgtccaccttggcctgccaaagtgctgggattacaggcgtgagccaccgcgcccggttggaaaaaatcttaagtagacaaataccctcttctcgtgaagcctaatattatttgaaaacaatggagttttctccaggacggtgtacgcagcgccaatggttctcagcctcaccttggcctgatcctgagcgtccttcctcctcgcccagatcaccaccagcacgtagaccacacacaggcagcccacggtggtcacgaccacagggttgtcctcaaaggtggcaaagagctcagcagtctggtggatgttgatggcattggacatcaccaggaacgtgcttccgaagaaagtgaggtggttgcagaggcagtgtgtctggtaggggctggtccgaggccccacctacaacccataaaggggctgtcagtggagacgctcgggaagctcaaccccggctcgctcgagcccaggggaggagaacggtgttcgctttgaagagtgcacactctgctggggtgtgtggtgggaagaccgctgggagaccagcttcaaaagccccttttgatctttttttttttttttttttttgagatggagtctcacctgttgccaggctggagtgtagtggcgagatctcggatcaatgcaatctccacctcccgggttcaagcaattctcctgcctcagcctcccgagtagctgggactacaggcatgcaccaccacacccagctatttttttttgtatttttagttgagacggggtttcaccatgttggccaggatggtctcaatctgctgacctcatgatccgcccgcctcagcctcctaaagtgctgggattacaggagtgagccactgtgtttggccaatattttttatttaattaaaatatggagataatattatttatatttttgtgtccatcattctcagtggacaactgtgtatatgttgccagtctgctttcctttttttttctttttcttcttctgagacgggatctcactctgtcggccaggctggagtgcagtgacacaatcttggctcactgctgcaacctctgcctgctgggttgaagcaattctcatgcctgtgtcccccaagaagctgagattacaggcaagcgccaccacacccggttaatttgggtattttcagtagagacggggtttcgccatgttggccaggcaggtctcaaacaggctgatctcaagtgatctgcttgcgtcagcctcccaaagtgctgggattgcaggcgtgtaccacagtgtgattcgcgtctgcaatctgagcttcttgggaggctgaagcacaagaattgcttgaaccccagaggcagaggttgtagtgagctgagatcacgccactgtactccagcatgggcgacagagaccctgtctcaaaaaaatacatatatatggcaagtaaatttgagatctcctttgtccctcttcccctataggcaaccaggatcacaaatttggcattcacccccgtggtgcacctggtgctcattcacaggacaaatatttgtggggtgctaattctacatccagcaacaggctaggtgctgagaggacactggtgtgactaactcatcccagtttgccagggcctttcctgcttttcaaacagaaagtcctgagtcccaggagctccttcagtcctgggcaacccgggacagttggtcagcttatgccgaaaagcaaaataacctgggggaaccacaggaagaaaaagaagaaaaagagaaggacacaggtttgagtcctaagctggcattgtggcacaaagaaggtgtgatggcacttacacaggtggtgccttgtggtgcaggacaacatggccgggcagcaaggggaccggagtgaaccagggcaggggctgccatctgtgcctgtgcttcacacccacatggccacccccaatcccccgcgagctcacagtcaccccctagggccttctggtgggtaaagaagatggtttgtttgtttgagacagagtcttgctctgtcgcccaggctggagtgcagtggcatcatctcggctcaccgcaacctccacctcccaggttcaagcgattctcctgcctcagcctcctgagtagctgggactacaggtgcccaccaccacacccggttaatttttgtatctttagtagaaatggggtttcaccatgttggccaggctgctcttgaactcctgacctcaagtgatccacccgcctcggcctcccaaagtgctgggattacaggcttgagccaccgtgcctggccctacatgtaagatttgggacaagtcagttgagtttcctgagcctttgttttgtcccctgtaaaatgagagtcacagctgtcttggagatgattgtgcagatctgatgagccgatgtaagcaaagcatggagctctgcacctggcacagaactaagggctgagctatgagttcattctcttggaaatgacaccctggcctcccttaacaacctagaggcagcaggccttcctgagtcattcgtcgcctgggtcaatgaccatttgttctcagtgatgaacaaagcacattgttcctgttgcactgggggctcccagtgcatggagggagacagacgtcatttaaatgatctcatgcgtagaggtgaaatgacccctctgcttagcgctatggatgaggagcactggggttggatgctctggatgtgtgtgctctgggggttcacaataggaaatctgacttagggagttaagaacagttttctcgaggaagcaatgcttaggctgaagcgaggatgaggcgggtatcctaggcaccaggaacagcaaaggccccacggagaggctcaagatgctgtgccagaggcaccaaaagggaaccctacatgagctgggcacagcccaccaagctgcctcatctccttcacttcgctctccttacctggcatcctgagtcgtcccaagtctcctggacctcatcccagaacacacagtgagacaggaaggtggtgatgccaaccgtgaggtccctgccgggggctggctccaggtcagactcagggaccacagtcaaatagtagaccccttctccaaaacgcaggtcctgtgggctcaggatccacgtgggcagctcatctgtaggaaagggggttccaggtcagcctgaagcctccttgagatgggcgttaagatcatgggagagggtgactgagccacttggcagggaagcagaccctgccggttttcccccacccctgatgtcctacaagcactctctcctcctgagaccaggagcatagaagaaggggcactccccagtcagggtgcacagctgactcaggcagacaagggctcaaacacagattctgccccttattggctgtatgagctcagaccagttccttttccttaacctctttgttcttatctggaaagtagagattttttttttttttttgagacagagtctcgctttgtcatccagggtggagtgcagtggtgtgatctcagctcactgcaacctctgcctcctgggttcaagctattcttgtgcctcagcctcctgagtacctgggattacaggtgtgcaccacctcgcccagctactttttgtattttcagtagatatggggtttcgccatgttggccaggctggtcttgaactcctgacctcaagtgatctgcccggcttggcctcccaaaatgctaggattacaggcgtgagccaccacacttggctgaaagtggaaatttcaatagttccccctgccaagggttgtcatgaggattgcaatgaggtcagtcctatatgagcttgtaaacttctttggggcatatagtaagtgctcacctaatgttggcaaatagtaacaccaataaaaaataagccactgaatgtgtggggtggtttttttctttgcttttcttcctgtggcttctgatttccaagtgaagctgatcataccccaggcagcagctcaggaaatggtcacaggcctacctggagccaccattggtacgaggtgagtttgggcatcgtagctgctcttgttggggtggtagccatagcccaggctaagcgtgagtgcaatgtctggtctccagtgcagctggatccccaaggttgcctcccctgaagtcacgttcacccacaaagcttcaggactggtcaggttcaacacggtcggctggctgtgtctttgtgaatgccggggcagcaggatctgtgatcagaaacaatcctattgaaggtgtgccaggaaggcaatgccagcccgtgggcatcaggactgctgtgtagagctgtgtggcctgagcacctgggaacagaaatccaggccgggctttgctcattgtattagtttcctaaggcttctatcacaaatgaccactgtgggaagcttaagacaatatacagttgttatcttttagttctaaaggctggaagtgcaaaatcagtttcccagggctaggggagaacatacttccctgcctttttcagcttctggtggccgcctgcattccttggctcatggccccttcctcgcattactccagcctcttgcttctggcatcaagtcacctttttgtcttctggagtcacctccctttctgcctcccttttataaggacccctgggaagacgcggagcccaccagataacccaggataatctccccagctcaggatgggcaagactcaagcacatctgcaaaatcccttttgcagttttgttgggtttttgtttttagacagggcctggctctgttacccaggctggagtgcaatggcatgaccaaagctcactataaccttgaagtctcgggctcatgtgatcctcccactttagcctcccaaagtgatgggattacaggtgtgagctaccacacctgacctcccttttgcatttaaggtgacatattcacaggctccagggatgagaacacagacatcactaaaattgttattgaattaggcattgatgagaaaattgtagaagactagaatagaatcattaaaattttgaaaaaatgtatttaggttgcaccatggtatgtttacgtttttgtttaaagaaaatctaactggacattttattttttatttatttttttgagatggagtcttgctctgttgcccaggctggagtgcaacggtgcgatcatggctcactgcaaactctgcctcccaagttcaagtgattctccagcctcagccttctgagtagctgggactacaggtgcctgccatcacgcccagccagttttgtgtttttagtagagacggagttttactgaacacaaatgagcaaatgcacgagaaagtgctatgcaaactgttttactgttggccaggctggtctcaaactcctgatctcaggtgatcgactcgccttagcctcccaaagtgttgggattgcaggtgtaagcccttgtgcccagcctaactggacattttagaggctatgtagtgggaatggtttatgtaacgaagataactaaaattccaaacaacagatttatataaccaggaaaactctggttatatacccaaggattggtgaatgaacatgcatttgtagttttaagttaagtacaatgattaagctagggtaaggacctttttttgtttgttgttcttttgttttttgtttttgagatggattctcactctgtcgccaggctggagtgcagtggcacgatcttggctcactgtaatctccgcctcccgggttccggccattctcctgccttagcctcccaagtagctgggattacaggcccgcactaccacactcagctaatttttgtattttttttagtatagacagggtttcgccacggtggccgggatggtcttgatctcctgacctggtgatccactcgcctcagcctcccaaagtgctgggattacaggcatgcgccagtgcgcccagcctgttgctgttattttttaaaccaatcttggttcactgcagcctcgacctcctgggcttaagcaatccttctgcctcagcctcctgagtagctaggaccacaggtgcatgccatcacacctgactaatttttgtattttttgtacagatggtgttgcacattgttgccgaggctggtcttgaactcctggtctctagtgatcctcccaccttgatctctcaaagtgctgggactaccagtcccaaagtgtgaactaccaggaccagctggtaaggatcattttggaaaattctcttctctaaccattttttaaaaaaaataattggccaactttcaatttcaaccaagttgaaaaagaagacagaggctgggcgtggtggctcatgcctgtaatcccagcactctgggaggccgaggcaggtggatcacctgaggtcgagagttcaagaccagcctgaccaacatggtgaaaccccgtctctaataaaaatacaaaaaattagccgggcatggtggcgcatgcttgtaatccagctactcgggaggctgaggcaggagaatcactcgaacccaggagacagagtttgcagtgagccgagatctcgccatcgcactctaatctgggcaacaagagcaaaactccatctcaaaaaaaaaaaaaaaaaaaaaaacagaaatgtggccaggtgcagtggctcacacctataatcctggcactttgggaggccaaggtgggaggactgcttgagcccaggagtttaagaccagcctgggcaatatagtgagaacttgttgctaccaaaacttaaaaaaaaaaaatcaactggatgtggtggcgtgcacctgttgccccagctacttgggaggctaaggtgggaggatcgcttgagcccaggaggcagaagttgcagtgagctgagatcatgccactgaactccagcctgggcccacctaacttttgacgacaccccaaacttctacctcgatattctccgacagattcttcacaggtatgagttgaccactagggctggtcacacggaggccaccgacagtcccgctgacatcaaagtggcttcgggctggaaaggggctctttgggaaactcatgatctgaaaccaagagcaaggagtgttggccaaggcccctgagaagctggagggtgaaagacaaggtcctaagactcaaggagaagtagccctggcgtgtggggcgggtggggcctgccttcggctgctgctgcttcccctggcatgtttccagcctcagggctgaggccgcagagaacctgcgctagaggacccatatcagacttgcttgggctgagcaatgactggaatgtaaaaccatccaagtctttttttttttttttttttgacacagtctcgctctgtcactcaggctggagtgtaatggcacaatctctgctcactgcaacctctgccttccgggttcaagccattcccctgcctcagcctcctgagtagctgggattacaggtgtgcaccaccatgcccggctaattttgtatttttagtagaaatggggtttcaccatgttggccaggctggtctcgaactcctggcctcaggtgatctgttctcctcagcctccccatccaagtctttcttccccaaaagccagtaagtctttaagagaaagatgtttgctttcactagagctcagggagtacacagttagacgtgctttaatttgcggatggaagagagcctgggttggccatttccaagttatgacactaagctgaagagctttatttccagtgactacctgaatcaaggctgttggagaaattttgtagcacaatggaaagagggtaaatctgggagcccagaggtgtgggtctgaaggccggcagagccacttacttgtggctttgggaaaatcattgaacctcactggtacagcgggcatcatcatactaaacacaaataaggaaatgcacgtgaaagtgctctgcaaactgtaaaggctgtccccaaggacgctactaccgttattacctttatatccacgggctcctggccgccctccagagagctgagggaggaggcagcgggcagcatgaaggttgcagagtctgcggcatcagggcgcagggaggagccttgccaactccagggttgtattctggccacaaggtgaggacagaggtggcaggggagggaggagaaagtcagtgttcgagggagccctcacacctcctgcactactgggagcccagcttcaccatcagagtgggggtgtgttttgattcccataggtggttcagcatgtttgtttcagcagaagcagcacaagaggcagctagactggaggctccatgagggtggggctttgccagcctggtttactactgtatccccaatgtctacagcagcgcctggcatataacaggtagtccatcagtattttcgttgaatgaataaatgagcttggatgcaggtttttctccagggttatctccccttcccacctggacctctgacgtcatgtcttaaccccgccccatcttttctggtctttgaccttgcccctttctgatcttgttggggaccccacttcagatcgttcctctaatcaggatactgctttgggaaactgtctgtgagatctaagagggaaaccctggcaggaggaactgaggcttggggcagagggtcccagtgttgccagcagcattgtccagctcctgcttgtcaggtggaggaatggaaggtgtggagcatcccaggtatggcatcagtgctcactgagagatgagccctctgtgtgtgtgtgtgtttgtgtgtgcgcgcgcacgccaaaagtaagaggatcttgagtccctgcaggcccaaggagcagtggctggtcagacacatgcacagcatggttaacagcaggctagtcccattcattcagccccctggcctgcacagctgccatgtgaccgtctctcaggactccttcaggtggatctaacactgggcttggcactccatgcctcccttcctgtgctgtgcaaacactcaacatggtgacaagggggccttctctcggtgggaagcccttcccagctctaggtcccatcacttctctagctccaaggctggtctcctgagctctgcctagcacagggctttggagtgccggtgtggaatgaaccaggttaggggatgagctttcttggggacctgtaacgcagctggtttgtacctgtttgtgtacacagagatggagggggtggccagcatggctggaaggccccctggcagttttcccagcaggagggtggtctgcacatgctccatgactcgaagcagccgcagcactgtggcaatctgaaaaaggaggcaggaagatgttgctatggacctgctgccatacaccatctttggttactgtcaccaggccaatgtgggaccttcaggagggatcgggagagtacagagaggagggagtaagactgcctcggaggtggcccaagaacagtactcataaagcttccagactggcttttgtgagcccattccatcctcacagtaactcggtgtggcaggggcttcactagccccattggacagatgggggatggaggcacagagagggtaggaggctgtgggaggtcacaaattgataaggggaagagccaggactcacggcaaagcatatggctacagagcccgtgtgctgggctgtcagacaatgtggctgtctgggctgctgacatctgccagcaccctaaggcttgttccaggggaaatggacagctgagagcgaggccatttcaccaggtcacctgggcttcgaatctgctccccacccgtcccaacccccagatgagatgcatcctgacaccacggctggtgcggggacccaggaagggctggatgtttgcacataattcctgttggggcacagatcgtgtgggtgtgagtgtgtgtgagtgtatgtgtgcatgtgcgcacacacgtgaacacacagtgtgagggtgacatcactgcatgtgaatgtcagtgtttgagcgtgtgtatgtgtgagcgaatgtgagtgtggtcctgagcgtgtgtgggtacagtgtttgagtgtgtgagtgtgcacaggtgactgcatgattatggagtgtgcaaccatatgtgagggtctgtgagtatgtgagtgcatgtgactgcatggccctgtgtgaagatgcgtgtgtgtaaatgtgcatctgtgtgcaaaagtgtgtgcttgaggccgtgtgagtatgaggtcctctcagtgtgtgtgtgagcttgcacatgagtgtgagtgtggccatgtgtttttgtgtgtgtttgtggagattgagtgtgtctgagcatgtgcgtgtgtgcatccacgcatctttgcgtgttgtgtgtctttcagttcttcctgaatggaggtgatggccccatgtgatcaagaaccatgcaacagcaagaaatgggttttgtggctctgtcatgatgccatctaggaggctatgtccccaccaggatgctggggccacgtgacacagtgctacacctattcttactctgggcagctgcctctcttctgtgttcttggtaaaatgagccacaagtttacccagacctgctagtgggtccatatgatctctccagttggcagcttatttgggatgaggcagagtgccttgatttacacataaggaaatgaggcttaggtaagctctgtaacttgcccaggtcacaagcctcctaagcgacagaggcaggattcaaactcagaccgtctcattccagagcctgtgatttggccaccactccacactgcctcccagaagccctgctctctggaaattttctctttttttctttctttttttttttttgagaaggagtttcactcttgttgcccaggctggagtgcaatggcgcgatcttggctcactgcaacctccgcctcccaggttcaagcaattctgcagcctcagcctcccgagtagctgggattacaggcgccggccatcacgcccggctaattttgtatttttagtagagacggggtttctccatgttgaggctggtcttgaactcctgacctcaggtgatcctcctgccttcgcctcccaaagtgctgggattacaggcttgagccaccgcgcccggcatgctctctggaaattttcttccacctcccagggcaacaccttaacctctgtgccgcactttcctcatctgcaagatggggggggaaagttccacctagaaaagctgatgtgactaagcattcagtgtgtgtgaggtctgcatctggcctggacacccacctggctgctgctggcctccgcaggctcttctggtctgttgctcagggaagcttccagcacactgcccacagcctgaaacaggtccctggtggctgcctggcgcctctggtcctcagggcgggccttggcactcactgtcaacagggcctcactggcatgctgtagagccaagctggcctcccactgggttcacccaaataaggaaaagcgatgtgagcctctgcttaagatagaccattcctgtgtcattcaagggacaagggaagcaaggaggggaacaagccaggaaagagctgggctagacctggcacacgagctccctgtatctccggcttgagaccagggcctcccaccttacagtcctctgagatcctctaggagagtagcctggtctgcctctgaatccttcccagaacgccctgcacagtgcccagcacatagcaggtcttcaagaacattcaatgactaggggacggatggatggatggatggatggatggatggatggatggatggataaatgaagggtggataggcagtttgataaatggatgtatggatgataggtggatgggtggaaaatggatggatggaggatgaatgaatgaatgggtggatggaggatgaatgggtgatgaatggatggatggatgggtgggtggatggatggtagatggatggatgggtggatggtgggtggatggatgaatggtgggggggtggatggatggagaatgaaggatggataagtgggtggatagatggatggatgacaggtggatggatgaatgggtggaagatgaatggatggaggatggatgaatgatggatgaatagatgggtggatggtagatgaatgaataggtggatggttgcgtgggtgggtgggcggatggattcagtacatattcaaattttgtagttttctatgtatttttgaaattatttgtctaatgtctggctgtctcagtaatctgaaaggaccgtaatggcagatgccatgtctacatgatttgctgctgaattctcaatgcgttgcacattacctggcacatacttgacattcaggaagcatttgttaaatgaatgatgaaattaatgcatgcatgaatggatagaaggatagagtggaggatgtgtacaggtccatgtatatacagtgtatatgcatgtaaatagatggattagcaaatggatgtgtaaatgggaagtgtcatatcaagaattagccccagaatcaagaccagccttgctggcttcaggctggaagattttaggagcacaacctcctaccagagtgcgtggggcaaagccaggacagttctcttctcttctgtttttttgtttgtttttgagatagattcttactgttgcccaggctggagtgcagtagcgcaagcatggcttactgtaacctcgaactcctgggctcaagtatcccttatgcctcagcctcctgagtagctgggactacaggtataagccagtatttaggtgttgttttttttttttttttttttgtaaagatgtggtttccctatgtttcacagactgggcttgaactctacggatcaagtgatcctactgcctcaggctcctgaagtgctgggattacaggcatgagccactgtgctggcccgctttccctgtttttagggcttctttttattgttattttttttcatagggtttgctctgtctgccatgctggagtgtagtggcacaatcatggctcactgcatcctcgaccttccgggctcaattgatcctcccacctcaacctcccaagtagctaggactacaggtgtgtaccatgatgcccaaccaattttgttttgctttgtttttgtttgtttgtttgtttttttgagatggagtctctatcacccaggctggagtgcagtggcacgatctcggctcactgcaacccccacctcctgggttgaagcaattctcctgcctcagcctcccgagtagctgggactacaggcgcacaccaccacgcccagctaatatttgtatttttagtagaaatggggtttcactatgttggccaggctggtctcaaactcctgacctcaggcagtccacctgcctcggcctcccaaagtgctgggattacaggcgtgagccaccgtgcccggcctttgttttgtttttgaagggatgaggtctcactatgttgcccaggctggtctcaaactcctggcctcaagcgatcctcctgcctctgcctcccaaaatgctgggattacagacgtcagccaccgtgcctcacctatggcttcttttttaacccttggctgtcagaaccctgggaacacggtgttttaatttgagttctccaagaagcagatcccagagcaagaatttgagagcaagtcatttatttggacatgatcccaagaaacacttgtggggagtagggggtgtgagacagggaagggtggaagccagtacaggagtgtgatcaagcccattacctgggattcactcctgcttgggattatccatcaagaggggtgaggtagctggggtgtttataagccagcttcattagtcactgaacactgcatgaattcacagccatatgggcaggtacagtaggctctgagggtcagagaagacccccagaaggataaggaagcacaggagctggcagccagatgtcaggctggcatgtactgaagttgagaacatgggcagtcagtagcagtgtctggactcacatttggccacccaaatattaatgagattcagttactccctcaacttgctcaccagcagatgcaggagtgagagtctgggcaaacaggccctctcacctagcgtgagatacatgggcagcaggaggggcaccttcccatgaatcgcccatgcaggacccctggaaagaagatgacagaggtcttggcagccccaaaatagccctgtgaccaagggaccccttcaacctatgctgatcacccacctgctgtgaaggagcgtgtcccatgttagcctctgtagatgggagctactcacctgggccgagggtgtgagttccttactccggcaggtcacctctctcagcacctcggccagctcctgcaccctctgcacgtcctccaagccggtggtgactgcagacagtgatcccagcacatgctctctgaccttggcacgggggagaaaggcagggagaggaaatgtaattctgtggctccatgaagtagtgtcaggaagatgcagggtcaggagtgaccagggttattagggggttctttttcttttctttcttttttttttttttttttgagtcagagtctcgctctgtcacccaggctggagtacactggcatgatctcgactcattgcaacctccgcctcctgggttcgggcctcagcctcctgagtagctgggattacaggtgcgcaccaccatcaccagctaattttttgtatttttagtagagacagggttttgccatgttggccaggctggtcttgaacttctgacctcaagtgatccacctgcctcagccttccaaagtgcaggtattacaggcgtgagccaccgcacctggcctcactggtggtttctaaagccctgcagacctctgtctgccttgtatgatgtgtgattaggcagataacagccccctcaagatgcccacattcacatccctgaaacctgtgaatatgttactgaatgtggcaaaaggcactttgactaagtcattttggagaagcaattaagttaaaaattctgagatggagagattatccgaacaggtgggaccaacgtcatcatacgacccttctaagagggaggtaggaacgttaatcagaacaggagatgggtgatggaggcaggggtagggggaagaaaaagagagggaaagaggatgaggtaagggtggggagagacagagggagaggagaggactttggagatgctgcgtggctggctttgaagataggagtcaaggagtgcaggcggcctctagaacccggaaaaggcaaggaatggcttctctcctggagcctccaggtttgcagctctgccatcaccttacttttggcctagtggaccccattttaaacttctggcctccagaactataaagtgaataaatgcgtgttgcgttaagccatgatctttgtggtcatttgtaacagcagccctagcaaacatatataggatgtctcaagctttctccaaatcttcaaattgaatctgtagaatttggcactatttgaaaataaattgtgtctcagcgtggcacctgtgaccagaatggcatgaaattcagaaactggatgactgttggtctggcatggatgggaggtctcaccggaggcttggggtccctgtgtgcctttgcagcagtggggacaagaacccccctacccagccctccactcctgtcttgggccaggccacgggcttcagggtcaagtgctttctacactacaaagcactaatgaggggctggtgaggggctttggtaggagcagagaaaaactaagaacatcatttcagcactgcccagtagaactgtcatttgtaactttatttaattttaataatgacttagatttaagcagcagccacttttgatggggcagagacaccgtggcctgttgctcacacctggctcagcctgacaggctttcccgaagcttccaagtatgagtgcatctgccatccattccagggacagccaggcctccatcccggctgtgtcttgggttgaggaaagaataggtcagtgtggcaggagactctttgcagaatattccagaagggaaactcagataatgggtaatctcacatttgcttctgcaggccctgaccccatcgtttgtcacctaccctgggtaaagatgtcaccggctctggaccctccggcaaatggactcacccagcaggagcccagcaggggacgagatggcaggaggagagagagctgggaggggtcattctcctgatgccctcggccaggtcaccgggggctggccgcctcattcttcaaaagccacagctcctaccagagagtccctctgtgggcagccgccccctggatcctgctcacggcaggccgggcctctggggtcctccacgctgtctagtttgttccctaagccctgcacacacctgtctcaacagagcccttgttaacatcttctcagcttcccagtgagagtttgacatctgtcttgtgccaggccccgggcatttcatggggagaccttgggttaggctgtgtggtctgtgtgcttggggaccacaggatgtccaggggaagcttcccattggtacttctcagagtgaatgtgaccaagaatgagagctgtgtgtgtgtgaaagtgtgtgagtgtgtatgtatgtgtatgtgtgaaagcataattgtgtgtgggagtatgtgtgtgtgtgacagcgtgtcagtgtatgtgtgtgagcatgtgtgtgagtttgtgtgtgcatgtgtatgtgtgtatatgagtgtgtgtgtgtgagcatctgtcagtgtgtgtatgtgtgtgagtatgagtcatatgagtgagtgtgtgagcatgtatgtatatgcgtataagtgtgtgagtatgtgtgtgggagtatgtgaatgtgtttgtgagtgtgtgtgtgtgaacatgtttgagtgtgtgtgtgtgcataagagtgtgtgtgaaagtgtgtatgtatgatgtgtgagagctaatgtgtatgtatgtggcagggggtctggggtaagagggctggaggtggagggggaacctctaaactgggtttgaacccaggcttcaccacttaccagacacagggacacaggcaggcacctctgattctcttaccctctgtttcctcagctgtaacatagatggaggcctcaccatttacgtcccagggttgtagtggggattacagatccatgaagccctaattcagggcctggcagctcatagcaggtgcttgatacatgttagtttctctcggtaagcgaccacaatgacaatccggcttcctgtattaagtacctaccaggcctctagcaccacactcagtaccttcctgcaaacctttcagggagccaagagaagtctttcttctcttctccgtgcccacaggggtgtgtgtgtgggtgtgtgcatgcacacacacgaacacaaactcatgtggcacatgctgggagtggacacaatcatacgttctgcaatagtttatcatactaggttgtaacaatggaacggccatttttgtagattaaaactgattgaatgttgacggtcttatctagttttttagttgcagtgatcgtaattcttatttaactcttactacaattgtatgaggagactagtattcttctatatggggaaactgagacttagagaggtttggtccctggcctgtgacaatgcgaatggtaagtgacaaagccgggacgccatctgtggtccaactccaaaccgctacccatgtgaccgaggacagtcccctttctgctctggggctctgccttgtcatctgaaacatgaaaagcaggggatgatgtgttctaaactccccccatcccagaggcctgtgcctccatgagggccagccgagaaagcaggttaccaaggaagaaggcattttcttcactttatgtcactcacccaaaagaccagagagggaggtggtgtcagccgcttgggagacaccacaggtttctcccctgatccatgaaccttgatccacagcccaaatggccgcacgcagaccctggggccccagaggaagggaatgaaaggagccccccagcttcccacgggtaccttctgtctgacgtctatgctcagtgactgtcctgagccctggctttcatgctcttggttcagcatggaggacacagccttggccagctggaggagctgctcggggccaccctcgccttgcagagctgtggggattttctctgacacggcagcctggaatgctacatcctcaacacatgtgtctccgagtgccacctgttaggaaatcagaaatatgctcagaacctgctaggaagaagctggcctctgaagtcaggggtcttcatgtggggtcagagaggcttggatgcctttggcctggcctgtgggctctcgagcacttcctgaggctggagggcacccagacctgctcgcaccaggcagctgacagccacccaaaccaagccttggttggctccagcctggcgcaagtcattgctctaccactggccgccctcctctcttggtctcaacctcttccacccccacctggcctctgacgcttgaaatcttcttggaatcttatccaggctcttccttgagtccttgttggctaatcttggtcctacttcttctgagctctctgaaggtgctggcctaactcatgccagagtcattctccaacccccctcacccacccaccagctcccaggaccctccccctattctggccactaaatcataacatctacaaaggtagagaccatgtctgttgtgtccctggctatacccccaggacgtggcccagggtagatgctctgtaaatatttgtggaaggaatggatgaatcactgacttatctggctatgcccctggctatcttccatccggccatccttttagtgaggttcatatgggtggagaatttttctcagtaaagaaacagtgaccactgccaccacctaccttagccatggcctgggtctgctgcgtgtcccctgcacgattggtggcagaaataactactgtcagcacaaagtcattgttctcctctccaagtggcagatacactgatgggagggcaggttcagggccacagtgtaggcaggaacctggcaaaaccagaaattgaccgatgagggggcatcgctaagccccaggtagactgcaacccactcaggtagaggctggtgacagggacacaaaagccacagctcttgaaggcatggtaggctctcgggattccacactttcaagtatgagacagtcacgtatgctgattcactgtcttctctaagcaactgcaggttgctgtaactttggaaaaattttactaaaatccataaaaaattgcaggaaaaacatcccatttacagttttttttttaaaaaaagtcaaggtggtaaaccaaattataagaggaagaaaaagaaggaggaggaggaggaggagcaacaatgacaacttaaaacttagctcaggggcgaggagttcaagaccagcctgggcaaattaggaagacgttgtttctacaaaaaaaagtaaaaattaggtctcgaactcctgacctcaggtgatccacccaccttagcctcccaaagttcctgggatgactgacatgagccaccacgcccagcctgggactcgtttttatgtagccacactttcctgcctccgtgctcacttggatgatgggggagaggtactaaagaggaatagcctattggaattagggcagctgtcctggcctttccctctggcgggacgcagtttgaaataacatccacttaccttgcttgaactttttcctttcagactcagccccattcacagccctcttaacggtgatgcatttccacatctattagacagggcgctcgtgaaaactacactctcttaggtattacaatagctgacgtgcactttccctaatcaaggtgtagtgtttatgccgttgtgatgtttgatgctggatttgggggaccatcctggcaacactactggtggctgactttggtggaaatttacaatctgattagagcattttcagagcacagaatgacaaagctctcccgggcgtgtggcttacatctgtaatcccagcactttgggaggccgaggcaggcagatcacctgaggtcaggagtttgagactagccgggctaacatagtgaaaccccatctctactaaaaatacaaaaattagccgggtgtggtggcgggcacctgtaatctcagctactcgggaagctgaggcaagagaatcgcttgaacccgggaggctgaggttgcagtgggccgagatcgtgccaccacactccagccttggcaacaaggcaaaactctgtctcaaaaaaaaaaaaaaaaaaagaagaagccaaagcccagtgggtggagatcagggctcagatgagccctccaaggaccaatcactctccaaatggaagaataaatgcaatgtgagtggctccctcatctctcctgctaatgccctgtggctgtcctggggtgtgagtggttagggtgaaagcagggagactgtgtagggttttatgcattgtggatggggtcttccatgtttgtcacctgtacacctttgcaaaaatgttctttcagttcagctagtcctgcaattatcacccattccctggggctgcttgcaaagcagcgtcaatgaaattgttgaagattctgttaaccagacccatctctgtcttcctgaatagctccaggcttctgggagtcccagctactacaagtgtgtgtgtgtgtgtgtgtgtgtgtgtgtgtgtgtgtgtgtgtgtgtgtgtgtgtgtgtgtgtgtggtgagcaggggttgggggatggtgtcttggtggtggccccacatggtcatacttttgggtatcctcgttcatttcactccatcactgtcccccacgccagggcaatggattttggcttccagttgtggaagagctattgatgagaccttcttctcatgtctctgtggactgatggctgagtcagtgtcttgaggctaggggttgaggtttaggggagccctcatcctaccaacctctctcgcacacggaacatattctttgcagctcccagagagaacaggcccctgttctgcaagaagatgagcccaggagctgagggaagagcagagtcttcagccggtacctgattccagacagaagcagaactccaggggtcccagggctgtggaggcgttgcagaagatggcaaagctcgtcagaacggtgccctcctctggggcaatagtgcaggcaggcacctcacggggaggcacagtgctgatcacataggtgtcctccccataggcatgcctggtcagtgctgggagtaaagagagatcatgttcagggggccacgtggggcccacaaactccatcctgctgttagattgccccctgagctcattaaacacaaagattcttgggctctacttcaaacccagaacttcagacatctctggatctgggaagagcccagaaatgtacatatctaacaattaaacaatgaaaccccaaaacaactccccctgatgcaagggatcccagggcctcactttgagaaactgggcagagataggggaagataattagacagacctgagcttgaattttagttctgccatttgttaaccgagtgacctcagacttgaccttttcttttccaattttgttttcctaattttttttctttttagagatagggtcttgcactgtcacctaggctagagtccagtggtgcaatcataacttactatagccttgaactcctacacttaagtgattccactgccttggcctctcgagtcagctagaaccacaggagtacaccattacggctggctaattttctaatttttgtagagacagggtctcgctctgttgccagggctggtcttgaactcctggcctcaagggatcctcccgcctcagcctcccaaagtgctgggattacaggcataagccactggacccgggctgagaacttgacctttttgagagtcagttcctcatctgtagaatgaggctgatgataatagcttccgcacaaagatcttgtgaggtgggagtatgctgggaaaatgctcaagatcacagagccaggaaagaccagaaccaggatccggaaacaggctgagcccaccccgaagcccacactcttcccaggcgccgagatcactgttaagagccacgagtggacctgcagtcacatcccacatcacctggagtagccacctacattttcagagagcgcatgcctggaagagctgggcataaagagaatttgaacccataaaaactcattccttggcctagacccaattcggaaagtttggggtggacccaagagtgtgcatgtttaactaattccttgtttatcctgatgtgcatggtctgtgggccacttcgggaaaaatggaagcaaagcaatccttcctaaaaagaatcatcacctccattgtttgtgtgtttgagaatctatgtttctcacacagggcttgttttaaacgagaagccctgaacaatcctggcagggtgtacaggttgcacgaccccagaatgacctgcttgtaacactggggttatctcattcatcctgcaaaataaccattctgaggcaggcatttcgattatcccagtttatatgtcaggaaactgaggcatagagaggcgaaatcctctgcctagagtctcccacgtagaaagcggaagtggtgcgatttacaccagagcctgcgctgtggcctctgcactaagctgatgccctggctgggtatggtgactcacagctgccatcccagcacttcaggaggctgggacaggaggatcgtttggctccaggagttcaggaccagactgggcaacatagtgagatcacatctctctatttcaatatttaaaagaaaaataaactgacacccaatatctgagtgtttctgggtttatctgggttccctgagaggagataaaagggaggtttcgcacctgtggctctgattcggatgacctctccccgggactgcagaaacgagctgttcaacagcaacgtggaggtgttgctctggaggagggttaaggaccttggccaaaatcctctgagtctgcaggcatccaggaggggctcagcctgaaagacaggatggcccagggctgctgacgctacagccaggccacaggactgcagcaggacagtggcttctgggtgctagacagcctttcagatttattactgatgaacggaggacaggcagccccagctccccaagaagtcacctggaatatacactttccagcctcactgcggtgtctgtcttagattgggctccccggaagcagagcctgagatggggatttgtgtgcaggttatttatttgtttatttttgagccaggcacagtggctcacacctctaatcccagcactttgggaggctgaggtgggtggatcatctgagctcaggagttcaagaccagcctggccaacatggggaaactctgtctctactaaaaatacgaaaatcagccgggcatggtgttatgtgcctgtaatcctggctacttgggaggctgaggcaggagaattgcttgaacccaggaggcagaggttgcagtgagctgagattgtgtcattgtactccagcctgggtgacagagtgagactctgtctcaaaaaaaaaaaaaaattaaaaagaaaatatttttgagacggagtctcactctgctgcccaggctagagtgcagtgtatgatctctgtgcactgcaacctctgcctcccaggttcaagtcattctcctgcctcggcctcccaagtagatagaattataggcacgcatcaccataccccgctaatgttttcgtatttttagtagagacggggtttcaccatgttggccaggctggtctcaaacccctgacctcaggtgatctgcctgcctcggcctcccaaagtgttgggattaaaggcttgagccaccatatccagccttgtgtgcaggttattgatggaaggaggattcacagggaaaagcagtgcagagagggaaacagcagagaacaaaacaaggcaaaaaacagttactggaggcatccagcctctgcctggtcacacggagagccctgaagtgtaagttgcacaactgaaatcaccctacctggggacagagaagctgggctattagaccctccacccatcagtcgttggccaatggtcaggccacaaaagctggagttaggatcgtccgcctgggaagcaggacttttgctgagatgccaagagcacccgctgcaaagtttctccagagcttatgctcctttgtgcccatttgccctgctgtcaattccctgattttctccccagcccaataccctgagtcccacaccacaggctctgaatggaattgacccaaccctggcccagtaccgggcatgcgacacgggtgtgctgaaagcgcaagggagatttccattcttgagtggttgtcactgtgctcacctgctctgttggggtgttgtccaaataccagctgaacatagccactggagagtcctcccccatggtgaccctgagcagaatgtctttgctggcattaactggcctgcagttcctctcacagctgaaaggcagacagaggacagagtgaggaagctccccgaggcattgctatcatctggatgtttgtcccctgaaacctcatgttgaaatatgatccccaatgttggaggcggggcttcatgggaggtgtttgggtcatggggttggattcctcatgactggatgaatgcctccctcgggagcgagttcttgctctattagtcaccaccggagctggttgctaaaaagatggccgggagcagtggctcacgtctgtaatcccagcactttgagaggcccaggcgggcagatcatgtgaggttaggagtttgagaccagcctggccaacatggtgaaaccctgtctctactaaaaatacaaaaattagtgggatgtggtggtgggtgcctgtagtcccagctactcgggagtctgaggcaggagaatcatttgaaccagggagatggaggttgcagtgagccaagatcacaccactgcactccaacctgggtgacagagtaacactccatctccaaaaaaaaaaaaaaaaaaaaagagcctggcacctcccacccttctctgcacacaccaggtccccttcatctttcactgtaagtggaagcagcctgaggcccttatcagatacagatgtccagtcttggattttccaaccataagaatcatgagccaaataaatctcttttcttctttcttttctttttcttttctttttttttttttttttgagacagagtctcgctctgtcgcccaggctgcagtgcagtggcgcgatcttggctcactgcaacctctgcctcccagattcaagcaattctcctgcctcagcctcctgaatagctgagattacagacaggcaccaccatacccaactaatttgtattttcagtagagacagcgttttgctgtgttggcctggctggtcttgaactcttggcttcaagtgatccacccgcctcaacctcccaaagtgctgggattacaggcatgagccactgcgcccagccaaccatttttctgtataaattacctagcctcagatattcctttataacaatgcaaaatgggccgggcgcggtggctcacacctgtaatcccagcactttgggaggccgaggctggtggatcacgaggtcaggagatcgagaccatcctggctaacacggtgaaaccccgtctctactaaaaatacaaaaaattagccaggcgtggtggcaggcgcctgtagtcccagctactcgggaggctgaggcaggagaatggcgtgaacccgggaggcggagcttgcagtgagccgagatagcgccactgcactccggcctgggtgaaagagcaagactccgtctcaaaaaaaaaaaaaaaaaaaaaaaaaatgcaaaacggactcagacaggcattgtgaccactggcctggtcttttgtccagtccttctcaagtcctttgagagggtaggaaatggccctttttcaaattaaagatggaataaaagccgcccctgccccaaccaacactgggacgtagccttggttgtgaagatggactgagtcatggcctgactgaattcccatgtcattcactgacagcgtaatgatacggaaggtgaatgaggctgagacaggacctgggttctaatcctgtccttgtcacttatgaagggtcaccttgtgtgcatcacttaaactttttttttttttttttttttttttgagactgagtctcactctatcgcccaggctagagtgcagtggcacgatctcggctcactacaacctccacctcctggttcaagagattctcctgcctcagcctcccgagtagctgggattataggcgctcaccaccatgcccggctaacgtttgtatttttttagtagagacagggtttcactgtgttggccaggctggtcttaaactcctgacctcaggtgatccgcccgcctcggcctcccaaagtgctgggattacaggtatgagccaccatgcccagccgaatcacttaaactctctaagcctcagtttcctcacctgcaaaatgaggggatagcctagataatttctgtgattctttttagttcagataatagtaaactaatgctgtggttcaacagcacgcctgccatgcacacattacttccattgtctctagcttgtccaatgctcacaatagccctatgagtgacatattagcatccccacatcacaggtgagctaaccaggccccgagagcttatgtgatttgtcctaagtgatgtaacttctaagtgggcagatagaatgtgaaccatcgtgtctggatccaaactcttggccttctctataatgtctctgtgaaggccaaagcaactccatttcagatgctaatctgccacgttgactactgattaaccccaattccaggaatgcctctaagatttctattctctctacagttctttgtgtaagagcatgtacttactatgagtgctgccctgaaagagattcacatagtattcttacctttccctacgactgtcctacacattcctttcctatggtatataagccctggttctggcgggtaatggcgctggctttcaccatcttgtcttgcagctgccctagacatcatggtttctgttcgcaagtctcaattaaatgtttctttctaagaaactaaatttgtcagcttctttctctggcctctctgcttcctcgaactttgcgggaaggtttgcatagacctgccctccacaggacggtcccccagtttcccctttggtctgaacttgatgacagctcttgaacttcctacttatctcctcatgtctgccctagtccaagtgtgcaggacattctctatctgcctctccaatccagtctcctcccacgtgcggctctgacctgggagactgagctctatacactgcatcacccaagctgccacaccctccagcttctaactgggtccagccaatgggaaccattgatagaggattggagggtgagaggagagagtttggggaatttattcacggctttccctgctcttttccctgatgggctgcaggtgagagatgctgtgcttctccaaccaaggccacagctccctacgtatgtagtcctgcctaatcttacctctgcattcctgggggtgataatggcttcccttggttgtagtcctgccttgtcgcccctgcttcattgccttatacctgccctcacctgtaaatagtcccttcatcagctctcttccattcattcctggtttggctgagccatcagcttcctgcagggactggctgatagtccaagcaaacttgacctcctaccttgactcctgcaagagcctgggcaatctccctgggtcttctcttgccctcttccaagtcattctccactgagccaccagagcatattgaagtcacatgcttagaactcttggttgcttggcttggcatggtggctcattcctgtaatcccagcaatttgggaggccgaggcaggtgggtcacctgaggtgaggagtttgagactagcctatccaacatggtgaaaccctgcctctacaaaaaatacaaaaattagctgcgcacggtggcatgtgtgcctgtaatcccagatactcaggagtctgaggcacgagaaatgtttgaacctgggaggcggaggctgcagtgagctgcgatggtgccactgcactccagcctgggtgacagagtgagactccatttcaaaaaaataaaaataaaaataaagaactcttgggtggtttctctgtatcactcttaggaaaaaggctaaaatcttgatatgaccggcaaggccccacttgagccaggccctgcctacactaccagctccttcccacccttctcttctccatcctcaggacattggcctctttcgctccctgatgattctctgctccctccctttgcccgctctgttcctgctccagctgccccttccctgccctgtgaatttctcctgaacacctctgctgagctgcagttcctgagagaagtctctctaaccccagtcagggcagttttcatagaggtgcgctctctgccttcttcattcgtgtccagaagtgctgatcaccaggtggtagtaacccctatgacaacagagaccaccacagcaagccttgccccaaggcagccccagcctcagtgggtcctcagtaagtgttggctgaacgaatgaatcaggaccctggaggaactgcccacgtgccccacctgactcgaggcctgagttcccagggcgcagacacgtagaggcactgctctgccctgttctccagctcttggcctctcagaacagccaggcgcagggtgacagcagagtcaggcggcggcaggcaggatgctggaaccaccagctccctctggtctgtgcgaagcagctgcctctcaacacagctgctccacagagcccagcaagaccctgagagaaatggacagacactatgatccatcaggagccctgaacgtggcacacactgctagcttctggttttgaaaggggtcatgaataataacatcagctctaaatagacattttaattttttaatgtcagttttattatttatttattttgagatggagtttcccccttattgccaaggccggagtgcaatggcaccatcttgcctcactgcaacctccgcctcctgggttcaaatgattctcctgtctcagcctccagagtagctaggattacaggcatgcaccaccacacctggctaatttttgtatttttactggagttggggtttcaacacgttggccaggctggtctcgaacttccaacctcaggtgacccacccacctcggccttccaaaatgctgggattacaggcctgagccaccacacccggccaaaacgtcacttttaatgcaggttgcagaaatggtgctatggaaggatgcttttgggaaaaagaaccatgcttcacccaaactctgagcaaatctgcaggatgtggttggcttgtgttgcactggtgctcaggaaggtgtgtagcaggagaggggccaggaggatctgtggccctgggagaaggtccagggcagcttcttatcccggtatatttgtcattccatgtggatgaggctgtccacagcgccaagtccctgtgggctactacggcggcctgggaggttgtactgccatctgggaggctgctgtgtcacctcctgctttatgttagcagcttcctaagtttctgtatcctctgcccttcaactctattgacagatgtttactcatcaatacctcacctcccaccatctccaatatggtgacaggcatatagcagcagagaggccaggaagatctaaatccccaggagaatattcccaagattcctgggactattccaagaattccaagattccctagatctacagccctgggagaacagtcccaagatatgttccctgagcatatttccaaaatatgttcagggttcaggctcatcagctcggtcgcctaaactctggacttgcatactctgtattcagataaggagaatgaatattcagagggatgtcattaccacgtaacaattaacatcaaaagccttaaaatgttgcatgacttttgacccagttattccatttctacaaatttatttatgaaagtaaccacagttgtaaatagagattgaactgtataagagcaaacaatgtgaaacaatctaaatgtccaaaaagagggtaaagaaatgatcgcacatcagccgggcactgcggctcacgcctgtaatcccagcactttgggaggccgaggcaggtggatcacctgaggtcaggagttcgagaccagcctggccaacatagtgaaacctcatctctactaaaagtacaacaattagttgggcatggtggcacgtgtctacaattccagctactcgggacctgaggcaggagaatcgcttgaacctgggaggtggaggttgcagtgagccgagattgcgccactgcactccaacctgggtgacagagcgagactccatctcaaaaaagaaaaaaaaatcacacatcaacattatggtctattgtgcagctattaagaaaatcaatatagagacgataccacgacattataatatgcaaatatgcaggttacattgttcaatgagaaaagggtaaagaaaacagtatgaataacatttctttctttctttctttctttttttttttgagacggagtcttactctgtcgcccaggctggagtgtagtggcacaatctcagctcactgcaacctctacctccaacattcaagcgattctcctgcctcagccttttgagtagctgggattacaggcacccaccaccatacctggctaatttttatatttttagtagagacggggtttcaccacattggccaggctggtctcgaactcccgtcctcaagtgatccccccacctcaacctcccaaagtgctgggattacaggcatgagccaccgtgcctggcccatttattttatgtctaaaagctaaaagaatgtgtatgtagctaggctatattcctgtaaaaaggaggataccatttctacaatgtgagcgctagtgctgccatcttggtttgttggaaaatgcctgactcacttcccccttctagattctctccctagggatataccaaagggctggggaaaggggaggagtccacaccagagaagaggagcactttatcacttttgtttggaattgtcagcgtatggaccagcttttcaggtttcattattgttttaaaattctctagatccccttgctgcctgcattcagggccacccttggtctgtcactgctttctcccaccttctattttttttttttttttttttgagacgcagtcttgctctgttgcccaggccagagtgcaatggcacaatctcagctcactgcaacctccacctcccaggtgcaaacaattctcctgcctcagcttcctgagtagctggaattacaggtgtgcgccaccacgcctggctaatttttgtatttttagtagagacggggttttgccaagttgaccaggctggtctcaaactcctgacctccagtgatccacctgcctcggtctcccaaagtgctgggattacaggtgtgagccaccacgcccggccccacctcctatttccatggaatttgcaagctctggcatgtacaagttatacaaaatgtaggccatagggaaagctggtgcgaagattaagaaaaagaacagcaaaatctgaccactgctcaccacttcttagtgaaacaggacaattcaagaactctatcattggccaggcgcggtggctcacacctgtaatccgagcactttgagaggccaaggcgggtatatcgcttgaggtcaggagttcgagactaacctggccaacatagtgaaaccctgtctctactaaaaatacaaaaattagctgggcgtggtggcaggcacctgtaatcccagctacttgggaggctgaggcaggagaatggcttgaacccaggaagtggaggttgcagtgagccaagatcacaccgttgcacaccagcctgggcaacaagagtgaaactccatctcaaaaaaaaaaaaaaaaaaagaactctattgtcacctaccacatgaccattggaagcgtaactccttgtcattgtctggccagcccagggtcactgtcgtgaaaggatccacatatggaccaggttggatgtacacctccatatcgcctttatctttctgcaaaaaaaagcagccagctggtgagactccaactacagttagctcaggctcactgtggggtgctgttggcattcccctttcaccccagagcagtctgcaccaagagcagctgcagtgtaaggcgtggggtggagacagaccctggccaatccccctggcttccttcccctcatggggcgtggagttggttgctcaggatccctgggcaagtcacgttattctgagtgttggctcggggtacacggggtgttcctggagtaagttctggtgggacttgttaaacagcttgggctgtggagcttcttgctcaagccccgaagtcctgacctgaaataacacagggctccagtggaactcaagccccagtggcctcccgtggcctgagaataaaatccaaatttcttgccttggcaactaaggctccgcgtgatctggcctctgtccacgtgtccataatctcctacatccctccctccaacaggctccagccacgctggcttcaggccatcgcctgcctctcagatctgcccactcagaaagctcttgttctgctttcaggcatggctggctggcttatcttcatgtgtccgcttacatgtcacctctggagaggccatgtctgaccacatcagccagaccaccctgttcgttgctatcgttgcactctattggttcttattagatacttaccacaattcctaattctatgataatttgtttgttggagttttttttttgagacagagtcttactctgttacccaggctggagtgcagtggcacggccatggctcactgcgcctcaacctctcaggcccaaactatcctcccacttcagcctcccaagtagctgggaccataggcatgtaccttaatgcctggctaatttttaattttgtttttttttttttgagatgagggtctcactttcttgcttgaactcctgggctcaagtgatcctcccaccttggcctcccaaagtgctgggattacaggcgtgagccactgtaccgggccgatatgttcgttagtatcactcagtaagcttcctgaaggcggagaccatatgtgcttattcactattgcattcccagcccctgataccaagccttgaatgttgtagatgcacagtaagtctttgttgtagaataagtgcacgcacgaacaacgtcaacagcaaggagctgaactcagtcttgttataaaaactgaagagcttggtctgttttcttttcttcctgctttctaatataagcattaaaagcgataaatttctctctgagcactgctttagctgcattccacaaatgtgcataggttgtattgtcattatcatgtagttagaaattttttctaatttcccttgtgatttcttcttgacctattgatttttttacaagtgtgctgtttaattgccaagatatctaacagatatctacatatcctagatagctcattatagatttacaacataactctgttgtgattagacaacttgctttgtttgaattcagtcattttgggcctcttctcaaatggaagaagcctcagggattcctagtgctctgggtattggtaccaaaaaaccaaaactcaaaactaaaacagagtgcttggacatcttttccttgtgaggttaaacgttttttaaagacaatactcacactctttccttcagcattcatcccagatggttcttggagaccggaaggggctgtgaacacagtgggaacgggtatcaagctttggttggaaaccttataaaaggctgtcaaaatatagagtcagagagtcatgtggaaaatgccaccaggggcgtcagcctgtctttgaaaatggtttaagggaacatagcaaacattcaggtcctagggaaatggattaaaagtgagtcatcttgtccaccactggactaaagacacccctttggtagttgagaaagaggcagctgccagtgcagataaaacacaagatttagagtcagacagatgcagctatgcactgctaatgtgtgtttttgttttgttttgtttgttgtttttgttttttgagacacagtcttgctctgtctctcaggctggagtgcagtggggcaatcttggctcaatgcaacctctgtctcctggttcaagtgcttctcctgcctcagcctcctgagtagccgggattacaggcacccaccaccacacccagataatttttttttttttttttttttgagacggagtctcgctctgtcgcccaggcgggactgcggactgcagtggcgcaatctcggctcactgcaagctccgcctcccgggttcacgccattctcctgcctcagcctcccgagtagctgggactacaggcgcccgccaccgcgcccggctaattttttttttgtatttttagtagagacggggtttcaccttgttagccaggatggtctcgatctcctgacctcatgatccacccgcctcggcctcccaaagtgctgggattacaggcgtgagccaccgcgcccggccaacccagataattttttgtatttttagtagagacggcgtttcaccatgttggccaggctggtcttaaactcttgacctcaggtgatccgcccatctcaacctcccaaagtgtagggattagaggcatgagccactgcacccagcctgcactgctaatgtttaactaccagtaaaggaggtgggagtgagaagccctgatttgtagggtttgtcaatttccatggtataaatgttcccaccaatctataagcctgatgctactgaatatagagtgaggagagatgggcacgctcacctctggcaagtgggtggagtcggcaccacacactaccctgttgtcagatcctcttactggcctcccattggctatgtgaaccgggcaggtgagttatcctctctgagtcttggtttcctcatttgtaaaaatacctggagtccatccccatttctcagggctccaggaagactgaatgtggtgctgtttatagaattgctttgtaaactatacatctagaaagaatgtcatcctggctaacacagtgaaaccccatctctactaaaaatacaaaaaaattagctgggcttggtggcgggcgcctgtagtcccagctactcgggaggctgaggcaggaggatcgcttgaacctgggaggcggagcttgcagtgagccaagatggctccactgcactccagcctgggcatcagagcaagatcctgtctcaaaaaaaaaaaaaaaaaaagaaagaaagaaagaaacaaagaacgctagtttttcaagtttaaacaatggaaaaagatacaatcaattgatgtctctgaaaatatatatatttttgagatggagtctagctctgttgcccagcctgtagtgcagtggcgtgatctcggttcactgcaatctgcccctcccgggttcaagcaattctcctgcctcagcctgctaagtggctggggttataggtgtgcaccaccacacccagctaatttttgtatttttagtagagacagggtttcaccatgttggccaggctggtctcgaacctctgacctccagtgatccacccgcttcgacctcccaaagtgctgggatcacaggcgtgagccactgtgcctggcctactgaaaatattgaaatattaatgattaatatctaattaaagtgtagtgcttaaagtaggaacttagagttatttcatgtgattcactaaggccctggatatattaaggtctgagtaccactgatctttaaaaaattctctcccagtgaattctcattcacacaactataattccaaaggcatgtaaaactgtacaaatcaaggctaagatgccagagaaaggggactttcttaaccttaagaaggaaggcagtccaatcaccctgaatgaaaaaattaggagaaacatttgctgcctttgatcctgcatgaatcagccatgtgacttctgcaaagtcaattaaactttctgggtctcaaatcccacatctggctgtcgaatttccaggcatctatgatcccctcccttggtagcagcatctacgggtgatattttccctaagaaccatccctccccaactctcaggccttggtttgggtgaagctgaccctacattgtactccagcgtgggcgtgagaccctgacctgccaaactgactgctgcttcccctggtctcagcagctggtccaggagaaaccatgaactgagcttcagccagcaagaggcagcctcaggacttctactagaaatatccatcaagacgtactctttctcctctggggttaaagatcaaagcctggggtcatcttgctactgctgggaagagagaatccaaaagaagtcaacacagaaccagaggaggaaagaggcaggtttctgaagacactgtctgagcgactcatccagctgtgtttaagaacaggtctactccctgggcttttcattttcattttcttttttcttttttttttttggtcggggggtggggacaccatctcactttgtcacccaggctggagtgcagtggcatgatcttggctaaatgcaacctctgcctcccagattcaagcaattctcctggcctcagcctccccagtagctgggactacaggtgtgtgccaccacgcccagctaattattgtatttttagtagagacaggctttcgccatgttggccaggctggtctcaaactcctgacctcaagtgatccaccacctcggcctcccaaaatgctgggattgtaggcatgagccacggtgcccagctggcttttcattttctgagctgataaaatttccttttgacccaagccagtttcaccttcgtttctgtcccttgctacttgaattgtcctagcaaacacattcaagtgaaccctacctctgtgatggctactctcagctagttccccaacagccattaccccagccttcctcctggcagccagaatccaccttctcccacagaaactgaaaatgctgggtatctgcttttccagtgcactttatagcagcggacctgaccctactttggtcatggtatctgaggtgatgattgcttagagtgagtgggaaagatttttcccctaataaaaagaggtgcacaggaggaaacccctgctcccgctgctggtacgctgcgttgacatgtaatatccggaactgcagcagtcactttgattccttgagcaacaagcctaaggcagcaccaaagctctaaggatggcagacgagaaagatagactgagcctggtttctcgctggcatcactgagccaccgaaccaaccctggaagtgcttacctcctaacttcttatgtgagtcaagaaagccctgaatctgaagctacttaggttggaccttctgttacttgcagcttaaagcatcataatgaacgcaaactcttgttttagaattctgtgtcagtggttggccgggtgcggtggttcacgcctgtaatcccagcactttgggaggctgagacgggcggatcatgaggtcaggagatcgagaccatcctggctaacatggtgaaacccggtctctactaaaaatacaaaaaaattagctaggcgtagtagtgggcacctgtagtcccagcaactcaggaggctgaggcaggagaatggtgtaaacccaggaggcagagcttgcagtgagccgagatcatgccactgcactccagcctgggtgacagagtgagactccatctcaaaaaaaaaaaaaaaaaaaaaaaaaagaattctgtgtcagtggtgaaatgttttactgtaaacatcattgcctccttagaataactggagaattctaaccatctgtagaacaagatacatattcagagccgtgtttggaaaggcccctcactggagcccaagcaggtgcaatgctctggactcttggtaaaaggttttatgctcccttgcagaaacaccttgcctgtgatagtgatgttcccgatttccaaactcaggttggagaaggcattcctcaccagcatggtgaccagaaaggtgcctgcaatacaaaggacccagagtcacagccattgtcatgaacttgaccaagaaaactctcccagcttgcttctctagtccaccgatgcctccaacgaaatctttcacctctgagcatttaatgaatccctgctgtatgtcaggcatggtgcaaggctctggggacacagagatgaaggagcttggttcttgtcctcaagggccttatcatgtagtagacacataggacagtgaacgccaaaccacgggaggaatcggcatggggcacagtgggcattgggtgggcccgcttcaacctcaggagagaaagaaatggttcacaggatagagccagggctggagctaaattccaaaggagaagtaggttctcgatagataagactgcagattcccaagagggagacacatagcaggattgtcagaagcgtggagacagtggaaaaggatattttattttattttactttactttattttatttttgagacaggatcttactctgtcatccaaactagagtgcagtggcacgatctcagctcaccacaacctccacctcccaggctcaagcaattctcctgcttcagcctcccgagtacctgagattacaggctcatgtcaccacgccaggctaatttttgtatttttagtagagacagggtttcaccgtgttggccaggcttggagaaggatttgtaagatttatttagatacatgtgtgtcccatcccttctccctcatggggaaggggctatgggtaggggctaccttctgtgttctcaagcccagagagaaatgcttgagagaggagccttccttggaaagcccggtatgtgtctgtttggggtccgcatggacaggcttcatactcatgcccttgaaggaacagtctgtgacgggaagacgtgcgggtgggaaggggacgggaggaaggggctccatttctgcgtctgggaaataattgcatttggctgggagtcggccaagacatgggtcagaatgttctgtggaccagatgtgtgccttggggagacggatgctgacgaggggagggagaatgaggagagtccaacagagaggggaggtggccagggagaagcagccagggcgtgtgaccagctaaaggggaggcatcccccaccaccccaggaacaaaggcctataaggcccagctgggggccccaagaacccagagaagctcctacaagaaagaggcagcttgaaacatctgctagccctcaagagccaggccagctaggactcggccagcaccaccaagtgcaaatgtccctgccctgtcccgttccctttccatccttccactcccgccacccctggagtcatccaaatctgttggccttaggggcaggaacagtctgttaatcatctaatagtgagcaaaagtcacaaagcacatggatattttatcagagagggatcatcttcccctgtggagtgacctttatagcagcgactttcatggcaggagtaatttttataggtgacaaagcaaaacctgcatctggcttataacccacgcgtggtgtgattttccagctgcagcagcctctagactttccctcttccaagctggacccttggtatctggcaaagcccggatggttttcttctcaaacctattgtcccttctgctatctggtttgtggagttgcttgcagagggcatggtaaccccacacctgcacagtatcacccgttttctaacacacttctgagatccagggggagctacgggcaggtcctggatgggctggagactctgccattctcatcacatttctgcctgctgatctcatccgggccctcaagaactctctgttccttacagattaaatgcaaatgggcgctgtggccacctcccctggctggtgcctgccagtctgtcctcccgtcagcatcattgcaaatacttctgagatagaccagagatgggacttggacccctgccctgcctcatcgaggactctactacaagctggttggggagggtggcccatggcaggcacagaccccagtcagatcatccagacgttgcaccacaaatcttgctcaaggtgccatgcccactgagtgcagaccttgaggaaacgaaaacaaacagctcccaccttaaatcttactcaagggagttaaccctatagcccgcacacacagaagaccagaaaaatgaccatctttaccctttgcctcattataatactaaaaatcatgcccgagggtggagctttaacatgctaatgagacataccacacatcaagaagcatgtgaccagactgcacaggcgctgaacattccccacctccacatgcttaaacatcgcccttttcccatcctacctcctttcagaatgccgggagtggtggctcatgcttataaacccagcactttgggaggtcgaggtgggcagatcatatgaggtcaggagttcaagaccagcctggccaacatggttaaaccccgtttccactaaaaataaaatagtcaggcatggtggtacatgcctgtagtctcagtgactcaggaggctgaggcaggagaatctcttgaaccagggaggtgaaggttgcagtgagctgagatcacgccactgcactccagcctgggtgacagagtgggactccatctcaaaaaaaaaaaaaaaaagacaggccgggcacgagggctcacgcctgtaatgccagcacttcgggaggccaaggtgggtggatcacctgaggttgggagttcaagagcagcctggccaacatggtgaaacccctctctactaaaaataccaaaaaaattctccgtgcgtggtggcgcatgtctgtaatcccagctgcttgggaggctgaggcacgagaattgcttgaacccaggaggcaaaggttgcagtgagtcaagatcacgccactgactgcactccagcctggaagacagagcaagactccatctctaaaaaaaaaaaaaaaaaaaaaagaacgccttctggactttttggggagtcagcccctgaacctccactccagtgctgccttctttatgtttgaacataagcctctaacaaaagcctcgtccaggaaagtttgagtacatcagagcctaagaccccatggtcggcaacacttcctctctccatccccatctctgccattcttggtttttacctctttcccgctagggcatcacctgcagttccccaaaccacactcttctctagagatgtttgaagaaatctgaatatgcctggtctcttacaggggccctaaatgggggtgattttgccccccaggggacatttggcaatgtctgacatttttgtcatcatgacttggggtgctggtgttactagcatctggtgaataaaagccagagatgctgctaaaactccttcagtaccagcccccaactgtaacgaggaatgatccagctccgaatgtcagaagtgccgaagtggagagctgataactcaacgatggcagattacatctggctgttccttatcttatgacccaggcaggatgctgtgaaccaaatctatgtcccggacacactggaaaactggccggcaggaccctgggcaccaagtcacaaagggaagaggaggggcatcagaaggggagccactaaccccatgtaccttcaaccggaacagccaggcggcaaatcccaaatggctctccaaagctcacttgctcgtgggagaaggttgcattgagtccagccacctcaaaggtcagctcttccggggtgccctgagccaatgagatggtgatcaataggtcctgtccaagctccaaatggtcagaagcccaggaggcctgcagccctgacagcagctccaccaagtggactgtaatgtttctggagattgtagaggtggtggtgttgccggtggcttggatctccaggcggtgcctcccagggcccatcagtttctgggtttctctgtccaggatcagattgtacggtagcgagcccttttgggtggtggactcggccagggttatgtcacccaaaagcacagtgtaagtcactcctgttcctaagtggggtaagaaaaattaaagaatgttggtaacaaccatgcggttgataatactatggcagctcagagtcagtctctgaagcctgattctggatacaaacttggatacagatgcagacataaagaaatatgtaaggatatgcccccttctcaaatattaatggtggttatccctgagtattaggttaatgactgatttcgtctttcttttgagacagggtctggcgctgtcgcccaggctggagtgcagtggtgcgatctcagctcactgcaacctctgcctccccggttcaagtgattctcctgcctcggcctctggagtagctgggattacaggcgcctgctaccacacccagctaattttttgtatttttagtagagacagggtttcaccgtgttagccaggatggtcttgaactcctgaccttggatttgcccgcctcagcctcccaaagtgctggggtgacaggcgtaagccaccgctcccggccgtgattttgtcatctgggggtccgctctgttcatttgcatattctaacttatttatactatacatgtcttacccgagaacctaaatatttgtaattaaaaaattaccacatttagttgccagggatgtcctggtcgggggaggaggaggaggactaaaagggagcatttcttaagggtgggggctgatttttatgcatgagaattagctttgggtcttgttttaagcaggagcaagtaaagccattccttcatcctacactggtgaccgcccagaaccctgcaaaccaacatgagaactcagcccgttcacgggaagatgggggctcccttgcaggttgcagatggttgttcttactggatgataaatattgcggttgactcttaaaatctgacttaaatcaacaaattaggattccttccaataaaaaccaagctagcgtagttctcatctgggtgatgatgatgataactacgatataagccccatgagaatgggaaccctgactttcatatttactgctgcctcgcccacacccggcagagtagtaggcactcaattatattagtaggatgagtaaataaatgaaggattattttgtttcctcaggggaacatatgagccctcttcatccaacaaacatgcaagaacagaaggggtttcctgagggctgtgttaaagccccattatgacttccacagctattgctatgagagggctccaggtgggatgtgaggtcaaaccgagccacctgctcattgcactagctctctgctgccctgtttacatcaacaggcctctattctaatctcaaactggtcctgggcttcaggaaaaacgctgccctgggtgaggatgagtcttagccaggagagtctctattgagagaaaggatgataatttaaaatatttaacaaccagcacagcatgggcgccaaccaattagaatggatgctctgataaatcagaatagacactgcgaccaacaaatagatgccatgaccaatcagaatagatgctgtgaccaatcagaatggacaccctgacccatcaaaatagacatgacaaccaatcagagcagtctctgtgaccgattagaaaacacaggctgggcgcggtggctcatgcctgtaatcccagcactttgggagtccgaggcgggtggatcatgaggtcaggagttcaagaccagcctggccaatatggtgaaaccctgtctctactaaaaatacaaaaattagctgggtgtggtggtgggcgcctgtaatcccagctacttgggaggctgaggcaggagaatcgcttgaatccaggaggcggaggttgcactgagctaagatcatgccattgcactccatcctgggacacagcgagactccatctcaaaaaaaaaaaaaaaaaaaaaggaaaacacactgtgggcaggcacagtggctcatgcctgtaatcccaacattttgggaggccgaggtgggcaggttacctgatgtcaggagttcaagaccagcctggccaacatggcgaaatcccatccctactaaaatagaaaaaaataaaaaattaacctggcatggtggcacgcacctgtagtcccagctacccaggaggctgaagcacgagaatcactggaacccgggtggtggaagttgcagtgagctgagatcgcaccactgcactccagcctggatgacagagcaagactctgtctcaaaaaaaaagaaaagacactgtgaccgatcagaatggacatgacaatcaatcagagcagtctctgtgaccaatcagaaaacaccctgtgaccaatgagaatggacctcagccataacagttggcatggctataccagtgggtgcagctgaatactggccttggccaggggcaacttgattgtgccaagctagtcgatgctggctgtactgagatgggctcaggcccagttggtagcagtcccagtgccacctcatcctagttaaattcccaaaaggaagtgactcggaagttcggttctacagggatgcaaagaagggcctttggaaggctaggagcactcactaccttactagccttctgactctgggcaaatgttttaacctttctgtgtcttcatttcttcatctgtaacatgaagataatactactatgtaatgagtagacaagtttatgcaaagcacttagaacagtgcctggcacacactaggtgctaaataaatgaataaatgatagtttaaaaatgaactcggtcaggtgtggtggctcacacctataatcccagcaccttgggaggccaagctaggtggatcatctgaggtcaggagtttgagaccagcctgaccaacatggtgaaaccctgtctctactaaatacaaaaaattagccaggtgtggtggtgcatgcttgtaatcccagctacttgggaggctgaggcaggggaatcacttgaacccaggcggtataggttgcagtgagctgagattgtgccgttgcactccacctgggcaaccagagcaaaactccatctcaaaaaaaaagaactcagtaggtgatccttgttactatttatttacttttttttgaaacagggtctcactctgttgtcctggctggcatgcagtagcatgatctcagctcactacagcctcgacctcccgggttcaagccatactcccacctcagccacccaagtagctgcaactacaggcatgtgcaaccatacctgactaatttttgtactttttgtacaaatggggtctcaccctgttgcccaggcttgtcccgaacttctgggctcaagcgatgcgcccgcctcagcctcccaaagtgttggaattgcaggctcaagccactgcacccagcccactatttattaaggtctgggagttggatagatttggaggaaatcagtgattttatagcttgccttgatgtgcccaattctgcagactcacctccatcaagctccacctgaatccacagaggatccccaaagacagcctggcagagagggccggctcctgactgggacaggccggagcatgcagtcacactgagcgtctccatcttgtctcgcacggtcacctgcctctgagctgtcacatgccactcactggttgtgcattcagcaaacacggtgaattccccaggagatgtgaactggtgggtcacattgctggacacattgccggccacagtcagggacatgaccagtgttggggaaacacaaagacacgcatttacacatgcactgacagggtttggatctgcgctcctgcccaaatctcatgttgaattataatccccaatgttggaggtggggcctggtggaaggtgattggctcataggggcgttttctcgcgagtggcttggcaccatcgccctgatgctgttctcttggtagtgagtgggttttcacaagatctggttgtttaaaagtgtatggctggccagccttggtggcttatgcctgtaatcccagcacttcgggaggccgaggcgggcagatcgcttgaggtcaggagacagagaccagcctggccaacgtggcgaaaccccatctctactaaaaacacaaaagttagctgggcgtggtggtgcacacctgtaatcccaggtactagggaggctgaggcaggaggatcgcttgaacccagaaggcggaggttgcagtgagctgagatcgcaccactgcattacaggctgggcgacagagtaagagcctgtctcaaaaaaaaaaaaaaaaaaaaaaaaaaaaaaaaaaatccagcgagtactagtaacactagcaataatagtaacaacttagactatgtcgttcctggcctgaaaaccctcctattatcctctgtagtgggtgctacagggaatcccccagattccacccttcaagcctgagcatgcattcccccagtacacctgtgagctgtggctgagggcttacagctgaatccatgtccaggagtcccttttagccaaagggagctgcctcgctcaaacctacctcccctcccatggacatctgcaccccacgagtgctcagtgccggggtataatggtctggctctctggcctcaactggaagcaactctgagggccatctctgctcagaggtttctgcaggatcgtcagggtctctgtggcccctgcatcccagttcaactctcctcttgccccatcttactactcccttcccatgctccacaacagagtctgtttcctggttcctgtgagacaaagtagcaaactcaaggagataggtgtgctcatttctgttagccagcataatcacaggaagcccctgactgcagtgacaggcagccctccagaacactttgaagacaaaacagaatagagtgctcggcttccacgtctctagcctgagtcactatatccctaaaaagataaatgactggtccttttcttacatataagataatgtctcgctgggtgcagtggctcacgcctgtaatcccagcactttgggaggccgaggtgggcggatcacgaggtcaggagattgagaccatcctggctaacacggtgaaaccccgtctctacaaaaatacaaaaaaaaaaaatttagccaggcgtggtggcgggcgcctgtagtcccaactacttgggaggctgaggcaggagaatggcgtgaacccgggaggaggagcttgcagtgggccgagatcgcgccactgcactccagcctgggtgacagagcaagactccgtcttaaagaaaaaaaaaaaaagataacatctgagatggctggtgattatgcttctgcaatctacaacaagattttttttttttttttttgagacagagtctttctctgttgctcaggctggagagcagtagcaggatctccgctcactgaaaccttcgcctgccaggttcaagcgattctcctccatcagcctcctgtgtagctgggaatacaggcatgcaccaccacgtccagctaatttttttttttttttttttttttttagtagagatggagtttcaccatgttgaccgggctggtcttgagctcctgaccccaagcgatctgcccaccttggcctcccaaagtgctgggattacaggcatgagccaccgaagccggccaacaagatatactttagtcatctagaggcagatgcactcttgcacccaaactttgatgtgattttacgtggactgaacctccacaacccatatagaagctgtgagctgaaacactgttttggagcagtctggcagaacctctttgaaagacctcccaggctgtagttctcagtctgtcgtcctgaacaaaactaactttaattatttaaaaagcttgatttttctttagttgacagaccccacctacgttagactggctagcatcaacagctcttcaggaccaggctcctgctgagtttttcagcatctttcattcttccacagagtcctgaactccaggcatggcgaggtccttgcagttatttgaatacgccacatgctttcaggtccatgctactctcttttctctagatccattgctcttgccttataattctggttccccgagagaggactttagctctaggtcactctaaggctcctgctgttttgtggattattagtttcagacaaatctctgcacgcccaatatcagctgtgcgcagaagcagccgattaacggaagaacaatgtcaatccctagatttgccagaaggtggcgctcagctaaccaacgctggattcacacagatttcaccaaaagcaaattgttctgtaaggcccgtaatacagtttcagaaatgtggaaaattttccatgacaaacacagaaaaaaaaaaggccctccatgcaaatgaatataaggcaaggtaaaaaggagcttctaacagagaagtcttctgactcctaagcaatgcaattcttcccaggagctcttattatttatcaacaatggatacgaagggtttgatttaaacatctcacctcttagactaatgatgagttaagaaaaaggaggctgcaccaacacataagagaaaagcacagtgatatttacacaaaaaaatgtggcttccgtacattcaaaaatcaaaattcatgctattttccctatcataacctgagttctgtggctgctagtattgataagaaggcatcagaaaggcatttcccagtgtttataaaaatgatttttaaaaggtgggtggtgaccaggcacaatcgctcacgcctgtaatcccagcactttgaaaagccgagatgggcagatcatctgaggtcaggagttcaagaccagcctggacaacatggcaaaaccccacctctatctactaaaaatacaaaaattagctgggcgtggtggagcatgcctgtagtcccagctactcgggagacagaggcaggagaatcgcttgaacctgggatatggaggttgcggtgagccgagatcatgccactgcactccagcctgggtgacagagcaagactctgccaatcctccacccgccccccccccccccaaaaaaaaggtgggtgggtagtttcaaggtccaacaaatctttaatgtaaaggaagatggactatttgggtggggcaatggtggaggaggtgccaccatctatttcctttgaaagagaaaaaaatgtcagtgattgttgtttagagctaatgcccagagagactgcaaatgtcaaacagtgctgtgtcttagattttaatcgcacaaaaacttccagagaataatacaacaaacacccttggattcgccatccagacttaacaaacattaacatttggtcccatttgcttctgttctaaaccactgtttatcactgaaaagtcctgtgtagctgtgggtcatagcggggctacatttaggcaattttgacttatgccaaattcaagttctacaagatttgggggctgaaagattgtgtaacttacaatctgtcgttttctttacaaactcatagcagtcaggaagaaacccacagaacagtggcataggtatttgtatcacccagatatttgcccccaaaacatcactgtaaatagtttctcatttgacaccatgaaacattcaaggcagccacgaacacaaatgtgacagggggccatgtgctgtggctcacacctgtactaccagcactgtgggaggccgagggggtagatcacttgtggttagaggttcgacaccaacctagccaacgtggtgaaaccctgtccctactaaaaatacaaatattagccaggcatggcggcacatgcttgtagttctagctacttgggaggctgaggcaggagaatcgcttgaacccaggaggtggaggttgcagtgagccgagatcgagccattgcactccagcctgggcgatggagaaagaccctgcctcaaaaaaaaaaaaaaaaaaaaagaaagaaagaaaagaaaagaaaagaaaacctatgaggtagagtgtttgcaaaagtagcagcaacagttcctcccatcccatatagaagcacctcgcagtgtggctccacactccttctatcagtaggtggggtctattcctccacctcttgaatctggtcttggccatggaacttgctttggccaacggtatcttagaaaatgtaacacaagcagagatttgaaaaaatgtttgcgcattgggctccgctgctaggaacactgtgtgaatgagcctaggctaacctgttgagtgatgagcagcatatgcttctagctgacatccagctgaccactaggcatgtgagtgagtgaggtcttcccggacagcctaccccagccaactccactcagacaagaaaagccgcccagctctccaaagaaccgtaagaaatggtaactattgttttaagccaccaagttttgggttggtttgttatgtggcaaaaaaactgatgatacaacctggctcaaggctcagagatttctcttacctcggcgggttgtagggatcaaaagtgtggctgtctcctgtactaattatacaggacaggtttcctatgtagggtgagaggagccacgtcagggagatggtgacattgtcaaagatgaaactctcactggacaccatcagctgcagggctgtggattaaaacataaaatgctgcatgcacttgtgaagcaaaattgcacatttctgtttataaccgactctcttctggctacctgtccagtatttttatgtgggtctttttttttttttttttttttttctcacagggtcttgctctttcacccaggctggagtacagtgatgcgatcatggctcactgcagcctcgatctttccaggctcaggtgatcttcccacctcagtagagactgagtagctgggactacaggtatgtgctaccacacccactaatatttatttttattttttgagacagggtttcactctgtcgcccagggtggagggcaatagcatgatctctgctcactgcaacctctgcctgctaggttcaagtgattctcccacctcagcctcccaagtagctgggattacaggtgcatgccactacggctggctaatttttgtattttttggtagagacagagtttcaccatgttggccaatggtctcgaactactgacttcaagtgatctactcccctcagcctcccaaagtcctgggattacaggcatgagccaccacacccagcctaatttttagattttttgtagagacggggtttctccacgttgtccaggcttgtctccaactcctgggctcagactatcctcctccctcccaaagtgctgggattacaggcgtgagccaccgcgtccagccaaggggagcaactttgaatgagggagtctcttagcacacagagatcagcccacgtgggtggctgctgtctctgttttcaggggaagctggacatgccataaaatcagagggacatttctatgctcaagcaagtcggggactcaccttcccggcactggtactgcacccacaggtaactgccctgagtcggacacaggtttccaaagtaggtctcatctgctgccacctggcatgactgtagctcctggcactggcctgggaagcacgcacatcccagcggaagcaggaatggtgtgcaagacaaaagaggatacattcaacagagctgtacagagatgaatggcctctcacccactcattcatttacccaccatccgcccaacaaatagcttttgatatctcctgaagaccaggtactgggctaggtactcaggtgagggagaagtaggatttctgtcctcaagtagttcagggtctagcatcctggtctcaaacttcagcttgcaacagatccccctgtgagtcttgtgaagataccatattccagaccccaccctcagcgattctgattcagtaggtatggagtgcagctggagaatatgcatttctaaccagttcctatgggatgctgatcctgacattgctggcccagggaccccacttcaagaaccactggtccagcagcgtctagagagatggcccaaaatagaaatctacacccagagaaccggcagaggaggcaagattaggaatcctgcgtctatcatggtaccacatgcccacagaagggaggagcagggacagcccattccagaagcttcagggtcatccagcacctctccctcctgcccagcgagatctgttagatgcccacagggaagcctgggagaaagaaacaggtccagaacacccacctgtgcttctcccagttacctgctaggtcccacttcttctgggcagttggccctgggcccacagagccaccctcaccctgccatgcttgtatcacagcgaactacattttccaaactcccttggccactggctcccaggtaggcttggccaatggccggcactactgaaagactggagggtggtgtattcatttccaatcactgttgtaacaacttaccactaacttaatgacttaaatctacatagatttggctgggagtggtggctcacacctataatcccagcactttgggaggcagaggtgggcagattacctgaggtcaggagctcgagaccagcctggccaacatggcaaaaccctgtctctactaaaaatacaaaaattagctgggcgtgatggcacatgcctgtaatcccagctactcaggaggctgaggcaggagaatagcttgagcctgagaggtgaagattgcagtgagcagagatcacgccattgcacccaatcctggattacagaacaagactcagtctcaaaacaaacaaacaaacaaaaacgcagatttttgtccaggtatggtggctcatgcctgtaatcccagcaatttgggaggctgagtcaggtggatcacttgaggtcagaagttcgaggccagactggccaacaagatgaaactccatctctaccaaaaatacaaaaactagctgggtgtggtggcacgcgcccgtagtcccagctacttaggagggtgaggcaggagaatcacttgaaccagggaggtggacgttgcagtgagctgagattgcgccactgcactccagccaaggcaacagagcaagactttgtctcaaaactaaaataaacaaaaataaagcagcacagattttttaaatctcacaattctgtatggtggtcagaagtctgggtgggctcagctggcctctgctcatatcacagggccgacaccaaggtgtcagggctgtgtttctttttttttttttttttgagatggagttttgctcttgttgcccaggctggagtgtagtggtgcgatctcggctcaccgcaatctctgtctcccaggttcaagcgattctcctgcctcagcctactgagtagctgggattacaggcatgtgccaccacaaccagctcattttgtatttttagtagagatggggtttctccatgttggtcagcctggtcttgaactcccaacctcaggtgatccacctgcctcggcctcccaaagtactgggtttacaggtgtgagtcactgcccctggccattttttttttttttttttgatacggagtctcgccatgtcacccaggctggagtgcagtggtgccatcttggctcactgcaacctctgcctctcagattcaagcaattctcctgcctcaccctcctgaatagttggggctccagatgtacaccaccatacccggctaatttttgtatttttagtagagacagggtttcaccatgttggacaggctggccttgaactcctgatgtcagatgatccacccacctcagcctcccaaagcactgggattacaggtgtgagccatcgtacccagcctcttgctttttttaagcatctcttctcccttgacacagcagttcccccagtggaagctccaattaactggcagctgtcagcatttaactagactcagaccctaccccccaggattctgattcagtaagtatggggtgcagctggagagtgtgcacgtctaacaagctcccaggggatgctgatcccgatactgctggcccagagccagctggaacagagcatgcagaaatttcaaccccatttgcagagtgcatacaaggtgctacactcttcccccaggttctcctgaccctcacaggagccccatgaaacttagaaagattctgcaacttgcctggatcacccaggcagcaggggctgagctgggatttgaaccccaacctgccgcccttttgccatgtaccctgctgcccacatcccagggggttctgccccatccttggactcggtctaagcagtttgcttagacaaactgggggtggcagcagggctcaccttccagctcacaaattaaaccacgcataatattcaacatccccttgtaatggataaactgcctcaagacgcagaggccacgtccctgctgaggtttttttctaatactgttgttacccagcgagaccatcctgggctctctctccaccatcacggttcatactgcagtccacacctgagcctgccacctcatgtcctcaccaccttgtcccccagtctttctcgtggctggatcctgcacttccctcacagccaggctcctgatgccgcccccgtaaagctttcctgagccccacctccaccccgtgatctggggggcccctctgatcaaaagggaacacgagccaccaccacatctctgttctcagattaaacagactcaaagagaggtctaattccagaacttgaggacagagttttttctatgactcttcgtagccacatataatccacttaaaaaaaaaaaaaaactaaatctgatctaattccaggatttaacacgccttgcagacaaaatttaaaatcccttcaggtccccagatgccttgaggctcagaatgtggcccaaagacatttgggatcctaagtggcatcacttgggagtgagttggaaatcaagtcggaggtttttaaaaatttttggttcactgcaacatctccaggacatagaacagtacctggcacatagtaggtacaaaataagttttgcatgactaaatagatagtgtttgctcttctgggttgcggcatttatcacagcattagttaattgcctgtatatcactgtctccccactccgccgcaagctctttgaaaaacagagcttgggccaggtgcggtggctcatgccggtaattccagcactttgagaggccaaggtgggtggatcactggaggccaggaggtacagaccagcccgggcaacatggtgaaaccctttctctacaaaaaatacaaaaattagctgggtgtgagggtgcttgcctctaattccagctacttgggtggctgaggcaggagaatcgcttgagcccgggaggcggaggttgcagtgagccacgactgtgccactgcactccagcctgggcaacagagcaagactccatctcaaaaaaaaaaaaaaaaaaaaaaaaaaaaaaagcaccaccaaaaaaaaccaagtgtttattggctaactgaatgaatgagggaccagggtgcttagatacagaccccgcgggatcctctctgcgctcctcctccgactcccacaacagggctcccctctaacgtgctctctgagctgtgggtaccacatttcaggaacttgcagctgagcctttgaggaaacagctcactaagccccagcagtgccttggtgaggaaggtacatccattctcccgtccggggccctttctccttgcaggggccacagcctcaggaacgctggagtaagaagagtcagtgaaaaccagccagctgattttagcgtttcctttccccatgcctgctccaaaaggcaggaggacagaggagccattctcagttccccgaggcaggagaaagttctgggagtactggcgtccctccctgaatcttcaaagggtctttgggcagaagcagaggctcagaggagagtgccaaaaggcacaactggggaggctggcccccaggacctgaggcttgcagcctggccacacggggctgtgtcctcacttagccaagaagcagcaggccacttgctttcctggaccctccagcggggacagtggtgactgcagcagaaagaagagggtttcccgatgtcctggaccagggaagtctctgaggagtttttacctcctagcagggtgcaagaaacccccataatcccggaaattgaatcctagtcactgggcaagcgcaactcagaagtagatttaatctgatttagaaaaacaaagccctagagtaactctcccacgtgaacaagataccatctatcaggagcttggcttcagcgttattcacagtcacagagattaagaaccaacctttctcaacaggagaagagacaaatggcggcacagttacacaacagatgaaacaaataaaccagcacaacatgtatcaagacggataatacatctcaaaaacaagatgttgagcaaaacacaggaaccaaaatgaaaagaaaaatgcattctatagaacgacacacaatatgataccatttatataaacattaaaaccctgcaaagtggccaggcacagtggctcacacttgtaatcccaggaaggccaaggtgggcggatcacctgaggtcaggagttcgagaccagcctggcaaacatggtgaaaccccgtctctactaaaaatataaaaaattaacctggtgtggtggcgcacgcctgtagtcccagctactcgggaggctgaggcacaagaatcgcttcaacccaggaggcagaggttgcagtgaaaagaaattgtgccactgcattccagcctgggtgacagactgagactccgtctcaaaaataaataaataaaaaataaattaaaaaaatagatttaaaaaaaagccctgcaaaagcaacagtctgtagtgtttaggaatacgtgcctagaaggtgaaaataaagcaggcgcagtggctcacgcccgtaatcccaacatttggggaggccgaggcaggcggatggcctaagctcaggagttcgagatcagcctggtcaacatggtgaaaccccgtctcttctaagaatacaaaaactggccaggagtggtggcacctgcctgtaatcccagctactcgggaggctgaggcattagaatcgcttgaacccaggaagcagagattgcagtgagctaagatcgggccactgcactctagcctgggcaagagtgagactctctctcaaaataaagagagggatccacaggagtctcctagtgttgtattcatttttctttttcctttttcttttctttttttcttttttgagacagagtcttgttccatcgcccaggctggagtgcgatgatctgatttcggctcactgcaacttccgcctccagggctcaagcgattctcctgcctcagcctcccaaatacctgggattacaggcatgtgccaccagcccggctaatttttgtatttttagtagagatggggtttcaccatgttggccaggctggtctggaattcctgacctcaggtgatccacctgccttggcctcccaagtgctgagattacaggcatgagccaccacgcccgactgtattgatttttctaacgagggaatcttaagcaaatgaggcacggtgttcagatctgatgaaggtgggtagtagatctgtgggagttcattacagtattttctattcttgtctatacgtttggagtatttcaaaaatttaaaaattaagttaaaaaagtgatgtttcctgcatccagcaggggtcgaggcacgccatgcccaccagatccatggctgtgtttgatgtcggggagggtggaccacagccccctgcttccttgctccgtgcgatgggcagggactggccagttttcccccatgttggaggcccacggtcagagatgaagattatcagaggcttccggaaccctttgctgagcacagaataccagcaactgccctctgctggccgccagagctgcagagcccttgggccctacctgccacctcctccttgacgttggcccagctgcatccctgctccagatctgaaggacgcccggcatcctgggtgcagaaatggggattctggcgcccgtagacggcatcctggacctggatgacctgccccaagccacagtgcacggtggcattgagtccctcgcaggccaggctctggccaacccctgaggcaaagggaaggcaagacattaggggggctcacggttacagacaggtgagtgccggttcacgggaagaggagggtcccgggggttgggctgagatgcaagaacccgataggagccgcttggcaggggtgataaattgaatatgattgtcggcagcattgtgctgagccaggttccctgggatcagatccagcccagccacacactgctgctgtgtgaccttcagcaagttagttagcttctctgtgcccccactctcatactaaacctcatgcaggccgggctccgtggctcacccctgtaatctcagcactttgggaggccgagacgggcggaccacttgaggtcaggagttcgagaccagcctggccaacatggtgaaaccccgtctctattaaaaaaaatacaaaaattatctggggatggtggctcgcacctgtaatcccagctactcgggaggttgagacaggagaatcacttgaacctgggaagcggaggttgcagtgagccaagatcacaccactccagcctcagtgacagagcaagactccatctcagaaaaaaaaaaaaaaaaaagcgggaaagacagaaacagagatgagacaggtgggcaggcaggaaggtgggcaggtggatggggacagggcagggatgagtgacggagcatcacgtgggcagagagagatgcatagagacagggagagaaagctgcggacagaggtaaggtcagaaaaacacacacaggtcagctcttcagcagggagatggggacagaaaccggcaggccctgaagagcgagagggagacagagagaccacagaggcaggaagagagtcagagaccaagggagagaaagagaaagagttagagaaaaacagaaggggaagaaagacccagagaaaactgagacaggggaggcggcaagagaaagagaaggtcagagagatggaggcaggaacaggagggagaggcgagcctggagagaggcctgcaggcaggcagggagacagggtgggagatgggaactcaggggcacgggccactcacggaactcgcacatgaaggcgaaggtctgggcgcagtccgaggtcacccactcagaggaagggcctctcccgatgtggccgcaggtgtcaggggcagcggcggcctgccctccatgccagttgctgtaggtcacattggaggtgtccaaccaagtccccggccctggaagggcaacacgaccaccaggactcagtaactgtcttcaaactccatttatacaaatgcaggactcacgcctgctctgccgctgctgggcagcaggtcagcaattaatgttgatgggatggagacctctctctccaggaccaataaagttctcttcctcactgtcatcatcaaacactcaatgtaagaactggaacaccaaattggagagcttgcaaaaggtgctttgattaaataaatgaggctgccagctctgtctaaccataatcaataatttatttattttgagatggggtcttgctctgtcacccaggttggagtgcagtggtgccatttcagctcgctacaagctccacctcccaggctcaagtgatcctcccagcttagcctcctgagtagctgagaccacaggtgcaagccgctatgcctggctgatttttttgtatttctggcagagacagggattttgtcttgttgcccaggctggcctccaactcctgagctcaaactccacccacctcagtctcccaaagttctggaattgcaggcatgagccaccacacctggccctgagcacagtctaaggaagagccaggggccaggcccagtggttcatgcttgtgatcctaacattgtggaggtgggaggatcacttgcacccaggagtttaagaccagcctgggcaacctagagagaccttgtctctacaaaaaaaaaaaaaaaaaaatttagtcaggcatgctgcctgtggtcccagctactcgggaggctgagttgggaggattgcttgagctgaggttggggctacagtgagccatgatcgtgcccctatattctggcctgggagacagagcaagaccctgtctcaaaataataataataataataataataataataataataataaagtccagaagtgggctaagggatgttttaacatatcatcttcttcataagctgtgtcccttgccaagtacacctgggcagtgctgagttaaaacatgagcagttattgttactttgggcctcttcagatccttgaaaatactgatgtaactctttaaaaggagtgtgtgtgtgtttatgtgtgtgtgtgtgtgtgtgtaaaacagaaccatgtcgaggacaccagagagctagaaaacactaaatatcaaaatttactatggattgggcatggtggctcacgcctggaatcccagcactttgggaggccaaggtggatggatcacttgaggccaggagttcaagaccagactggccaacatggtgaaaccctgtctctattagaattacaaaaattagccataattccagctactagggaggctgaggcaggggaatcacttgaacccgggaggcagaggtcgcagtgagccaagatggtgccgccactgcactccagcctgggaaacagagtgagattgtctcaaaaaacaaacatttattatgggtactcagaaacgtaattattaatttattgaaagagactcatgcaaatgaaatggttttaaaaaatccaaagggtctaaaatgaaagtatcttccctctccaagctatgggcttctccatcattgttatgtttctcataaatgattccaggatgaattgaattgtatccacacatcagcatctatgagtgcctgaaatctacttacataaatgtcatgtgattgcacacagtatctggcccttgcttcttaaatgacattaaatattggaggttgttgcctatcagcctagttagaactacctcattttctgcaacagccacacggtatccctggagaggtgttaataggcacacctcctctagctggatgtgaaaggatgttcaatacacagaaatcggcaattgttgcatctacacctcaagaaaccattcaggagacattgtctgcaggggcgtcttaagaattcaaatccccttggctgtgggttttcttaaatgagcttcccggtagctcatttattaaaacacttccatccacgctggtgttgttctgtggctgttcggcacaggccatgtctcatttctcaaacccagtagcttctacaggggcaaagagaacctctgggtaccaaggtgcccagtaggaaagtcaggcttagcattgctctgactggtagagaccccactgtgcaccaccagctatgtcatgttgagcacgtcttttctctctagacttcattttcctcctccgtgaaaggagagtagccacgcttacctcatgggatccgtgtgaggcttaaatgcaaatgttttcttgtccattctctctctctctttttttttttttttttttttttgagacagtttctctctgtgttgtccaggctggagtgcaatggcacaatcttggctcactggaacctctgtctcctgggttgaagggattctcctgcctcagcctcctgagtagctgggattacaggtgcgtgctaccatgcccagctaatttttctatgtttagtagagatgaggtttcaccatgttggccagtctgatctcgaactcctgaccttgagtgatccacctgcctcggcctcccaaagtgctgggattacaagcgtgacccaccacgcccagcctccttgtccattctcaattgtgtctaggcactgggaaaacaaaaatggccagggtatggttctttccttgaagggcttgtagtctaggagggagacagacaacttagctgtttaagccacagcaaaagtactgccttggaagtgtgaacagggccctgcaggctcgtagagaacgactcacctgactgcactgggtgggggaaggagccttcagagaataaaggaggactaagactttcaggaccattaaaattagactgtgaatggaactatgctaagcacttggtctgctttaatgtcagagcaagtggggaaagacaagtgggacactttaaaaaatagcttagtcattattttctgagactcagttttctcatctgtaaaatggggacataaggccgggcgcagtggctaccacctgtaatcccagcactttgggaggccaaggcaggcggatcacaaggtcaggagatcgagaccatcttggctaacacggtgaaaccccgtctctattcaaaatacaaaaaattagccgagcatagtggcatctgcctgtaatcccagctacttgggaggctgaggcagaagaatcacttgaaccagggaggcagaggttgcagtgagccgcgatcgtgccactgcactccagcctgggcaacagagagagactctgtctcaaaaataaataaataaataaataaataaataaataaaaaatggggacatgatttttctcattgttattgtaagaattcaacatgatagtgacaacgaagcactcaggatagtgcctggcactatcctagcaagaatcaaagcagtcagagtattactattaggaacaggcaaagaagcgaacatttctagagggtcagaatttgatgtgccagattctgtgctaggcattagacatgaattatttaatccacaacacaaccaaagggaagggtatccataccatgagaattaggtcgtattaatttgttccatgtttctttgggtgagaagtgatggcaagaattgcaaacacaagtttctcataaaacagcgatcacggcacctaccctccgtggttccattccgtgccaagttccacgtgagtccaatccaccattccctgtcctgggagatgtgcttctgcagaaaccactgggtgccttcgtcctgaatgaagaccaaatggcctccttgcccctcgcaccagctctgggcatcacggaaggtgcgtccgagtggcacaaattcatagcaagcatctctgaaggccacctggctgttagagcaaaagctgccttcctctggcttaacagtggtggccctaagcctcagagcaagcaccaggagtaccaagcccactgcactcat

SEQ ID NO: 817 - DNA, 227682 bp, Homo sapiens
gctcccgtcccccttccgccgcgtgggtgccatggcaacggagagagacggcaacctgggttccggaagccggagagctggagctttgaagccaccccggtcaaaggatgctgagtccggagcgcctagccctaccggactacgagtatctgggtaggaaccccctttaactttggggagggaaagacgtgcagacgaattaggccagggtctgggaggaggcgggggcggggtctgagtgggatcgggtccgggtggtatggggaggggcggagaggcgggggttccagggcctgagcctgtaaggccgagcaggaaggaaaaaagcacctgggaagtaaagaatgtttgaagtgtaggggctggaactcaggcaatgtggattgtgttcaaatgggtcaggttggcgttgaggatttggggccctgttggggtattattgatatgctggtagtggagtaagaataaccttggaacctcaagtgccaaatcagtcagcgaacatttcgagcttttctttttcattaggcactgtgctaagcatttttcatgcatcattcttcatttgaatttctcaacagccctaggaggaattaccgtgttttcttccagttttgcaggtggagaaactggggctgaagaggtaacttgcgttaagttaggccacacagctagaaaatggtagcgctaggatcagaaccggatttgcccactccaacagaacttgagatattgacttggctcttgagctaagactgtatatgtagtactttgttgagcatctttagtgtataaggcatttaatgaatgaaaaaaggcacacacacgcatagatatgtacacacacacacatatgcacacaatacacattttattttattttatttttgagacggagtctagctctgtcgcccgggctggagtgcagtggcgcgatcttggctcactgcaagctccgcctcccgggtagctgggactacaggcgcccgccacctcgcccggctacttttttgtatacttaatagagacggggtttcaccgtgttaaccaggatggtctcgatctcctgacctcgtgatctgcccgcctcagcctccaaaagtgcttggattacaggcgtgagccaccgcgcccggccacaatacacattttaaataattcatagacttttatttttttaaagacgttttgttttgttttgttttgttttttgagacagagtttctctcctgttgcccaggctggagtacactgcaacctctgcctcccggattcaagcgattctcctgcctcagcctcccgagtagttgagattacaggcatgcgccaccacgccaggttaattttatatttttagtagagacggggtttcaccatgttggtcaggctggtctcaaactcctgacctcaggtgatccgcccacctcggcctcccaaagtgttgggattacaggcgtgagccactgcacatggcgagaagttttaagtttacagaaaattgagcagatagtacggcgagttcccatataccttgggtctccctcactcacagtttccgctattatttacatcttgcattagtgtggtacatttgttacaatggataaacatatatatttataatatataataatatattatatattattattattatatagatatattattatagatacatattattaactaaagtccatagtttacattagggttctttgtgttgttcagttctgtgggttttgataaatgcatgtcatgtattcaccattccattatcatacagaatagtttcactgtcctgaaaaatcccctgtgctccacctattgatccttctccctccccctgcagcccttgccaaccactgatcttatggtctctaaagttttgccttttccagaatatcatgtagttggagtcatacagtgtgtaaatttttcagatgggcttctttaacttagcagtaagcatttaagtttcctccatgtctttctgtggcatgataactcatttctttttatttctgaataatattccattgtatggatgtaccatgcacatcttttttttttttcttcttctttttttttttttttgagacaatgtctggcactgtcactcaggctggagtgcagtggcactatcacggctcactgcagcctcaacctccgggctcaagtgatcctgctacctcagccttccaagtagctgggactacaggcacatgccaccatccctggttaattttttaattttttgtagagaaagagtctcactatgttgtccaggttggtcttgaactccagggctcaagcaagcctcttactgtggccttccaaagtactgagattacaggtgtgagtcactgcacctggcttacatctttttttttttttttttttttttttgagatggagtttcactcttgttgcctaggctggagtgcaatgatgcgatctgggctcaccccaacctccgcctcctgggttcaagtgattctcctgcctcagcctccctagtacctgggattacaggcatgcgccaccacgcctggctaattttgtatttttagtagagatgggtttctccatgttggtcaggctggtctcaaactcctgacctcaggtgatccacccacctcggcctcccaaactgcttggattacaggcgtgagccaccgcgcccagccaacatctttttaaatgaaaaacaattctggtttacattttgtttaacttattttaaaaattaattttaaaatattttttaaggttggtaatatggaaacttgattcaaagtattttttaggcctggcatggtggctcatgcctgtaatcccaatactttgggaggctgacgtaggaggattgcttgaggtcaggagttcaagaccagactggatgatagagtgagaccctgcctctaaaatgcatagatagatagatagatagatagatagatagatagatagataggtagatgtttttagtgaaaagcctacccctttgcctccatctgcccagtttccatccatcctcagcctcccaaaagtaaccactattattgttttcctgtgtatctttccagagtttattatatacataaaggagtatacagtgcatactttttcatttaatacatcttgaagtaatttccgtttcttttgttttttcttttctttctttcttgagacagagtctcactctgtcacccaggctggagtgcagtggcaccatctcggctcactgcaacctccacttcctgggttcaagccattctcctgccccagcctctcaagtagctggaactgcaggcacgagccaccacacctggctaagtttttgtattttgggtagagatagggtttctccatgttgcccaggctgcttttgaacttcctgagctcaagcgatctgcccaccttggcttcccaaagtcctgggattataggcgtgagccactgcgcctggcctcgaagtaatttctcagtcagtagggagcttcttcgttcttcatgaaattcatttttagctatatagtatttaaataatttatttaaccagtcccgcactggtaaacaagttgtttttagccttttgctgttactaagaatgctgcaatgaataacctgcagttttgttcctttgcaagtgtatctgcaagaataagttccacaaagtggaattggtggattaagggcatatgcattgaagtacttatagatattgtcagattgcccttaataggtgttgtaccattttgccaccagcaatgaaagagaatgcctgtttccccattgtgctgacaacaaaatacatcaaacttggatttttttcaatctaagtgacagatagtctgagtagatttaatatgcatttttaaatgaagttgagtgcctttttaccaagtttaagggctgattggtctttgaaagctatatatatacacatatatacatgaacatatatatagacatatatatagagagagagcttaagacagtgaccacatccattaatcagctaaaaggggatatcacagacaattttgtatctaatgaataacagtatcaatgtcaagcaatgcctagacttttttccaaagattttatgtattttattacccagtactcaatgaatatatgaaatatttgaaaaggctagttcattgttcagttccttgggtgtttgctgtttgaattttatgtctcaaaggcttggcagatttggtgtattggtgccttggtgaatagaagttggtggtctcttcataaatggcgttttcaggaaggccaattcagtggcagtgttgagaatgaatctacaaacagaatcagagtctcaggttggttgaaaaagcttcaatgtttgtgaagcccaaccaatcacctaataattgaatcctatacaaatgcttcttcatgctttgttgcatatttaagtgtcttaattccttgtcctaaccactaactagacattcatactgccctcagcatggtcacacccctcactgccttctcctggttcatcaaaccgtatcactctgctgaaatgcgtttgtctttagttgagaactatccctgccttttacaatttgtctctcttagaggcatgctgctttgacctattcaccctcaattttttttttcttttttcttgagacggagtctcgctctgtcacccaggctggagtgcaatgatgtgatcttggctcactccaacctccgcctccagggttcaagtgattctcgtgtctcagcctcccaagtagctgggattacaggcacctgccaccatgcccagctaatttttgtatttttagtagagacagagtttcaccatgtttgccaggctggtctcgaactcctgacctcaggtgatccacccaccttagcctcccaaagtgctgggattacaggtgtgagccaccacgcctggccaacctattcaccctcaatctaatgaccgtttaaaaccactccctacagaatagattaataaaatatttcctgatttaaatttttaaatacctgtgatttttccatttgtttttatttttatacattataaagttacttgtatgtgtaagcctaaagaagactatacttatagagaaaacaaaactgcagactggaaagccctaggcattcagtgaaacccaaaagctaaagttgagttccccttggttagtgtatctggagacctctctttaggattatggtgtaaattacagggatacctatccaaagaatatctagagatatccctttctccctgctagctagggattgtatttacctttctgactattagtgaagaaatcaatcttttatcatgttgggtaaactgatcctttccccactgactttgtagattaggaacctgtaatcatggccttgcatggcttaagatcttaagatcatcactaaagaatagcttagtgatgttcatgtctgcagtcatcagaatgtagtgataaaaattgtgttaatgcctaggcctgaagagagaaaggagagtctggtaaggagatgaaataagtatagaccctctctgtaggacccgcaaaaggtttccagccttatgaaacctacttagtggaagcttctgccagaggctgaaggtgtgtctgtgtatctggttgggtgtggcgagctctctagagccaaagggcagcctgttctggtcccaggtttgccaaacataccacctacgtgctgacctgagtataagcatgagggcgtgaggtttattttttactccacctaatttggtgaggtgcatgctttcactcacgctccaagttgcctcttcttttccatggaacctgcttattctcactacggttgatagtgggttagtataatagataactctagaaatcaaagatggcctttctcctttggggactagacatttagaagaatcacaataaattgggtagttttttttttaagctatagtttttgaactcttcctatatgcctggcactgtggtttatctcatttaattttcacaactaccatatgaagtgggtactcttactggtcccaattagtagttattaatatcatcttctcattttataaataaggaagctgaggcttagaaaggctaattgatttgcacaaggtcacacaggcaatgatgcatagtaaacaggggttcatacccaggtttgtcatattccacagcttgtgttttttcctcttcactaaaaagataaaaacaaaccaaaaaacccctattggttcaaagggcagtaattcttgcttccttattaaggatgaggctcttgcaaataaatttcttgggaacaagaattgtgttttactcatcattgtcaaccttctatcattgtctaccttctatcactgtataccttctatcattgtatactctcctacacttaattcatacgtatatgtgaaatggaatatgaataatctgaccttagggtaccctaaacatgagtagctaacaaaagcaaccgagacttattaagaacttactctgtaccaggtaccattttaaatgctttacatatattgatgtatatgaagatagtttcagttgttatctccattcggcagatgaggaaactacacacaaagataccaaataacaagttgtaagtggtggatccagaattctaacccagcagtctaattgaagtccacatggttaaactctatgctataaatactttgagcaactcccaaagtggggctccaactattgtgtagacctatacgtggatcctggagtaaggtcaagtgattccagtgtcttcatttaacatttctgccatgaggaggcatccgaggaatgaggatggatcagggaatggtaaaatttccaatttcttcttgccactggactcatctctcagaggcaggcagtgaggaagataacttctaccatttgggagaattttattgacaatcatctttgtactttgggtagctgtatgacctagaagaaatcacttaacctctctgtgccttagtttccacatctccaaaatgtgggtggtaatagtacagtcatggtggcttacgcctatattcccagcactgtgggaggccaaggagggaggattgcttgagcccaggagtttgagaccaatgggacatagtgagacttcgtctctactaaaaataaaaaaaaaatagctgggtgcaacagcatgcatctgtagtcccagttactcaggaggcggaggtgggaggatggcttgagcccaggaggtcaaggctgcagtgagctgttttcacaccactgcactccagcctgggtgacaaagtgagaccctttctcaaaaaatttaaaaaaggccaggcatggtggctcatgcctataatcccagcattttgggaggccgaggcgggtggatcacctgaggtcaggagttcgagaccagcctggccaaaatggtgaaaccccatctctactaaaaatgcaaaaattagcagagcgtgggggtgtgttcctatagtcccagctactcaggaggttgagacacgagaattgcttgaacccgggaggaggaggctgcagtgagctgaaatctcaccactgcactccagcctgggtgacagagtgagactgcttctcaaaaaaaaaaaaaaaaaaattgtgcttgcctcatacatgtaagcatttatcctgttagagcacctgtgtaggtgctcaataaatattagctgctagtgttattaccatatttttgtgcaaatacgtaaacatctggtggcaaccaggaatgtgtgcctctcagatctcctacactggggaggggagggtaattgactcctgaccccagctctgaatctaacaccttgttcacactgaggtcacactttccacagactgctcctagtcaatgactgggcaggacagacccacttccatgagatgttttactcctctagtgggtgactttggcttaaagactctcactgcacactgctaagtccctcattctcccttctccctcctaaaggagggataataattagggtccctcctaaaggagggataataaattagggtcacacctgcatttgatctcttagctctcccagactcctccggcttccttcccattttctatcatgggcgtttcccccagtacatctctcgcatgtctgatcctgttttggtgtctgtttctcacagtatctgagctaagacaacatctaacagttactgatatagtctcttccagccatgaggttaatacaacttctttaggacttggcaaaggttctgacataggaccccttctatgtggaagataagtgttactaatcttaattttttttgtatttgctgataccacagcatatgatagttacttgtctgacttccagacacattctattttttgattttgaatgaatcctgataaacttatttttatttgaatataactagtgagccttccaaacccaattctattctaggaaatattgctgtttacagtaagttagcagaaattctcttagggccttaaagtgtttggttgctgcagaaaggaaatgaaataaaataggtgttaaactgacttcctaaatctttggaaactaggtttataatacataaaactggtcactttgaaatgattatgggccaggtgcggtggctcatgcctgtaatcccagcattttggaaggctgaggcgggcagatcacttgaggtcaggagttcgagaccagcttggccaacatggtgaaaccctgtctctactaaaaatatgaaaaatagctgggcatggtggtgcgcacctggagtcccagctacttgggaggctgaggcatgagaatcgcttgaacccgggaggcagaggttgcagtccactgagatcacgccagtgcactccagcctgggcgacagagcaagactctgtctcaaaataataataataaataaataaaataattatgaacatgttcacaaagtcacctctttctttccttttcctccccctacccttctccttccttttcttcctccctgaataccttctctatataaagccaggcatgaatatatgaatataaagcatccctccccacaggaaacttacacagtagatgggagatgggacatattcataaatgaccataacataaaaagacagtataataagtaaagagtatgtgacctatatggttctagagccagcagctatcttggccttttctcagtttggtcagcagcttctcagtcatggaagggacagcagttcccttggtagcctagttctggaatgggccttttgggagttgttcctggaaggtcgatctagatttttttccttttccaaagattctgtaacctatttaatacatgtaataaataaatatctttttgttggggggaaaaaagagccagtaagttctaagccatgttgttcccaacccttgcctacctccatttctccaaagtaaattgcagagtgatgtcagtgttattctggggttttaagatagctttaaaatttttgactttgtttatcatttatatattcaagtaatgttaaaatctttattccaaatgctattcagaagttggggatcacttttatttgcacaaatgcaatatgtgctaaatgaataattctaggaggccgagtagataaattgaagttttaaaaataatagtagagcaggccgggagcagtggctcaacgcctgtaatcccagcactttgggaggccaaggcgggtggatcacgaggtcaggagatcgagaccatcctggctaacacggtgaaaccctgtctctactaaaaatacaaaaaattagccgggcgtggtggcaggcgcctgtagtcccagctactcgcgaggctgaggcaggagaatggtgtgaacccgggaggcggagcttgcagtgagccgagattgcaccacggcactccagcctgggcgacagagcgagactccatctcaaaaataagtaaataaataaaaataatagtagagcagaagagacatgatccattatcctatttctggttcatcatcctatttatgtccttcatagcacttatcagagttatcttgtgtacctacttgtatacttggttattgtctgtttcttattagaatgtgagccatgagggcaggccttttctctctaaaatctagcacaatgcttggcccaaatgaagtgctcagttgttgaatgaatggtctactttaagtaacagaataaattttaaaataaatgggagaaaggaatccagttcaacaaatagttactgaattcctaacatgtgagagaaactatgtttttccccccttccatgaatgaaaaaggatgattaaatctgctctggatcttttcggttttaactctgatttatacctaaagttaatttcttggttgataccatagtttctgtgtttgggttacataacattaaaatttaatccattttgtaaaaccaatattttaaaaaggaaggagattttctacaattttggagcatctcaatgagatcctgtcctttagttggacagagtgatatgctttgattaagactggaattacccttgtaaactaatctctgggtcctctttctgtgttgggatcacccttacactacttccctaggggccttaggaaatagctcattctatgattggaatttcaagtcaaaacacatttatctgagcagaattttaatgatttatcaaagagaggagggattttcccaaacacaactgaacttacaaattactgatcccactagctatgttttttcttaagcacctttctttaaacaaagcaattactgctgaaatcatcaaatgtatttttttcatggaaagcttttgactaagttttgtttgattagcaggaacctactaaaagtaaatattgtttgagacagcactttcagagcctgttctttttcttcattcaattagcttttaaagcactattctttggagaaagtaagagccttttttccagctgtcctattgtgtaactcaaggtctcgttaatactattatctagccccgagattacaggtaattgtgataaaacacaagcttcagtttctgtaatctcagacagaaatctgcttgtgccccaggacttcagatcaggtgttttttaaattcagacttctctcacctgggacagtcccattggcccaaagtaaacagaggcatctggcggggatagagctgcattagggcccattgccactttttttttttccctttaaattaatgtggcagaactcctcctgtggccaacttacaaagacctgttctaaatgggaaaattctgtattttaaaataggcatgcttgaaacaataacacttttgaatgtaagatatatgaaaggccacacgtcttcggctttgcttgtcaaatggagaggctgccagaaccggtcggctccatggttctcatgccccaaagtcctgcaaattgacacgtaagtaggcaacacacaaagaagttcagcccatgagaaagtgagtttgggcgcttgggctggcctcctttctctctgtgtggagttctttccaactttgcctcttctgtcccatcttagtttttcagaaaggagagattaaatgtgtctggtatatcagcatgttaactgcttgggcaacatgaggctagcactcaggacactgttcagcctgtcatatggaaggaattgcctttcagaggagattataattgtgtatatagccacacaaatgcacattctgcctggaggaaattgcacagaagaggatgccttatgctgccactcaggtctctttgtggaaggctgcgtaagaagtgcttacatggcatagtcacctcttttggacttaatgagtcatctttttgtgtgatggctacataaaaaaaaaggaaagaagaaatgtactcttccccaagtgagctgcttttattggccctgctgctttgtctaagagttttatacactcctcatgacatcatttacaatgctggtgcacagacagtaaacaaaaaataatttagcccttgggcacctagacgaaacttaagtagtccaatttagagaaatgataacaataaacttcataaacagtgaacacatgagcttaaacagcaagcatgactccagtcctttttggaatgcgatgcattgaaagatggctatagagaaaactagaagctccacacgtcagttatgtgcagttaagccttgagtccatggtctagtgttaatctcaagagtacattctagttagtggataaaatacaggctaccatgtgagtaagtcattaagctccttgagccacagcatttcacctataaaagtgggaaaggtaatattgccacctacctcacaggaatgaaagatgattgagaagataaacttgtggagttccttatagggaaggtattttgtaaatagaaaacactgttattattctccttgatcaaatttccccaacaaatggagttgataaaagctacctcacagagggttgagaggctgaattaattaatatacgtctagtatcttaagagtaaactatttaatgaaacctaaaattgattgtctttcttgatagtctatgaactaccagacctgctgtttagaaacatgattgtcttctaaagtctcacatatgcagtctttgccttctcttcaagggttggcacgataaagaatagtgaatgtacaggcaaaagataggctaaatcttcagggagaacagccttgccttttttcttttcaagggtatatttacaaatagcctttggagtcttgctaatctttgttaccatgcctgaacatagggactgttttgacctttgttcttccaataaatatttatttttgatatcatatttctaaatgagaaacaaacttagaaggaaaagaagtggttgaatttgtctcacattataaattttttcttatctttcctaggatggtaagagaaaataacttttttttttttttttgagacagagtttcgctccatcacccaggctggagtgcaatggcacaatctcagctcactgcaacctctgcctcctgggttcatgcaatcaattctcatgcctcagcctcccgagtagctggaattataggtgcatgccaccatgcctggctaatttttgtatttttagtagagatgggggtttcgccatgttggccaggctggtctcaaactcctgatctcaagtgatcctcccgcctcggcctccccaaatgctgggattacaagcatgagccaccgtgcccggcctgaaaataactattattgaaggaccagacatcaggctctccaactggaaagttctcaaacttagccaagtgattaaaaacagctttggctgttcagaatttaatcttttgttttcaattacagttagtagtatttgggtaacttcatttcccagatttcatttgctgttaggtgacacaaaaaggggaaagactttttcttttctttttttttttttttgagatggagtctcgctctgtcgcccaggctggagtgcagtggcgtgatcttggctcactgcaagctccgcctcccaggttcacgccattctcctgcctcagcctcccgagtagctaggactacaggcgcccgccacctcgcccagctaattttttgtatttttagtagagacggagtttcaccgtgttagccaggatggtctcgatctcctgaccttgtgatccgcctgcctcggcctcccaaagtgctgggattacaggcatgagccaccgcgcccggcctaaagactttcttttaaattctaatcccttaggcagggatcatgtctcatatatatattttttaatacagagataatatttcaacttttaagtagtacagctgcctaaatactgtcttaagtagaaactgttttcttttttccttttttctttttttgaggtggagtctcactttgttgcccaggctggagtgcaatggcccgatctcggctcactgcaacctccacctcccgggttcaagcaattctcctgcctcagcctcccgagtagctgggattataggcgcctgctatcacgcctggctaatttttgtatttttagtagagacagggtttcaccatattggccaggctggtctgttggtcagggtggtcttgaactcctgacctcatgagccacccgcctcagcctcccaaaatgctgggattacagccatgagccaccaggcctggcctggaaactgttttcaaataggtgttcttcatatgccatctagagtaattctcatatgcaggaggactgaaggagacagcagtctcgttcagtcctcacagcaggtagacaccagctgatcccacttttctttgaggaaactgggatttaagttatataacttgtccaaggtcactgagctagtatgtctggagctgaagtttgaatgaagtttatctgactctaaagccagtagtattgttagccactttctttcaggttttgtaatttctaagagccttctttcccattcagttcaataaaaatttaagtgtcagaacttaaattcagtagaaaattctacagaatatatgatatattccttagactctttttttttttttttttttgagacaaggtctcactctgtcatccaggctgaagtgcagtggcatgatcatggctcagtgtagcctcgacctcctgagctcaggtgatcctcccacctcagcctcccaggtagctgggactataggagtgtgctaccatgcctagctaatttttaaattctttgtttgttatgttgcccaggctggtctcgaactcctgggctcaggtgatccacccgccttggcctcccacagtgctgagattacagacgtgagccaccataccctgccagattgttttaatatatagaagataatttaacattttcttggtgaggtagtgtcattattttagacctaatttattatattgtgctataaatgtgttataacagttacccatgaagatggatgttattttttttatgcatgagaagaaatggtggctcaaataacttaagtaaattttccatttatatagatagcagttagtgaagctgttatttgattctaattcttctaatttgaaattaagtggtttaggtgccactcagtgttaaattctaatttatagctattaattaataagaagacatctccctgctcccacaccagtacttaccattcccttctctccagactaatgtttcctactgagtcagtaagctgttgaggtctactgaggtttgtttggcgcttcaggtggtttggtgctcctaatctctcagggtattagggtgagggctgagctggtgttataaaaacaaaacaaaacaaaaaacctccaccacttaactccccctccctcccagtgcaatggctcatacaagaagcactttctttctttcttacttaatccaaatccaggatgtgaaaggcagggtctgctttaggaagtcatcattggatttcagctagcagagcagtcattctgtctgaaacacatggtttccaaagctgcctcaattgtagccattttcagccagtaaaaggggaaacagtgaatccagggcaaggaccttttaggcaagtgaagccgaagatgcaaacatcacttgtgctcacatttcataggtgagaacttaataaggtccctgctaactgccaacgaggcagggaattttagtctaatggacagtcgtgtgcaagaagaatggcagtgtatttttggtggtacacaaacaaaaatctgtcatacctagtatatgcggtggagacatctaccctactcaaggcaagttgtattgttggtagctgcttgcccttattcacaggtgaagcatagatgtgctggtcagtatttggtttttgtcctctacctcttgaagtacaaagttattttatccttggtccctgtctctgagttcagttgctccctttttacaatggttattattttctttcttaactttatgttgcctgtcatttctctgtgtcacttcctgtcctttgtaaacatttccaataatcagaatagttcctctctatactctagtgagtcgttcaccttagtgagaacatgtaattttagaatttttagttctttataattggtttgttgctgggcgttggaggtaactttgctgctaaataattttatttttctattgagagttagagacccattgtagaaaccaaaatcttgtttccagagagctagttttacaataaagaaagatatttatcttcctagactggagagtgatttgtaagagatttaggaggagagtgagaaaaaggcagtgccacagacactggggacgtgggggtggagagtttcaagatggaggaagtgttcaatgataccagatgcctcagagaggtcaaagaagatacgggctgcaaggcaggttgttagtggcattaagggaggttttcatggagtagtgtggcaagatgcctgattttgctggattgaagagtaaatcggagggtgaaggcgttgagaataggctagattcgtttcaagaagtttgaccaattagggaaaggaggagagggggtgatagcaagaggaggaagagagagtttattgtttttagtttttagatgggagaaacttgagtatgtttttaggctgaagggaaaggaaccattgtacagggagagagggaagatccaagggaaggaaaggatgatgaatacttgatggaacatttttagaagtacgaggaaatttaggatcaaaggcagaggtgcaaggctattttgaagttgggagtcaggaccatatttatccagaaggcactgtttgtgtggtgcctaaccaacaaactgttatgggatctttgaaaatatttgagacctaaaaaaaaatttatcaaccctaaagtatggatatatgttttattatatatgtataaaacaatataatgtcaactttcattattacatgtaatattgacagacattttgccatatttgaaagcaattcataagtaagaattttctcaattaggaagaattcccaagtgagaaatcaggtcttaaggtgatcttaaaaccgcttcacatggcgtaattaaatttgaacaacagaggtgggaagtaagggtgatgaaggacatggttaaacttagaaatggagctagaaattggtgttctttacctgatgacctcttctttgtctgaagtaagaatcaagattatcttcttagagttagggaagcagaagtaaaaggcttgaggagagcaaagaaagtttgtattagctactgggggaaagaagaaagatagctcgactagggccaagtacaagtattctgagctacattaaagcatgtgaagtaaggctgcataaatcattttaaaaaaagaagtaactaagaatgctaacaggagcaaagttgactatgggaattggtaaaagaaaaaatacaaaagcattacaaaataataattagaagaaacagttgaaaaactcttttaggaaaacatgatgtcacaaataatgcataagaagagggaggattcggctggatgcagtagcttatgcctataatcctagcacgttgggaggctgaggctggtggatcacttgaggtcaggagttcgagaccagcctggccaatgtggtgaaaccccatttctactaaaaatacaaaatttggttgggtatggtggcaggtgcctataattccggctaccctggaggctgaggcaggagaatcgcttgaaccctggaggcagaggtggcagtgagccgagatcgtaccactgcacttcagcctgggcgacacagtgagactctgttttgaaaaaataaataaataaataaaaaataaaataaaaaagaagagggagaatccagagagcgcaaaattccacttcttccattgaagaaagttcaaagaattgctggatttaaagtttttgatgtttatgtttcttaactacagaattttaaaaatcaaatgggtctataagagttataacaaaaaaaagcagtaccctacaccataaccttctcaccccgaagtctcactcctcagaggaggccattttctttcttttttttttttttgagtaccagtaagtctttatttattcattgtattttcccagggaaaggagaagggaagggaagagtcagcatgtgttaaaaaatgatgagaaaatgggaaaggaagtacccagtacagcaaaatcaaccgtcaaataaacacaccccagtgatggggtcaccaaagcccaaaggggctcagtctcctgcagttcaggaatgagggaaaaggatcaggaaaaaaacagacaggtacaggctttcctaccctccctccccataaattcaagattttacacaaagctttggtttctagcagtaaacatggagttacattcattcatctcctattaaacaatcttgtggccactttgacataagtttctaccacctgcataaaagttcctgagtgacttggatatacattcatattccctttcttggcctcctgaccccactttctacatggaaggcccccaattgcatctctttactttaggattagaaattaaaagtaagtaggtttgatccatccaaaatacagtagtgtggttttttttttgttgtttttttgttttttttttttcgagacagggtcttgctctgtaaccaggctggagtgcagtggtgcgatctcagctcactgcaacctccgccttccaggttaaagcgattcccccgcctcagcctcctgaatagccgggaccacaggtatgcgccaccacacctggctaatttttttgtatttcagcagagacggggtttcaccgtgttggccaggatggttttgaactcctgaccttgtgattcgcccgcctcagccttccaaagtgctgggactacaggtgtgagccactgcgcccaggctacagcagtgtcttaagtgtttggcatgaatacatgaagaaatggtcggcctagcgtggtggctcatgcctgcaatcctagtaccctgggaagccaaggtgggcagatcacctgaggtcaggagttccagaccagcctggacaacacggtgaaaccccgtctctactaaaaataaaaaaattagctgggcgcggcgggtgcctgaaatcccagctactcaggaggctgaggcaggagaatcgcccgaacccaagaggcagaggctgcagtgagccgatcatgccactgcactccagcctgggcgacagagcgagactccatccacccccccccccccaccaaaaaaagaaagaaatggtaatggtcttgacttaggaggttgggaacaagggatggagggttttcctagcttcaggatttttgcatacatcatttaagagttgtggagacactccaagcattaaatgtgtatgtgtgtgggtgtgtaagttttcttttgggggtgaacagaaaagagggcagggtagaagacaagtttttaggacagaagatctggtctaataggtaataggggaaggggaatacaaaagaaaggatggttcaagatccccactttaagaagcgggccccccaaactaatgtttcagatctttttgcctggtgcagaaacttctgtcaaagatgctttggctatttttctctcaatacaaaaagaactttgtaaacaaaacccccaaagaacacggaggaagaccaatacattatatttacacaaactaggccacctagcaatcaacttagtgaagtcctacaaagcccagacaaatacagtaacttggggggcagcatttaggggagacaagaacccaggatcagacacacaccacccaatgcgttctattgtatttgtcccgtttcaacacagtgaggtaggtttgcggtgatctcacagcatgtaaacgaaaccccctttttcgaggaggccattttcaaatttttcagcattaaaaacaatttttttttgctgtgtactttaaaataacatgcttaaattgctcttcttgatttttcagttttagatattatttaatgactttatattatagaagatgaggatttaggtctcttatactactcaatttcccttcttcctagtcttccaacaaaattattataatttttggttaaatcaatattcagtgtttattatgactgtgaaaattatacatatgtatgcacgtatacatagtatatatgtatatatatatacacacagtatacaacatatatatgtaaaatatatataatatagtatactatgattacatttctcctttttgaacattttttttcattttcctgcaattaataattgcctttccttttgtgcatggttttcgatgaacttgtgccccagactttatagcctaaggtcagttcaaacacatcaggcatcctctcagtttcaatttcttttcttcaaggtaacttttctgaagtacttcttcatctaactggtccccctgcttcagtctggcctggttgctctctaaatccttcatctttatcatgggtattacttcattcttcatccttacatggatattacttgtcttgcttaagtaagttttagtgcatatttcctaaagcctatgtcttcctttttccttacatgttccttctttttattagattgcatcctctagtagctttctgagaaagggtgcatgcaaagtaatattttagggaatcttctgtttatgaaaatgactttatactacccttacccttgattgatagtttagatacatataaaattctgtgttggagataattttcccttagaatttttaaagcatttctcccctatcttttagctttctgtattgctattgagtgatctaatgccattctgatttgtgatatttcatgtagttttacattggtgtggatcttctttcattgtcttgagatcctttcagtgtagaaattcatgtatatcagttctgagaagttttcttgaattatgtgtttaatattgtctcatctctgttctatctctggaactgttgttacttagacattggacttatggatttatgctctaatttttcttgttttctcttttctgtcttttttgatttttgtatgttatatgaatatccttaacctttccaatccttttgttgaatatcaaaaatatctattgtattagccagagttccccagaaaaactgaactaataggatatgtaaagacctagatacatagctatatagatatacagctgacccttgaacaacatggatttgaattgtgtgatccacttatacacagattttctttgccacctctgagacagtaagatcaaccccctccatttctacctcctcagcctattcagtgtgaaaacaacgatgaagacctttataatgaatgatctacttccacttaatgaatagtaaatatattttctccttgtgattttcttttttttaaattttaaattattattattgtagagatgggatcttgctttgttgtccaggctggtcttgaactcctggcttcaagtgattctcctgccttggcctcccacagtgttgggattacaggcatgagccaccacgcctggccccataattttcttaacattttcttttccctagcttactttattgtaagaatacagtatataatacatatacaaaatatgtgctaattgactgtttatgttattggtaacgctgtcagtcaaatattggctattaatagttatgttttgggggagtccaaagttatatgtggatattttttcttttctttttatagagatagagtctcgctatattgtccaggctggtcttgaactcctgggttcaagcattcctccctccttgaagtcccaatgtgctggggttacaagtgtgagccactatacccaggccccactttgttaaagggtcagctgtatagatttattatgggaattggctgacatgactatggaggctgagaagtcccaccatttgtgcctgcaaggtagagaaccaggaaagccagtggtgtagttccgtctgagttcataggcttgagaaggtagggtgaggaggagcagtgtgctggtataagttccagagtctgaaagcctgagaaccagaagccttggtgtcccagggcaagatgagagggagaatttgcctttcccctctgccttttgttctgcgtgggccctcattgggttagatggtgcccacccacattggtgaaggtgaatcttctttattcaatctactcattcaaatgctagtctctgccagaaagtctatcacaaacacaaccagaaatgatgttttaccagctatctgggcatcccttagcccaatcaagttgacataaaaaaattcaattatggtagatttgatgatttaaatttctactccatttaaaaaagtttgttgaattcctaaatataagatttaatcttgcctttctgagaatattaattgtagagtttcttttttgttgttgttttattggtttttttttttgcatgtgaatgtcgtctacattttctttttctcctgagttctttttttctagtttttaaatgtgtttttcatatacagacttttctcaagtttttgaagctacttgtttaggaaagggtcttacagatcaatatatagagttttatgtaatattcctgtttttagtagggcacctctgtcttcaaactattcttggtgttcccaagttcaacatccttctgattcaacttctcaatagagaataaacctttaattttaaacctgggtggaggaggagtagtaactttactatgtaaggttgggaagaggatctagaaatataactgcttcttatgtagacttttaacccaattttccatttttacctttacttactcccacggctttagaggtgcctgatacctactgttcctaagcctttctgatgttgtataagagggtgtgcttgttttttgttctcttttctcagtatagccacttaagttttagctttttttctgttcatacaataagttgtgtgtctaatttccattttccaaaatttttaacatttcttatctgctgccatcttaacttcaactctatttttataaatctatgtcttcttttatttagatatgcttagcacaccaattcagtggggtttaaataatttttttttttttttttttgagatggagtctttctctgtaacccaggctggaatgcaatggtgcgatttcggctcactgcaacctccacctcccaggttcaagcaattcttctgccttagcttcccgagtagctgggattacaggcacatgccaccatacctggctaatttttgtatttttagtagagacagcgtttcaccatgctggccaggctggtctcgaacacccaacttcaggcaatctgcctaacttggctttccaaagtgctgggattataggcgtgagccactgcactgggcctaaataattttttgaaagacacagagtctcaatatattgcccaggctgatcttgaactcctgggctcaagtgattctcttgcctcagtttcctgtgtaggtgagattttttagtatactatgcatgacgccacaatgcctggcattttttagtgtactcacaaggttatgtaactaccaccatgatataattgcagaacatttttatcaacccataaagaaacttcataccaattagcagccactcccattttactttccccgcaacccctggcaaccactaatctaatttttgtctctatgaatttgcttattctagatattgcatacaaatgataattattatacaatatggggtttattgtgtctggcttctttcacttagcataatgtttttaagattcatcgatgtttgctgggcgcggtggctaacccagcactttgggaggccgaggtgggtaaatgacctgaggtcaggagttcgagaccagcctggccaacatggtgaaaccccgtctctactaaaaatacaaaaaattagccaggcatggtggcgggtgcctgtaatctcagcaactcaggagtctgaggcaggagaactgcttgaatccagtaggcagaggttgcagtgagccaagatcgtgccactgcactccagcctgggcaacaagagcgaaactctgtctcaaaaaaaagaaaaaaaaaaagattcatcaattgttgtagggtatttcagcacttcattcctgttgtggctaaataatgtttgattgtatgggtacatcacattttgtttattcattcatcacttgatggacctttggattattttcactacttggattttatgaaaatactgctgtgaacatctgtatacaagtttttgttcgaacaccttttttcatttcttttaagcatatacctaggcgtggaatttctaggtcatttggtaactctatgtttaactttttaaaggattgccaaactttttcaaagcagctgctccattttacccaccagcagtatatgagggttctaatttctccatatcctttccaacacttgttgttgttgccttttttattatagccatcctagtgcatgtgaagtagtatctcattgtgggtttgttttgcatttccctaatgattaatgatgttgagtgtcttttcatgtgtttttggccaagggtttgtcttcttggagaaatgtctactcaaatcttttgcctctttttaattgggttgaggttaagatggcagtttagatctggactgttgaattgtaacagtctttacatattctggatactagacccttatagatatatgatttgcaaatattttctcccatcttgtgggttgtctttttactttcttggtagtgtcctttggagtacagtttttaattttgatgaagtccaatttattttttctttggatatttatgctttaggtgttatatctaagaaatggttacctaaaccaagttcacaaaactttgtacctattttttattctaagagttttatagtattagcttttacatttaggtttttgatccattttaaaatggcttgaggtaggagtcaaaaatcatttttttacatatgagtatccagttgtcccagcaccatttaaaaaaaagactgttctttccccattgagtgtttttggcactgtattagtccattctcacactgctaataaagacatacccaagactggataatttataaaggaaaaaggtttaattgattcacagttcagcatggctggggaggcctcaggaagtttacaatcatggcagaagaggaagcaaacacgtccttcacatgataggagcaaggagaagtgctgagcaaaagggggaaaagtcccttataaaaccatcagatcttgtgagaagtctctcactatcacaagaacagcatggaggtaatcacccccatgattcagttaccccactgggtcccttccatgacacgtggggattatgggaactacagttcaagatgagatttgggtggggacacagccaagccatatcaggcacttacgtcaaaaatcaatttgctataaaatataagggtttatttatagactctcaattatatttcattggtttctatgtctgccttatgccagtaccacacagtcttggttactgtagctttgaataagttttgaaattgggaatgtgaatcctacaaatttgttcttctttttcgagattgttttggttattctgggtcttttgcatttccttatgaattttaggatcagcttgtcagtttctctccaaaaagccagctgggattttgatagggattgtattgatattgtaggtcagtttgtggagtgtgccatttaacaatattaagtctaacaacctacgaacatggagtgtctttcctattatttaggcctttaatttctttcaacaatgttctatagttttcattgtataagtcttatacttctttgttaaatgtgttcttaagtatttcatttttatattatcatagttagcactgttttctctatttcacctttgaattgttcattgctcatatatagaaatatagtgccagcctgggcaacatggcgaaaccccatctctactaaaaatacaaaaaattacctgggcttgatggtgctcacctgtagtcccagctattcaggaagctaaggtgggagaatcacctgaacctaggaagctgaggctgcagggagccgtgttcacattactgcactccagcctgggcaacgggagtgagaccctgtccaaaaaggaaaaatgatcttgtatctttcaacattgctgaactagtatattagctctaatagtttcttagatttcttaggattttttataccagataatgtcatctccaagtagagatcattttacgtcatcctttccaatctggatgcttttattttttttttcttgcctaattgtgctggttagaacctgcagtagaatattgagtagaattggcaaaagtggacatctttgtgttgttactgataggaggaaagcacattttgtcttttgccatcaagtacaatgttaactgggggagttttgtagatattctttatcaggttgaggaagttcccttttattcctagtttgtttagttttagttttagctttttttttttttttcatgaaaggatgttagactttgtcaagtagtttttccacatctattgagatgatcaagtagtagggtttaagtctttttaaaatcccttcagtgatattttagcagaggttttggagggaaaaaaagaaaacacatttaagctgatacatttaactgcaagatacaaagagattttaaaaaagatattaggggccgggcgcgagaaggcctggatgggcagaccatatgaggccaggagttcgagaccagcctggccaacatggtgaaacccgtctatactaaaaatacaaaaaaaattagctgggtgtggtgcacacacctgtaatcccagctactccggaggctgaggcatgagaatcgtttgaaccctggagataaaggttgcagtgagctgagatcacgccattgcactccatcctgggcaacagagtgagactctgtatcaaaaaaaaaaaaaaaagatattagaaactaatgtagtttgtttgaagttggtcatagctagaccaactagctatgaccaattactagaccatagctagaccatagtttaagaaatttggaaatttagaaaagataactgcttgatcatgctaaaacacctaattcattatttttaaatgtataattaaaataataaataacaacctattatccctcaaagaaaaaggaaaagtataggtttttattcgatgactcagcagttttctatctggtctcgttaccttcaattctttctctttatttctatcagagctatctttctaaaacctaaactggatctggttaaaatctttcactaactccccatgttagcatggcatacaaaccttgtgatatggcagcttttttccctccgtctagcacaattcttccatcaaactgttttctctagctatgctgaacaatgtacagttccagaattcacagtgtcttctctctctctctcttttttttttttttgaaatggagtctcgctctgtcacccaggctggagtgcagtgacgcgatttcggctcactggaagctccgcctcccgggttcacgccattctcctgccttagcctcccgagtagctgggactataggcgcccgcctccacgcctgactaatattttgtatttttagtagagacggggtttcactgtgttagccaggatggtcttgatctcctgacctcgtgatccgcccgcctcggccccccagagtgctgggattacaggcgtgagccaccgcgcctggcccacagtgctttctcttatctctgggccttaatacggactgttttgtttacttagaactgtaattctcaaactttttggtttcaggatctctttacacttttaaaaataattgaggatttcattgagctttaggtaggatatatctatcaaattgttactgaaactctaggggtttggtataggtcccattgcttgcccctcagaaagctgatcactgagactacgagtattgccagggaacaaggctttaatcgggtgctgaagctgaggacatgggagatcagtcccaaattcatctcccgggactgactaaaattgggggtttctatagcagggaagaaacgtaaccatgtgtgggaaaacaggaattagggagggctaaggaaaaggaattggttagtaggaagcagatggttggacaggtaatcatgacaggtgagtgcacaaattttaagactgggggggtcgatttctatgtttattcaaagaaaccataaacatcagttctatgggacaagtggactactttcaaaatactttcaaaatgttactatatttgaatttaaaacagaaaatttaaacattaattcatttaaaataacaataatcagcctatagcatattaacacaaacagcttttttttttttatttttttttggagacagagtctggctctgtcgctcgggctggaatgcagtggtgcaatctcgggtaactctacctcctcctcccgggttcaagcgattcttcttcctcagcctcctgagtagctgggattacaggcatgcaccaccacgcccagctaatttttgtatttttagtagagatggggttttgccatgttggtcaggctggtcttgaactcctgacctaaagtgatctgcccgcctgggcctcccaaagtgttaggattacaggcatgagccaccgtgcctggcctaaagagcatttttattaaaaatattttctaaaaaccaaaataattagtgacaatagtagcattgttttacacttttgcatatctttttaatctctagcttagtaatagaagacagatgaattctcatatttgcttttgcattcagactgttacaaaatgttgctttagttgaagaatatgaaggaagtctatccttacacagatacgtagttcaaaaaacaggaatattttaaattgccttttcaggtatttatttcaccaaaactagagaaatagtagtttcttacaggttagttgcattgtgaaatctaaaactacatcagtgaacttttcagagtcttttatattaaagttcacaggtctatgtgcactacgaaaggacattttaccctcgtatgatttatgcagaaaatggtgcttcacttaagtatagcaggtcttccaaatgtgtatttcatgatacagtatcaaaagatcacgttcattaatatcaccacagatcttatcagaaaagtcttttttttgtttgtttgtttgagatggaatcttgctgtgtcaccaggctggagttcagtggcgtgatcttggctcactgcaacctctacctcccgggttcaagtgattctcctgcctcagcctcccaagtagctgggactacagacgtgcgccaccatgcccagctaatttttgtatttttagtagagacggggtttcaccatgttggccaggatggtctcgatctcttgacctcgtgatctgcctgcctcggcctcccaaagtgttgggattacaggcgtgagccaccgcgcctggcccagaaaagtctttaagaatcgagaagctctcaggctcatggatgaagtatgttttcctcctttttttcccatactgcacagatgtagagttttccaaaattttaatttttcatgtgaaagcttgactttttatcactgataacaaatactatcacttgttttccttgaagtaacaggctcattttgttcatttttgagaaaatttctgccaaatacccaagtctgaacaaccaggatttgtgcattagttctttcaagtaaaaatggtgttttataaaaaaaaaacagctagttgagcttgcatgtcaaataatcttccagtgcttttctttaagacaactttcatgcttttgcagaaattttttatgcatactttctagtttgtacatagaatattaaaaaggcatgtacttatggggcaaggggtaagatttaatgaaattaatatttactgtatcttcaagaatatttgtaagtgaaactggctgtattagtcagcttgggctgtcataacaaaatatgcaaactggggtggcttaaacaactgttttctcgcagttctggaggctcagaagtccaagatcaaggtgctggccaatttggctcctggtgagggctcccttcccttccagatttttgccttctcggggtgaccttatatggctgggagagacagactctatggtgtcttttgaagagcaaacatttaaaattttgataaagtgtaacatcaaattttttctttaatagctcatatattttatgtcatatttaggaaatttttacctaacccagggtcactaagattatctcctatattttcttctggaagttttatagttttagctcttacatttaggtctatggcccattctgagttaatgagttaatttttctaatggtgtgaggaaaggttcatttttttgtatatgagttgtatatgaatatcgaagtattccagcaccatttattaaaaagattatattttctccaatgaattgccttgccaccttgttgaaaatgaattggccatgtatgtgcatatttctagattcttatattccatcattgtatatatgtatctttatgctaatatcacactgtcttaatgactgtagctttaccataaatcttaaaatcaggtagagtaagtcctccaacttagtttttctttttcaaagttgttttcgctatttcatgtttcttcatagctatgtgatcttgggcaggttacttgtcttctctgtgcttagtttccagatttgtaaaatgaagaataatattagactcttaggaggattaaatgaataaaactcttacaactgtgcccggcacataggaagaactccataaatattagctaatcttagtaattttgggtatatttaatgaggtaaatattggatttatccttaatcctggcaaaaaataatcttaaaataggaaactatattattatttataactatattattatatattattattaactatattattatcgagacaacatttcaacaaatttagttcaaatatcaaattaacttttattaatgattcatgaacagggcagtatctcctctaaaaatttagaaaaggggctccggtgagctgagtggaggagattggctttataggtagggaagggcggaagaaagcagaaacaagaaactgaagcagattggttgttttgaagttactttccttgtagggtcagaacagaggagacttcttttcatgctggctgaaactggcccatttggagatttggctgttatctctcttgacttctcagaaggtcagataactgacttagttttagtttggtgacctggagctttagcctgagtgactccattttggtttagtctactggggcctagcgcaggaactcagttgaaatcaaaggccttctataaattttatttaacactattttaagatacaagcaaaaatgtaaacatccctcaatacaattctagcaaatggcataaatatatatatatttaattaatatatataatatataattatatataatatttaatatatttaaataatatatttaatatattattaaaataaatatatatacatatatatgtttatcccagaaatagaccagtcttatctataatattatttataagaaaatgataactggaattacccataggagcacattagtagacattcaaagccttttgataaaattatctaattttttttagtatctaatcttgatcacccccccgaacaattaaaaatagagtgtttctgctgggcgcagtggctcacagctgtaatcccagcactttgggcggctgaggcaggtggatcacgaggtcaggagttcgagaccagcctgaccaacatggtgacaccccgtctctactaaaaatacaaaaattagccgggtgtgatggtgtgtgcctgtaatcccagctactcaggaggctgaggcaggagaatcgcttgaacccggggggcggaggttgcagtgagccgagatcgtgccactgcattccagcctgggcaacagagtgagattctgtctcaataataataataaaaaaaagagtgtttctaacttttgttaatgtcttcatttacaaccaagagaagcattagggttatatttcttgaaaaataagaaaaagaaacactgttcttaggcctctagaatcctctagaaccactgttcgtttttatactattggatattcttgtcttacagaaagaccagatctgaacattttttttaaaaagatgaatataggtccccatgactcccacggcaacactgagtggccttgttctacctggctcactttgctaatacagtggggttttttttctttctcttctgtccttatgtgtaaggcagaatacaagggcctgaagcccccgcccctcctgcatttgacaacagggttggacattgtgtattgagtttttttgtttacattgttctgattaaagtatgcaaaataaaaagatgcagttttatataacagaagatggatatagaaacattataaatggtaaaagcttttataattgtttgctgatgagaatatgaaatgatatattttggaaaattgtttggcagtatataaagctgaacctatgtataccctgtgacccagttattcacttctaggcacagaaacaagggaagtgtggacatatgtttaccaaaaaactcatactagaatgctcgtagtggcactattcataataggtccagattatgggaaactggaactaaagaaaacaaatgccgtcaacagtggaactgataaataaattgtggtatattcaacaatggactgttattctgtaatgagattgaacaatgggatattatgctgcaatgagaattaatgaacagttacccacagctatatggataaaccccacaaacataatgtttttttttgagacagggtctcactctgtcacccaggctagagtgcagtggcatgatctcagctgactgcaacctccgcctcctgggttcaagcgattctcatgcctcagcctcccaagtagcagggattacaggtgcacttcaccacacccgactaatttttttgtatttttagtacagacatggtttcgccatgttggccaggatgcacaaacataatgttgagtgaaagaagccagaggcaaaagactgcatactataatagactatatagatagtttatatatgtatacacacatacatatataaaacaggcacaatttaccattgaggggttagggactagacagtggctgtaggatgttttctagggtgctgattataagtataaatttacatttttctgtatattattatatttaaatagaaagttgtaaaaaatgtttggtagtaaatttctaacttaaaactaagcaaatgatacacaattgagatcccggaaatagatgccaaagaacaaatctatttaatctgtgacaaactaagtgtaacaaagtaagcatggcacatgtatacatatgtaactaacctgcacattgtgcacatgtaccctaaaactttataataataataaataaataaataaataaataaataaaattcattaattgagataactagatttcaatatggcaaaaataaatttaggttcatgcctcataccatatggtacattgaattgtagtttgaattaaaatattaataaaatattaatgtattttttataactaaagtataattatggctgagataattttacatataaaaattgatatagatctgtaagggcagattgatgcataaatagatgttggtttttaaaatttgtgtacaacaaataacacagataaaaggaaaatgacagaataaggacgattatgatgaatatgatgaataaagcttaatatgatatgtacagaaaataaatgacacaaatttatgttacagtcctgtcaagcagtcaaaggaaatgatttaagagtttgttcatgtgcaacattcttcataaaggtgaaaaattagaatcaatccacatgcccatcaataagggaacaattaataaattatggtatttctatgatagatactacgatgtagccattacaaagaattagatttgttaatatggaaagatgtacatgaagtattaagtgaaaaaatgagttgtagaataaagtacatatgtatagtgtcattacacttttctacaaaacaagttaatgcaacatttgtcaacaagtatatggtcacatgtagtgtaagttatggaaggtatagatcaaactgttagcagtgaatactctggggaattggcataagagggcgcttatcctgtttttacttcacaccctcctgtattgttctgtttcattgatgtgtgcttttacaattaaaaattttaaactatatataaaggagaaaggtaagttaactaaatattcacatttaccaataaataaaccactggaaataagatacttttgagttagttaaaacacagaactttatattgggacatctgcaaggaaattggtctcttccgtttcttggatgtaatataatctggtgtaatctttctggaaagtaatctgacaatacataacaggagccataaaaatgagcatatcttttgatcctagagccttacttctgggaatataccctaaggaagtaactcaaaagagaaaagaaatttgcttgtgcaaatatatttatagccacattattttaagcagaaaactgaaaataatccaaaaagaattctgtatttaagcaatattttaaaatgcagtaatacattgatcttctaattttttttttttaagtattgctgggtgcagtggctcacgccagtaatctcaaccctttgggaggccaaggcaggaggatcgcttgagcctaggagtttgagaccaccctgggcaacacagtgagaccctgtctctgcaaaaactttttaaaaattaggcaggtgtggtggtgtggcacttgtggtcctagctacttgggaggctgagataggagaatagtgagagcctgggaggttgaggctgcagtgagccgtgattgtgccactgcacttcagcaagcaacacagcgagaccttgtctcaaaaagaaaaaagctaggtgacctaataagattgccatcagcttcatccttttataatgtcaaaaaaatgaaattaaaagtaaagtttcttttatcttttccctatagtaccattcaaattcttctgctcagtttaacatttttcttcaacttggtccctctaacaagactttttactgggtcattttgttttggaaagacaaagtatgaatttagagaagtagaagagagtatagtaattttttctccttatctatttatagtaaacattatagaagcaaaatatttacttacacttaatcaggtttccaaattgtcctggagagtagaatatcctcctccatgatctagtgaggaggttaagttggaggttaaataccttgcataataccccaaagagataggacagggattagagaccaggtcttatataatgagacccccttgctagggttgttgagcattggtgcctgtctgtgggatggcagtgcagggctgggatcaattctctgtttaagagcaagtctgaaggtcagttctttcctttttgagctgggctatttgagcggtacagtgtacactttctgaagagatttctggaagcaattgcagaagtttcttatacagggtagaatctgacctaagctgtccaaagagaaatggcccttagagagaagttgtgcttcccctttgctacctcatattttatgtgctgcctctcatttgttccttttcctctctagttcaaaatgcaggatctgagaaggagacggagctgtcatcagttctaaacctgaacagaatgtttcctcagttagtaaatggaaaaattattttaaaaaatcttcatgtatgtttgtgaaataccaagacattgatttgtggtctagtttgcaatcatgataattatattaattagtaccaatcatgatcattttaaactttctgaatttctctatcctaattctgtgattcagtggaaaatatttatactcaagagattaaggttcaattttctgccctaccacttaacaactgtgtgaccttgggcagtttcttcactggtaatatggagataataatcccagccttatctgactcctaggtttgttgtaaggttcaatgagataatgtatgtgaaagtattcggtaaactttcaagagcaatacaaatgtttttgttgaagttatgaaagtcattaccctgtttaaaacacagtaagcactgaagatgtcagtacgtctcttaagattctaaaatagtgtcaagaaatgttctatcctatcctagcatgcgctaacctaggtctgtgaataggccaaggagccctctccttggttgattggttgcttgccagatatattagtttgatctcttcatttatactttctggaaaatatatggatgctttatgttaggtttgtctgcatacaacagagaaacctaaaataccgtggtttaaacaagatagaagattatttctctttcatggaaaacaagtctgaaaataggcagtccacagctggtagagtatactccagggtttcatcaggactcaagcatatatttttctgtgccaacatcctcaccatagaatccattctttacctcatgacccatgaggactgaaggaactcctttttatccattgggataaataaaggatatctcaactgaatcagtcccatttaagtactttctagaaaatccacacagtattttgcttacattttataactgagtcacatgactaaagactagctacaagagaagctgagaaatataatctttatgccagtgaccatgaacccaggtatgtatactggagggtgtatgtgtgtgtgtgtgtgtgtctgtgtgtgtctgtgtgtctgtgtgtgttgaagagggtaatttataaccaaaaacattcatatttttatataatgctgtggcagagacttcaagttgcaaacttcaatggcttcttcttccttagaaacgtacttgcagttttggccagtcatggtggctcacacctgtaatcccagtgctttgggaaactgaggtgggaagattgcttgaggctggaagtttgagactaccctgggcaacatagcaagaccctgtctctaccaaaaaacaaaaacaaaaaattaaactgggtttggtggtgcacacctgtagtcccagctactccagggggctgaggcaggaggattccttgagcccagctgtggaggttgcgatgagctatgattgcaccacactgcactccactgtgggcaacagagcaagaccttgtctcaaaaatgaaacaggcctggcgcagtggctcacgcctgtaatcccagcactttggaaggccgaggcgggcagatcgcttgaggtcaagagttcgagaccagcctgtccaagatggtgcaaccccgtctctactaaaaatacaaaaattatccaggcgtggtgccaggcgcctgtaatcccagctacttgggaggctgaggcaggagaatcacttgaatctgggagcagaggttgcagtgagcagagaccttgccattgcactccagcctgggcaaaagagcgagactctgtctcaaaaaaaaaaaaaaaagaaagaaaaagaaacaggccaggcatggtgactaacacctgtaatcccagcactttgggaggccgaggtgggtggttcacttgagatcaggagtttgagaccagcctggccaacatggtgaaaccccatctataccaaaaaacaaaacaaaacaaaacaaaaattagctgggtgtggtggtgtgcacctgtagtcccagctacttgggaggctgaggtgggaggctcgcttgaacctgggaggtagaggttgcagtgagctgagatcatgccactgcattccagtctgggtgacagagtgagactctatctcaaaacacacacacacacacacacacacacacacacacacacacacacacaatactccaatttttacctggagattcgagaaattagggaagaaaccaaagaaaatatatttccttataaaataaatattaaaataaagaaaaaaaagtctgggtgcagtggctcacacctgtaatcccagcactttggggaggctgaggcaggaggattgcttgagcccaggagtttgacaccagccatagtgagaccctgtctctacaaaaaaatttaaaagttagccaggcatggtggtgcacacttgtaatcccagctgctcaggaggctgagataggaggattgcttgaacctgggaggtcaaggctgcagtgagccatgatcacaccactgcactccagcctgggcgacagagcatgaccctctctcaaaaaaattttaaaagttagaaaatatatttctatagtgcaataacaaagtgatttgtgcagggaaaactaaaaattctggagacattttttaagctcagcagtatttgcataaagaaatatttataatgtgaaaacaaagtacttcatttaattttgaaagatgtattaagcaaaaaaggaaagaaaaatgagaggaaaaatgctagaaatacagggggtacattggtttaatttgaaccctcttatgtatatgtatctttagctccttttactttagcttttctcgtctctttggaaatgaaaatattcagttgttgccatgattttgcttgctttgtacaaatgaaatgttggctttatggttatagacagaaatatggaaaactttagagctactttgagcaagcccaagaactttgaatcattgaatcaagaggagaaaaaatgaagaaaatatttcaagttctttatctgtaaaatgatggagataaacaatatgatctgaaagtctttcaacttcttaagtttttataattcaggagcagtggtaagaatagtaatgaagtttctaactactacttccaagttaagtacaatccagagaggccagtgggacagaatctgtgggacgatgtgggaggacttaagtgattttaagtcctggtgaagaggaatagtgtgttcaatggaaattgaggaagacaaggacttttcaggtcagggggcttaatgggtcatcattgtgtttgttacagagttttaggagagtggtggagaaaaagatggagaaaaagaaaatggactatgtgctcctaggaagagagatgtgattgttttctaacatgtaggcaatgaaccctcagaggaactatagatgagcattagggtgttcttgaatgctctaaaattatatgcaacatattatattcgtttttctgtgagaaagcatttgtagctttaatcagattcttattgtaagctaacaaagccacttgctcttaaaaatgaataataaagactttaaatgattaaaaacagaaaaagtgacacttcagtggtcctgcagtgggtgaatatagtcattgtgatattttcagagtaagctaggtttcagtcacacacacacacacacacacacacacacagtacacacacacacacaatgagagaaatgtatagaatcgtggggaatttgctgtacagttttgggttttggcttgctattattagctgcaccttgggcatgttacagaacctccctaagcttcaatttcctctgctataaaataaggataaaagtaccttaaatggtggttgtgaaaattagagacaatgtaagttgagtacatagtacagtgcttggcacagaataggtatttggtaaccctttccccacatgagttttttaagtttctgtatttactttaaggcccttattgtatgcagtcatccatgagtatatgcagggggttagttccagggctctctgagtataccaaaatctgtgcatactcaagtcctgcagttggccctgtggaacccgaatctacgagaagttgaccctccctatacgtgtgttttgcttcctgagaatactgaagtttcgacctacatttggttggaaaaaaccctcacttttaagtggacccaagctattgaaatccgtattgttcaagggtcaatcgtatttcactttgaaggactggtcctcagcaagttcatcttctgaactactcagtgatgctcacactcaagaagaccatatcttattaagtggttagtttagaagctctttcccatgcagatttgcaagcggagtgtgtaaaaatcacacattgcacttgttgcctggcagcacgtgtccctgagtggtagtacatggcttgcattgtaatgttatcagtgctggggccagctggctagacatgtactgctacatgggctagggactccattcctcaacaaaacagcagccagcactagggttaacagaaaatgacaaaccaggaatggatgagggaggcgccagcacagcagcgggatgtcttttgatttgcttctgttatttgcatgtctctcttgtgatgtctgtgaaatgtttagaatgacaaagtttttaaaagacctgctgactccgcctgaaaaatgtgaaaaacctcccatttagagacctattatgtccagctagcctgcattttctatatctttttctttattttttattaatgcaaacatttgcatgaagacagaacctttgtttcttaaagagttcatctgctcctgctgcttactggccctgccatgcaagagcacaacagaacctttgttaggctttcagcaaagctgtttatgaacggtggcttactgaggactgcttcctgtgctgtgtgcttccattttgtctaaaaagaaaaaaagaaaatagttattaggagtaaaaagaatttggactttcttttattcaagtcctggatgttgaaatgacaagtagcccccaaatttgtgaggaactggtaattgcatcgaatgcattttttcgctttaccttgaacataatgaggctcttagtaacaatagaaggaacaagtgccttctcattggaatagagagaaggaacagtagtaaaaaggcaacagaaagagtagttgagaacaggacaaaagtggcttccagtaagaacactaacattgtaatagaatgtgttttgatatttagcgtttcccacctgggaggcacagtcctaaagtggttgagttgaataaagaacagcatcacagtttataaatagtggatacagtttgtatgttcattaagtaaatatttgaatgtctaccatgtgaaagacactgaatggtcctgagtgttaaaggaaataaaagataaatgagtcatggtgcctatctttaaggatcaggacatccaacaaagaagataacatacgcataacagaaataactgtgtatcaaggtagaaagtgccactggaaatatttaaaatagatgtttagggagtttgggaaaagggaagatcacttctggctgggacagaatcagggaaaggttcacaaagaaggtggcatttgagttgggcctggcagaaaaggtaggactgaacattgcaacattcctaaaagtgatgagtcaaaaattatgttgttctagtaaaacagatccaaagtatgtttttatagggtactttggtggtgtttttataccattaatttagatgatatgttaagtgttatgagttttctgtgtagactaaactggggcctctctgtctagtctatgttgttccaaccatttgccccatacggtttttgtgcactttggcctaggcctttttgtatctataaatatctacaatagcatcctttactttcataacaaaaatagaaactcaaagggattattgagcactattacagctatatcccataaacagtatgtggagatagttcttagtggggatttcacatgtgagactcttatttgaaaaagaatccccaccttcgtgcagagccacatcaaccacaagagagaggacagggaattctaagcccgtgagttttcagttactttaaattagaacttttctgtatctttttgtcattagaaaaaatgagatcctgttactgttagttcagttgtgaatgccaactaatttttatgtaatatttttaatgtaaaatgccaagcaaatgattaagctgttgtattagtatcttattgcattaatatcactattctgtatattcatagttaaattgcatattaccaattaatattaatctgtaaatttaatgataattgataaatacatggtttgcccccaaaggctatactttttcttttttttaaagagacaggagtcctactatgttggtcttgaactcctgggctcaagggatcatcctgcctcagcctcctgagtaactgggaccataggcatgcatcaccatgcccggctgcaagactacaactcgtgctatagcacaattaattttcaccttgtaattttattacttccctgtttgaaaacatgagtggcatatgatttactacatgtttagcaatttacaggattttttttttacccatgatactttctggaaaatagttatgtgaatgtttatggcgttgacttgataactatactgctttattagtaactatttttgcaaagttattgccatgacaaatattacttgggttcttcatatgtcccttagattgtaactgtgggaaacttaagtgctactttagatttctctggtgttcaggaagtacattttgttatggtcagctagctgagtgctttaagtttgaactatgaaaatctccttaaaaaaaaaaaggacgcggtggcttatgcctgtaatcgcagcactttgggaggccaaggcaggcggatcacctgaggtcaagagtttgagaccagcctggccaacatggtgaaaccctgtctctactaaaagtacaaaaattagctgagcatggtggcgggcgcctgtaatcccacctactcaggaggctgaggcaggagaatcgcttgaaccctggaggtggaggttgcagtgagccgcgatcacgccactacactccagcctgggtgacaacagcgagactctgacttaaaataaaaaagattctgtagtttctggcacttgaaattgcaggactccaacctacaaatgctgtattattatgagatttaggctggaaatactgaggcagtaggatttaagcacttacccttaattgacatcccaaaactatatataaaacaaacaaacaaacaaaaaaacaaaaaaacccaccagttttaggaaagagaagggaagaggggaggattaatggttgaccagagactgttttgagtgtcaaggcactcagcttttcacagctattaaccagtacaataccccttttggttgagggaaatagactttagtttttcatcctctacttaacataaagatctttagacacctcttgttttctggttgtcacaggtgatgttagcatatgtgtaatgctttgtttgcctctggcgtgtcttttagtatttgagtttgactagccgtatagcaggactttagtggtttggatgcatagatgcaatgtattgcttttgtctgttttataattaacaattataaaataaaaggtcattccttaatttgcaaatttgttctcagaaagttctgtttgatacatgtcatactgcatggctctttaaaggtggcagtatcatgcagtacagactggaatataggataataggcttatacacttggagtagagaaggcctttttgaataggacacaaagcacaccaaaaaaaagccacagatacattattttgactgtatcaacacttaaaacttctgtaaaatgaaagataccacagacaagttaaaagaagaccatgaagtagatgtatgtatttgtgacatgtatagaattatctacaagtcaagaagaagaaaaaaagacaaccagagaagaaaattggcaaaggataagaaatacaaataaacatgaaaatgtgcttaactttatttgtaatcaagaaaagtaaaattaaaacaacagagaaaagctattttctaactattaaatcggcaaaattaaaaagcattaggccaaggatagtgaaaatagatactcatacagctggtggtgtgtaaattggaataactaatttgtaaaagcaattgtctatctctggtaaacatgaagatatcctgtgcatcctatgaaatgccaattccatcttgaggaatctaccttagaaaaactcttgcacatatatacaaggaaacacgtacaagaatgttcaacacagcccagtttattatagtgaaaacatggaaacaacctaaatgtttatcagtagggaaatatttaccattgggaactatcaaaaaggtaagtaggttccatattgttttataaaagatctccagacattgttgattaaaaaaaaaaaagatgcagaaaggatatatcagacacttaaaaacaacttaaaacatgaaaacagaacaagctcacaaactatatttctgtatttttgaaaatatgtaccccaaactgataatagttgttatctatgggaactggaattagtctttagctttatctgtattgtttgaacctttaaaaattattgtgtgtttaactagaaataaacatttttaaaaatttaaagatcataccagtactttgatttaccaatttaagcttcttaatactataaagtattaacagggaagagccagcaatttctagataatacaacgtaagatggggcactttgtaggtttttggatttttcttgttttgctttcatttttggttttgagaggtagtggggtgaatggaagaatacgggctttggagtcaaatctaagtttgaatccaagctctgccatttatttagactttgggcaggtttcttaacctctctagtttttaaaaaaattgctattacctacttcgttgggttgtataagaattacatgtgctagatttcctcatttccccattccctttggttaagggaaattggtctagtgtggtctaagatcaaagatggtctcgtatggatgacaaaatgtttcacaagaacacactatatccttggaccaggatataccagtaaagatggaggatgtaaataataaattttagaggtctattaactgtttaaaccattaagctatctatttgtacctcacaagatcaaatactagattatgttagtgatttataaatgatattgaacttgaaacttctaagcagtttacatgacaggttgttgattaacaggtttacttttttttttaaatctcagagaacattttaatttagttcagcaaacatttatttgtgccatccagcatctcaatctcaagaggcctcatagaccaaaatatgtctcaaaaggaagaaaggaaaactctatgtatttatcaatttatttatcaaactctggcaaggggggaaaaagtcaggtttaaagttgagtatatgtatatactctgcttttcacttgtactgctattgcctatgtgtgcatctgttaatatcatatatagcaattcatatgaagattttttccagtgagacttagttattctattattgggactctgtattaaataataatttttaaaaaagagtgctctaactaatgttaaggtggaaattctagacccctcaaacaaaaatttccaaataggaccccttatcatttaattgtgaaataaacaactaatgcttttatggtatttatgcttgggaagagaataaaataaatagttttggattttccccatataaattagggcctgctgagtaattagcagttaataagtgaatgcttcctacaagtttaaaggtcatacctgaaatgggtatatgatgatgtatatttttatagttatagattttatatagcccaagaatccttgaagatagtctaaacatcttggtttgatgagcagaactttcaataagggggtaaggggctaatattgtttgagcacttactatgtgccaagcactattctaagatgattacatagattattttatttaatcttcaccacagtcttctgtggtaggtactagtattgcccaattttatagaaaagggcagagagataaggtaacttatatgaagttacacagtcagtaaatgacagagctagaaatcatatccaggttcagttggctcaagaacccatattcttaaccattgcagtaaaaattgttatgctgttttaatctgtagagtcagcatgtagcaataataatataatcattaacatgttacattttgcatatattgaatgctttctaaagaagtagtttattatcagacatattcttagaatcatacccattttatagcaggattgacagtgttataaagagattacgtgatcaacatggggtgagtcaacagaaccaagaagtttctgatccacaattgccttcacttgctaggttcaagtaaggatcatatagtgtttacttacatttgccttagatttttcagtatagcatgatgaaattctaaatgcttatctcagacagtgatgctatctgagcaagacatggacaattgggcattagtgtgaattttaggacactagagcgtaggtacaggttagaaaacttaatcctcatcttgtggaagtcatggcaaagccaaagaggaaaagcctgtcttaaatgcttttccttttccaaggggcagctaaggtgcccagatatctttgccctccagggatgcaggtgtgctgttttttattctttaatcattcacataaattaaagcctattcctttgcattaaaaaaaatgtaaaatgacactctccgtgttttattgccaggcaagagctttgaacttctgtctcattgaagtttgataaactaaggattttcccgtgttgggtggtacccttaaccacagagggagcattagactgataagagctgcaggtgaaggaaaccaccagggcacggcaattagggagagcttcgcacttggctgttggctggtgtaaaactctctgcagggaggaacttttcttcttagcttcttcccttcacccacacgtaaaaagaacaccagggctttctatttctactttgcgaactaggaatggatgggatggttcttttcaagaaactttcaaatttagggacaagttctaacttcacacaaatgctgattggtatgaaggtggggggacaggacagacagacatacacacacataaattcacgtggacccaaatggaccatatctctcaggtgattttactatcaacatacattcctgcctttgtgcactgtgtaaaataaagataatttttacttccataactgattataaagtgttaatggtgaggcaacgtgttaagagaatgggttcttgtatcaggtaaaccttggttcaaatcttggcttctcttcccactagctgtgtaaattaattttgtaagtctcagttctcccacttgtaaaaatagaagtctaagaataactattataggattgtatttggaagaaatagaataaagcatgtgaaacaattagtacagtactatatctgtcacattgttgtttaataaattgtgcaagtactcaaaaatggtagctgttattatttgtaatatgaaactaaatatctgattggtagattaatgttaaacatgcatggtccaatatatttctttctttccttttttatatttttggtataaagtctattttcttgaaaattcctgctttttttttctagaaggacaaaagtactttgatttttactgctctgaaaatatttatcccgtaaaaagctttcacattaactttgagtccctggagctagggaggagaagcagcaggatttgctactaagtagagctctttcatttctaccatcaaaaagaaaaaaaaaaaaaatcctgtgctagccttaggtagagctaagtcataaaaggccatatagcctaaggaaggactctttttataagatcaggataaaccgatagaagaaaggaaggagaacacagaggtgaaaatgcagctgattttaatgtttccctggccattttccctcccaatttaatatacacctaattataattattatattttgaaaacaataccagaaattggcaggtattatctcacagcttcactcttagttttggccgtttcttaaagaaacagttttctagttggatgaactgttgagttgaggcactgattttgttttcacctctttttgggtggggttgggggtgggcagtcagggtttgcagtggtttatagttgttagttttgggaagcactcatttagatagaatgagtcacagaatgtaaacaggtcatccatctggactttaggctgctgggaacgtggtgaaaccttaggtcaccgcgatcattatggtcaaatgaagacttttgggctcaggttggcaggtaaacttacttgttttatgagcttcactagactaccaggacttcagaaatagttttttgaaataccaatatttataaattttaggtaattccatcatattttcctgaggaatgaaactgtgaaagaagtaaatgtctactttggcagcaacttcatagaattgctttttggaaggatattcatcactttggggttttttgttctcactgctccagatgaaagtatttttctgaattttttatggtaaatgtggacactgaattggaagcttctatgtaaagtttgtcaggaaacctctgtcatacctaaggataaaattcagagaaagggaagaagtatttgagtacctgacatctaagaagttctggcctatgttgtttactgagtaaactcccaataatgctttgagacaggcttttaaggaaacatgttatcaatcacgtactatgtaccaaacacatagtggtgttttacctgtattatcttatttatttctcataaccctataatgtaagtaccattattatccccattttaccatgaagaataggcttgaagaataatttgtttatggtcacataactaggaagtggcagagctgagaatggagctctcaactctctgtaatccaaagcccaggttcttaaccagtgattcttaaacttaagagtacataagaagcatcaggagtacttgttaaaaattactgggctgtagtaaaaaatgtaaggtcactaaatctgggacagtgccagactataaatctgcgttttaaacggcatcccaggggattcagatcaagaaattgattgaccatattttgagaaacatagttaaattatattgcttttcacacttgataaagaagaaaacaggtgtagactaagtaactatccaagattaagctaccaagacagagccatgattcaaactcaggtctgtctcactctaatactcatactttttattatacgcccatgattaactcacacatttccaagtcacaacaaatgcagaaaacatgacatctaataaaccaagccagatagatttcatggtcttgttatttaccaaagttaataacttatatatacaccagtacgaaaattttcatggtccttaaacctttccagtgactttttttttttttttctaatttaaattaactgagttttcttttttttctgttctgaaatgaagtctggctctgtcgcccaggctggagtgcaatggcatgatcttggctcactgcaacctccacctcccaggttcaagcaattcccctgccgcagcttcctgagtagctgggattactagctactcaggaagtagccactgcatctggctaatttttgtattattggtagagacaggttttcaccatgttgccaagctggtctcgaactcctgacctcaagtgatccacccgcctcagcctcccaaaatgctgggattacaggcctgagccactgtgcctggccagagttttctttacaatcataccatccatgcttcaagcatggaattactaactccctgggataagtttctgatgcagaaatggaaaagaatagaaggaggtagaaagaaaagaacttccaggtgtatctgctgaatggtgctaaatctcctcttcaacccacccttgtgattgagatgaagaatgaagggttgatgctaatactaacagccagtcaaatggcaattggtcatgttcacatcatctcccaatctatcctttgagactatagctcagttagggtcagcaagtttgctttgcctattccagtccactgatgaagtgtcatcagacagagccaacacctggattgccttacacatgacctcctactaggattgggatcattctttttaaaatctttctctcattttctctttctctcttgctatttgattgcagctcagcgacatgtcctcacctacatggaggatgcagtgtgccagctgctagaaaacagggaagatattagccaatatggaattgccaggttcttcactgaatagtaagtacatgaatgttgtactaatacagtgaacccagaggaggcgcttggaagcaggcaggatacttgaggaacagagcaggacaatgctgattaggtagtggcagtgaatgtttagttttggtaggttggttgtgggccgcccaaacatgttttggagcatgcctttggtgcagctagtttgtccagtgatgtctcatgaatagttttgattacagtagcttaacaactgcttgtttgatctattagatctatttctgtaggtttctcttttaactttctcctttattcaaaatattcactttgatttcctttcgctgatgttcatctagcctgttttttttcatggctggcttttctcatggaatctaggctaatgttcctctgcagttttctttctacaggatgctgtgccaatcacttaatgatttaagtgtatttctaatcagcaaagtgaagagacaacccacagaatgggagaaagtatttgcaaactacccatctgacaagggattaataaccagaatatataaggagctcaaatatctctataggaaaacatccaataatcccatcaaaaaatggacaaaagatgtgcatagacacttctcaaaacaagacatacaaatggcaaacaggcataagcaaaggtgctcaacatcattgatcatcagagaaatgcaaatcaaaactacaatgagataacatctcaccccagttacaatggcttgtatcctaaagacaggcaataacaaatgctggcgaggatgtggagaaagggaacccttctacactgttgatggggatgtaaattagtataaccactgtggagaacagtttggaggttcctcaaaaaactaggaatagggctgccatatgatccagcaattcaactgctgggtatatacccaaaagaaaggaaattagtgtatcgaataaatatcagtactcctatgtttgttacagcactgtttagagtactaagatttggaagcaatctaagtgtccatcaacagatgaatgggtaaagaaaatgtggtacatatacacaatggagtattatttggccctaagaaagaatgagatcctgtcatttgcaacaacatgaatggaactgaagatcattatgttaagtgaaataagccaggcacagaaagacaaacattggatgttctcacttgtttgtgggatgtaaaaatcaaaacaattaaactcatggacaaagagaatagaaggatggttaccagagattgggaagggtagcagggggctgggggaagaggtggggatggttgatggttacaaaaaagaaaaaaaagaatgaaaaagacctgctatttgatagcacaacagggtgactctagtcaatgataacttaattgttcattttaaaataactcaaagggtacatttagattgtttgtaacacaaaggaaaaatgcttgatggggtggataccctattctccatgatatgattagttaacattgcatgtctgtatcaaaacatattatgtgccctaaaaatatatacacctactatgtacccatgaaaattagaacttaaaaaaattttttaaaggaatatttctagagggaggatatctttcatagattatatatttgaaaggtcatacctaggccaggcatggtggctcaaacccgtaatcccagcactttgggaggctgaggtgggcagatcatgaggtcaggagttggagaccagcctgaccaacatgttgaaaccccatctctactaaaaatacaaaaatcagccaggcatggtggcacgcacctgtaatcccagctactagggaggctgaggcaggagaatcgcttgaacccagtaggcagaggtggcagtgagccaagatggtgccactgcactccagcctggccaacagagagagactccgtctcaaaaaaaaaaacaggtcatacttctttataaagtatacttagaatgtgtaaaagtcaaaatgattactaccttttttatttttctgagatagaattttactctgttgttaaggctggagtacagtggcatcatcatggctcattgtagccttgaactcctgggttcaaggaatcctcctgcctcagcctccccagtagctgggactacaggtatgtactatcatgctcagctaaatttaaaatttatcttttgtagagacagggtttcagtatgttgaccaggctggttttgaactgcaggcctcaagtaatcctctcaccttggcctctcaaagtgttgggattgtaggcatgagccaccatgcccaactgattaccactttttgaatatcacagaactgtttttaggctgaatgagataaacactttaaaaacacattaatattctttttcttccaacttttattttagatacagggaatacatgtgcaggtttgttacatgggtacattgcacccaggtagtgagcatagtacccaataggtagtttttgacccattacccctctcccttctcccctctagcagtccacagtgtctgttgctcccatgttcatgtccatgaatgctcaatgtttagctcccacttataagtgagaacatgtggtatttggttttctgtacctacattaattcacttaggattatggcctctagctccatccatgttgctacaaaggacatgatttcattcttttttatggctgcatagtactccatggtatatatgtaccatattttctttatccagttcaccttgatgggcacctaggttgactccatgtctttgctattgtgaatagtgcagcaatgaatgtacgagtgcatggggagaatgatgtattttcctttggcatacccactaatgaatgggactgctgagtcaaattgtagctctgttttaagttctttgagaaatctccaaactcatttccacagtagctgaattaatttacattcccaccaacagtgtataagcatcctcttttctcagcagccttgccagcatctgtgttttttcttttttgactttttaataatagtcattctgactggcatgagatggtatctcactgtggttttgatttgcatttctctgatgatgagtgataatgagcattttttcatatgtttcttggccacttatatatcttcttttgagaaaatgtctgttcatgtcctttgaccatttttaaatggggttatttcgtttttgcttcttaagttccttatagattctggatattagacctttgttggatgcatagtttgtgaatattttttcccattctgtaggttgtctattgatagtttcttttgctgtgcagaagctttttagtttaattaggtcccacttgtcagtttttgtttttgttgcaattgcttttggggacttggccaagaattatttgccaaggctgatgttgagaaggatatttcctaggttttcttctaggatttttatagtttgagatcttacatttaaatctttaatctatcttgaattaatttttgtatatagtgaaaggtaagggtccagtttcattcttctgcatatggctagccagttatcccagcaccatttattaaacagggagtcctttccccagtgcttgtttttgtcagccttgtcaaagataagattgttttaagtgtgtgctttatttttgagttttctgtactttccattggtctatgtttctgtttttgtaccggtaccatgcaaaacgcaatcttcatgaaaggatgtgctagagaaatacatatgccatcacatatttatataatcgtttggattctctttccttttcttctggtttttgggaacattctaagaaaggaagagtaatccttataggcttccatttaagtgaatcttgaactcaagttcatctttcttgaacatagtttttttttttttttttcctttctgttctccagaggctccttggagatcagacagctattcaaatggcctcaccttgggtttctgttaggggaatacttgagattccctagctcttttgctgaactctaaagttcttttcaatgaaatctagattttttatggattggcatttaggttcgttggaaaaagaagctttctgggagtaaagttgttcctttcacccagtcttctaaaggaggatgaagtagagaaaggaattttatttgttctcatgatgtgggctggagcaaatgaggtgggcagggaataaagactgagattgaatagccttgcttgcttttacagaacagacaagtgaactgacaagcctacgggtcaagtttctataccatttaatctgtaccagcactcttgaggctccttgccaagtgaaatatgactcttctgggggtaatgcttcttcctggcttttttcattttactcccctccccatctctgttacaagtcttttccctattacactggttgcttgaaggtaggcatcatttaaatttttttttgaggcagagtctccctctgttgcccaggccggagtgcagtggtgcaatcttggctcactgcaacctccgtctcccgggttcaagagattctcccgcctcagcctcccgagtagctgggattacaggcacccgccaccatacctggctaatttttgtatttttactagagacggggtttcaccgtgttagccaggcttgtcttgaactcctggcctcaagtgatctgcccgccttggcatcccaaagtgttgggattataggtgtgagccatttgtgcccggcctcatttattcttcatctttgcattcctggtacttggcatgatgctttgcatataatagatgttagctaaatatttattgaatcaacagcagtatctatattttaagttattgaatactatctactcttctagattttgttataataaggactactttcttgttttttcctccctttctttttttattttttttatttattattattttttattatactttaagttctagggtatatgtgcacaacatggaggtttgttacatatgtatacatgtgccatgttggtgtgctgcacccattaacttgtcatttacattgggtatatctactaatgctatcccttccccctccccccaccccaagacaggccccagtgtgtgatgtttcccatcctgtgtccaagtgttttcattgttcaatgcccacctatgagtgagaacatgcggtgtttggttttctctccttgtgacagtttgctcagagtgatggtttccagcttcatccatgtccctacaaaggacatgatctcatccttttttatggctgcatagtattccatggtgtatatgtgcccattttcttaacccagtctatcattgatggacatttgggttggttccaagtctttgctatcgtgaatagtgccacaataaacatacatgtgcatgtgtctttatagcagcatgatttataatcctttgggtatatacccagtaatgggatggctgggtcaaatggtatttctagttctagatccttgaggaatcgccacactgtcttccataatggttgaactagtttacagtcccaccaacagtgtaaaaatgttcctatttctccacatcctctccagcacctgttgtttcctgactttttaatgatcaccattctaactggtgtgaaatggtatctcattgtggttttgatttgcgttctctgatggccagtgatgatgagcattttttcatgtgtctgttggctgcataaatgtcttcttttgagaagtatctgttcgtatcctttgcccactttttgatggggttgtttgattttttcttgtaaatttgttgaagttctttgtagattctggatagtagccctttgtcagatgggtagattgcagaaattttctcccattctgtaggttgcctgttcactctgatggtagtttcttttgcagtgcagaagctctttagtttaattataccccatttctcagttttggcttttgttgccattgcttttggtgttttagacgtgaagaagtccttgcccatgcctgtcctgaatggtattgcctaggttttcttttcttttcttttctttttttttttgcctaggttttcttctagggtttttatggttttaggtctgacatttaagtctttaattcatcttgaattaatttttgtataaggtgtaaggaagggatccagtttcagctttctacatatggctagccagttttcccagaaccatttattaaatagggaatcctttccccatttcttgtttttgtcaggtttgtcaaagatcagatggttgtagatgtgtggtattatttctgagggctctgttctgttccattggtctatatctctgttttggtaccagtaccatgctgttttggttactgtagccttgtagtatagtttgaagtcagatagcatgatgtctccagctttgttcttttggcttaggattgtcttggaaatgagggctcttttttggttccatatgtactttaaagtagttttttccagttctgtgaagaaagtcattggtagcttgatggggatggcattgaatctataaattaccttgggcagtatggccattttcacgatattgattcttcccatccatgagcatggaatgttcttccttttgtttgtgtcctcttttatttcgttgagcagtggtttgtaattctccttgaagaggtccttcacatcccttgtaagttggattcctgggtattttattctctttgaagtaattgtgaatgggcgttcactcatgattttgctctcagtttgtctgttattggtgtataggaatgcttgtgatttttgcacattgattttgtatcctgagactttgctgaagttgcttatcagcttaaggagattttgggctgagatgatggggttttctaaatatataatcatgtcatctgcaaagagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagcttttgcccattcagtatgatattggctgtgggattgtcataaatagctcattattttgagatacaccccgtcaatacctgatttattgagagtttttagcaggaagggctgttgaattttgtcaaaggccttttctgcatctgttgagataatcatgtggtttttgtctttggttctgtttatatgatggattacatttattgatttgtgtatgttgaaccagtcttgcatcccagggatgaagcccacttgatcatggtggataagctttttgatgtactgctggattcggtttgccagtattttattgaggatttttgcatcgatgttcatcagggatattggtctaaaattctctttttttgttatgtctctgccaggctttggtatcaggatgatgctggcctcataaaatgagttagggaggattccctctttttctattgattggaatagtttcagaaggaatagtaccagctcctctttgtacctctggtagaattcagctgtgaatccatctggtcctggactttttttggttggtaggctattaattattgccttaatttcagagcctgttattggtctactcagggattcaacttcttcctggtttagtcttgggagagtgtatgtgtccaggaatttatccatttcttctagattttctagtttatttgcgtagaggtgtttatagcattctctgatggtagtttgtatttctgtgggatcagtggtaatatcccctttatcattttttattgcgtctatttgattcttctctcttttcttctttattagtcttgctagtggtctatcaattttgttgatcttttcaaaaaaccagctcctggattcattgattttttgaaagtttttttgtgtctctatctccttcagttctgctctgatcttagttatttcttgccttctgctagcttttgaatttgtttgctcttgcttctttagttcttttaattgtgatgttagggtgtcagttttagatctttcctgctttcccttgtgggcatttagtgctatcaatttccctctacacactgctttaaatgtgtcccagagattctggtatgttgtgtctttgttctcattggtttcaaagaacatctttatttctgccttcatttcattatgtacccagtagtcattcaggagcaagttgttcagtttccatgtagttgattggttttgagagagtttcttcatgctgagttctagtttgattgcactgtggtctgagagacagtttgttataatttctggtgttttacatttgctgaggagtgctttactaccaactatgtggtcaattttggaataagtgcgatgtggtgctgagtagaatgtatattctgttgatatggggtggagagttctgtagatgtctactaggtctgcttggtgcagagctgagttcaattcctggatatccttgttaactttctgtctcgttgatctgtcatatgttgacagtggggtgttaaagtctcccattattattgtgtgggagtctaagtctctttgtaggtctctaaggacttgctttatgaatctgggtgctcctgtattgggtgcgtatatatttaggatagttagctcttcttgttgaattgatccctttaccattatgtaatggccttctttgtctcttttgatctttgttggtttaaagtctgtttaatcaaagactaggattgcaacccctgcttttttttgttttccatttgcatggtagatcttcctccatccctttattttgagcctatgtgtgtctctgcatgtgagatgggtctcctgaatatagcacactgatgggtcttgactctttatccaatttgccagtctgtgtcttttaactggagcatttagcccatttacatttaaggttaatattgttttttattttattttatttttttttttgagacggagtttcgctctgtcgcccaggctggagtgcagtggtgcaatctcgactcactgcaagctccgcctcccgggttcacgccattctcctgcctcagcctcccgtctagctgggactacaggcacgcgccaccatgcccggctaatttttgtatttttagtagagacggggtttcaccatgttagccaggatggtctcgatctcctgacctcgtgatccgcccgtctcggtctcccaaagttaaggttaatattgttaatgtgtgaatttgatcctgtcattatgatgttagctgattattttgctctttagttgatgcagtttcttcctagcattgatggtctttacaatttggcatgtttttgcagtggctggtactggtttttcctttccacgtttagtgcttccttcaggggctcgcctggtggtgataaaatctctcagcatttgcttgtctgtaaaggattttatttctccttcacttatgaagcttagtttgactgggtatgaaattctgggttgaaaattcttttctttaagaatgttgaatattggcccccactctcttctggcttgtagagtttctgccaagagatctgctgttagtctgatgggcttccctttgcgggtaacccgacctttccctctggctgtccttaacattttttccttcatttcagctttgatgaatctgacaattttgtgtcttggagttgctcttctcgaggagtatctttgtggtgttctctgtatttcctgaatttgaatgttggctttcctcgctaggttggggaagttctcctggataatatcctgaagagtgttttccaacttggttctgttctccgcattactttcaggtacaccaatcagatgtagatttggtcttttcacatagtcccatatttcttggaggctttgttcgtttctttttactcttttttctctaaacttctcttcttgcttcatttcattcatttgatcttcaatcactcttacccttttttccagttgatcaaatcggctactgaagcttgtgtgtgtgtcacatagttcttgtgccatggttttcagctccatcaggtcatttaaggtcttttctacactggttattctagttagccattcgtctaatcatttttcaaggtttttagcttctttgcgatggattcggacatcctcctttagctcggagaagtttgttattacctatcgtctgaagccttcttctctcaactcgtcaaagtcgttctccgtccagctttcctctgttgctggcgaggatctgcgtttctttggagaaaaggcactctgatttttagaattttcagcttttctgctctggtttctccccatctttgtggttttatctacctttggtctttgatgatggtgacgtacagatggggttttggtgtggatgccctttctgtttgttagttttccttctaacagacaggaccctcagctgcaggtctgttggagtttgttggaggtccactccagaccctgtttgcctgggtatcaccagcggaggctgcagaaccgcaaatattgcagaggagcaaatgtagttgcctgatcgttcctctggaagctttgtctcagaggggcacccagccgtatgaagtgtcagtcggcccctactgggaggtgcttaccagttaggctactcgggggtcagggacccacttgaggaggcagtctttccattctcagatctcaaactccgtgctgggagatccattaccctcttcaaagctccgttggaaatgcggaaatcacccgtcttctgcgtcgctcacgctgggagctgtagactggagctgttcctattcggccatcttggaacctccccttttcctccctttcttgattctttgtggtaaagctctatattgtgccattttagaagctgtatactgtgcgccttgcactccaaaagtgaattccacttgttctgtgtagccaatgctgagctgtagtgaaccaacagtaaggctgactgtaggcagcttttatctaccaacacactgttgaaaaaaaatcgtaagattttctacagtgctgatagaaatgtacttgccaagcaggctgtttcttgtccccagaaagctgaaatttacataatatacgagtgacacatacctgacacttccataagtctatgacaccagattggcttgaggtaaattattctaagaagtgaaaagtaaaccagctccagaaacttttgggttttctttttttttgaagacctgaaaggtgtggatgtatgacagaatgggaaatagtgtaagtataatttggtagacaaggagacctggatgatggaagctcctgagtttactttgtgaatttgatttagttagtgaaaatccttcactttcaggcttcagtttttttgttttgtttttttttgttttttgagatggagtcttgctctgtcgcccaggctggggtgcagtggcgcgatctcggctcaccgcaagctccgcctctcaggttcacgacattctcccgcctcagcctcccgagtatctgggactacaggtgcccgccacatgcccggctaatttttgttttttgtatttttagtagagagggggcttcaccgtgttagccaggatggtctcgatttcctgaccttgtgatccgcctgcctcggccttccaaagtgctgggattacaggtgtgagccaccgcgcctggcctcaggcttcagttttgtattgattaataagagaaacatagtgaagtggaaagagcactaccctagaaggaaaaagagctgcttattcttctaagtcctcactctataaccctgggcaaatttctgaaatatgggcttcagttgcctcatctatgaagtgggtttaataaagccttacatgataataataataatataataattatatattataatatgcagtttttactaaactaataccatgtctcagctactacaattctttgagatgggtactattattattgttatctctgttttatagaggaggaagtggatgctcagaaagattaaaatagcttcttcaagttcacaagctgttaagtgacagactcaggaatcaagcctcatctgcagtattatagagtccactgttctctactgcctccaagccactttactgcttaatgttgctagagggctaaccagatcatatttggaggtttcttctagctataatttctactatttttgaattctcccttatgaactatactttgcaagcttatcacacagccttagctggtgacctcagtttactgccatttaaatgtttaatatggccttttgggggatgcaactagagctgactataaagagcaggaagcatgattttcaaaaatatgttaacggtatccttccatcttacagtttcgagttcacatcttgagactttcatatatttagccgtgggtgatttacctttaaacagtgataaaagtactccttgaaattgtatttggaaggcttctcttctgattttcttctctgggtctgcttgccctctcacctatgctgtctgtcactccttggttgttggtgttttcaaacaagtccatgactgttccagcaaatctggataaactgtaaaacacaagtggctgaacagtactttgtgtatgtctgcaagaccatgagctctgtagatcatattcctctggacactcttgaaagacggatactaaatcccagaggattttcttttatgttgtatgtaacctctacctctgaatgttgtccttcaaccagtggaaggtaaaagaaattaatatttagaggtgctactctaagaataggccaaatgtcagcactgggtcaggacctctgaagaaatacatccaagaaaatgggcgagagtagctctaacttagaaaccacagcagagtgtgaccagattcttgtggtaaagataaaatgagaaatgtggctttttgagacattggaaaataatgatgagagaaaaacaggatgaaatctgagaatttgtatcagaattgggaaccattcttcacaggctaaattgatagttccaacactatggcatcagggagcttgacttccacatactaatatagaaaagaataatattctgtggtcttggttggtgggcccaggagagctcgcttttatgatcaagtgtcttgttttcgttttttaaaggatgattttagttttttggtgaagtttttatgatgactgttttggttgcaagggaaagaagtacacagactacctttggtttattttaaggatacgtgagaatatgcagcattcatttgtgaattattcattcacaaattacttttgggcacctactctgtgcctgtgtgtactatgcaatgggaatagagcagtgagcaagacaaataaggtacctatctttatgaacctagtgttttaatgagggtaataatcaataaacaagcaaactgatggggatgagaatagctaatagttaataagcactgtgtgctaggcactgttctaagcatataatatccattattttatttaatcttcacagttctatataaacagggtattagtattatcctcattttactcataaggaaattcaggctataaaagtaacattctcatggttacatagctggtaactgtaacaagacaaataacaagaaaacagccagagtaaggtaatatatagtatggacagggaagtcctcttggaagagatgacgattgagagctcatcccatcagagagccaataacttagctcagagggtgatgcaccttttctttgtccaccttgattatctaagtaagcttcctgtgtccaaaaatgatcatttgattgattttatttgttgctactgagaatggagtacccttactaggcagtgttcttaggaccccctcatgggtaactggcctccctcatgctctgctcctatttaaccagtgaaagtaaataaaataattcatcatcaaaagtatttgtgttctacactacatagtataaatatggagatggaaatctttgtcagtttttagaaaaggagcattaataatttcattttgatacatgttaatcatcagaattaattttgattcaaataaatccataaaatatgaacttcattaattcatccttggagaaaaaaagagattccaatagtgcatacccgttttttttttcttttttcttttcttttactttaagttctgggatacatgtgtagaacgtgcaggtttgttacataggtaatagtgcatattcctaaataacttaaaacgtaactctaatgaaaacaatccatgattataaaatatgtatcatttcttgttattttttttttcagacaggtgctttaagccctatgaaaagatgacccacttctttcctacataatctataacaatcagggcataaacattcattctaaaggtgacagattttttaaggatcattcaccatctagagtttaaataatgttgtttggggttcttcttgtgtccatggtaacagaggagcaggtgtgaggcaacaagaagcacatcagaacaaaccaagacttcgctgatttccagcttgtagctctgaatgagagatggacttgagacttctttgggccatttctgctcatgttttctctacttatttacgttaaattgagccaaaatgtggtgtggtaaagtaatggtgactaatcctattatagacttcttcaaaaggggtaatgcttccccctttacccaccccctcccctgacttttttccatagttcagttcttagctgttaaacattgtaacagaaaattacccgtttctcattgtcagcatctggtttcccacagactcagataattgtcaggaagagatttgccttcagttaaagcaaccctatccccactgttactaggccaggcacctctgttagaccatcatagaaccaaatctatagaggattctttctggctcttttctgtattactagaggtatgctatagcaaaaagactacagggagccatggtggtgagttaagagtcaaaatctgttttgaaacttaaaaatccagggtcattgaggatgcaagaagttgcctgtttttgtagaatccatctcacttcttcagtccctttgtattatggttacaggaaactatccagcagcacttgacctggtaatggaggaagctatttcacagcccactggtcccttgactcgtttagaagtcagagtcaaaggttacagaagtaataattgggcccagattctccctgtcaggaaagaccttgttccccccaccccaccccctgccttctacaagttaagagaaacttatctgttataaaaccattcaataagaggaaatgaagaaacaccatccttggctgaagtgttctcaagccccaatgatactatttctgttttcatgggagctgcttttgcagctagctagtataaaatttaggtctgattttttacattaaaatatctccccttagataaataacttgatttatttcaatctataaataatatgaaggatctttatttggtccaagccctgatattccttcacaccaccactctgataattccctgaatacttgtctggcaatcaagtacactcacacgagtcttaattaacaagtgttatgccattagcaatgtaaagtcagtcatcaaaagttaagaaactaggccagattataggctcacacctataatcccagcactttgggaagccaaggtgggaaaatcacttgaggccaggagtttgaggccatcctgggcaacacaatgagacccctgtctctacaagaagaataagaagtttaaaaagctttacttcaccagcaacagaacaatttaaaattttcagtgcttttaatttcttccataatttgctcagaactctagcagatcaatctgtggtgccattggcacaggcttggcactggagtaggaaagaatgacacaatttggcacctttaaccagaagatctttaatgagctggcgtgggggtggaggggacagagaggaaggaaggacagttaggattttggcagtaacacaaaggttcttcttccctgagaaaagtgaaatgaaagtcaaatgaagcttcactctgcttttagaatttgctaagatgtttgtctgtctctcagctcccggcccccttgcaggtgcatcattatagtcagtgacttctccaaaaaacaaattgtctctcaggatccttcaggaggggtcatatctaaccaatttcttgtctgaggacataattgtgattcccttcttcaactatcagatgcaatgctaccagcactgcagaaactgtcttatcagaaagtggcacaaatgtgtacatttcttctaggtcacagttctagtattgctgagttctggggctgcaacaatagataatactacaatgagagatgtttgggaaaagcattgtttcctgggtggccgtagaagcagacttgaaatcatccctttgtcattaaataatatcaacaacaaatgtctttgttgatgtcattgtattgtaattttctaggtctagattattgctagggatgataatacctatcttctagggttgttatgcaaatcacatgaaattacacatgcaagatgtctggctatatataattcatcttcattgtgtgttgttctccttaagctccacttttctgggatttttgtatctctgtggatctggatagtcttccttttctctctctttaaatggcatcagagttgaagatcttgaggactttttagtctctcttttgttttttgttgttgttgttgttactggtttgtttttgtttttgtttttttgtttttgttttttttttttgagatagtgtctcactctgtcacccaggctggagttgtagcacaaacatggctcattgcagccttaacctgggctcaagcaatcctcctgcctcagcttcccatgtagccatgaccacaggtgcgtgccaccatacccagctaacttttttttttcttttttatagagacgggtctcattttattgctcaaactggtcttgaactcctgggctcatgttatgctcctgcctcagcctcccaaaatgctagaattacaggtgtgcgccactgtacctggcctctcttactttctataacacttctttcttgccctgtattttgtgtacgtttttggagactaaaacattcaatgattgcctgcatgactcttaaccacttcactcatcatttagttcattcacagaatagcctaagaaagcttttctatctttgttttctttgcatatgccattttctcacttcctgtctttaccccctttcctctagatacagaattttaaaactcaaggtgtagtgggagacttgagtcagtcaactctatccaacttgtgttgttcccactcttagctctagcagtacagtgatgggctcagggtaatgaaaagcagactttctctgctgaggtcattgctcctcatgctggcagcctgctccaggaagctgtttatctatgcttgcagagccaagctccagcctctgaacagttggaatgtattgagaaaccacagagcccaaagagagaacattacacaggcagttccaggcagggagagtatatttacaccagacaaactgcagcttacatgtgtggggataattgttcatctgcacactctcatactttaccttctatgcaatctatataccctctcaagaaggtttaaccaggagaacttgtactgctatgtccaaattaccctgaacatcccctaaaatgtcataaggaaaaagagatactacagaaaattgatgtaaaaactttttaagatagtggtttttttgtttttctgagtcaaattttatgtttagaatcttagaccatgtaagcctgatcactaaagcattcaaaaacactgtttcttgcatggaaatgtttttcttcatccctttacaaaaatattaagtattgttatagagcttcaaatgtgctctatattaataggaatataagatatggtcacttccctgtaagatgtaatctggttaaagaggtaaaactcattgaataacgaacaattacagagcaatacaagaccttatataatggcattaagttatatggcccagtacactgagaattgagagtaaggaaaaataatggctattagttaagtaaaattagttgagtcttatagaggagtttgtcttaattttggaaaggaaggtagagtttggataaacaaaacagaaaggagacatattttgcaacatgaaagcaccataacatagtggttaagaacatggactttggaatcagataggtctatgttagagggcctgccactttctggtatgagatcttgggcagattgcttacctcatctataaaatagggagactcatatataaaatataaaattccatgttacataattgttggaatgattaaatgagttaatgaaagtaaagtgcttggcatttcacttaagatacaataagtgttgaattaattagtagctactgctactactgttgttcactcattcattcaatatatatttattgagtgcctacgtcttagcgttctagatactagggatatagcagtgaaaaaaacagaccagaaatttcaactcttatggagcttccattctgaaattgttttcattttacctttttagaatgtgtgtgaataattttggacttacataaagtttaaaaaaatctatatatggagttcccacatccatttcatacagcttctactaatgttaacatttcctgtatccataatataactgccaaaatcaagaacttaacattaattcaaaactattaactaatctatacgtcttatttacattttcacctcatttttgaagggcagtttttttcctgagataaattctaggttggcagctgttttaccattccattatcttttggtttctactgactttgttgagaagttgctctcagttttattcttgcttctttgaaaataatctttttttaaatctctggatggtttttggatatttctacttggtctttggtttttgatagttttagtgtaatgtgtctagttttgcttttctttatatttaaactattcggtgttcttagtgcttcttgaacctatagcttgatatcatttatcagtcctggaaaactctcaataattagctcttcaaatttacttctgttctactctctctctgtctctgtctcttttttttttttgaggcaggatctctgtctgtcacccaggttggagtgcagtggtgcagtcatggctcactgcagcctctacctcctgggctcaggcaatcctcttgcctcactcagcctcccaagtggctgggaccacagttgcacgccaccacactcagctaatttttttttttttttttttagagatagggtcttgccatcttgcccagactggtctcaaactcctgggctcaagtgatcctcctgcctcgccctcccaaagtgctgggattacagacatgagccaacacgactggcctctaccctctctttactcctattgggattctaattacacaaacattagaccttttcatagtattctctgtctcttatgctcttttttgcattttctatcattttgtgtggttttttttttttttttttttttgagacagagtctcactctgtcacccaggctggagtgcagtagcactatcttggctcactgcaacccaggtttgcctcccaggttcaacccactctgccttcctggttcaagtgattcttctgcctcagcctcctgagtagctgggattacaggcgcccaccaccgtggctggctaatttgtgtttttagtagagatggggtttcaccatgttgggcaggctggtctcaaactcctgacctcaaatgatctgcctgcctcggcctcccaaagtgctggaattacagtcatgagccaccatgcccagcccatcattttgtagtttatgctttattctggatattttcttctgatctattttccaggtcattaattctctcttcatttctgtgtaatttactattaaacccatctactgagttcttaattctaattattgtatttttttagttcaagtatttttattcagtttttgtttgtttccttgctaaatcttgtctttcatttgcttgaacatagtaaataaagcatggttattacaaagtccataatttattgtctggataccctgtgggtctgtttctgttttctgtcctatccattttttttttactccattatcttatcttgtgttatacttttttttttctctagttgagttatgtaaattgtgtatgagttatgtaaattgaaaaactatacagataatgtgaggcccagaatgatgttatctttcttcggaggggatttatatttgcttttggcagatggcctgggcactagcaatcctggattacctcaatcccatgagggtttgaaaggatttgaatatagatttacatctcagggagggctgattttcagtatagctctgaggagtgccaaaagagctttagggtttaccagagtcccagcccccaacgtgggtgggtcctgaactctattttttttttcttttctttttgagactgagtctcactctgtcgcccaggctggagtgcagtggaatgatcttggctcactgcaacctctgcctcccgggttcaagtgattctcctgcctcagcctcccaagtagctgggattacaggcctgcgccaccatgccaggctaattttttgtttttagtagagacggggtttcaccgtgctggccaggctggtctcgaactcctgacctggtgatctgcccgccttggcctctcaaagtgctgggattacaggtgtgagccaccgcgcccagccaactctgattttttatctgcaagccctaacagtcatttgaaaactcaggaacttaacattaattcaaaattattaactgcttagtgtatcagttgaatcttccagaactggcagaggcccctagagctaccagtgatataataataccttatttctgaagtggtgataagtataaatgatattgtgagatatctggtatgacagtaatgttatatgaaaatatctgaggtttctttttttttattttaaagttttttgtaaagatttggtcttgctatattgcccaggctactctcaaactccagtcctcaagtcatcctcctgcctcagcctcctaaagtgctgggattacaggtgtgaaccactgtgcctagccaatatctgagatttctattattgaaagagtcacaggtactgttaattctgctatgcttatattcataatagaaggaaatgccaaattccagttagaggttagtaaaaataaacataaaaatttccctggctcatgcctcccagcactttgggaggctgagcaagcagatcacaaggtcaggagatcgagaccatcctggctaacacggtgaaaccccgtctctactaaaaatacaaaaaaattagctgggcgtagtggcaggctcctgtagtcccagcttctcaggaggctgaggcaggagaatgccaggaacccaggaggtggaacttgcagtgagccaagatcacaccactgcactccagcctgggcaacagagcaagactccatctaaaaaaaaaaaaaaaaatttccctatccaagtgtgtggatctcttgaatttaatccatggacccttctgtttagaaaccctacacattgggaaaagtggcactaaatgctcagctcacctttctcggttttattctctcataacttggccttgtcattcttcatttgccttggtggctctctgatgacttcagacaattgtctttaataatttatccatttttttctcagccagaagagttagtctgaattacctactctacttttattggaggaagaactcttttaaaacttgcattctgatggaacatattaataattagttgaagtagaaaatatcatacactgcaagggatcataaaggaatctaatttgactcatggaggactagtacaaggtaaaaagcaacaaacagaaaatatataatgaggatagggccagtttgtggaaggctcaattatattgaaataagtagaaaggtaaaatggctgagtgtggtggctcatgcctgtaatcccagcactttgggaggccaaggcgggagcatcagctggggtcaggagctcgagaccagtccggccaacatggtgaaaccccatttctactaaaaatagaaaaattaactgggtgtggtggcaggcgcctgtaatcccagccacttgggaggctgaggcagaagaattgcttgaacctgggaggcagaggttgcagggaggttgcagtgacccaagatcgcactactgcactctagcatgggcaacagagtgacagagtaagactctgtctcaaaaagaaaaaaaaaaggaagaggaagaaaggcaaagacagtacctcataaatgctgagaaactcattgtttggtcttctttcaatttttaaaattcagtaactatttattaaatagttatcatatgccaatcactgtgtgtcagatatggtcctcaagaaattcactgtcatgtaaaaattagatagtgacacaaatacaattaaaatagagcattagaagttctggactagtgagtaaactttgacaggaaaagtgattatttatacggtcaggaaagaattcacagaatagtgacattaatttagttttaaagaatgtgtagataattatcagacagagaagagagaatggaactccgggaagcgaagactacttgggaaaggagtggaaataaaaagtagatcccaagtttagtgtgccttggcaaaaagaggaaagtggatgggaatggagatcatgttgagaaatgaaattcctcaaaagagtgggaccagcttttcttcaaagagtctcactttatacaaattccgtagcagtaaatgttcttggccgaagcaacggaatctgtctctggctatcttaagcaaagagactggagtggaaagatgtgtcagttgcagtagctgcttatggatcagactgttgtggtgagacctttgcctagtttcctgatgctcagcctccaaagctcctttgattcctgtctgtttttcaagtctgatggttcagccacctgtggattttgtgagccactaataatacccttccagcagagcccttttttgcttaagatagtgagacttggtttctgttgcttgcaaccaagaaccctattactgttattaatttttttggtacattcttgagtcatttaggaatgtattagttaccagatgaaactgaattctcataaatgttatttggtagtgacttttactttgtagggaaaaagaggtatgattggactgttattcttatttacaggtaatatttagattttgtttgatgttaacactgtccctggtaaatttttttttcttctctcaagcttcagtgtgattccccaggaaaatcttggaaattgccaatagagaagatgtattactaagtatcagaagttttcttggaaggacatctaataagtttcccaagatgtgattctgcctgttcagtagttgcttgagtgctgatgaaattccccccaaacacttcctaatatattattgaaatatttgagataaaggaaagctgaacatattaaaactaatttttaagtggtgagagaagtggaattgaagtctatttgaggaatttgaaacatttatcacccacggtttttccaaaaatatacatttgtgtcagtctgtcaaactttttatcaaaaaaaactgtgaattatccatttaaaatacatttttattacattttcttctgtatctgagaaatatgccagatggtagaaatttcctagaagtctctgacacttacagattgaaagatgaatgacgagaagacaagaatttgggtatccagattaatagatagaactttacaactattgacttcttatttgctcttgttgagttttgaaaaggaattaggcaaggtagatgaaaatagagattcttctcccttcagtacccatgtgatttaacacagccatagaaggctccaagttttggggtgtgggcacaatttcaaagatatatttctattaagcttcttgagagtgatatgaagaagaaacgaagtatagagtctctcagatgcaaaaatcacttagaggtaggccatgtatccatccttatcacacttcactttttccaagaactacgactggcttgtcttttatggctttttaagaatctaacttcattgtgtaatcagcttatttcctctccattattaatgccctaattggcaggttttctgacccattttcttttctgtgatgctcttctagatgtctaaacttttcatatcacaacatggatttaggtagtttttcagtaataaaagttggtgtgaatatgcagtagtatgtggattaattaacatacatttaacaaatgtttattgaaggcctactgcaccctagacatgtaataaataaataaacaaataaattagtaaggtagcttcagatagtgataaattctattaagaaaatcaggagccggacatgatggctcgtgcctataatctcagcgacttgggaggctgaagcgggaggattgattgaggccaggagttcaagaccaacctgggcaacttagcagtacctcgtttaaaaaaaaaaaaaaaattagccaggcttagtggcacacacctatagtcccagctactcagggggctgaggcaagaggattgcttcagcccagtgaactgtgatcatcccactgcactccaacctgggcaacagagtgagactgtgtctccaaaaaaaggaaataaaggagggctttgggatactgaatgactgggagatggaaatctactttcaatagtgtagtcagagaaggcctcactgaggctttctattgccattgctattttagatacttgcttaaagaaagagaggtggtcttttaaaaagtatattcttgattaagataatggagagagaagaggaagaaaaaagggatattacaacctgtagctgtataggggaaaggaagagaaaaaagataggggataggggatagcaaagcaaactttatttgctttgtagatagctgtataggggaaaggaagagaaaaaagaaaaagagaagcttgaactttattatttgctttgtaaataatttgtgaccattgacttccatttcaaggatataataatgataggaattggctggcaggtacgactggattcacgatgggagccctttctttaaattatgccactaggtcttctctgaggtgccttctatataaatcaggattcataatctccctgattttacaggagccaggaactgagtcttcttttctttctatctctcataggaataaaagggggaaatgaacatttttttatactaccgaggtcaggtatccttgggtctaatgttaaacttaaaacagaaatttctgagagagcccttttatcctttgttatttagaaaatacttgaccctcctgtgcccttgctgtattggtgcgagacagaatggttatatatatattttattatataaataataactatatataataatatgttattatataaataataacatatatattttattatataaataacatataatcatatattattatataaataacatatataatcatatagcatatataaccatatgtagttatatataaatggttattatatataacatatataaccatatgtagttatatataaatggttatatatatatatttatttatttattgttgttgttttgttttgttttaagttccagggtacatgtacaggatatgcaggtttgttacatagataaacatgtgtgccatggtgatttgctgcatctctcaacccatcacctaggtattaagcccagcatgcaatagctatttttcctaatattctccctcctgcacccctcctaacagaccccagtgtatgttgttcccatccccatgtccatgttttctcactgttcatctcccacttgtaagtgagaacatgcagtgtttggttttctgtttctgtgttagtttgctgaggataatggcttccagctccatccatgtccctgcaaaggacatgacctcattcctttttatggctgcatagtattctatggtgtatatgtaccacattttctttatgcagtctatcattgatgggcatttgggttgattctatgtctttgctattgtgaatgaacatatgcatgcatgtatctttacaatagaataatttatattcctttgggtgtatacccggtaatgggattgctgagtcaaatggtatttctggttctaggtctttgaggaatcatcacactatcttccacaatggttgaactaatttacattcccaccaacagtgtaaaagtgttcatatttcttcacagccttgccagcatctgttgttttttgactttgtaataatagccaggtgcagtagctcacacccataatcctaacactttgggaggccaaggtgggtggattgtttgagcccaggagtttgagaccagcctgggcaacatgacaaaaccccatctctacaaaaaaatacaacaaaattagccatgcatggcagtgcacacctgtagtcccagctacttggtatggcttgagcccagaaggtcaaggctgcaattagccatgagtatgccattgtactccagcctgagtgacacagtgagacccccatgaaaagaaagagagaaagagaaaaagaaaggaaaaagaaagaaggaaggaaggaagaaaggaaggaaggagagaaagaaagagaaaagaaaggaaggagggaggaagaaagagagaagagaaagaaagagtaaaagagagaaagaaacagaaaagaaagagaaaggaaggaagaaagaaaaaaagaaagaaaaagaaaaaaaaaagagagaaaggaaagaaagaaagcctggcgcggtggctcatgcttgtaatcccagcactttgggagactgaggtgggtggatcaccgatcacctaagttgggaatttgagatcagcctgaccaacgcggaaaaaccccatctctactaaaaatacaaaattagccaggcgtggtggtgcatgactataatcccagctattcgggaggctgaggcaggagaatcacacttggacccgggaggcagaggttgtggtgagcagagatcacaccattgcactccagcctgggcaacgagcgaaactctgtctcaaagaaagagaaagagagagaaagaaagagagagagaaggaaaggaaggaagggagggagggaaggaaggaaggagggagggagggagggaaagagaaagaaattagaaaaagaagagcaatttaaaagttaggggggaaggggatggaaagagtaaagattagagtagaaatcaatgaaatagataccagaaaaacagtagagaaaattagtgaagccaagcaggttctttgagaagataaataaaatcggaaaatcatgagccagactgatcacaacaaaagagagaaaagacacaaattaccaatatcaggaacgagagagatacatcattacagattctataggtattaagagataataaggaaatattatcaattttataccaataaattcaatgacttagaccaaacggacaaagacacaaaggacattcaagaataaatagataacttgaagaaacagaatttgtagttaaaaataatctcacaggctgggcacggtggctcacgcctataatcccagcaatccaaggcagggggatcgcgaggtcaggagactgagaccatcctggccaacatggtgaaaccccgtctctactaaaaaaaaaaaatacaaaaattagccaggcatggtggtgcgcgcctgtaatcccagctactcaggaggctgaggcaggagaatcacttgaactcgggaggaggaggctgcagtgagccaaggtcatgccactgcactccagcctggcaacagagcaagactccgtctcaaaaacaaacaaacaaacaaacaaaaaatatatatatgtatatatgtatatatatcagaaactccaggcccaggtggcttcactggtgaattctaccaagcatattaggaagaaagaacaccagttctacacaaatgcttccagaaaattgaaaagaagtacttctgaactcaatctaggagactagcattattctaatacccaaacaaaacaaagacatttccagaaaagaaaactgcaaaccaatattccttgtcacaaaaattcttaaaattttagtaaattgaatccaacaatatataaaaaccatgtgggatttattccaggaatgcatgtggtggtttcacatttaaaaatcaatgtaaacttaaaaattctggaaaaagaaatgcgtaacccaccatataaaaagaaaaaaaaagatcatttcaataaatagagaaaaagcattttataaaatcgagcattcattcctgattcaaaaaaacaaaaatcaagactgttcatgctgtctctcacctgtaatcccagcactttgggaggctgaagcaggaggattgcttgagccccagaggtggaggttgcagtgagctgagatcatgccactgtactccagcctgggcaatagagccagaccttgcctcaaacaacaacaaagaccacctagcaaagcaggaatagaagggaattttttcaccaagtgaagggcatctacgaaaaacctatcaaacttaatggtgaaagacagaagactttcctgctaaaatcaggaacagggcaacgatttccattctcaccatttttgttcaacattgtcctggaggttctagccagtggataaggcaagaaaacttgaaaaaaaacaagtttgttcacataggacatgattgtctatatagaaaagcctatggaatctacaaaaaacaaaaaacaaaaaacaaaaaaaaaacgctactagaactaataagtgaatttatcaaggctgtatatcaatatataaaaattgtatttttgtattccagcaaagaacaattggaaatttaaattttaaaagcagtgtcatttacaatagcatcaaaaaatacaaaatacttagaaataattctgacaaaaggtttacactgaaaattacaaaacattgctgagaggaattaaagactatagtgactgattaatatatggtaacaaagtatatcagttgtggacaggaggtcacaggcagacaggagggaggaattccaaatagggtcaaaggaaactttgggaggtaatggatatgttcattatcttgattgtggtgatggtttcttgggtatacacatatataaaaacttaccaaattatatgtgtactttttcatttagtactttttttttttttttttttttgagatggagtctcgctctgtcgcccaggctggagtgcagtggcccaatctcggctcactgcaggctccgcctcccaggttcacgccattctcctgcctcagcctcccgagtagctggaactacaggcgcccaccaccacgcctggctaatttttttttttttttgtatttttagtagagatgagttttcaccgtgttagccaggatggtctcgatctcctgatctcatgatctgcccgcctcagcctcttaaagtgctgggattacaggtgtgagccaccatgcccagccactttttcatttaattctatgaatttttttttttttttttttgagatggagtctcactctgttccccaggctggagtgcagtggcgcaatcttggctcactgcaacctccacttcccaggttcaagcggttctcccacctcaatcacccgagtagctgggactacaggtgcatgccaccacgcccagctaatttttgtatttttagtagagatggggtttcaccatattggtcaggctgatcttgaactgctgacctcgtgatcttcccgccttggcctcccaaagtgctgggattacaggcgtgagccacagtgcccgaccagttctatgaatttttaacacatgtatatatacagaacaatttcatcaccacaaaaaactccatactatccctttataatcacaccctcttctgtctcccaacgcaaacccctgacaaccactgatttgttctccatcactatagttttgtcttttcaacaatgtcatatccatggacttatacaatatataaacttttttttttttttttttgagacagagtctcactctgttgcccaggctggggtgcagtggcacgatcttggctcactgaaacctccccttcttgggttcaggcaattctcatgcctcagcctcccaagtagctgggattataagcagacatcaccatgcctggctaatttttgtgttattagtagagatgggatttcaccatgctggccaggctggtctcgaactcctggcctcaagtgatctgcccaccttggcctcccaaagtgttggtattacaggcgtgagccactgtgcccagctttatacagtatataacgttttgagattagcttttttcactctgcataatgctttgagagctttgagattcctccaggttgtggcatgtgtcagtactttgcttctttttattgctgagtagtattgtattgtatatatgtaccacaatttgtttatccattcacccttggaaggatatttgggtttcccccaattggcaattatgaatagagttgctataaatactcatgtactcatttctgtgtgaacatacattttcttttctctgaattgtgtacccaagaataagattgctcactcaatcacatggtatgtttagctttttttttttttttttttttttttgagatggagtcttactctgtcacccaggctggaatgcagtggtgcaatgttggctcactgcaacctctgctgcctgggttcaagtgattctcctgcatcagcctcctgagtacctgggattacaggcacctgccactgcgcctggctaatttttgtagttttagtagttacggggtttcaccatcttggccaggctggtcttgaactcctgacctcgtgatccacctgcctctgcctcccaaagtgctgggattacaggcatgagccactacgcccagccatgtttagctttttaagaaaatgccacagtgttgtccagagtggctgtaccagttagtatttctaccagcaatatatgaatgattgggttgttctatatccttgtcagcacttggcactgtcagtatttttaattttaactattctaataggtatctcattgtggtcttgatttgcatttctcaagtggctaatgatgttgaaaaacttcttatttgccattcacatatcctctttggtgaagtgtctgttcaaacttttgcccatttttaaattgggttgtttgttttcctactattgagttttgagagttgtttatatattctggatacaagtcctttgtaatctgcaaatattttctactagcatttagcttgtattttcattctcttctcagtgttatatacagagcaaaagtttattttttttttttgagacggagttttgctcttgttgcccaagctggaatgcaatggtgcaatctcagctcactacaacctctgcctcccaggttcaagcaattcttgttcctcagcctccctagtagctgggattacaggcgtgagccatcatgcctgcctaatttttttgtatttttagtagagacggggtttcaccatgttggccaggctggtttcaaactcctggcctcatgtaatctgctcgcctcggccttaccaaagtgctaggattatagacatgagccaccgcacctggcctggaatgtcctttaaatttctttcaagaactttttctttgcattcacaacttggctaactgttttgtgtaagaggcctagctttcggcctatcttggcttttgacatgctctcttcactaagcttaataatttctagcttttaatttaaagtaagagactcttcctttcacttgaacacttagaggccattgtagggttattagttgacctaatttcaataccattgtagctcagggaatagagagcaccaaggaaagagagggagaaagaggaatggctggtcggtggaggagtcagaacataacgacatttattgattaagttcaccctcctatatggatgtggtttgtggcaccccaaaataattacaataataacatcaaagatcagtgatcacagaccatgataacagatatacaaataatgaaaaagtttgaaatattgtgagaattaccaaaatgtgaagcagagatatgaagtgagcacatgctgttggcacccatagacttgcttgacacagaattaccaaaatccttcaattttcaaaaaatgcaatatctacaaagtacaataaaatgaagcataataaaacaaggtatgcctgtaaatggtgcactacacatgctattctgtataatgaatttttttctgaatacataggctatatatattttaagattattaaataatatgacatttaaacatagccaatcatataagcaaagttgttcagctgtttctcacacctgaaagtgccccccacaccaaataaaacatttttagattatgtgtcccaatttggacttctgaaagtatggtcaccatatgccaaggcatgaaggcattaactggggaatgagtatggagtttgatgcctttcatctcctttgctcatctgtccctatccacatgatggctgcatttgaaatgaaataaagtctacatactggagaatagtttataaatcaatattttatgaaaacagttatatctaataattttttataaaataatgtatttatttgagtcttaagcttagtgatgtaattaaaagcctatttggttttttcttaggaatccaaatcctctctttaatatttaaaccctttaatttgctaaagataagttttgtgccctgttgaccacctaatggaacaagcaagtgttgaagatctcttgtggttttttttttagttgcaaattctaccaagctaacccatttattgcagtggataggagctggagagctgttcattcggcaataataggcaaagggtggtggagggaagaaaactatctttccaatatttttgcttaggaatttggggattcagaatttagtcataaacaactagattaatgtgtttaaatactttgaatcagttctaaatcattccttgttttgtaacatacaagatcttagagataactaaaacagtggttgaaaaattctgttgtggattgaagatcctccagaagcataattcactaataggcacagtgtttggggtgatgggtaaacaaacatctgtgtcctgtggttgcctctctgcataggaggagatatatagttttcaggcaagagatttctttggagagtccactgtctctgttttgcaagttatttatttatttttaatcccagagataacgaaaccatgtagtggcagtagatggtattattcatcaggagtttaggatgttaccatgttaggccatttaaaataagacagaaaggattactttttgccagctgcatcatttctggcaagagcttactactttgcttattgcggtcattgttgtggttgttgttaacccatcagagaaactaaccactacattggttttagccaaatccttgtcatcattggccttacattcttttggggaccaaagagcacctggtcattctgaaagcttccatccccagtgattgatgctcatctctgcaggctcctgcaggctctctcaagcttgcctcccatttttcctgaagcacctttaagcatttctgcatggctactcactctcttctattatacctcctcctcctgccttactgaatgctgaatttcccagctcacaactctaagaaggagctttatttcagagtagaaaggggcccccatatgtggcctattatatccatatcaacttgcttacccttttcaaacagctattgtcttttaatagggtcctgcctggcagggggagtccttaattcctgccatataagaatgggcagcttgagttacagctagctgcagtttggtgctctgatcaaaaggcctctgttgttttttagggtttttccccctccttctctctctctttctatatcctgtgctaataattcagcacagcaaggtcattacaggctttgaattgggagctgagagtgttaaattactgacctagaataaaagagatctggggggctctcaagaaagataaagtgattccggctagtaaaatgcaagcccagcaacctcacttcttaacaatattattattttttaatcccctctgtctctaaaagtcttttctgggacaaggagagatcccctgccagagaattaggttagaaacccaatgacatcttctgagagttgtggcccaggtgctggcagcttatgggcgcctgtgcagttgtcctttttgtctccctaccttgtcaatatttcactctgttctaccttggtctctcagccacatatatggtttttttttttttttatcacgtaagtcatatatgtttatgacatttcagctgaaaggtaatatcccatgaagggatttcagacatgtggaaagcataccacttagcccccaaaatatcttaaacatgacatcatcttattaaaagccactttcattccatttatgttttgtaaataatattagtctggtcctcccatactttaacaaaaaaaaagtcccattgtaaatgaatttgatgtctccactctattctacattgtatcttctgaagaaagtcatttccatttcttcatactattttctttcatatctttcatatgtccttttttttttttttttttttttttttttggagacagagtcttgccctgtcacccagactggagtacagtggtgtgatctcggttcactgcaacctctgcctcctgggttcaggagattctcctgcctcagcctcccaagtagctgggactacaggcgtgcgccaccacacctggctaatttttggatttttagtagaggcagggtttcaccatgttggccaggctggtctcaaactcctgacctcaggtgatccgcctgccttggcctcccaaagtgctgggattatagatgtgagccactgcacccagccactacagttatctcttaaagccatacactatccatatcctctggaaaatattgattttctaagactaatatttttagaaaagttcctaaaatcaactttcacagattttctgcacagcagagtaataataataagatagtccccgaatgtgccaagcattttacagaatgcattattaacacatttaacctttggcaaccttatgtaataagcattcctgtaatcactagtttacagagaaaaataattgcaatacaaagtcatacagccaggaagatttgtcccagactagtgcttcttgaactttttcatgtttgtgtgaatcacctagggatcttgttaaaatgcagaatcagattttgtaggtctgggttggggcctcagattctgatttttaacaggcttctaagtgatgctagtgctgctgtccttggttcacattttcagtagcaaagccatagtcattttttcttgagaactactcaaaaagtttttggttataacttccagtttttcattccatcaggcaattctatgaatatacatagtggatatttcacacctatatcttactttttaaaaaatatgataaaacatagcacttaacccacaaaatatcttaaatgttagaaaatatttaagatattttgcctcctattggccctgcagaagctggacctcctgaactgtgtgacctacttcagtggtacctcaggttctacatggtgagtatcctggggactggaagagtggagatgatcagggcccataggggacctggttaaaattgactattttaactatttttaagtgtacagttctgtggcattaaatacattcacattgttctgcaaccatcactgtcatccacctccataacttttctatcttcctaaactaaaactctgtactcactaaatactgacttgccaacttcccattccttctgaccccctagctcctggcaatcaccatgctactttctgtatctaggaatttgactactctaggtacctcaagtaagtgaactcatacaatatttgtcttttttgattggtttatttcatttagagtaaggtcttcaaagttcattcatgttgtaccatgtatcagatttccttccttcttaagactgaataatagtccgttgtatgtatgtatcacattttgcttatctgtcattagacactagggtggcttccaccttttgactgttgtgagtaatattgctgtgaacatgggtgtatatatcatatatttgtccaagtccctgctttcatttcttttgactatatacccagaagtggaattactgaattatatggtaattccaccaatatcttactttctaagaaaccagtttatgtttaagttattgtgttccttttttttttttctaagtgagacagggtctcactttgttacccaggctggagtgctggaatgcagtggcatgaacatagctcactggccttgacctcttgggctcaagagatcctcttgcctcagtctcccaagtagctgagaccacaggtgtgtgccatcacacctggcaaatgtttaaagatatttttcatagagacgggacctcaccatgttacccaggctggtctcaaactcctgggctcaagcaatcctcttgccttatagcctcccaaagtgctgggattacaagtgtgagccacttcacccaatcttctctctctctttttttttttttaaacattccttacataaagtaaatctttaaaggtttggcaggaagagtgagttttcagtacagattttcattaaagtctattgtctgtagctactttgtaattttcaatcaatcacaaaagaatattgagaaatgtcctttgatccttagaaggttggtaattggttaaatggcaccaagtagagaattagagagagagtgctcatgttctgaaataaaccaatactaagaaggtttatatcacagagaaagttttatataaatgaatttaagacctcacctgacaaacaggtagtcaaggaacaggtgaaccccttgttaaatttatgctctcctttaaagattttctggaacaactatcccaggatcttcaaaaattttgtggtacctctttctctgtggtctttaataatacattaaattctcgtttgtttataagagtttggtgcaagattctgcctgctacctagaggtctttccttatgtatctttagaaatgaaattctctattggaaataggaaaagaaataaactgatattgaaacctaatgagttaacagaacatttgaagggagttttaaaaaggtatcaggaagaaactgatttttttcctgtggtataatactgaatcattaagatagtaactttaatcatttgtgcctatagtgcccttattttaggagttcctagttactacaatggacttgaacttggaaaggtaaaacaatacaaaatagcttttaactaaagttgggaatatgagtgcttaaaaaatatacatggatttaccagtagctttagaaggtaaatatacatgactactgaaataaactacaattattttctaaaaagtgagaccaactttggagataaaacaaataaaagaatgaacagaaggcgactctggaaataacggtagtaaagttatataggacatgttgagatgataaccatgaagaggagaatcgaatcattatctgcaagtttcatgtggatggctctaaaagaacaaaccctgcatcctaaacccccttcaattttattattttgaattataatcaagtccaaggagacttggcctattattaacaactttgtatgaagtatttttttcaaccaaattcatatcatcttgaataagaacaaaggattatggtttgagaattattatacttgctggactttgaaccaacagagttgatatatttaatacttccacttcttagatgaggtggtactgaggaaggggtttgtaacatctaagggggcccataaaaatagtgtttagttttcagtgaaatctacaggtgatgctaaaatgggaacatttttaaagggatcctagtgagaacaaaaagacaacaaaaaagaacctaaaggctatagctgcaggcagaaaatagaataaaatttaccttaaaatgttgtctagtgcaatgccaagcatagatatacagtggatgagcaaaatcttgtaagaaattagaattgagtttaaaaagttataaaagaaaacagacaagaaattagatgaaactatggtatgtgatctggcagtaaaacagacaaaagctgttttaaggtctggagatagagaggaggggaaggaatggcaggatctgcagatgactgagggaggcctcacctgtgactaaactcagcttcagtagcagaagaaaatagtacagacagggtgaaccagttgacaaaagagatacagaggttggaacatagagctgaagagaaagaaataacagatgacaggtttagaaaccacataaagaatgtgagatgtaatatgtagcagaaggtgagatgtaacagaaatactgtaaagagaaacagtctgtccagaaactcttcctaggggataaggctaggggatatttccccagagaaaccatgaaaacacaattattctggatttcaagtgaaattaggcaagctcctggaagctctgttataaagagctctgcttagaggccttgttgaaagaactgaaggatcttgtaggaacaagacaaattagagatttacggtaattgttgttatttttttttaattgacataacattacacaatatttggaagacaggaagaaatcaataataagccaaaaccctaatccagtgaataaatacaattcatatcttttaaatttttaatcactttccttattcagacctactttaaagtagctaaaattggctgggcacggtggctcatgcctgtaatcccagctctttgggaggccgaggtgggtggatcacttgaggccaggagttcaagaccagcctggccaacctggcgaaaccccatctctactaaaaatacaaaaattagctggccatagtagcatatgcctgtagtcccagctactcgggtggctgaggcatgagaatcacttgaactcaggaggcagaggttgcaataagttgagatcgcagcaccacactccagcctggatgacagaggaagaccctgtctcaaaaaaacaaaacataaataaatgaagtagctaaaattatcatgtacacacaattttgtttccttttttgtttgtttgtttcttcttttattctcagtaccttcctcaggatcctccttaaatataacatatgaatcatgtttttataatttaaatttctaacatgctataaagagtatgtatgtgtgcagtaaccttttcccagtgctcggcgcattgattttccatcctgtatttccctgtttctactggcctggagtaaccagccttataaaaaaagatattccttcatacttaaagctgcaaggggtaagcagatgtgaattaatcatcttatatcagccggtaagaagctgatgtgttagggatggcacctgcgagtttaccatagcatgccaggccttcaggaatgagttttgaagtttgagggcttcaaaggggagtttgaaacattttaaaaccctgacagggttttacctgaattatatgcaaagatccaatggggggaagagtttacttcagagaagcagcaactgaaaaccaggtcctttgcgtagccttcctggaaagaaccgtctttcttccttagcagcagcccccagggtaggaccagtgctctatttcacggctattttaagaaagttctttatggatttgggtaacagaaaagcacttggtgaagtgatcaaggaaagaaactaactctgctactgaggattacttaggcagaaaaaaaatcttgttatgaaacaccaatgtttaagtccttagagtgaactgataagctgatttggggcttttttgctgttgcagaaattataaatcctatccactacaatggcagctcagttctcacagatgggttcacctatccttagacagtaacttaagattgatagtccctgttggatttcttcctaaattgttttttaaagaagccaaagatcttggattctaattctaatggagccactgctgacaagaagaagatgaagaagattgttagtgctcacttgcagtgtggcacatctctattttcttttttttttcttttttttttttttgagacggagtcttgctctgttgcccaggctggagtgcagtggcacgatctcggctcactgcaagctccacctcctgggttcacgccattctcctgcctcagcctcccaagtagctgggactacaggcgcccgccaccatgcctggctaattttttgtatttttagtagagacggggtttcaccatgttagccatgatggtctcgatctcccgaccttgtgatccgcccgcctcggcctcccaaagtgctgggattacaggcgtgagccatcacgcccggccacatctctattttctatagcatttacaattatttctttgtagccaacagaaaagttgcactcaatgaacctatcaattcatgatgcatatccgtggggagaagctcattccgaatacatcatatgttaaatttatccttggattcaggatcatattgttcacttactttttcctgtagtcagcatgttgtaattttgaacaatagaataatagataacaacagcctactagagaattagaaatactgtagttctaagaactgtagtaattagaaatactgtagttctaagaactgtagttcttagaaatactgcattcaacttttgtaaagaaacttttttgtatcactatataagaaagaagctggtgtgtaaggcaacttctgtgcaaatatgttgtctaaactgctttggggttctgtaacatagactagctgacttgcctcactgatttctcttatcaagttagcattgccaaattctatagctgataggcaatgggaagaaaacatttcagggctttaggcttcctctgaatttcacaaggaaacaaagaacaaatccagggattgttaggtcaggagacaaaatcatgccataggaatatatatctttttttttcttctttttttttgagacaaggtctggctgtgtcatccaggctggagtgcagtgatgtaatcttggctcactgtaacctctccctcccgggctcaagccgtcttcccatctcagcctcccaagtagctgggactacaggcgcaggccaccatgcccagctaattttcatattttttttttttggtagagacgggatttcactatgttgcccaagctgatctcaaactcctaggcacaagcaattcatctgcctcgggctcccaaaatgctgggattacaagtgtgagccactgcacccagccacagaaatatatctttagagcctggtgactttgtgcaaaacaaaactgcagttagccaacctgttagtggaaaatatgccccaaaagtcttctcctcccagcttgcccctttccaactcagaatatattttttccttctgtttatagaagcaacacaaggttactttaaatcataattttggccaggcatggtggctcactcctgtaatcccagcactttgggaggctgaggtgggcagatcacctgaggtcaggagtttgagaccagtctagccaacatggtgaaaccccgtctctactaaaaatacaaaaaaattagccgggcatggtggtgggcacctgtagtcccagctacttaagaagctgaggcagcagaatctcttgaacctgagaggtggaagttgcagtgagccaagatacaagattgtgccactgcgctccagcctgggcgacagagtgagactctatctcaaaaaaaaaaaaaaatcataatttcataatttttcccaagatgttttggatctttggtcttatatattctgtggaggccaattcatatgctgtgtttgaatcaccttagtgtggccagtttgtgctgcatagttggatgtgatctgctctcctgttttacttcttggcagatatatttaggattccttgaaaaaaaaaaaggctgggcacagtggctcacacctataatcctagcactttgggaggccaaaacaggaggatcgcttgagcccaggagttcaagaccagcctgggcaacatagtgaggcctcgtctctactggaaaaaaaaaaaaaaagaaagaaaggaagaaagaaagaaaattagccgggcatggtggtgcacacctgtagtcccagctacacaggcggctgaggcaggaggattgcttgaaactaggaatttgaagctgcagtgagctatgatcgtactactgtactccagccttggtaacagaataagaccctgcctcaaaacaaaacaaaacaaaacaaaaaaaacctatcagaagacaagttcaattccaattctaacagaagataatccactctaatgagctggcctggttttagaaagaaaaaaaggagacaggagaatggcctaggaagactcaactgccatcatccagttaaacagtgcaggtcaagattcactggccgttttcagtttgagtgagaacaaggagcacctggaggacatagagtgctgttggagttttgaagttttgcctctttgcacattaagaatgagctggaatattttaatttggtcctcttgcccatgtctttattacttctatatgtggaatgtgaatagctatttatatatagatccagtatggttacagttatttatttatttacttatttatttttaacttttaagttcaggggtacttgtgcaggtttgttacataggtaaacttgtgttgtgggggtttgtggtacagattatttcatcactcaggtattaagcctagtacccattagttgttttccctgatcttttccctcttcccatcctccaccctccaataggccccagtgtgtgttgttcccctctatgcatccgtgtgttctcatcatttagctcccacttataagtgagaacatgcagaatttggctttctcttcctgcattagtttgctaaggataatggcctccagctacatgaatgttcctgcagaggacatgatctcattcttttctatggctgcagactattccatagtgtgtatgtaccacattttcttcatcccgtctatcactgatgggacagtgtgaggaatcctcaaagatctaaagtcagaaataccattcgacccagcaatcccattactgagtatatacccaaaggaatataaatcattctattataaagatgtgtggttacatttatatttaattctttcttggtagtccctgagctattgcccacttcaccagaataatttaaatcaattcttgctttttgctagttaatagccaaaattaagatgtttatgtggaattgacatcatacataaattcttagaatttgtatctagtttttcaggagaaaatagataccacttaatagaattctgtatgactttttctgtgcaaacagcgtttgttactagaagagaacatgaaattgtatcaagaactcccattagcttaacatgtttacaaatgtctgattataaaattattaatttttaacacagctcctgctgtgttttcttaatatattactggagaaaactgccctagagctgggcatggtggctcacgtctgtaatcccaatgctttgagatgctgaggtgggaggattgctttagctcaggagtttgagaccagcctgggcaacataacgagactctgtctttacaaaaaataaaataaacaaaattagccaggcatggtagcgcatgtctgagtcccagctacttgggaggctgaggcagggggatcgcttcagcccaggagtttgaggctacagtgagctatgatcgtgccactgcactccagcctgagcaacagagaaaaaccccatctctttttttttttttttttttaaaagagatctcttaaaaaaaaattgccctgaagttaaatattgtattagggttctctagagggatggaactaatggaatagatttatatatataaaggggagtttactaagtattaactcacacaatcacaaggtcccacaataggccatctgcaagctgaggagcaaggatagccagtaaactgaagaacttggagtccaatgttttagggcaggaagcatccagcatgggagaaagatgtagcctggaagggtaggccagtctctcttttcacatttttctgcctgcattttattctagctggctagactggcagctaattagattgtgctcactcagattaagggtaggtctgcctttcccagcccaccgactcaaagttaatctcctttggcaacaccctcaccgacacacccaggatcaatactttgtatccttcaatcagtttgacactcaatattaacatgacaaatattaagctaataaaataggaaaactatggaatttattttattgtcaaaactaaattaagagagatttgtactcagcccatttcattttttttactttagaattttttaatttccagtgaaaccaaattttactactgttgtgaacacagccttcacatttgatgcaaatgggagggcttaattataatcacttagtgacagtattgtagacaaagccaatagtgtatggcacatagatgattatatcttctggagagagttgactttacaattaatacaaacatatttgactaaagaaaatggaagcatcttcagaccatttcatcttaattatatcttgtaaggttaaaaatatataactcacaaataaattttaatttaaaaaatttttttaactttcatgtcacagccaagtccaaaaaattttaattttgatgtttctggttctcttgtggctagataatccatagagatttcctgaacttcttattcatgatagcttaaaaagaaacattcagatccctgtgaattggacaaaaggatatctattttatgctactttttgtagcataaggaagaagaggaaataaaaacacaatgggcccttgaacaacatgagggttacaggtgccgacctctcctcttcacttagtctaaaatccacatataattttggactcaccaagaacttaactactgatagtctactattgaccttaccaatagcattaaaacagttgattaacacataccttgtatatgtattttatactgtattcctacaacaaagtaagctagagaaaagaaaatgttattaagaaaatcaaaaggaaaatatatttactattcattaagttaaagtggatcatgataaagacctccatctttttcttcttgatgttaagtggctgaggaagagaaagaggaggaggagttggtcttgctgtcttaagcgtggcagggaagaagaggtggagattgtagaaggggaggcaggcacactcggtgtagctttatgaaaacacatggtgatttctgattttttttgccttttcatgtctttaaaaatgtttctatatggtaccaatttttcttccatttgctttagtttcagtgcctgtatcactgaagagttcatgtcataaaagaagtcaaaagcagtcttgaatagttggaactcttctgccagatggtctaatgtcagtttgttttctggccctgcttctgtgtcttcttccccttctattccttcttttctggcactggttcagaagcactcaccttcatcaagttgtcttctgttaattcctctggtgtgatgtctgttagctcttgaatttctccaagatccatatcttgggacccttcccccaccttctttgccatatccacaatctctttcatgatctccttgattggctctgtcgtaaatcctgtgaagtcatgcacaacatctggatgcagttttctccagcaggaatctattgtttggggctcaatggctttttccataacaacagtggcatcttcaatggtgtaatcctcccagactttcttgatgttctatcaggattctcttccatagcgttgacagtcctttccaacagagtactatgtgtaatgggccttaaaggtccttataaccccctgacttaggggctgaattagaaacattgtgtttgggggcaagtattacagaccattttgatacctttggtgttgaactcatgggttctgggtggccagggacattgtccaattcaaaagaactttaaaaggcagtccatgttggtgtgctgcacccattaattcatcatttacgttaggtatatctcctaacatggcacatgtatagatatgtaacaaacctgcacgttgtgcgcatgtaccctagaacttaaagtataataaaaatatatatatataaaaataaaaaaataaaaataaaaggcagtccattaccagcaaggtacatcctgacttcaggaagaatgttgatgaaacccagtccagaaaaaatggttctcattatccagggcttcttgtacaacacccaaaactggcaactggtatttatcttttcccttcaaagctcaggggttaccagctttatagataagggcagtcctaatcataaacctgactgtgtttgcacaaaatagtagagttagcccatcccttcctgccctaaatcctggtgcttgcatctcttccttactaataagtgtcctttgtggcatttttccccttagcatctgcattaaaaaactgctcaggaagatatcctttttcctcaatgatttttaaaagcttctttttttttttttttagagcagggtctcactgtgttgcccaggctggagtccagtggcatgattataattcacaccacctcgaattcctgtgctcgagtgagtttcatgcttcagcctctttagtagctgggactacaggcttgtgccaccacagtcggctaatttttatttttggtagagatggggtttttccatgttgcccaagctggtttcaaactcctgggctcaagcaatcctcccacctcagccttccaaagtgctgggattacaggcatgagccactgcacctggttgcctcaataattttcttaatggcatctggaaacttgtttgctgcctcttggttggcagatgctacttcccctgatatcctgatattttttaagccaaaactttttctaaaattatcaaaccatcctttactggcattaaattctccagctttagacccttcacctttcttctgctttaagttgtcatataatgacttcactttttctcagatcatattagggtcatatgcctttcttatagaaatcctgcactcctataaaagctgtgttttcaagacaagttaaaaaagtatttcaccaaaagtgcaatgtttttatgcctgctgatgtagctgcagcaactgcttcatgaatttcctttgtttataattgtccttaccttagattcatttatcttgaaatgaaggccaaaccacagctgcagatctcaatctatgatgtatgtcaagcaattcaactttatcttgtaacgtcatgaattttctctgtttcttgggagcacttccggcatcactagtgacacttcgtatgggtccgatagtgttatttgaggtttatggttttgtactgaacacgatgaaaaatacatgagaaccatgagagatcactttttactgtgatacacaatttactggagaaatgaactgcccatgcagagatgattagcatcacatggtgttttaagcagatacttgcaacacttgtgctcactgcaatagcaacaggagttggctatgaatgaaattattatagtagtacagtatgagctacagttaattttatacagttatgatttaatactgtatgtttgcttacatttctctccactatgaatggcaccatgtatggtctgtgtgtgtgtcagttttgctaaatgttaactttttataacagatttgtgtatattttaatgtagtaaatgataaaatggactagtgtctacatattttatgcattcaggacatacttttaaaaatttttccaatatgtgtaggatgcacagttggtctgtgagttttttttaaattgctgaaatccctccaaaatttctaatatatttattgaaaaaaaatccatgtataagtagacccacacagttcaaatccatgctgttcaaaggtcaactgtatatacatgtatctgctcatctgagaaaaaaatatgcacacaggaagaataaaccagagatgaatgagattcattatctctaagatgttagtgaaatggagtgaaaagatatatatatatatatatatattatatatatataatatataaattatatatattatattatatattatatattatatataatgtatattataatatacaatataatatataatatattatatataatgcatattataatatataaatatatatttatattatatattatatattatattaatatataatatatataatatattatatttatatattatatattatataatatatatattatatattatatttatatattcaacaagattgggggagactctaaaattgaaaacaaacaagtgaagcaaattgtatttcaaatgaataatataccgtactgcagggggttggagaaactaatctaaggaacataatatttggactatataccctcaggctaaaacaactctaaacaagtattaaactctaattagtaggcttctttttcacagaggaatgggttagctagctcagtacattttaggattaagcaaataagtaaatatgttatagataataggagcctttttctcactttagaaaaaggacatttcagatatggaaagggaagatgatagaatgtaacctgtagtgttgaactggaattgaatcagtgtgagctcatagatttgttttgttttgttttgttttgttttgtttgagacgcagtctcttctctgtcacccaggctggagtgcagtggcacaaccttggctcactgcaacctctgcctcccgggttcaatcaattctcctccctcagcctcccgagtagctgggattacaggcgagtgccaccacgcccagctaattttttttatttttcttagaggggtggagttttgccatgttggccaggctggtctcgaactcctgacctctggtgatccgcccacctcggcctcccaaagtgctgggattacaggagtgagccaccacgcccagcctattctttactaaaaacaactgggcttcttggataaatggctggctccagggtgaagtagggaaagaacaagatgatcctggaacatcttattctatcaaaaaaggaaggaagtgatcagagaattatgtagatgtgtcaaaaggacatagaagtcagcttgaagggcttccatggcaaaatatgggatcatttgaacataaaaatatataatgatagtaaaggattataacctattgaataaagaatccatgagtccacaatgatataaataaataagaagggaaagctcttccttattgtagaaggtcgacttaaaaacgtagatgaaacgacgtagttggaaaaagatcaccatttggcaaaaccttcatattcattgttggttctggcaacaattattattattattattttttttttttaattgatcattcttgggtgtttctcgcagagggggatttggcagggtcacaggacaatagtggagggaaggtcagcagataaacaagtgaacaaaggtctctggttttcctaggcagaggaccctgcggccttctgcagtgtttgtgtccctgggtacttgagattagggagtggtgatgactcttaaggagcatgctgccttcaagcatctgtttaacaaagcacatcttgcaccgcccttaatccattcaaccctgagtggatacagcacatgtttcagagagcacagggttgggggtaaggtcacagatcaacaggatcccaaggcagaagaatttttcttagtgcagaacaaaatgaaaagtctcccacgtctacctctttctacacagacacggcaaccatccgatttctcaatcttttccccacccttcccccctttctattccacaaaaccgccattgtcatcatggccccttctcaatgagctgttgggtacacctcccagatggggtggtggccgggcagaggggctcctcacttcccagtaggggcggccgggcagagggctgaccccccccacctccctcctggacggggcggctggccgggcagaggggctcctcacttcccagtaggggcggccgggcagaggcgcccctcacctcccggatggggcggctggccgggcggggggctgacccccccacctccctcccggatggggcggctggcccgggcggggggcggacccccccacctccctcccagacggggcggctggccgggcagagggactcctcacttcccagtaggggcggccggccagaggcgcccctcacttcccggatggggcggctggccgggcggggggctgacccccccacctccctcccggacggggcggctggccgggcggggggctgaccccccacctccctcctggacggagtggctggccggacagaggggctcctcacttcccagtaggggcggccgggcagaggcgcccctcacctcccggatggggcggctggccgggcggggggctgacccccccacctccctcccggacggggcggccggccaggcagaggggctcctcacttcccagtaggggcggccgggcagaggcgcccctcacctcccggacggggcggctggccgggcggggggctgatccccccacctccctcccggactgggaggctggccgggcgggggtctgacccccccacctctctcccggacggggtggctggccgggcggggggctgacccccccacctccctgccggacgaggtggctcccgggcagagacgctcctcacttcccagacggggtggctgctgggcggaggggctcctcacttctcagatggggcggttgccgggcggaggggctcctcacttctcagacggggcggttgccaggcagagggtctcctcacttctcagacggggcggctgggcagagacgctcctcacatcccggacggggcggcagggcagaggtgctccccacatctcagaggatgggccgccgggcagagacgctcctcacttcccagatgggatggcggccgggaagaggcgctcctcacttcctagatgggatggcggccgggcagagacgctcctcactttccagactgggcagccaggcagagacgctcctcacttcccagacggggtggcggccgggcagaggctgcaatctcggcactttgggaggccaaggcaggctgctgggaggtgaaggttgtagcgagccgaggtcacgccactgcactccagcctgggcaccattgagcacggagtgaatgagactccgtctgcaatcccggcacctcaggatgccgaggctggcggatcactcgcggttaggagctggagaccagcccagccaacacagcgaaaccccgtctccaccaaaaaaatacgaaaaccagtcaggcgtggcggcgcgcgcccaggcagttggcaggctgaggcaggagaatcaggcagcagtaccgtccagcttcagctccgcatcagagggagaccgtggagagagggagagggagaccgtggggagagggagagggagagggagctctggtactttcttatagccacacgaacagataaagactgtacctatctgttggctgggcgcagtggctcacgtctgtaatcccagcacttcgggaggcttagacaagcggatcacgaggtcaggagatcgagaccatcctggctaacatgatgaaaccccgtctctactaaaaatacaaaaaatttagctgggcgcggtggcgggcgcctgtagtcccagctactcaggaggctgaggcacgagaatggcatgaacccgggaggcggagcttgcagtgagccgagatcgtgccactgcagtccgtcctgggcgaaagagcgagactccgtctcaaaaaaacaaacaaacaagaggtccagagtgtgacaacatggccttgcaaccttgtgctcagggaccctggaggcagtccttcataggtctgctggaactcgccaacaattattaatagatactaaaatttgtgaatgaaagtttgaagagtaactatatatttccacagactcaaaatgtcttcccacaggatacttatccattacaaaggctaactttatagtggcaaaacctggcagatgctgctctaactaaagaatcaaagttaacatccccagtaattagactaatcagcaagtgcccccagatgtgatgcactgagaggaactcagcatcacctttgtgataatcctgccaaaggggcataacctgaattgaattatgagggggcatcagacacacccaaattcaagaacattctacaaagtaacctgtacaacaggttttcaaataactttgtttcatttaacatcattttcattgtaactattttgtggtttaagatcattttatgaagagcaagaggcagggagagatggcagggaggacaactagagcacttctacacccaccaggagaatagactccctccctgcttcctgttgtgctggacccctattgacttcagtagggatggcaccatgtttgcgaggctgaaaaagagacatggagccagcaaatgaaacataaggttttttgaggggatttacatacagggcagtccaggggcagcatgctgaacaggagaactgctaccacttataaaaaagcatgcagtttatacagcattttcacttagcccctcgaccccggcaatctccacctggcaaccttcatccaacccaaaacaaagggcctcgaacccctgtatggcctgtgatccatgggatggatcagatggttcagatgttcctcatagataaagaatgaatctctgggttggccattcccaaattccttcactcagaactctgaacacacattcatcttagaccacagggtcattctcagggtatgcttcaattatttatgacaggtgcatctaccatacacctgctccccaagtggctcccttgtactatggcagcggtggtggggagggatttgtgtaaactctgccctggagggtggggaaggtgaaggttggatgtaaaatggcagcagctggggctggcagtggtgctgctgggtgctacagggcttgtagggttccataaagagggctgagaaggtgttgactttgtctgccccctgcacctcatggggaaacagtggcagtttcacagtgcaaaagtctttataagtgttctccgtctggttcagatacttggcctggatcttgtgtcaggcctcacatatctttcaggattttcagggttggggaagagaagctgggtgatgatgatgttgtatgtgtcaatcttgtacttggccagctcctggatcagtcactctgtctcatacagggatagaactcagggatatattcgcagatgatacaggtaatctactcagggcccttgaactgtttgctgacaaagtagatgatggacagtgtctacttcagcatggaggacagcacgtctgtgttcatgtccccaagacctagaacgttgcatgtctgtaagataaaggggctgatctggttcttgatctgctgagtgtcatgtcaaccaccaccactgagaagttcatgcccttcaccagcctcatgacctcagcatagctcatggcctcattgatgccgggaaaggcgctcatggcttcctgcatcaacttcttgctcatgctcagcatgttttccttctcaaagaactcactgggcagctatgctgcaccctggctggggtcaatttccacagtgaagaggttgtcagagcctttgaccttggtaggcacctttgagaacttctggtcaaaaccatctgagatgttgtgggctaggtctgtggagatgatcagaatactttcatgcccttttgatagctggatggccaggctgcaactgcaagtggtctttcccatgccacctttgcgccagcaaggatccacttaacttaaggctgcatttctcaatgatgttgctaaacctaggctccagtggctcttggaggctgactttgggagactgaggtggaaggatcacttgaagccaggagtttgagatcggcctggaagtgagaccccatctctacaaaaaaaaatttttttaaatagacaagcatgattgtgtgtgcttgtagtcccagctactcaggaggctgaggtgggaggatcacttgagctcaggagttcaaggctacagtgagctatgattgcatcactgcattccagcctgggcaacagagcaagtccctgtccaaaaaaataaaaaataaaataaagaaagagaggaaggaaggaaggatggatggatggaagaaagatttcattatttttagggaatatttttaggaattccttatttcctaatttttatttatcttgctcagcactttgacttctgttttttttttttttttgaaatactgtaggagtaaacaagcgtcacgtctataacttactcttaaatagttccaaaaaatgataatatgtatatacatatgtacttatatgtctgtgtgtgtgtgtgagagagagagagagaaaagagagtgagtgagagtaaatgtagcaaaatattcacatttgagtaatccaggtaaaggatattcaggaattctttgtgctattataactttttggtaaatttgaaattacaatatgtcaaaatttttaaaaattaaaatcttcaaggaaaaacttcaacaacttaaagaataaaaaaaattgctcaatgaaatttgaatactcgttttggcaaaatctgtttatggcagacatatggtgtacttctgtatggcctttaagatatttttaggaacttttttgttttactttagaggaaagattaatgtctattaaagaactttgtagtttagtcaaatacaatgaaaaattagtgcaaatatgcatttttaagcttggtaggtcaaatgtttgttttggatttctggtcatgatggcttgcagtgttcatgacttgggcctcttattcatttcatacacatggtaatgatacataaaattttctaagatttttaaggacatagccatgtataaaattaatataaattcatctgactaggaactcactaaaccacaatgcagtaagtgggactgtaaccacatgcctcctgtgctctggattcagaaggcgtaggtaactgaaagctcatttcttgaatggtggagactcaaaatgttatacacacagtgcaggagactggagctagccccttttgcctccaccactttaagaaagactcaaaaaaagttatgactgctacctgagaaatggcttacataaaacctggaggtttagccaggtgcggtggtgcacacctgtagccccagctgtttggaaagctgaggcaggagaatcccttgagccaggagtttgagaccagcctgggcaacatagtgagaccccgtctattaaaaaaacaaaaaccttgaggtgtgggaggaagcagacagccttacagccaggtcttagtggtccaacctccttaggggtacagtgacaatctgtatgatatccctaatatcaggaatggagccataagccatccaatacaagacctggttctggactagggtctgtccacaagagagagtagaaacctcccacttcacatgaacttatacgctgaaattctaaaatacatgaggaacactgatgttgagaaagatagtcaataaacccaataaacataaatttactccagagaaaacaaaaatagttgaacatttaaaactgactttgaggccaggttgaggtggctcacacctgtaatcctggcattttcagaggccaaagtgggtggatcacttgagcccaggagtttgagaccagcctgggcaacatggcgaaaccctgtctctacaatcctgtctctagatataaaaaggcatggtggcatgcgcctgtagattcagctacttgggaggcacttattatctttaaattattcattctctattctgtctggtcagcctgaataatgcaggttctacaatgtatctaccatgtaggtttatttttatttatttatttatttttgagatggagtctcgctctgtcacccaggctggagtgtagtggcgtgatctcggctcactgcaacctctgcctcccaggttcaaccaattctcctgcctcagcctcccaagtagctgggattacaggcatgcaccatcacgcctggctaatttttttgtgtttttagtagagacagggtttcaccatattggccaggctggtcacaaattcctgaccttgtgacccacccgcctcgacctcccaaaatgctgggattacaggtgtgagccaccgctcctggacagtttatttttatttatcttactcagcactttgacttctgttttgttttttgttgttgttgttagttctggaaaattctcagccaatatatatacatgtgtatttcttgagataggatctcacattattgcccaggctggagcgcagtcacgtgaatcttgcagaattgtagaatctgcattacttaggctgaacagacagaatagagaatgaataatttaaaagataataacataaagagataaaaaactatgaagacaggtaagaggcattaaaaagctacaatgtatatctaataggaaacagaagaaaatgatatagggaatggcaaagaagcaatattttaaaaagaattggggggtgcagtgactcacatctataattctagtactttgggaggctgaggcaggaggattgcttgaggaccagcctgagcaacatagcgagctcccatctctacaaaaaaattaagtttagccaggcatggttgtgtgcacctgtagtcccagctactcaggaagctgaggtgggaggatcacttgaacccaggagttcaagcttctagtgagctatggtcatgctactgcactccagcctgggcaacaaagtgagatcctgtctcaaaaaatgtatatgtgggctgagaattttcctgaactgacaaaaaacagaagtcagtttaaagtactgagcaagataaataaaaataaacctacatggtagatacattgtagaatctgcattaatgataaagaaaattgtttatatgaattataagaatgattaactccaaaggaatggcaggagtttgacagcagtttgcttgatatcagtgataggtgcgaggtgacaactgggtggtatctttaaagtgctgagagaagataagtaacaaccagaattctccactgaattaaatttcactccagaaggtaaaataaagatattttgaggtagatgaaaactgagagcatttaccactcacaggcttttgctgaaagaactacaggtttatgtatattaataaatttcacaattcaaaaaaagctttgaaaacctgaagttgtcctttggtaagttttcagcaacctcatttgtggggcaaacttgacctaaactagttcatgggctaattttggtctttgtttatcccacttagtgtgaatacttatatgtttcactgtggagactttaatatgtttgaatccatggggtgctatcccaaccctgctgaaggtgttatatcacatctggtttgtgcaacctttataaaatctcaaaatttgtcacttccaaaccagaaaggtcccaggatttcagataagtgattatggatcttattaaaggattatggatcttatttctttagcaagaaataattgaaccaagagtgaaggagcagaatgtgggaaacagtagtgagcatgaaaattgatttgataaatgtaggtaaacttaattaattattgatttttttaaagtagtcatttttttcttttttctcttttttttctttttgagatggagtctcactctgatgcccaggctggagtgcagtggtgccatctaggctcactgcaacctccgtcccccgggtttaagcaattctcctgcctcagcctcccgagtagctgggattacaggcacctgccaccacacctgggtaatttttgtatttttagtagagacggggtttcaccatgttggccaggctggtcttgtactcctgacttcatgatgcacccgcctcagcctcccaaagtgctgggattacaggcgtgagccaccactcccagcctaaagtggtaatttttacatttaaaaaggtatattgtcctgtaggtatgggggtgaattttttaaaaaaggaaaaaaaaggaaaaggtagatatcaaaagaaataaatgacatccaaattggaaagtaaaaggtaaaactatattcacaggttacatggtcctatgcataaaaagcatcctaaagaatccaccaaaagaaaaaaaaaaaaaaaaaacttctagagcttataaatgaattcagcaaagttgcaggggacaagagcaacacataaaaatcagttgtttctatataccatcaatgaacaatctaaaaaggaaattaagaaaagcaattctgtttaaaagagcatccaaaagatttagtctattaggaataagtctaactgaggaggtgaaagacttgcacactgaaaactataaaacattgctgaatgaaattaaagaagagctaaataaatagaaagacaccctgagtacatggataggatgatgtaacactgttaacatgtcagttctacccaaagcaatctactgattcaacacaattttcttttcttttcttttatcttcttttcttttttttttttttttttttttttgagacagagtctcactctgccacccaggctggagtgcagtggcgtgatctcggctcactgcaacctccacctcccaggttcaagtgattctcctgctcagaatcctgagtagctgggattacaggcatccaccaccatgcccgactaatttttgtatttttagtagagatggggtttcaccatgttggtcaggctggttgattgaacacaatttcttttcttttttttttttttgagatggagtctcactctgtctcccaggctggagtgcagtggctcaatctcagctcactacaacctccacctcccgggttcaagcggttcttctgcctcagcctccagaaaagctgggattacaggtgcccgccaccacacctggctaatttttgtatttttagtagatacagggtttcaccatgttggccaggctggtcttgaactcctgacctcaggtgatctgcccgcgtcaacctcccaaagtgctaggattacagacgtgagccaccgcacctggcgattcaacaaaatttctatcaaaataaataggctttttcactgagagaagaagctaatcctcaaaatcatatggaatagccaggacaatcttgaaaaaagaatataaaattggaaagttcaaacttcccaactataaaactagctatgaagccacagtaattcaagtattatggtcctggcataaggacaaacatatagaccactggaatagattaggaagcccagaaataaatctttacatatatggtcatttgatttcctgcaaaggtgcaattcaatagggaaaggacagtcttttcaaccaatggtgctgggaaaactggatatccacgtgtgaaagaatgaaattggactacaacactcttagaagaaaacaggggacagttttcataacattaaatttagcaattatttcatggatataacaccaaaagcataaggaacaaaaaatatagataaattggacttcatcaaaattaagaacttttgtgcatcaaaggatactatcatgaaagtgaaaggacaacctacacaatagaagaaaatatttgcaaatcatatatccaataaggaattaatatccagaatatgtaaagaactcctgcaactcaacaacaacaaaacaacccaatttaaaaatgggcaaaggacttgaagagacatttctccaaagaagatatccaaatggccaacacatgaaaagatgctcaacatcattagtcattggtaaaatgcaaatcaaaacaacaataagatgccacttcacatcttctaggttggctgttttttaaaaaggaaaatagcatgtgttgctgaggaggtggacaaattggagcccttgtgcattgctagtgagaatgtaaaatagtacagctgctctggaaaacagttcggttgtttctcaaaaggttaaacctataactaccatatgacccagcaattgcacttgtaggtatacatctaaaagaattaaagaaggaactgaaacagatacttgtatacaaatcatagcagcattattcacaatagccaaaaggtggaagtaacccaagggtccatcaacagatcaatggataaacaatagatggtacatacatacaaaggaatattattctgctttaaaaagaaaataaatttatggccctgcagtggcttacacctgtaatcccaacactttgggaaggtacggttgaaggatcatttaaggccaggagttcaaggcttgagaccagcctgggcaacatagggagaccctgtctctattatttaaaaattatgaaggaaggaaagaaggaaggagggaaagaaagaaagaaattttgatacatgctacatgtacggcccttgaagacattattcttagtgaaataggccagaacgacagatattacatgattccacttatatgaggtacttagaataggcaaatatatagagatagaaagtagaatagaggttatgagggtctggggggtgggcagaagggggtgttgttgtttaattgatgtagagtttttgttggggatgatgaaaaagttttgggtattgatagtgttcatggttgcacagcattgtgaatatatttaatgacactgaattgtacagttgcaaatggttaaatgataaatattatgtatagtttaccacattaaaaaagttttccaatttaaaaagagatagattctagtcacattctaaaaaataatatcagaagatgagaagactgcacataagttatagaaagtgtgctttgggctttgtcttgttttatttttatttttgttttgtttgtttatttattttgagacagggtcttgctctgtcacccaggctggagtgcagtggtgcgatcacagctcactgcagccttgacctcctaggctccagcagtcctcccacctcagcctctcaagtagctgggaccaaaggcatgcaccaccatgcccagctaatttttgtaatgtttcataaaatcaaggtttcactatgttgcccaggctggtctcaaactgctgagctcaagcagcccacccacctcagccttccaaagtgctgggattataggcataagccaccatgcctggcccattgtcttgttttggagagttataaagataatgagtattttcagacattttcaaaaatatgtagataggccaggcgcggtggctcatgccagtaatcccaacactttgggaggctgagatgggtggatcacttgaactcaggagtttgagaccagtcagggcaacatggtaagaccccatctctactaaaaatccaaaaaaatagctgagtgtgatgatgcctgcctttggtcccagctaattgggaggctgaggtgggaggatcagtgcttgagcctggagggcagaggttgcagtgagccaagatggggccactgcactccagactgggtgacagtgggagacaatgtctggggaaaaacaatgtagataaatattatgttaatgttttaagatggggtctcaccatattgcccaggctggactcaaactgctgggctcaagcgatcctccatcctcagcctctgagtagaactacaggcatgcaccaccatgcctggctgattatgttaaattttaatactgaaagattatagattttgtctatagcttccaaactaacagggagggtagaaaagaattaaaacaaaactttactaacacaatagaaggtgggaaaagaaggtggggaaagggaaagaagaatggataatgggaaagacaaaataagatatcaggtcagaaattaatcagatacactgaaaagctactcgttaacatatagtgactgtaaggttgggtagagaagcagaatctagccatatgctatttacaagagatatacataaacaaaatgacctagaagggttattaaaggcacagaaacagatacaccaggaaaataccaatcaaaataaagctggtattgcaatattataataaaaatatcagactcaaagcctggaatttagaaaaattagtaagatatagactttcaatatttcctgtgtggctagcttcaaagatacattctacctggcatcacttacctgtctttcttatctttctaaatcaatttccacaaatatttatgagtaactatcagttaggtaatgagtcaggtaatatagtagaggcaaagatgagtacagcctaagtgcttactccatagaactgacagtctaataggagaaagtccagtaactttaaaacaaagtagcaaattgtgagcactgttagagagttttaagtgagatacgatggaaattgggcatgggagataaaatcaggaaaagactttacacaaaattggcatttgagatggtctttaaaagctataccaaagctataatttcactagaccatgacctagacatcagctttttcccccttagaatatgaagcacaatttgggactacttctttgctggacagtttcataaatttaggctacagtattatcatttcagacttcatttgctggaaatgtagcctactgcatttacctataacagctcatttgctgtattttttattttcctttccttaagacaatagcactgcgtggttaggttaacactttcattgcttttgaaagcccctcttctaacctaatcttttgccaggtgatgtccgcatacttcctcagggtgtcttagaagtagatttctatgctagctctccatgaaaggagaagagtatataatttgctttttcatacagtgctgttactattaggaaggaactaactttattctaaatgaaaacacactctatattaaagacaagttagatactttcccatgaagttggtctaggagaagggaaacggaatagatgcctcctgaaattttttcctgttccattcagagtcagatttttccccccctttatatggtcaacaaatgaaaactggcatttggaattaccatcgttccccccattgcttgccatcttcaaatttaatgtctgcctctccacaaagattaacatgtttccactcctgatttacttgtcagggaatttagaagttttctggaacctaaagttcactctggtagggatgattactggataattgcctattcttcggtggaatttccacttttagattacaccaggctctacagcctttatttctttggcaggaaaacccaaaggcaatggagtatatttttttcccttccctggcccagcttaaacaatgactcacttgggccctggggctttgcttcatactctcatttaggggccactttatacccttgtttctattttcctttcttgttctgtttggaccctttatatcctttggcacatgggatttgtctctggggttattgtcagagagatatataaaaccaccccaaactggaacagccactccagttatgtccccatagccatgtcatccttatggcagctggtataggccagggagagtacagaaataatatcttttttcttttttttttttttttttgagactgagtctcactctgttgatcaggctggagtgcagtggcatgatctcggctcactgcaacctccacctcccaggttcaagtgattctcctgcctcagcctcccgagtagctggaatgactggtgcacgccaccatgcccagctaatttttgtatttttagtagagacagggtttcaccatgttggccaggctggtctccaactcctgacctcaagtgatccacccgccttggcctcccaaagtgctgggattacaggcgtgacccactgcgcccagcccagaaataatatctttaaggaaacctaattccaaatgcagtagagggaaaagtattctccaaaaagaaagatatgagtgccagtgtcatccagttagaggctaaaaggctttcctccatatgcgttgctcgaatgactgattcagatgtcctctgtgtgtacctgtggaaggtgggaagcactcagaggaactggcctccaagagttttcggaaaggtatggttatatgaagagacttccccatagaaggactaggtctaatctagagttcagagttttgttggggagaaaaattccccgtttttggcagtggttctctctggtctcaatttttcattctgattccagccttctggattccatctaacaatgacttcttgacttttctctttgcagttttaacagtgtatgccagggaacacacattctctttcgagaattcagcttcgtccaagccaccccccacaatagggtatcatttttacgggccttctggagatgcttccgaactgtgggcaaaaatggcggtaagtcttcccaaattctttttccttccttccttccttccttcctttcttccttccttccttcctctctctctctttctttctctctctcttttcctctctttctctttcaaactttttcttttgttcctataaatattgtttgaatgcatgctattcaaggcatttagaatacctcacttttgaggagttgtctggtttatgtcaaagatattactattaccactaccatcactaatggtacctattaagagccaagtgtagctctttacatgtagtaactcatttatctttacaagggctctctgtggtagataccataatccccattttgtaactaatgaaactgaggatcagagaggttaagtaacttggcaaggttacatagtaaattctgggcccagatttatacccaggcagtctgacttcacagcccttgctcttggcagatattaaaatgccatgcagtaaatacaaggaataatgtgaatatgaagaaagaaactcctgaatgggggtgggatggggatactgttgttagagaagggagagaaaagtggagtagagaaggttctccttagaactgactgtttgatctaagctgggaaggaagagtaggaatcattcacatggataaaggagagaagggcatcctaggtagaacatatgctgaagcacaaaagaacctagaatacttacataacagatcaggatgtctagagtttgtgtggagtttatgaaggaggttaggggagatgagactgtaaaggaataatggagctgctgaaagatcattttttagccataaaaaagaaattgggccaggcacagtggctcagcctgtaatcccagcactttgggatgccaaggcaggtggatcacttgaggtcaggggtttgaaaccagcctgtccaacatggtgaaaccccgtctctactaaaaatacaaaaattagccaggtgtggtggcgcactcctataatcccagctattcaggaggctgaggaacgaaaatcgtttgaaccctgggggacagaggttgccgtgagccgagatcgtgccactgctctccagcctggacgacagagcaagactctgcctcaaaaaaaaaaaaaaagaaaaaagaaaagaaaagaaattggggctggatgtggtggctcacacctgtaatcccagcattttgggagcccaaggtgggaggatcacttgagcccaggagtttgagaccaacctggacaacatactgagacttcgtctctacaaaaaaataaacaaaattagccaggtgtggtggcacatacctgtactcacagctacttgggaggctgaggtgggaggatcacttgagctgagggaggttgaggctacagtgagtcatgattatgccactgactctagcctaggtgacagcgagatcctgcttcaaaaaaacaaacaaacaaacaaaaaagttaaattttattctctgggtattatttgaaggcttttttttttttaaagaccctgttgcagccgggcacggtgactcatgcctgtaatctcagcactttgggaggccgaggcgggcagatcacaaggtcaggagatcgagaccatcctggctaacatggtgaaaccccatctctactaaaaaatacaaaaaaattagccgggtgtggtggcgggtgcctgtagtcccagctacccgggaggctgaggcaggagaatggtgtgaacccaggaggtggagcttgcagtgatccaagatcgcgctactgcactccagcctgggtgacagagcaatactccgtctcaaaaaaaaaaaaaaaaaaaaaaagaccctgttgcccaggctggagtgcagtggcatgatcatatgatcatagttcactataaccttgagcttccaggctcaagtgatcttcctaactcagcctcccaactagctaggactacaggtacatgcctaccatacctagctaattttaaatttttttgtagagacggggttttgctgtgtggcccaggctggtctcaaactcctgggctcaaggcctcagcctcccaaagcactgggattacagatgtgagccaccatgccccatcttatttgaaggcttttagataggagagtggtgtggtgatatctgagctctagaaagatcattcaaaaggcagtgtagaagatggcctagactagagacaaggaacatagaagtctggtagtagttgagtgagagattagacccaacactaaggcagtatggagacagaaggggcactttcagagatagaatccataggatttggtgattggatttggcattaagatgagagagaagaccgtggtaatttccaagtttttggcttgggccactgggtaagaatattttttaaaagccttcaagtaatagccacagaataaatttcaatttttttttttttttttttttttttttttggagacagggttttactctgtcacccaggcaggaatacaatgacacaatctcagctcactgcagcctcgaccttccaagctcaggtgatcctcccacctcaagtagctgggaatatatttgtgcactaccatgtgtggctaatttttctattttttatagagttggggtttcgctatgttatccaggctggtctcaaactcctgggctcaagccactcgtccacctcagcctcccaaagtgctggggttataggcgtgggctaccatgcctggtctcctactttcatattatgtgttttcataaatacctttaagacaatttcttgcttgcttgcttttctttttctttcttctttcttgccttccttccttcgttccttccttccttcccctccctccctcccctcccttccttccttcccctcccctccccactgaggttatagtcagtgaataggtagtctccctgcttttgaatttatgagattccccaccatgctctaatcaatgctactgctacgaaactgtaacttttctaaatagctactaaatatatagctattaaacttttatatgtagttactaaatcttttctaaaacttttccacccaatatcttattagttccactgccctaagaaataggtaaagtgggtattattgtgcccattttgtaaataatgaaattgtgtaacttgcagaaagatttcatggtgaattagtagcaaagctagaaattgaacccagatttactaatatgctgatgtgctatttctactatttttacttcaatcattgcctctttgacatataactctggagatcatgcatctccattacagtattatgaaagaagtacttagtgtactgaggatcgtatcatttcccttacagaataaatgcactaataggcaaaaaccaatgtggactcaattttaagttaagtaattcagaaaaactattccattggtctctatgtaaacaaaactgggaactgtgagtatataggtaaagctcgtgctatgttatcagaggttatctttcccagtccctcactcagtcagcaaatatttgttttagaccacctagtacagtcgtctctcagtctatgcagggattggttccaggacccctgtttataccaaaatccacgcataatcaaggcctacattagtcctgtggaactctcatatgtgaaaagtcaatcttccgtatacagggcttcatatccctagaatagtgtattttcgatccatatttggttgaaaaaaatccacctaaaagtgtggacctgcacagctgaaacctgtgttgttcaagggtcagctgcatgttgaagaatatggctagagctagtttctgtgatagaacatatggagataactatggaaaacagtcttcagatagccttaacttttttcctgatatagaagtggggcctcttcaagaatgtatttactatcacgagggattcatatagcatttggactcttagcagatgtgggtttctttatctttctaatagcagctgccagtgactcatccagctgctaagaataagcagctccaaattcccccagtttctccttgtgccataaacaagacctagattttatgctggctgtttattgttatccttcttaatcagacagcctcagatttcttagactaaatgcaacatctgtgtctaggtgttcctaaaataattggttaagtagctttaatgtattctcagctttttctaggaaactccagaacatctttctaaaccagaatgtgtcaatctccaattttaatccggaattagtgaaaactcttggcggcaaggttctaaaggaaaggatttattaagccccattttatcaattataatgccaggtacctacctactcagtggaactcctactgcattattcttctgcagataacttccttagaatgtcatgtgcatactttagcattatcaagtggaaagtaactcttctgggaggtagcaaaacaagagcataacatatctaaaaatgaagccacctgtagaactctaaggacctggtcccttttgacaaaaaatattttattccagtttttagcaagtacaggatatgatatcttttctgcatgactgagtactgatgctaattatcttgtccaaattttagataatctcatgaagactgtaacaaacctcttggtatctaagcaactttagactcttggaagcaaaagttatattagaattttaaaagcctttaaaattacacttctcactttgctaattttttctgtataggaatattaatctgaattttctaagtctggcaaagattgatattctcttaatgtaaatctttacttctgtttagggatatcggctcaaaagtgccttctccaagtttattttcaattagaatttaattttcaatatatacatatatacacatacatacatatatatatttcatttgataaaataatgataggtacttcctcttctatctgtgaagaagtatctactaagggaattgccctcttgccactaacaatgagaaaatcagcatatctgaaacaacagttttcagacattgggcaataggcagtgggggctgtggattctgagagccagtttccaagcaacagtatagggagagagattgtcaaagagcttagcagtgttattgagttgaggaggcagagactggggtttagggaggctggagcagccagtatttacaggtcagaatccaagagaggaagaagttgttcagtgagctccagaatctttggctacaaattctgcatatgtgtgggctggaaaaagaaccaccagaaaacagtgggccaaacaatttctggagtatacaaggggctaaggataattcaaacttctaccagccatagggaagagacctcaaaacacaccgggcactgggtagagttctcaacagtttaaaagcaaaaaggattaaatcgatccgcaagtaatttaatgctatataagaacaaaattcaataatctttaaaggaatttaacaaaatccagcattcagcaatgcaaaattcacaaagtctgacatccaattcaaaattaccagacaggccaggcatggtggctcatgcctacaatcccaggactttgggaggccaaggcaagtggatcacttgagcccaggagttcatgaccagcttgggcaacagagcaaaaccctgtctctacaaaaaatttaaaaaattagccaggtgtgacacctgtggtcccagctactctaatggctgaggcgggaggattgcttgagcctggaaagttgaggctgcagtgagctgtgatcgcaccactgcactcaagcctgggcaatagagtaagaccctgtctcaaaaacaaaacaaaacaaaataaaattaccagacattaaaagaagcaggaaaatacagcccataaccaggagaaaaattaatcaatagaaacacagatccagaaatgacagagatgatggaattaactaacaaggaccttaaaatagttattttaaatcatataaatatgcttaagtatgtaaagaaaacatgaatatgattaggagattagtggaagatattaaaaagatccaaatggaatttctagacatgaaaaatacaatatagtgaaaatgataataatagcaattaacatttattaagtgcttctatgtagattatctcatttttcttcacaacaaccctatgtgttaggtagatgctattatttcctttgcatagaaaatgaaacagatttagaatgttaaataacttgctgtaggtcacacacccagtcaatgaaaaagccaatgccaggagaagccatgaagtctgactccaggctgtattattgcttcagcgtgttatgcatcaacactgcatgacaggctggaaatacaaatgagtaagtgacaatacttgccctcaaggagctcttattctaggagaagaaacagtagcataggaaccaacccaaatgcccatcaatgatagactggataaagaaaatatggaacatatacaccacagaatactatgcagccataaaaaggaacgagatcgtgtcctttgcagggacatggatgaagctggaagccatcatcctcagcaaactaacacaggaacagaaaaccaaacactgcatgttctcactcataagtgggagttgaacaatgagaacacgatggacacagggaggagaacatcacacaccaggtcctgttggggggctggggggtgaaggaagggaagttagagggcaggtcaatagttgcagcaaaccaccatggtacacgtatacctatgtaacaagcctgcacattctgtacatctatcccgttttttttagaagaaataaaataaactagattcttaattcaaccccaccccctctctgccaaaaaaaacctgagtggtgtagaaatagtctccatagagtacaggtgatttttagagccacacataagattccataatagcacaagggagaaaatagtcaattctatagaagcgggtgaaggctataaaggtgcaaagacagttgggatggatcttggagcagtagaaagctgttaagcaaataaggaatacgttctaaaaacagggaacacgatttctgaaagtatgataacatgaaacaacatggttcctttggaaagtggtaagaagtcattgtggccagtatttaacacataataaggaaacactaccacagtcaataggagataatgcggaatgcttttatgtgccatacactgagcaaaatgtttacatgtattcattcatttaatccacacaataaacatatgagttgatatgattactatcctgttttatatgttaagacacagagtccgctgggcgcggtgactcatgcctgtaatcccagcactttgagagcccgaggcaggtggatccttgaggtcagaagtttgcgaccagcctggccaacatggtgaaatcccttctttactaaaaatacaaaaattagctgggtgtggtggtgcatgcctgtagtcccagctactcaggaggctaaagcaggagaattgcttgagtctgggaggtggaggttgcagtgagccaagatcatgccactgcactccagcctaggcaacagagcgagactctgtctcgaaaaaaaaaaaaaagaaaagaaaaagaatcgaaactgagagtcagaggattaagtaactcacacaaggccacagcgcttataagtagcacagctcatattccaacctacgtcttcacaaagttcacattttcacattctttctcttttcttttcttttttttttttttttttttgtttgagactgagtctcactctgttgcccactcactgcaacctctgcctcccgggcccaagcaatcctcccacctcagcctccctagtagctgggaatacaagcacataccaccacacccagctaatttttgtattttttgtagagatggggtttcaccatgttgcctaggctggtctcaaactcctgggctcaagcagtccacccgcctcagcctcccaaagtgctgattacaggtgtgagccaccactctcaagcccacaaagtccacattcttaacaactctgctgtgcctgctaccccaggttatgaagggctttgtgtgcactaaaaagcataagaatgatacaatggactttggggacccggggaaaggatgggttgggggtgagggataaaggactacaaattgggttcattgttactgcttgggtaatgggtgcaacaaaatctcacaaatcgccactaaagaacctactcatgtaaaccagataccactggttcccccaaaaccctatgaaaataaaaaatttctcctgaagttagtagaatcttctccatttgtgtggtattttcacatgtaacacagacaaaagcatggaaaatgtaaggcaggtaaaagtgaaagcatagacccgttaggagactactacaatataacagaaatgaccatgaaaatgaagagctatttaagaagttggtttgacaggatttgctgattcattgtgtgagggatgtggcagagaaagagtcaagaatgaatgccagaatgtaaagtatggccagttttatccctctcttgcttttttcctttccttttttttctttcatcttttatgtttcactctgaattcacagtggttttgtgttcatatttattcattcgacaaacatttatgtatcagttcttggtgataaagcagtgactgggacagacagaaatttttattcttgtcaactttgctgtatgatcagaaaattgacaaaaatccctgcttttatagagcttacattctaggaatcagggaattgcagtgggtctatctgagtatgtgataaaaatctgttagtttttctaaaatatctattgtttatggtggacaaagtgatgtcaagggaaaatgcagacactttaggctgaaatgaagatgttggtctgacttctttttgtaattgccttgaacttcacttgattttgcttgtcactaatccttatcttcaccagtaaaaatcattcagtgaggattaatagcgctttactacaggagtgggtggctgtctttgaattattaaagagcaattgttgcttctgtaatgttttaaacaaacaagaactgttccatgtggtctcttcagtgatgtgggccccaccagccaattatcttcacctgctccagccagtgcatctcctcttctcattttctcccagaaaccagatgtagacaatcaacaagaatttcagtgcctgtttcctagctcccgttttgtttatttctcctgagttcctaattttccctttgtttttcatgtttatttccttcttcaaaatcttttctccagggagaaaattgacaattgatggcccctcaaatcattcacctctgtacctccaataactttaatctttccccctatttaatgttctcttttttttcaatgttggttatttggggctcttacgcaagcattcctggaatgcttttgtcactatcttctctcccacctgaagctcctcaaccctccatacataatacctgtaggttttagttttaaaggtcaggtccttaaagaagccttctctgtgactcccttccttatctgaattgggtccttccattataatttttcagattatcctctgatttttatcatatcatttattacagtttctgactcagtatttacttgaatgacttttaatgtccatctcccttattaaaattataaactttatgagtacaggaaccttgtttgttttgccagtaattatatccctagcacctaatacaggtgaatgatttttttgttatataatatgaaggcttaccttttcccagtaatgatacagaagatagattattgaatggattatattatcattcattttatcagaggataggttagtttttaaaatctgctttacactaacttttctatattgtataggaacttctgatttaaattaataatagctaccccttattgagcaaatgctatatgccaggtactaaagttcatgtttaaagtgttccactaaaaaccagcctaatcaaagctatactatactaaataacacctaattaaaataatattcagtattccaaaataaggatttgaaagatttagatcatgatctgtaatcaaactttaaacactggtgaatagtacatccgttccttcttttgtattctgggtttttgccttcactccatgaaaggtatcacaaactagtagtcggctaactacacatgccttggcctacagatgtgtcttctttgactttcagtgttaaaaatacttagattcaattagatgccaatgtttcacataaaagtctcaatttcagtttcacttgaagaatggaaaatcctcccagcaccatgcccacattcctgcagggagacagttcaccagggcagagatgcagctgctccctttagacagggcatgtggtctcagatttaccaccaacccaagctgccctgcttcacctgctgacattccctgcgcgtctgtaggcattggagtttgctaccattgctagagcttcttggtccatttataatcactaaaaggtaaagtttcactcttaattcagtcaggagctttttcctcaactattaatagattctctttctcttttctccttgatatctccatgatatcacataaaattttagaattagaagggaccttagaaattatttcatcttgaaactaggtcttaaatatatatatatggtttttcttattattgtggtaaaatatataacaaaatttaccatttaccactttttaatttgagaaatcttttttatggcaataaaacctatataacaaaacttaccactttaaccatttttaagtgtacagttccgtggcattaagtacattcacagtgttgtgcaaccattattaccctccatctccaaaactctttatcttgcaaaaccgaaactcagtagccattaaacaatgactcccatttctctcctcctccagtccctagaaaccaccattctactttctgtatctatgtatttgactattctagatacatcagataagtgtgtacaatatctgtccttttgtgtctcacttatgtaacttagcatgatgttttcaaagtgcatccatgttgtaatatgtatctgaatttcattcctttttatggctgaataatattccattgtgtgtatataccacattttgtttattcattcacctgttgatggccacttgggttgtttctacattttcgctgttgtaagtaatgctgctatgaatgtaagtgtacaaatatctttctagtccctgctttccattactttgggcacataactagaagtgggattactgtaccatacagtaattttatgtttaattttttgaggaactgctgtaaagttttctacagcaggtgtatcattttacattctcaccagcaatgcataagggttccagtttctccacatccccaataatgcttgttgctattttctatttttctgataatagccatcctaaagaatgtgaagtggtatctcatggttttgatttgcatttccttaatgacaaatgatgttgagtgtcttttaatatgcttattagccattttatatcttctctagaggagtatctattcaagccctttgccctttttgaatcaggctgttttgtcgttgagttgtaggagttcttcatgtattctggatattcattccttatcaggtatatgatttgcaaattttttttctgttctgtaggtcatcttttcactttttttttatcatatcctctgatgtacaaaagttcttaatttcaatgaagtccaatttatctgtttttcttttgtcctctgtgtttttggtgttatatctaggaaatcatttacaaatccagtgtcatggagatttcccctatgttttcttctaagaaatttctagttttagctcataaatttaggtatttgatcaattttgagttaatttttatgtaaggtattaggtaagggtccaacttcattcttttgcacgtgcatattcagttttcccaacaccatttattgaaaagactgtcctttctccccttgaatggtaccctttgcacccttgtcaaaagtcaaatgaccatatatatgaggatttttgtttctgggatttacattctcttttgttggtttgcctgtccttatgattactgtggctttgtaataagttggggtttttttgttttgtttgtttgtttgtttggtttgtttgttttgagatagagtctcactctgttgcccaggctggagtgcagtggcacgatctcagctcaccgcaacctccacctcctgggttcaagcgattctcctgcttcagcctcctgtgtagctgggattacaggcacatgctaccacacccgctaatttttgtatttttagtagagacggggtttcatcattttggtcaggctagtcttgaactcctgaccttgtgatccacctgcttcggcctcccaaagtgctgggatgataggcttcagccaccacacccagccttgtaataagttttaaaatcaagaaatgtgagtcatccaactttgttcttcttcaaggttgttttgggtattcttggtccttttaaagatattttatgaatggttttttctattaaaaaataccattggaataccattggaattttgataggattgcagtgaatctatagatcactttcggtggtagtatcaccttgacaatattaagtcatttaatctatgaacataggatgtgtttccatttatttaggtcatcttcagtttctttcagcaattttttttttaagagaaagtgtcttgctctgttgccctggctggagtgcagtggcacaatcatagctaattgtagccttgaactcctgggctcaagcaatcctcccacctctgccatcaagcccagctaattttttatttcttttagagatgaggtctcactctgttgcccagactggtctcaaactcctggcctcaagcaatcttcctgcctctgccttccaaagcagaggggttgcaggcatgagctaccacgcccagcctctttcagcgatgttttgtagttttcaagtatacaagtctgtcacctccttggttaaatttattcctaagtattttattcttttcatgctattgtaaatggaattgtttttcttagtttccttttcatatttttcattgttaatttataaaaatataattgattattattattattatttttttgagacaaagtctcactctgtcgcccaggctagagtgtagtggcgtgatctcggttcactgcaacctccgccacccgggttcgagcaattcacctgcttcagcctcccaaatagctgagattacagggacatgccaccaccccagcatgtaattgatttttgtatcttgattttgtatgctgcatctttgctgaattcatttattaggtctaacagttgtgtgtgtgtgtgtgtgtgtgtgtaaaatctttagggctttctgcatataagatcatatcatctgtgaacagaggttattttatttctttctttctaatttggatgccttgtgggttttttttttttttttttttttttgtttgtttgttttttccttaattgctctggctagaacttcctgtactatgatgaatagaagtagtgaaagcaggcatctttgtctttttcctgatcttaggggaaaagtttttcagtacagcaggtcctcaaataacataattgcattataacattgatgaggaaaaaaaaaattgattcccagctggggccactgtgtgaaatttgcacattctccccatgtctgcatggattttctctgggtactccagttttctaccacagatgtatgtgttgggttcattggtgtgactaaatggtcccagtgtgagtgaatgttggtgtgtgtgtgtgctccccgagatggaatgagatgtcctgtacagggctatccaccttgtgtcccaggcttccaggataggctctggccacctgcaaccctaagctagaataagcaggttggaaaatgaatgaatacaaattattattgaatacaaattattatcaaatacaaatttataaagtagatgataatcatacaactgcacaacaataagcgatgaggtatgaaagcgttcagctagcccaccatatttgtgattgttttttaattcatggtcggaggaggtgctccttaaatttttctatttgcaaatatctattcccttatttaatccaccaccactacaactgtcgtcattcagcgattcaccaaaaattgggtaatcttacttgttgttattaacctttcttaaatgtatgtatagcccacatttatttcaatgtttaatattagaggtgtgtagggtctttatttagaagttgggtgattatttgtgaccagaaacatgccataggaacttaactcttgtttatgtcgattagcctatgatgaaattggttttattataccttgtttcacttaaagtcagtttccaagaacctattgatgaggttgaggacttttatttggttttaaggtaaaagtgtgccaaaaaattgagattcatacagataagtagcttcaaatactaatagatttgtttttaacattttgactgatctttttttagctttactaatgttcagaaagggagtaatagtaaatttgtgtttcaaagctgagttgctcacattcctaattaatgagtaatcactctggagaaatcaacaaattttctcagctagtttaaaaattttattgtttggagaaaaataaatgtatattataacatcatatataagttgttcaatggtattattttttgaaaagatcagatgactcaaaggctagtatgactgaactgtgtctgccccccccaaattcccatgttgaagccatacctccaatgtgactatatttgaagaaattcctcctgtaaggaggaaattaaggttaagagaggtgataagggtagggcttcatcagataggaaggattagtatccttgcaagaagagacaccggaactggtgtccctgtaagaggagataccagagagctgcccatgcccctccacgtgaggacacagtgagaaggcagctgtctgcaaaccaaggagagagcctttaccagacaccaactctgctggcaccttgatctcagacttccagtccccagaactgtgagaaaattaatttctgctgtttaagtcactcagtctatggtatttgttacggcagcccggacagactaacacagaggtcttctttttaactcacagtttcagcacagaaagattcattttattttgcatgttgactccaaaacctgttttgatttatcattaacattttatctgaagttgtgagtatggccgtgttgtgaccctgcgttatcaaattgagccatctaatttatttccacattgataaacttatattcaatggattttagtttaaggtagaaataatggtaattactttttttttttaactgtagtcctcatacctgccttatgtcaatcaggaaactttagtataaaagaataaattttgatacaactgcttatatccctgcaaataactcagaaagatctgcagcttaaagactttgtcctaataaaactgacagcctgtatcaatctgtatgttatccaatgtaatattttttaaaatgtaaatgttaattttgaaaactgcatgtgtaattttggccaggcacagtggcttatgcctgtaatcccagtactttgagaggctgaggtgggcagatcatttgaggccaggagttcaagaccaacctggccaacatggtgaaaccctgtctctattaaaaacacaaaaattagtgaagcacggtggcgcgcgcctgtaattgcagctactcaggaggctgaggtgggagaattgtttgaacctaggaggcagaggttgcagtgagccaagatcatgccactgcactccaatatgggtgacagagcaagactccatctcaaaaaaaagaaaagaaaacttcttgtataattttaactgctagtgcttatctacacaatatttttggctgccttctcttttatgtgatcctctactccttgaatttttttctgccattgcctttccagtcaccgtacaaatatgactaccttatactactttgttagtatcttaacacttaaagacttccattttataattatcaagcattttataaaataataaatttactttgcatttgcttctataccagatcatataagtaaaaggagagcttgacaacatctgtcttctcatccagtataaagattttatgtaatctcagctttcatgccaatatagtcctggattaaaaagaaaataaaaagaccagagcagataataatttcctaatcagtggcacatttacagttgcaaatatatatatatatttgtggagtaggagaaattccacaaatgagttaacctatgagcacaggttgatagtgtgtgtatattaaaatttactgtgtaacatatttagtgtacattttgtttttcttatagactttaaataaaagtatgtttttaataagaattgaaattaaacttttatagaaacttctaagtgcctctgcaaatttctaagcttctgtggaacatggtttgaaaactactgatctacttcaacccttccccattgtgtaaatataaaaatcaaagccaaggtctcctagtcacttggtaggacctgtaaaaccaagactaaattcaggtcttctggttgtcagtcaaatgttctagccattatcatgctctgctgctaaatgaacatatacattttgtgtcatttagtctctgagatgaatgtatgattttgtagcccaaaacgtaattgtagtagttaaggcataagaatgcattgcccatgtgattttatttcttctttcattgttttacagatgaaggtaaagtagctacaagttctttaattttaagttccattttacctatcttcaagagaaaaaatagttactccacctggtttaaaatttaaaaataataattcttattagagagggacgtataatacttgtttattggatatttcatgctttgaaggacataataagcagattttggaagttctttgaaaatacaagagttttattgttgttgttgttgctgtttattttattattattattttttttttgagacagagtctcactctgtagcccaggttggagtgcagtggcacgatctcactcactgctacctcctcctcctgggtcctggttccagcaattctcctgcctcagcctcccaaatagctgggattaccggcatgtgccaccatgcccagctaatttttgtgtttttagtagagacgggggtttcaccatgttggccaggctggtcttgaactcctgacctcatgatccacccgccttggcctcccaaagtgctgggattacaggcatgagccaccgcacccggccgttgttgctttttaattttaaagttaggctgaagtgagactgtaacacacaacgttattaaacgcattctctaaagtagatctaccaagccaggcacagtgcacatgccggtaatctcacttgagcccaggagcccaggagttggagaacataagtgcactatgaatgtgcctgtaaatacccactgatctgcagcctgggcaacagagtgagacaccatctcaaacagggtgggtggatggatggagagagggggagagagagagagagagagagctggaagtatgtaaaagcaaatataaataatgttgaaaatttaatattttccagttttattttgcttggcataacctgctcttgattcccactgataccgcctgaccctaatttagaaacctaattagacaccttggggaggttgtcaaaaagacagattccttgatcccacctcaaacgtactcgaccacagccagcaggcaaggggcctgggaattaattttaacaagcatttcaggtgattcttaggatcactcaagtttgggaaacattaagcggtttcaaccctgcttgcatattaggatcagctagggtgcttttaaaaaatactgttgcctaggtccctccccagaccactttaatcagaatctttttggttgggacccaggcattttaaatgctctgcaggtggttctcatacacactgaagcttgagaactcctgcaagacagttggaaatgtaattctctgaagcacagccctggtcttgtcactgctgctgagaacctcaatggttctgtattgcctactaatgaaatatgaatttatgactatcataaggctactcatgacccaacaccagctttccaaccactactctcctacttatagactatactctggccacacagaaacactttccccaaacactccttgtgctttccccctttcacacctctgtttttgctttcccaccatgtagaactttcccccatgtctgtctgtcacagtcctgcccatcctcaaatagacccagctcaagtagattcccatttcctcctgtccttgccctcccctgcctccattcaaaagcgacctcttagggcatttgtcctatcataccttatatttagttattggcagatacatagtctctttcataaaatgccatgtggaattaagaataagtggatttttatctttcctttttccccatctagattgtaaatttgtaatatcaactatctgtttacttctgtgtgaggcactaaagagaaagactttagagtcaaatggccctaggttcaggtgccttttttattggatatggctgtgtgaccatggtcaggttaatttttccaagccttagttttctcatctataaaatggagaatatactacttcagtgttgtgaaaactagatttgataaccgactggagccttcagtaatcccggtatgtaataactgctctgtcaaagtctgttgcttttatcattgtgataatgatcattgttagctcccttgagggcaaagactgcatattttatctttggatccccattctgaaccttgcttattgtaggtgcttgataaatactgggtgaataaaataatgaatgcctgctgggtcgtgcttacttatatagtccactaccaatcagttcagcctgtcttggaaggagcacttcaaatttcaatttaaccatcagataaagatagaaaataggatttccactacaaactttaaaaactgtattaaaaaggccaaaaccccagttaaactgtaagacagctgctctctttctgctgccaggaaatagagaaaaccctccaaggactatttgctgtttgtttgtgcatcatataataaacatgctgtgacttggggagagcacacacttcccctgcaggcaagcttgggtttgggaagttgcatgtagcagcagtgaggaagaaatcccccactctgtgggagaggttccttcacggactccactaagcccatttgcagttttgctgagttatttactaagatgaagggactgggtgtggctggtctgagattcctcctgggaagtcacttcaagaatctccttaatttcctcacccttcatctttgttctctggctttggtgcaagggtgcagtcagtcgcacccagttggctgctgttcccagcacactgaattatttgaagctggctgtggcagccaaggattccctgttctgttcttttccccttgccctgatttgaaaaacggtctggaaattctcatctggcatgaccagaaggaacttagtaggttgcaagctgtttttctagatgcacaggaccaaacagaacctttaaagctgtaaattaccatttctcaaaaactcaatttgatggattttacatggacaaattatataacgtaggctttaccatcaccactatcgtttaaacaagaggccatccaattgagatgaaaccgatataggaaagtaattatcatcagctttgtcacttgaagaaggaatgtgaggatatattagctaattgaaacctcaggaaagatgtataacaaaacatataaggattaatgagtagtccacaaaagtgtttaccagatgaccaatatcttttaaaatatatagatgtattccagctcttttaattagaaaatatatatatatacacacacacatatatggataaaaaatgaacttataattacaatagatgtgatgacaaaataattcatagtctgaaaaatatataatttcagtgatcagagccttatgtattatgctaattgtccaataatttcttgaaagtatgtttctacttttaaagtaaaattaaattcagaaagcaatgatgagcaaatatgtgataatattctaggcagacactgaacatttatatttattgtgagaacagcatgatggtagagtactatttatataaaattatgtatctttatgtctttatatgtttacatgcatacaaaaatatttggaaggaggtttactgaaatgttgtgaatgattttctcttagtgttgagactacttttttcttcacacatttttatattgtctgagtttttataatgagcatataacatttttataatcatagtaaaaataaagctatttttatagctttcatataggaaaattttgcttgagcatctgctatgtgtccaaagtggtactagaaattatgagatataggaaagaaggctgtggcctggctaccaagatgcttacaatctagctgggaagacaactagggagtgggatcctatagaatgtaatccggtgtcgggatgtatggttcaaaaaggtgctacggagcatcaggaagaggagaggaagctctcaatggaaggaagctttcatcgaaaatgaagattaggctgggtgcagtgactcatgcctgtaatccgagcactttggggggccagggtaggagggttgcttgagcccaggagttcaaaaccaacttgagcaacatagtgagaccctgtatttttttgagaaatattttaaaacttagaaagaaagaaaaggaagcttagattggaccttgaaagatggacaaaaattgaataggagggagagaagaaggcattttaggcagcatgagcgctaaagtgataataataatgctttttgaaaagaaaggaggaaaccagcttgtctagaataaaaagtaaatatgatttgtgatggagaagtttgctttattgctaagtttatttcataagatatctttgatatattacaaactatatttttgtatacttgagcaggtcctagaaaaatattttgtaattattctgaatattgactctaaagtgatgtaaaaactatgactactatgaaaaattcattattttagtgtattgagggtagaagatttcagtacatatgctgtgtaacactgtcatctctgtgcacaagcttgttctcaagtcaaacagtggcttttcatatagtcttttaatttgtggttaatatgttcctacacctttcttcttctattaaaaaaatcaaattagccgaacgtggtggtgcacacctgtaatcccagctacttgggaggctcaggcgggagaatctcttgaactcgggaggcagtggttgcagtgagctgagattgcgccactgcactccagcctgggcaacagtctcaacaacaacaacaacaaatcaaaaagcaccagttgccatggctcatgcctatagtcctagcactttgggaggcaaacatgggaggattgcttgagcccaagaatttgagaccagcctgggcaacacaatgagaccaacatctctacaaaaataagaaaaactcaccaggcatagtggctcacgcctctggcccagctacttgggaggctgaggtgggaagattccttgagctcaggaggttgaggctgcagtgagctgtgatcatgccactgcatttcagcctgggcaacagagcaagatcctgtctcagaaaaaaaaaaaaaaaaaaaacagaaaaaaaaaaatcaaaactaaggttggggaaggggggaaattttcttttaaaaaagacattaagatggagacttttcaaacaatggaatcagaattcacttttagcagttacttagttaacaggactatattctgtttgtagtgtataccctaaatgctgtagccatgtaagtgataattacaatgtatacaagtcttcctgagaaccatatatttgaaattttaagtacaaaatgtcagccataaagttttccttattgaatttgtgtattattaagtgctttcaatgttcaaagctctatgccagatgaaagatatacagggagctccctcattcatcgattcgtttattcaacagtatttttttagtgtgtcctctgtgccaggtattattctaggtgctggtactaaaagaataaggagaatatagttctatttttaaagagttcacagtctcgtctgaaagaaaatggacatgtaaatagttatagaccctctagaaagtgtcaggccaaatacatgtgtttatttgctgtctctgtagagcacactaaaattgtaatacgtcaggtgtggtggcttatgcctgtaatcccaggactttggggaggccaaggcaggaagatcacttgaggtcaggagttcgagaccagcttggccaacatggtgaaaccccatatctactaaaactacaaaaattagccaggtgtgatggcagatgtctgtagtcccagctacttgggacttgaggcaggagaatcggttgaacccaggagacagaggctgcagtgagccgagatcgcagcactgcacttcagcttgggcaacagtgcaagaccttgcctcaaaaaataaataaataaaataaaataaaagtataataaagagggagaaaagatgtaaaggcacaagaacaaaacaaaggaagacatgacaggaaataatagatatccaccaaattttagacggtggacagcagaagcataagtaaaaactgatttggtaaagaaaactgatgtataactacttgcaaaaggaaaaaggtatgtttgtgccatagaggcctaaaagggttcaagaattggaggtgggttcaagaattggaggtgtcggccaggcgtggtggcctcacgcctgtaattccagcactttgggaggcagaggcagacagatcacctgaggtcaggagcttgcgaccagcctggccagggtggttaagccccgtctctacaaaaatacaaaaattagctcagcatgatggcaggtgcctgtaatcccagctactcaggaggctgaggcaggtgaatctcttgaacctgagaggtggaggttgctgggttgctgtgagctgatattgcgccactgtactccaggcctgggtgacagagcgagattcattctcaaaaaaaaaaaaaaaaaaaaaaaaaagaattggaggtgtcaagtactctgaaactgggagtgagaggggagctgaaaataagaggatatattgaaaatcattatgaggagcaattagatccccagatccctcccccaacttcaagcatcaaggtcactacccttcattccatagaagactggagatattaaactagaggagctcttgactcaggagcaccagacacagagcgtaggtgagatgccctagtgaaaaaagattgtcaatgtctatctgctaaatgttgacatttattttccagctcccttcccttgcttagctgtcagaatgctggcttccaaatgaatataccccaggtgggattctggaatattttctggagaaactgaaatagcctcagaggaagtccctacaaatctgacatttaggagttgcacaatgaaatgaccaggtttccgcccattcattctacagtgaagctcaatataaacaagctccaattcattcagataaccagttttttagtacctcgcaccaaataggaatgaacatattcaggtattcaaggatcaccagaaatttgggggaagtctctaatatgatagccagaagccaaaacaaaacaaaatagaggccaggcatggtggctcacacctataatcccagcactttgggaggccgaggagggcagatcacctgaggtcaggagttcaagaccagcctggctaacatggcaaaaccccgtctctactaaaaatataaaaatcagctggccatggtgcctgtaatcccagctactcgggagactgaggcacaagaattgcttgaacccagtaggcagatgttgcagtgagccaagatggtgccactgcactgcagcctgggtgatggagcaagactctgtctccaaaaaaaaaaaaggaacaagaaagagttcttagaaagtaaacattgtaatagctgaaagaaaaattcagtagatgggttgaaagatcaagaaattacccagcaaaggcaaagaagtagaaaacaggaggaaaaaaaaaaaaaaagaaaactgaaggcccagtccaggagtataagacctaaaaatttgaagttctagaaagagaaattggaagaactagaatgccatcaggcttctcaacagcaacatgagaagcttaaaaaaaaaaaaagtgcaatgcttttagaattctaagagaaaattattttcaacctagaattctgtaccaaaccgaactatcaatcaactgtgaggataaagttgtttttttttttttttctttttagacagagtcttgctcttgtcgcccaggctggagttcagtggcccaaactcggctcactgcaacctccgcctcctgggttcaagcgattctcctgcctcagcctcccaagcagctgagattagaggcacccgccaccacacccagctaattttttgtatttttagtagagacgggtttcaccttgttggtcgggctggtctcgaactcctgacctcaggtgatctgcccacctcggcctcccaaagtgctaggattacaggtgtgagccactacacccagccgaggataaagatttttagatgggcagggtttcataaactttaacttttatgcagcctttctcatgaaactactgaagagtatgttttatcaaaaagtgagaataagtttaggaagatgaaattatgagatctagcatcaaggggtgcaacacaggagagaaagaaagagaattcttagaatgataatggaaggtagttgcaggacaacagtttgtgcaagacagctagaaagcaattcagattgaagtagcaggacagaaggctctaggaggaatttctgcaggaaaattaaataatagaattgattatctgttgtgtaaaaaaattgtccaaccttcagttggagaattagggtttaatacttcagttgaagaagcactgattaatacttaaaaacccccacaaaccgagaaagaaataatcattctaagaaaaacaaaaggttgtataagaaagaaaatataataatataccttgtgtttttgctgtgcataatatttacatagtcataaatgagtaaatactgaatattggtaagccaaaattagtatcatgaaaagatggacagatgggaagtatatgtgtgtggtgaaaaagataatttgtcatcttcaactgaaagttaaaagatgtctaacatttaaaaatcaagaaatagcagtataaacatattatttaaagaagcaaagcaaaaaacagaggactcagtgagttttgttaagtatgacaggttagaagaattactacagtagtttggttggggtgaaatgagttataacttccaagagaaccattttagttgagtgacggaagcaacgttgaaggagttactgagtgaatgaatgggtagtaagaaagaggaggtaatgagcatagcatactcctctgagaaatctggctttgaaaacaaagggaggagaaagcggtgttagtgagttgagtctatgaaagattttttagattaagacaccacttagacatgtgtgcatagacagcaaggagttaatggagaaggtaaggtcaacgatgcaagcgtaaaggggatagttggtggagcaaggtcccagaaactgagataacatggactcaagagcatagatggaaagattaattgtaggaagagaagggaaagatttctttctctgaaagaaggaaggaagaggtgcagataagtgaaaatgcagagaaatattaaggtataaaggaaggaaattgagggacttaaaaaggtggcttcagtcttctcaagaaaataagaggttctctgctgagagtttggatttggggcataggattagcttggaaatttgagaatggaaaatatctgaaggcatgtgatgccaagttaaaaggagatgactaaaatgattatccagtagccacgagtgtccagttgaggttagatagcagaaatttgtaataaagccaatcaatatggtttctggacttccctcaagaacgttctatctccaaaagttgtattaatcatcatcttggctaggatggcgtttccttggagtgtcttaagagacattccagggttcaaaaactttagaaaatgcttgctcaaggagagtcagtgctcaagaataccagagagaaggttttcttgtgggacacttcaatctaggtcattcggaggtcttgtgggggatcatgagcaacgaaaaagaaatatacttgagagacttaaatgacacaaaacagtttgatatcaaaaagatctgtagctgcatggacatctggacacaaatctgagggtgagagcgtgttggagaacacctggattcagataaaagaagagcagaagagaagtgacatcattgtgggattagaatatagactacctagccagatggaagaaatagataaagcatttctgatgcagatcgcaaaactggcctgagtcaagagagcttggtgatagggatttcaagcatcagcacataagctcaaagtcaagttcagccaaaagctgcatacttgattaattctttttttcctgtttgtttatgtttttctgatcaaagaaaaacttgctcattgtagaaatgtagtagtacaggaaagtgtaatgaagtagaaaaataatcactcataaatccactcaccattaaaatacttgctaattatttctagtatttttatgcattgttgtctttgcatagtagagattatgctgaatatacatttgtctaaactgttttttaacataaaagacttttctcatatatatttcttatatatctcatatattttcatatatatctgaaattctttttatatgttcatctttcagaaggaagaaatacggccgggcgcggtggctcacgcctgtaatcccagcactttgggaggcggaggcgagtggatcacttgaggtcaggagttcgagaccagcctgaccaacacggtgataccccgtctctattaaaaatacaaaaaaatttagccgggcatggttgcacacacctgtaatcccagctacttgggagggtgaggcaggagaatcacgtgaacccggaggcaaaggttgcagtgagccaaggtcatgccattgtactgcagcctgggaaacatgagtaaaactccatctcaaaaacaaacaaacaaaaaaaaggaagaaatatgagataggagtccaagatatatataattataaaaataatttcagggccgggcgcggtggctcacgcctgtaatcccaacacttggggaggccgaggcaggcggatcatgaggtcaggagatcgagaccatcctggctaacatggtgaaaccctgtctctactaaaaatacaaaaaattagccaggggtggtggcacgcgcctatagtcccagctgctcaggaggctgaggtaggagaattgcttgaacccgggagatggaggttgcagtgagccaagatcgtgccactgcactccagcctgggtgacagagtgaaactccgtctcaaaaaataataatttcactatttactctttgctaacattatttccatttttctgaaaataaccagtcaatgctactgtattaggcaggaaaaagaaataagaggcataaaaattttaaaagagaaggaaaaattacatgattgcaggtgatatgattacttagctggaaagcccaaggtaatcaaattgaaatctattataaacattatgcttcagcaaggtagatggacaaaatatactaaaatcaataatttattttaaaaaataataagggccaggtgcagtggctcacacctgcaatcctagcacgttgggaggccgaggcaggcagattgcttgagcctaggagttcgagaccagcctgggaaacatggtgaaactctgtctctacaaaaaatacaaaaattggccaggcatagtggtgtgtgcctgtagtgctagctactgggaaggctgagatgggaggatcacttgagcctgggagtttaaggatgcagtgagccaagatcagaccactgcactccagcctgggcaatagagcaagaccccatctcaaaaaaaaaaaaaaaagattacatacctaggaagaaatgtaacaagaatatgaagagagctttaaaacactactggaaacaaaaaaaagacttggacatatggaaaggcatggtatgttcttaggaagatttaaaatcataaacctgtcagtgctccttaatttaatctataagttaacatgatctccctaaaaaaaaccaataggactttttgcttatttgcttatttttttgagagaaatgattgtaaagctcatacagaaaaaatatgtagactaaaataaccagaaatatcccgagaaagaaaagaaataatgagataccagcctcgttaatatctataatagatattaaaatctgttataaagctataataattccactataattgctaacaataaacactgtgtgccaggcactgttctaagctctttaaatataacaattcatttaattctcataaaagcccgttgagattaacctactcaaactcacactgccaataagtggcagagctcagatttgaactcaggtgctagctccagaacatgtactctctccatcaccacactcttcatcaccagcacatttgttattgacatattaatagacaggcaatcaatggaccagaatcagaagcttagaaattgactcaaatatagaaataaaattaatctacattggggagagcatttaaattaatgagcacaactggtagccatgttaagaatatgatattggattctttcctcacatcttatatgcaaacaaattctagatggatcaaaaatttcaatataggccagctacagtggctcatacctgtaatcccagcactttgggaggccgaggtgggaggattgcttgaacccaggagttcaagactagcctgggcaatgtaaagaaatctgtctctacaaaaaaaccttttttttttttttttttacagcagggtgtggtggcgcacgcttatattaggttggtgcaaaggtaattgcggcttttgccattcgtagcaatagtctcagctactcgaaaggctgaggtgaggggatcacttgagcccaggagttggaggcttcagtgagccatgatcacaccactgcactcccgcctgggagacggagtgagaccctgtctcaaaaaaaaaaaaaaaaaatacaaaaaacaaaaacacaaacatgaagaaaccacagaaagatgttcttacaatctcacagaagggaagatgtttctaagagagctgataaaaaaaaacctggaagccataaaagaaaagattgatatattttgttgcagaaagaggaaaaatatttgcttgccaacaaatactgtaaacaataacaaaagattaacaacaaacagaaagtatttgcaacttatatcacagatgaagggctaatttccttatatacagagttcctaaaaatcaataataaaaataccaaaaactcagtagaagattgaaggatgaaaatgaacagagtttatagtaaaggattgtataagtggttctttaaaaattatttttaataactagattgagatataatttatataccatacaattcacctatttaaagtgtacaattcagtcgtttttagaatattcagttgtaaaaccatcaccaaaatcagttttagaatattttcatcaagccccctctgccaagaaaaataccccgtacacattagcagtaactcccctttttccccacccacaaactcccagtcctaggcaaccactaacctactttctgtctctgtggatatgcctattctggacatttcatatagattatatatagatagaatcatacaatatatgggcttctgtatttggtttctttcactcaatgttttcttttctttgtttttatttaagttcttggggtacatgtgcaggatgtgcaggtttgttacataggtaaatgtgtgccatagtggtttgctgcacagatcaacccatcacttaggtattaagcccagtatgcattagctattttttctaatgttctccctcccccgacctcaccccccaacaggccccagtatgtgttgttcccctccctgtgtccatgtgttctcattgttcagctcccacttataaatgagaacatgcggtgtttgtttttctgttcctgcgttagtttgctgaggataatggcttccagctccatccttgtccctgcaaaggacatgatctcattcctttttatggctgcatcacttacagttttcaagatttatccatgttgtaacatgtatcagtactttattcctttttgtggccaaataatattccattgtatgattataccacattttgtctatccattcatccattgatagacattggattgtttccactttttggctatcatgaataatgctgctgtggatgtttgtatacacacttttttgtgaacatgttttcagttctcttggatatatacctaggagtggaatattgggtcatatggtaattctgtgtttgaaagaacagccaaactgttttccaaaatgcctgcactctgttacattcccagtaacagtttatgagggttacaatttctccacattcttgccagcatttgatgttacgtgtcttttttattatcgccagcctagaggtgtgaaatggtatctcactatccttttgatttgtattttcctgatgactaatgatgtcgaacatctttttacatgcatattagccatttgtgtatcttttctggagaaatgttcatccacattgtggaatgtatcagcacttcattcctttttactgctatgtagtattccgttgtatgaatatagcacactttgctttttgtttgcttgttaatgtacacttgggttatgtacagtttttgcccattatgaataaatcttctaggaacatttgtctccaggtctttttatggatgtatgttttcatttatcttgggtaaatacctaagggttgaattactgactgctttctaaaacagttgtaccatcttacattcccaccagcaatgtatgagaattccagtttttacaattgcttgttaacatttggtattgtcagtcttttgcattttagccattctagtggttgtgaaatgaaatctcattgtggttttagtttgcatttccctgatgactaatgatgttgaatactttttactgcttgttggtcatttgtatatcttcctttgtgaagtgtctcttcaaatattttgcccaatttttagtgggttgtttgtctttttattatccagtggtaggagttctttacacattctggttacaagttagatatgttcattacaaatattttctccctctgtggcctctttatttatttccttagtgatgtcttttattgagcagaagttttaattttttagcattttttttcttttatggttaatgccttctgggtccagtctaaaaaatctttgcctaccctaaggctgtgacagtgttaccctatatttccttctaaaagcaatagaggtttaacttttatgtttaggcctataattcatcctgaattattttttgttggtagtttaagattgagggtcaaggtttttccccgctcccctcatggatagccagttgagacagtatgatttattgaaaagactttccttctcctacttgttgtggttcctttgttaaaaataaataaataaattgaccatgtattaatatgtgcatatctatctctggattctctattctgttccattgatctaaggtagtgtatgcccttcaactttttctttttcaagattgttttattcattcaaggccctttgcatttccatataaaatttagaataaactggttcatttctacaaaaaaagcctgatgagaattggattgaaattattaagaatcgccgggtgcgatggattacgcctgtaatcccagcactttgggaggccaaggtgggcagatcacctgaggtcaggagtttgagaccagcctgaccaacatgcccctgaccaacatggagaaaccccatctctactaaaaatacaaaaaaaaattagctgggcgtggtggtggacacctgtaatcccagctagtcgggaggctgaggcagaagaattgcttgaacccgagaggcagaggttgcagtgagccaagatcacgccactgcactccagcctggcaacagagcgagactccatctcaaacaaacaaacaaacagtaagacccgaaatattatttttgaaccccaagctcacttttgtatagatatacctactctagaaacaatgacaaaactaggaattgtgacacaatactaaagacaatattaaaaggcttttttaaaaagttacattgggagcaaaaagaacaaggaggcctaggtgggtggtatcatattaatgaatgaaagaaagaaaatagagcattcacctctattttggtttagtcttctctgtcaaagaggatactctttggactggaaaagataaaataaacactggttccagggaatgcagtcaaacgtagttgagattgaaataggtcatgcaactgctttaaatgatttcaagttccttaatcttatatttcaagatactgaggactaggctgggcgcagtggctcatgcatgaaatctcagcactttgggaggctgaggtgggtggatcacctgaggtcaggagttcgagaccagcctggctaacatgacgaaaccccgtctctactaaaaatacaaaaattagctgggtgtggtggcaggcacctgtaatcccaggtactagggaggctaaggctggaaaatcacttgaacccaggaagcagagccaaggtcgcaccattgcactctagtctgggtgacgagtgaaactctgtctcaaaaaaaaaaaagatactgaggactagtggatgagctggctgaagcattgctggcagtctctgagaaagtgtgcatggggagggggaattaggggatgggggtcggggatggatagaaatttcagaagattagagtcaaggaactaatattcaggaggtcacttcagcagacttgacatccatcttaggtaatattcttaaactacttatgaacaagaataagttaagaggcctggcacagtggctcacgcctgaaatcccagcactttgggaggtggagtcgggcggatcacttgaggtcaggagtttgagaccagcctggccaacatgatgaaaccccatctctactaaaaatccaaaaaaaaaaaaaaaaaaaaaaatagctggctgtggtagtacatacctgtaatcccagctacttgagaggctgaggcaggagaatcccttgaacccgggaggcagcggttacagagagccaagattgcgccactgcactccagcctgtgtgatggagtgagactctgtggaaaaaaaattttttaaaaagaataaattaagaaaaggaagttgggatcaccataagcttaccagaatttattgaagatggagacagaaaaggggaggaagtagggggtaaagggggaaaggaagaagggaagagaagataataaaggggaagggaagggacaggaggcgaaggaaaaggaataggaaaagattccaggcttagtgggtaaagaagacttgatttcaaccctggctcttttacttcttagtaaaatgatgttaggcaagttattaattgctataagctagatttccttattggtaaaattgaaataagagaaactacttcatagagtagtcctgatgattaaattaaataatgtgtataaagtgcttatttatcaaaagcagtgataactgtgaagggggtgaatgatggtaatgacaataatactgacggagaaggaacgggagtagacaatgtaaacttactccctttttgaagagattattacattggtaagttgacagaaatctgtacagtatagctatatttagtatagctatatttagtatatttgtttagctaaattggatttctacaagactttgacaacatctccatgacatccttgcgaacaaggagaaggaatataggctggatgatataggctggttgaatagtcatacttaaagtgtgctgattaatgggttcctgtcatgctgaaattctccaggagtgtaaatctggactatgtacttagccaagcttttttaaaaaatcattatttgcataagagcattgatagcaggctaattaaatttgggaacaatagctaataagctgactgaaaaaaacagaacctaaaaagaaatggtataatacagagcaaagaatatggccttaatgtcatggatctatcactactagctgtgtggctttgagtaaattgcttaaccacctgagccttttgttcctcatttgcatggagataatactacatattccatgtggttgtgagaacataaaagataatatatgtgtattatcacacctgtaatcccagcactttgggaggcccagggtgggcagatcacaaggtcaggagatcgaggccatcctgaccaatatggtgaaaccccatctctactaaaaatacaaaaattagctgggcatggtggtgcgggcctgtaatcccagctactcaggaggctgaggcaggagaatcacttgaaccagggagtcggaggttgcagtgagccgagatcgcaccactgcactccagcctggcaacatggcgagactcaaatatatatgtgtatgtcaaatgtatgtgtgtgtgtgtgtgtgtgaattagttatctatttctgtgttataaatctcccccaaaaaacctgggggcctaaaacaatacacatttattatttcacacaggttctaaaggctgggaatccaagagcagcttactggggtggttctggctcagagtctcttctaaggttgaaatcaagattttgattgggactgcagtcatctaaaggcttgaatggatctggagggcctgcttctaagctcagtcatgtgggaggcctcagatctttagcacatgatcctcgtgatatgaggaactggcttccccagagcaagtggtcttagaagaagagagcaagcaggaagccacagtgcctttatcacttggcctctgacatcacattctgtcgcttttgttttattttctccattagaagcgtgttgctaagtttagctcatattcaaggggaaaagaattaggatccacctcttgaagtgggggagtatcatagaattttgtgggcatatcttaaaactgcaacaatctaaaaagtactcagtacagtgcctagcacataagtgctccataaatggcagttgttattctactattaatagtctacacttaatatacatatacaattaatatacatggtccctactatgaaaccggtgtgggtaggacaagataaactcatgatttcttagattcctggaaaacacagaaaaagaagtaccacatatgactacattaattacatctgttttgtacaccaaaatgaatggattatttttgcactgcatgtaatgcactaagaacaggactagtaaaaataaattttagtaatatttatttatttatttattttgagacagcgtctctctcttgcccaggctggagtgcaatggcacgatctcagctcactgcaacctccacctcctgggttcaagcgattctcctgcctcagcctcccaagtagctgggactacacgcatgcaccacaacactggctaatttttgtatttttaatagagatggggtttcaccatattgtccaggctggtctcgaactcctgacctcaagtgatccacctgcctcggcctcccaaagtgctgagattacagatgtgagccactgtgcccggccaaattttagtaatatttaataggcatacataaaatgtatagtctgtaaatatgagtgatatgaaaaattcgaatgacaacctaaaagtgatattatatggttttgttaaagagttttatatgtacatttaaatataagtattgatcatctgagaactcatcaaagcttaactgaataatgtatcaacttgtctttctgagtgtccttttctcatttccatttaaaaatgtgccacagctaagactgacaggccccagtctgcagcaaagatggggaagacttggtagttcacacgcctcccctgagggcaaggagtaattctggggggatgtaaactaacaaacataaaagtattatatcggcaaaggggtcgattaagtaaaagagttgatgttgacagtaaaaatttagaagcaataattaatgtggctgaatcactagataatttcctctttatgtatacatttatatgtgtatatatatatttatatatgggtccataatgcccatcattagcctcaaagattgtctaatgttcattggaaacaaaaacataagaactctcccacccgggtggacagagtaatttactgagccactttggtaagataagaacattagattgaaggtaatgtcacaccttaaacttgttaatttattggtgttttgatttgcattaaacattagacagatcctcaggctagcggctgacatggtagaactctccttagtatctcaccaaaatagcagtcaaacttctaagatgttcaaaacatagttactaatttgaaagtaagtagaaatggttgctgaggagccaggatttacagaggttatatgcatcattgtaggtgaggcaggaagtctcctaagatttcacagggagcctcctgacttataaatgcataaatcacagtattgatcaggtcagcagtgacagataaaaagtagtgacgtgggttttaactgttgctagccttagccacacactgacagttgtgataaatggtaacagaaaagggagttattatagatccaaacagtgaagagaaaatatatatttaaaaaccaacattttaagtaagataggtagtaatttactgtgtagaggacaaataaatggctttatacgtctttttgttctttttttgtttgaacggagtttcgcttttgttgcctaagctggagtgcaatggtgggatctcagctcaccacaacctctgcctcccaggttcaagcgattctcctgcctcagcctccggagtagctgggattacaggcatgtgccaccatgcccagctaattttttgtgtgtttttagtagagacggggtttctccacgttgctcaggctggtctcgaactcccgacctcaggtgatccgcccgccttggcctcccaaagtgctaggattacaggcgtgagccactgcacctggcatgtctttttgttctttaagggtatctactatggtccaagaaaatgagcagtatgcacaatgttgaaacagagttgataaacaaaaggtgactgatgttcactatcatcttttttaggaagtcaagtaagtttgtgatatagtttacagatacttctatcaaatattaaaatgtcttaagatggaaaaaaaaacagttttgacactcaagtaggttttacatattaacatatatagaatgcacatagaagaaagggtcagagaggtccctggaaatgccgtgtactgattcagcatcatgggggctgcacagcctgcactgtgagtaataactataataatagctatcatttaatgagcatttaccatgtgccaggaattaggttaaatctttacatgaattatagtattgagcccttttatccatgccttgagtaggtattattatatctattttaaagataaggaaattgagggccgggcacggaggctcacgcctgtaatcccagcactttgggaggccgaggtgggcggagcacaaggtcaggagatcgagaccatcctggctaacacggtgaaaccccatctctactaaaaatacaaaaaattagccaggcgcggtggcgggcgcctgtggtcccagctactcgggaggctgaggcaggagaatggcatgaacctgggaggcagagtttgcagtgagccgagatcacacaactgcactccagcccgggcaacagagcgagacagcgagactccatctcaaaaaaaaaaaaaaaaaaagataaggaaattgagacatagtggttaaaaatttacctaacattggctgggggcggtggctcacacctgtaatcccagcactttgggaggccaaggcaggcggatcaggaggtcaggagatcgagaccatcctagctaacacggtgaaaccccatctctactaaaaatacaaaaaaattagctgggcacatccagctactcgggaggctgaggcaggagaatcacctgaacccaggaggcagaggttgcagtgagccgaggtcacaccactgcactccagcctgggtgacagagcgagactccatctcaaaaaaaaaaaaaattttacctaacattgttcatgtggttaagtggcagagcccagaatcaaagtgaagtctgagtacctccatccaggtttactatctcagtctacgtgttttatggaaatgaggcatgccctttctgagaaggaatgatgttattatacctccttatatattttcattaagaatgagtgaggatctcctcctttattatttattcatgtgaccctttcttttccctcaccctgtgggaggctgaataatggccctaaagatattcaggccctaatccaggattatccaggtgaaccctaaatgtaatcacaagtgtccttttaagagggagtcagatagagatttgatgacgggagaggaagaagacaatgtgacacaagaagtgggtgtgtttggagcagggaagtgacatgacatggggccacaagccaaggaatgaggataacctctagaaactggaaaaagataggaaactgattctcccctagaacctccaggaggaaccagcctgctgacaccttgattttagtcccataagactcattttggacttctggcatccagaactctaagagaataaatttctgttgttttaagctaccaaattgtagtaatattttatagcaaccataggaattgaatacatatcccatattactggcttcaggacttatttgcattatactttctccttgtatttttcctacattttgtaactgtttattacttccagaatgcaactgtagagtgtgtaaataacatattcgtaaaagcattgtttcagataaagtctaaaaaagaggtattttattttaaaataatatccaatcctatggctatcccatatcccagcctttccaatggctgtaaaagggaaaattatgggacgaatgttgtcaagtatataatgaaaggaaatcttttcaatatgaatgatcaataaacttgtagaaaaatgtccaccataacgagagtcacaccagttaatcataacccacatctctgactaggaatgcagtaggtttcccccattcccaccactctttatttggagatttgttgaaacctataagagaattatgagaatagtatgaaggcacttgtctgcccttcaccaaatgctaactaatatgtcaccatatttgtgaacaacagatagataacttgaaactaagttatgggaatcatgacatcttacccctcacatccctcatctcctaagagtaaggactttctcctcttctcctgcataactccaatgtcatttgagaaaataacactaattttataacatcacctaacatccagtccagtgcaaattacaatttccccaattgttcctaaacattattaatagctgtttgttttctgacccagcatccagtcagggtttacacattgcacttggtaatgtctctttagtttcttttaatctggaacagaccccttacaattttgttttcatgatactgacttctttgtgttttcctgaccctcccacactagaatgtacattttacaggggcagggattttcgtctctgttaattgccatgtccttagcattgagaatgctgcctagcactttgtaaatatttgtttaataactagatgaatgaataagtaatacaagtacaatgagtgtcatgaaaggtgatttagaggatgccaagggtcctgagaatctaatctgttgttgtttgtgtgtaactcttacctctgcattacacgtattgtgttacacatatacgtgtttcaggcttgagcaaagggctcattttacaaatcagtggggagatataagtgtaataaatataaataagaattgagttttaaaaaatacctaagttggtcaagattaaaaggcatgatagcaggcactttaacagcaaaactgcaagagacttaagctgagtttgggcaactgtgatgtgactggcaagatgctaaattagctttagacttaatacaataagaacagaggctataatgaagaaggtgattgtcttgctctatttattcattctttcattcaacaaatatttattgagtaccttgtgtgccaggcactgttttggtgctggatatttagaattgagcaccacaaagtcttcggccacatggagcttacattccatgatgaacaaacaatacttaagtaagttttttgagggtaggggctctgtgctttcacaagagaggcaacatagcgtaatggtcaagagcagtggtttttgagccaccagacataggtttgagtcccagtttgtatacttttttgctgcttggtcttgggtaagttccttaagctctcagagcctgagtttccccagtagtaaggtcatggcaaataacagtacagcctcataggttgggaagggacttaagcgagataatgcatgagaattgtctcacatggtgcctggcacttaatagcttcttgataaatgttagttgttgttttcatcattattaacattgactaactaaaacatgtcttactagaaaagggatttgaaaccaaatgatgaagaacagttgaaggaaccagggatgttaaactcatagaaaagtaaatggaatacatgcttactggtttcaaatacttgatgatgtagcatgtgacctgagcttacttattctgtgtggtcccagaaaacagaattaggtccagccggtggaagttaccaggaagacaattttcacaatgtaagaagaaatgttcttaacaattagaattatctataaatagaaagagctgcttgggaggaaatggattttctgtcattagagataataaagcaggtactagacatgtgctctccaatatgtagccactagcctcctatggctatttaaatttaaagtaattaaaattaaatacagttataaaggcagaggataggatggtggtttccagggattggggaagggagaaactgggtattgttgttcaattggtgtaaagttacagttatgcaagatgaatcaattctaaagacctgctctatagcataatgcttataactaacaaaattaggaacctaacaatttattaagagggtagatctcatgtcaatcattcttaccacacacagagagagagagagagagagagaaacttttgaggatgtggatatgcctgttatcttgatggtagcggtgatttcaccattttatgcatatatccaagctcatcaaattgtacatattaaatatgtatagttttttgtatgtcagttaaacctcaataaagctaatttttaagaaattaaatacaaatacaattcagttatttagtcacattagtcacgtttcaaagtgctcacaagccacatatggctagtggctgctgccatattagtgcagaataacaaacattgccatcatcacagaaagttctgttgtatagtgctgttctggacaatgaacaaagatgtttaagaagaaatggaggcacaagatgagaaagaagagctgaattaattaggtaacttgtaaagtccattctaagcctcagttttatagattatgaaaggtcatcttttaaccatttcattttggaataaaggaagagttattctcacagaaataaaactgttgtgttatttggagatatttttattttactgatttgacttaaaaattgcttcttttcagctcatcactctagttagagaaataaatttctgaggggaaatggcctagcaatggcatggcccaggagaagtacagtaatcattgcatctttttcctgaaagaactttccatgattttttagttcagcctgaagagccatttgtgacgcttaaaaatcaatgaaggggaaaaatgggactgagctgggccagttttcaaaggacatgaggggtgagtcttgtttcagttgctagtattagacaggatttcatttatgaactttgttctcttgtccaactccagttcctacaggtttcctttttcctttgctctccagtcaaaaggaaaaatactcacatgattattagaaatactggagcaataaattgtttgagggacttgaaacaccctttttttctttcccttcaaagccttaaatgatagttgcttcattgaagcttacagatcattaaaagcagtcctgccagggtgttgtaatatatgttttagcttccaattgaaggaaaatctctaccaaactaacctttgagtcatacagaattttttattttctatttttgatgtcttgggtgttccagcactttttcatcacctgccatatacaaaattcccatatcttatttgagccaaaaatgaagcctggtatcacctctaacaagtacaaattcctagcgcttttcaactatgttattatttgcctattttatttattgcagaacagttcccaaggagtaatgtcctggagaaacagaaataacactgtagaagagcagtagtgttatggacattgagagtaccattgcaaaacctgattttttttgcattttcatggcttcagtttcgagtaattgtagatggacagaggccaagctgttttcaatttgacccttggttaagctaaaaaactacataacaactaagggtaccctatctcctgttacagagatagatacataaaagggccagactaacaagaaaccaaatagccagtctggggtatggccagagaatctgtaactctaataagcacaccaagggattctggtgaacagactaatttggggaactgcttaggtccacattattttgtaaaggaatgattgaagaacctttttctgaatttttaaaaataagacaccaatttttttattgtagtaaaatatatgtaatatagaacttaccattttcaccatttttaaatatacaattcaatggtattaagtacaaccatcaccacgcatttccagaactttttcatcatcctaaactgaaaccgtacccattaaacaataactcctcattccctgctcctttccctcccaggccctggtaacctctataacactttctgtccctctgaatttgcctgttctaggtccctcatataagtgaagagataattgatttttaacaaaagcttaattgctttcttgcctggaggcatgggtcggagtgaaggggagcaaacattaattggtgtcttgacctgacaagtcaaggtcacattcggatttactggatttatctcaagcaatagaaaactgtgtttttaaactttggttccatggaatcatacagactccttttattctaattgtttttatcatgacctgtgtgttcacctatgaaattattcatttgaaattgttactgactagttggtgatattcaatctgattttctcatgaaaattaataagtatgtttctgaaaatctcctctcaattatgtcattctaaacaatttctgcaatgttaaggcccagcagaaaaaaaaaaaaaaaagttactatcaaaatgtttccaaagttcaaaagcagaagaattagcactttttagtttctttttataaaatgcatctacttcaagccatagcaaatttgaagtttcagatcctctgtccacaagattgagtacttaacgatagcccttttggctccttccagatctcctaataaagcagggagctcctctcagcccggccagccaccccgtccgggagggagatggggggtcagcccccccacccggccagccgccccgtccgggagggaggtaggggggtcagccccccgcctggccagccgccccgtccgggagggaggtgggggtgtcagccctccgcccggccagccgccccgtctgggaggtgaggggcgcctctgcccagccgcccctactgggaagtgaggagcccctctgcccggccagccgccccgtccgggagggaggtgggggggtcagccccccgcccagccagccgccccgtccgggagggaggtgggggggtcagccctccgcccggccagccgccccgtctgggaggtgaggggcgcctctgcccggccgcccctactgggaagtgaggagcccctctgcccggccagccgccccgtccgggagggaggtgggggggggtcggcccccctgcccggccagccgccccgtccgggaggtgaggggcgcctctgcccggccgcccctactgggaagtgaggagcccctctgcccggccagccgccccgtccgggagggaggtgggggggtcagccctccgcccggccagccgccccgtccgggagggaggtgggggggtcggccccccgcccggccagccgccccgtccgggagggaggtgggggggggtcggcccccctgcctggccagccgccccgtccgggaggtgaggggcgcctctgcccggccgcccctactgggaagtgaggagcccctctgcccggccaccaccccgtctgggaggtgtacccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgcactaagaaaaattcctctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaatttaaaaaaaaaataaataaataaaaaataaaaaaaaataaagcagggagctccttcagtgtccagcatactactctggggagaaggcctcttcatcttgtctagagcagggcttcagatatctgtgccagaggcttaggaaagacctaccacttggaatgtagaacaaaagaaatgattgttttcttttttctttttttttttttttggagatggagtttcgctctgttgcccagggtggagtgcagtggcgggatctcggcacactgcagcctctgcctcttgggttcaagtgattctcctgcctcagcctcctgcgtagctgggattacaggtgtctgctaccacagctaatttttgtatttttagtagagatgaggtttcaccatattggccaggctggtctctaactcctgacctcaggtgctctgcccgcctcagcttgttttgttcattttaaacaattttccataaatttataaagccattctccatgacatgcttaccactttcacggtctgtgtaaatctgatccatcagtaatatagtatggcagcacctaattatgtgttttgtgaaaagctatggaacaaaaagtaccacctgttacttaactccctaattgtaaaattgtgttttatttctgtgccctgaggttggaccacagtattgtgataaaccatgggactgacgggtcttgctacccattcctgttctccattaaaaaaaaaagtaatcagatttcttctaactctcaaacctctaaaagcgcttctgaaaacttagatctaactgtttaaagttgacccctggattctataaccctctctgtcacaaatctgctttgtaactttgagcgaattatttatcttaaacacttaactttccatacaactattcattgagcataaaacctaaataatgatactacctctggaaaaaaggattcatgactcagtgggtctgtttccctacttaaatctggaagggaaaatgccttcttactcttccttctgaattttcccatttagtccctggcacaaatgaagactcgctcttcttggcagcatccatggctgctaagagaaactttgccccactgcctttgatgtggtgaaacaaagcctttaccagagtggttggaggatctgtcaccctggagactcctagggacccccacccacaacctctttgggaagttcttttcctaaagttgtattcagatttataccaatatgcagaggagacgtctttcttataaaaagcttgcttttcctctcaaagctgtgaagaagctagtgaaggggaagttgaactgggtataatattgacaaatgttttgagcacttcagataaaaatgtttgataagtgcagtcctgtttgtattgccttattacactgctcattggagaaagtgttttctttggtcacctgccaatgaaaaagattagccttttcctgtatttaggattgtttctttgactagttatgttggtagaacaagatagacaaatgctgctgaaattagcaaatcagtattggaacacagtgatactcatttctcctcactgccctttccaattcattgacagttgccgcaagcagtatgaatgggttttttataggactctctttctctccttacctattccaatttgtattttcactttagttcccttgctctgatgttcaagactttaaaggatttgccactgcccaccacaccatgctttcctattttataggatccaataagaaacattttttcatttaaatgcctcttctataacatgagtcaccttttagatttctataccttgtatcttctagtttctattttagtacagaaaaattatagtttcatcttctttgaggcaagatatgaagatttttttttgccctccctcaaatttattccctgtttacagcaaaggaagccactggctgcttttctaacatttctctatcagaagctagttgagctaaatgtatatacttttatattccccttaatatgtttagattgatctggggtacatcttttggatctggacattatgaaacaaagttaagccctttaacccatcatcagcctacatctgtctcttcagacaaaaaggaaatgaacttccattgctgtaggaaaaatttatgtcacacataagggcaaatttgttagcaataatgttattcaagccaggtgtggtggcgcatgcctgtaatcctagcactttgggaggccgaggcagtggattgcttgagaccaggagttcaagaccagcctgaccaacgtggcaaaaccctatttctactaaaaatacaaaaattagcctggcatggtggcatatgcctgtagtcccagctccttgggaggctgaggcacaagaatcgcttaaacccagaggcagatgttgcagtgagccgacattgtgccactgtactccagcatgggcgacagagggagaccctgtctcaaaaaacaaacaaaagagatagtgttattcagtactgggttcctaagcagtattacagtataaccttctctgaaattctttgcttttgtttttaatagaatagattttcataaggaatggattaggtgcagaccttcttgacagcatgagataacaagttatttcttgaagtcactctttagaataaataagtcgtattttattctgagggaatttttttttttttttagacagagtcttgctctgtcacccaggtaggagtgcagtggtataatcttggctcgctgcaacttccaccttctgggttcaagcaattcttctacctcagccttctgaatagctgggattacaggtgcctgccaccacaccggctaatttttttttttttttttttttttttattttatttttagtagagatggggtttcaccatgttggtcaggctggtcttgaactcctgaactcaggtgatccgcccacctcagcctctattccaagggaattttaacattgatttaattgagagaatcaaaagagcctgagggtagtttacagagaagagcccttttaggtagtattttttatttgacttgccaacctctaattctcactgacttatggtgagtttcaagtatggatagttttaagatgtggttagttcccatgactacaaaataaaatatgaatttcccatgttacttgaagactgtttgtgggaggtcttcatttaggtctttgcatcttctcaggagcatatcataatttaatagcctgtcatcggaaccctgcaaagatagtgatattcatcttagaaaaaaaaaaaacttgcatacctcctatacagcattctttgctgccacctaaagccatttgctcatgaaacagtaacctttagaacaatagcccgagttctcttcctatcagtcaattcttagagactctattagcaccttcctttgcttttgtcctgtcagatggagagacggggttggcagaagcaaaacagcctttataaatttttcttagaggtccgtgatcctagattaaagtaggaatcagaagacatcaggtctagaaatcctcagagtgaccttttttgacagagaagatatttatatgaagaaacatcagtgccaatgacctaaatttagctatctaacctctcaatatgatcatttctctgcttgtaaaaggggaatagtgacaccaatcactaccgtcctctggagtttgagagatacttaatgaaataatgaacgtaattctcctcttgcaagggaatatattgttgacttttaggagaatgatttgggggtccctaaggggcttaacaatctattacctctctggcactcaaataggattattgtaaaaagctaatctactgccaaaaagtaagccatttattctgtggatagatcaggtccagtgtgaaaaaaaggattttgatctcttttttggaataactattactaactagataggcacaaagatgtcttttttttctttctttctttaaaaaaaaaattagaacagaagtgtaattgtgtttgatggttcactttgggagaatgttaggttcaatcctgaacacagtaaatcagatgatatacttcttttaaaaagcctctagaatatgccttctcaattgaggcaatattgcctccaagggggcaaaaattggttctttgggaggcaaaaaaaaaaattagatattataatggtttgtgacccttaaaaaatatatagatagataatatgttcatgatatcaaaatttcatggggagtggacaaatagaaaaaaggtctaaaaagctagggggtgataatgaaaaaaagactgagaaacttttctcaagtctagaatgtgcatataactgtcaattactctttcagctgtgtttgtccctaagcatgggcaagctgcacattgtcaggtcgaaacagcttgctattgattattccttcagtctgagaggaactgagttcatagaaaacttgaacgaaatgaaatgtataccctaaggggtaatgatttcagacaaacaaacgtaacaaacatctacttgttagaaccaatactttgcactttaaaatgtggttaagcctttaaggtaagaggtttcttttttctcttgcctctttagccttacagaaaggcacatcaagggtaggaatgatcttcaaagtgcctcacagaaaaaaaaaaaaaaaaaagccagattgggagaaagtgtggccccaaaggcatactttggagagagtgtggccccaaaggcaggaagggaataattgactaaatagtaatgtaaagtgtacagcatcggcagggtgtggtggcttatgcctataatcccagcactttgggaggccaaggtgggaggatcgcttgagccctggagttcaagaccagcctgggcaacatagtgagacctcatctctacaaaaaatacaaaaaaattatcctggtgtggtggcacatacctgtagttccagctactctggaggctgaggtgggaggattgcttgagcctgggaggtgggggttgcagtgagctgagatcatgccactgcactctggcctgggcaacaaagcaagaccctgtctcaaaaaaaaaaaaaaatgtacagaatcaaagtcaagaaaattgatgggaattgacactgaagtacttaagaaattttaagtttgctcttgctgctggtattaataaactttcatatatccaacatattcttccttccacctttctcatatgtcttattagttctttcaaacactcagaatggatggaatgatccaaaattgacttgctacatactggggaatttggaagggacctgtgttttgcttagcagccctgaaacaatagaatggccttttttttttttttttttttttttgagacagggtctcactcttgcctaggctggagtaaagtggtgctatctcagctcactgtaacctctgcctcctgagttcatgcgattcttgtgcttcagcctcctgagtagctgggaccacaggtatgtgttaccacgccctgctaattttttttttaattaatggggtctcactatgttgcccaggatctcaaactgctgagctcaagtgatcctccctccttggcctcccaaagtgctgggattacaggcatgagcgactgtgcctgataatggccatatttaaagatatattttttcctcagtctctgactcttccttgcttaatcatcctattctttaatatacaaacctataactttgaggaaagagaatcagagattatttctccctacttacccatttcatggtgcgacaatgagcactcttctccaagccaagcatttgataagcattcattgctatgggtattttactgccttaaagaaatccaccccaattccctgccgattgatttcttaagatcacagaagaaagtggaatgaatcctagagaggccttcaagctccctgacacccatggggcccactcatctccacccccaatactccaatttcaaaatctaacacattgtccttttcttagttcctcagttccccgcccttcagcttctctttgttagccactgggtgggtgtaaccaaacctcagtcacactgtggccccagcagctgggcttctctctcccccattacattgcagacattcttttcacatcattttgtcctctctgctgcattccctacatttggcttcattccctctgtgcaaacttctgtttcaagggacagcagtttgccaaggagatgctggcagagagggtccagttctttcctttctatctgaagagcccagtgtcattcattagcatatgagaagaatggttgtaaataaacatcaaatgaggttaacgagctgcagctcatcaatattaatgaagtccacctcacagccttggtatgaggtaccaatggctctaatcacaagaagcagtttcataaggccccagttacagggcaggaagggttagatccagcgtgttgaaatgtttgtcattttatgaccccaggaatgctgcagggtaaggcagtctgataccagatctgtgcttgcaaacccctcttgtgttcagtttacatctgtttgtctcaacaggtggaagcctaggaaaaggctatatctgctaagccagaatctggggtgggaattctccaggtcaacctgcagttcccaaatcaaaatgaagttccagagtaccagggtttgatctctcattgcccttccatcagttaccccagataacccaaacacttgtttccagtgtagtgaaggatggtttgaggatctaagcccagcttggtaaggaatgaagaaactcccatttcatgtagctcatgtgcctgccagccaccagttaagtccctgtgcctattatttagaggattcaaagagtaacaagggccaggcatggtggctcatgcctgtaatccctacactttgggaagcagatgtgaggggatcacttaaagtgaggggttccagactagcctgggcaatatagggagacctctctcaaaaacaataaataaataaaaattttaaaagtagttgggcgtggtagcctgtattcccagctactcaggaggctgaggtgggaggatcacgtgagcctaggagtttgaggccacggtgagccatgatcatacaactgtactccagcatgggcaacagacagagactctgtctctgaaaaaaaaatttttttttaattaaaagaaacagtaagtacagctatcatttattgaacacttactgtgtcctaggcatggtactaaacatttttgttatataatcctcacaataatcccatgaaggtattcccattttacagatgaggaagttgaaactcactgatttgatgtcatgggtctaagatcacacatcagcaagtggcagaagaggagctcagatttcgatctgtctaactgcagagcccatgctcttacttcctaccctctgtggtatcatctcagagccaagcacataaaatgcaagcttttgtgctgctccttttcgtcaaagatgtgtgtcctccagtttcaagggactaaacacaaagtagttccctggaagtagaatcagaaggctttagaattaatttttttaagtcaaagtgcctctttgaaattatttttagaaaggaaactttcattaaatatgttttccttgatatataaatttggggtcagagggattaggctttgagaatatgtgtgtgtatgcatgacccagtctgtgttgatagccatgatactgatttatccaccttgtcacactagttccttttatgattaagcacacaccttgcatgaggtcagtgaccatggaacacagggaaaccgctcccatggctgatttgagcctatgatcttagcctcaattacattgtttcaacaactgaacgcctggtttattacttaaagtactatcattgtactttgtcttaggggtgggaaggagaaccgatcaaattgttgttatcacaaaagctacacctgattgtttgtaaagaaggacttctagtgaaaggatgaaagtgaaacagctatttctctttcttctatttttctccttgaaaattcagggacctaggccaagacaggcggatcacttgaggccaggagttcaagacctgcctggctaacatggcaaaaccccgtctctactaaaaatacaaaaattagccaggcgtggtgacacgcacctgtagtcccaggtacacgggaagctgagacacaaaaattgcttgaacccaggagggagaggttgcagtgagccaagatcacaccactgcactccagcctgggtgatagagcaagaccctatctcaaaaaaaaaaaagaaaagaaaagaacatgaaagaaagaaagaaaactcagggaccttacttggtaatttttacctaggcaaaatgcccaggaatgtttccacagaatggtacccaaagcccacccatgcaggagcccttcctgccaccaaggtaaccaagactaggaagcaattgaaactgggccttcctttcccaggcctgtggctgtcaacttggctcagaaagaggcagactgatgactttgtctccttacccactcacactaccacacagttctcatttgagcctggtcacatggctgtgccttcttatggccaaacaaggatacgctgtttcccgttctttgcaccctgggtttggcctgagcatccttagatgaaaccatcaggacccccaaaccttgaagcttttccaggggcaaattgcatgcaggggaaggaggggctgagctgtgtagtggagcagcggatggtgtgcagtcgggatgtttgcaagagccaaggggttagttcattgctgctttgtatactcaggcacaccagaaaactcagattaataggctgtttattcttcagcatgttccttgaatcaaaggctctggatggtattattaaagagtgtttgtgagagcgccctggaacactcctcctgggctccgctcactgaagaggaacgattgagtcctttcatttcctgggcagcatccctctcactcattgctcactgtagtataaaggtctgtagaacctttgttagaaacaggatcttttgttctgtccttatgaggtcccattacctacagcaccttgatctgttggagtctaattatttaatgttcttgtcttttgagctacctgaacctaatgaatgcagtccactctatctcagggagttgttttgctttggttttttgcctctatttggcaccagtttcctgtttggacagtattgccttttattttcatggttttttttcaaggagtttgtccaggagagaaggagacatccacctgaaacctactctgtgaagcaaatgaatatgttttttctattagaagattctcctaaaatgttctgaagtttgttcatatctgggaattgaagcacattgaattaagaaagaattacttcctccacctccacccctgcaatagagatttatactggacaaggtggcaaaaaaaaattagggggaaactgctcggtacaattcccccccagttcccttggggcagcagcgtgctgcacatgaggaatcactgtaccttgttcccctggcagtgatacttctctgtggccaggcaaatacagtagtccaggccttccacaacttctgcatgtgcgcatgtgcgcacacacacacagacgctcaaaaccatacccctcctgggcatccccttaatagaggcatccagtatattgcaaaggtactcatcactatacacagtgcaaatactcagcactcgtttatagcaaacccagtatgaataattagcaatagtttgggatctggcacaacccttaattaccacaactagaggccagaaaatgaaatcagggtcatatatctgaggttagaactctagaatctgtctggcatcctatagcccaaagcaccacagggaggtacaccttggagcaatgggagcactgtcatccaggagacactgtcccctcactttcctccaaaaccagcacagctgtttgcacgagggctatctgccgtatatacagtgagactaagatatatatacacaccctggcgcttcgcctgatttcttctgtgaagtccatctgtttatccagttccagatcccaaaaggcagtcaccaaaaactaaatagtgagaagggacaggcttttttttttcttttttgataaacatgttacagtgaacaaaacagattttgcaaacacattccatctagtaaatcttacctcacagctgtgtgagaagagcttggaggagagaaggatggggagcaggagggtctcaggacttgattggagaattagaaagttcagaaacccacaagggtgggacagttcagtactatctacttttttttttttttttttttgagatggagtctcactgcgtcgcccaggctggagtacagtggcacaatctcagctcactgcaacctcggcctcttgggttcaagcgattctcttacctcagcctcctgagtaactgggattacaggcgccggccaccatgcctgactaatttttgtatttttagtagagacagggtttcaccatgttggtcaggcttgtcttgaactcctgacctcaagtgattcgcccacctcaccctcccaaagtgctgggattacaggcgtgagccaccgcccctagcctatctacttcttatagggtgataattggccttttcccttcattctagcccctcatcctaaacctggaatctgtgatgggctcaccaaaaatgaagatctggctgcagactttggcttctttcactgaaaagctgatctagccagactttatcttcaaaagacaggccctgcacttctgatgttccctgagcctctcccactgagcctactctcgtccactgtagccatgatgctctctggattcagacaatggtgtgttgtcccagaacactgtatctggcctgtctgtgcttcacatctacccctttggctaggaaaatgagggacagagctcacatcagtaacttggattctgaggaccgaggacaagcagaagaaattgaccttttgcctcagaggtggctggatgtttgtgtgtctctcttcgatgtcaaattggctcactgaaccactcaagagttgttttttaaaaatgttctgctcactcctcatttgcgggtcagatgctttggataatccagtggaattctctctgcttcactgctggttgctgccagacacagagtgctaaatcctgtcagtcggtgacttgaaatgatgatgtgtgaaacagtgctgcgatttggacatcctgcactcatttgcatggactcctttgccagttaaccacagtagtgaaatggggcagcctggggcagcttccacagcccttgccttatctttcctcagtgtccccaccctcccccatggcagtatgtagctccagtaattggtaaggcttggaattctgtttcatttaatattattcccttcctaggcatcatagagcaatttctttaacatgctagattgcaacatgccagagacagagaaatagcatttgtgtgcagaatggagaggcgggaagcaaaacactcttgttgctgattcccatctcccggtctttgcccttccttctttccctagattgcatggctggctgattctcatctggtgagttctcagctcaaatggtacgttctcaaagatgagcctggcacagccatctcatgtggtcccaccctcagtcactgtgtatcacaccaccctgcctgatttatgtcattgctctcctcacttcctaaaagtatttctttctttgttactttttattctctgtctccccaaccactgcctccacacatacacactagaatgtaagtaccatgaaaatagggatttttatctgtcttatcccttgctgtttccccagaatctagcacagtccctggcatacctttgacacttagtatattgactaaataagtagctaagaatgtagcaattaagaacttctaaagcaaatatccatggttactatcaggaaatagtaaaggcagacagacagagagtttgaggaatggaatgagaagacatgatttcttatactgattttaataatggtcttaattacaaattgaatacgttaagtcaaagatcacaatatcgagtcgctcttcatttcttctgactcagactaaactgccccttattgagtaggttaggtcagggtcatagagaccaagtactacaaacttcctggccaaactggcataattgatgccacaaagtatgcccacttccagatttccactgggtggtgcctggctttgctttccttagggcagttgccagaagaaactggcacaatttaaagcagtttaaagcccagcctgggtatcttcatctagcctttattatattcttgcctgcctccagttcccaaaaagactgcattcctgtctgcaactccagggccctgaagccccttcagtcatgaaagccatggaggtgggttagccctgatccacccagcgtgagacagtatgaccaagagaacacatctttttttttttttttttgagacagagtctagctctgccgcccaggctggagtgcagtggcgcaatcacggctcactgcaagctccgcctcccgggttcacgccattctcctgcctcagcctcccgagtagctgggactacaggcgcccgtcaccactcctggctaatttttttgtatttttttagtagagacggggttttactgtgttagccaggatggtctcgatctcctgacctcgtgatctgtccgcctcggcctgagaacacatctttagtccagcagatacatggcactcatctcctcaagagtccttcacccaaacgagaattattagcttctcagaagttatcctttgtcttgttggggcaagatctgtgcctagtgtcaagagagagatgttaaagattaaagagcctccaccaggaaagggaatggttttgcctgaatctcttaatttgtttttccccgctacgagtgcattcatgttgctgggctccctggcttactccccggtggtttgtagtcattttcatcatgactttgcggttgcattgatatcagaatgagtttcgactgctgtacgtgatgcttccatgctccattgctttctctcttatgttgctaacgactctcctgttggcttcagcccttagccaagcccaccccactccacaccccactccttccctgtcttttattgatgctatgttgactttgcatgcctcagttagttcagttttctgagcacctgcagagaattaaccatctctgcttgctgctgcggatcacctaggcctttgatctgtttgatttctgtacttctaaaaatgttgaaggactctctaaccccaccaaagtacataaatggtgctacagttcctgtagcctgacctcctccagactagctctgcttagggaacagaagatcttcatgtaaatacagatgtagataccatttattaaatgttttctatgtacgattttactgttctaagcacttaatgtgaatatttcatttaatctttgcttatagagctaaaaggccatatacatgaactggcccattatttctctaacctcatctcttcttcctttccctcttattcttttggctcctgccatgttggtttccatgctgttcctcttacccaataggcacactccctccttaagactgtaatggctattccctctgcctggaatgctcttccctcagatgtctgtatcagttactccttaaccccttcaaatcttcacttgagtgttaccttctccattaaacctacctagaccactctagagagaattgaaccaccagtaccacctcatattccctatctctgacttgctgtattctctttttttccattatatttatcactgaatctcttaatttgcctcagttaactttctatatagcttatttgtttgtttgtttgtttgttttttgagactgagtcttgatctgtcacccaggctggagtccagtggcacaatctcagctcactgcagcctctgcctcctgggttcaagcgattctcctgcctcagcctcctgagtagctgggattacaggcatgcaccaccatgcccggctaatttttgtattttttgtagagacgggttttcaccatgttggccaggctggtctcaaattcttgacctcaagtgatccgcctgccttggcctcccaaactgtcaggactacaggcgtgagctgctgcgcccagcctatttgtttattttctttatcattcattatctgtcttccccactgcaagataagctccatgaaggcaaagagcttgtctatttcttctctaatgtatcctaagcacctaaaaagtaacatgtgacacataatagatgctacataatatctattaagtcagtgaactttgtcccctaaaaacccatgctgtaggttcttctgttatccccattttgtttatttatttatttttattatattttaagttctagggtacatgtgcacaatctgcaggtttggtacataggtgtacatgtgccatgttggtttgctgcacccgtcaactcatcatttacattaggcaaatctcctaatactatctctccccactcccccaaccccacgacaggacccggtgtgtgatgttccccgccctgtgtccaagtgatctcattgttcaattcccacctatgagtgagaacatgtggtgtttggttttctgtccttgtgacagttttctgagaatgatggtttctagcttcatctatgtccctgcaaaggacatgaactcatccttttttatggctgcatagtattccatggtgtatatgtgccacattttcttaatccagtctatcattgttggacatttgggttggttccaagtctttgctattgtgaatagtgccacaataaacatacgtatgcatgtgtctttatagcagcatgatttataatcctttgagtatatacctagtaatgggatggctgggatggctgggtcaaatggtatttctagttctagatccctgaggaatcaccacactgacttccacaatggttgaattagtttacagtcccaccaacagtgtaaaagtgttcctattcctccacctcctctccagcatctattgtttcctgactttttaatgactgtcattctaactggcgtgagatggtatttcattatggttttgatttgcatttctctgatgaccagtgatgatgagcattttttcacatgtctgttggctgcatagatgtcttcttttgagaagtgtctgttcatatcctttgcccactttttgatggggttgttttttttcttgtaaatttgtttgagttctttgtagattctggatattagccctttgtcagatgggtagattgcaaaaattttctcccattctttaggttgcctgttcactctgatggtagtttcttttgccatgcatcagctctttagtttaattcgatcccatttgtctattttggcttttgttgccattgcttttggtgttttagtcatgaagtccttgcccatgcctatgtcctgaatagtattgcctaggttttcttctaaggtttttatggttttaggtcgaacatttaagtctttaatccatcttgaattaatttttgtataagatgtaaggaagggatccaatttcagctttctacatatggctagccagttttcccagcaccatttattaaatagggaatcctttccccatttcttgattttgtcaggtttgtcaaagatcagatggttgtagatgtgtggcattatttctgaggcctctgttctgttccattggtcaatatatctgttttggtaccagtaccaggctgttttggttattgtagccttgtagtatagtttgaagtcaggtagcatgaagcctccagctttgtcctttttgcttaggattgttttggcaatgcgggctcttttttggttccatatgaactttaaagtaattttttctaattctgtgaagaaagtcattggtagcttgatggggatggcagtgaatctacaaattactttgggcagtatcaccattttctatccatgagcatggaatattcttccatttgtttgtgtcctcttttatttcgttgagcagtggtttgtagttctccttgaagaggtccttcacatcccttgtaagttggattcctaggtattttattctctttgtagcaattgtgaatgggagttcactcatgatttggctctctgtttgtctgttattggtgtataagaatgcttgtgatttttgcacattgattttgtatcctgagactttgctgcagttgctgatcagcttaaagagattttgggctgcgacaatgggttttctaaatatacaatcatgtcatctgcaaacagggacaatttgacttccttatatcctaattgaataccctttatttctttctcttgcctgattgccctggccagaacttccaacagtatgttgaataggagtggtgagagagggcatccttgtcttgtgccggttttcaaagggaatgcttccagcttttgcccattcagtgtgatattggctgtgggtttgtcataagtagctcttattattttgagatacgttccatcaatacctagtttattgagagtttttagcatgaagggctgttgaattttgtcaaggccttttctgcatctattgagataatcaagtggtttttgtctttggttctgtttatatgatggattacatttattgatttgcgtatgttgagccagccttgcatcccagggatgaaactaacttgatcgtggtggataaggtttttgatgtgctgctggatttggtttgccagtattttattgaggatttttgcattgaagttcatcagggatattggtctaaaattctctttttttgttgtgtctctgccaggctttggtatcaggatgatgctggcctcataaaatgagttagggaggattccctctttttctattgattggaatagtttcagaaggaatggtaccagctcctctttgtacctctggtagaatccatctggtcctggacttcttttggttggtaggctattaattatttccttaatttcagagcctgtctattcagacattcaacttcttcctggtttagtcttgggagagtgtatatgtccaggaatttatccatttcttctagattttctagtttatttgcgtaaatgtgtttatagtattctctgatggtagtttgtatttctgtgggatcggtgatgatatcccctttaacattttttattgcatctatttgattcttctctcttttcttctttattcatcttgctagcggtctatcaattttgttgatctttaaaaaaaaaaaaaccagctcctggattcattgatttttttgtagggttttttgtgtctctatctctttcagttctgctctgatcttagttatttcttgccttctgctagcttttgaatttgtttgctcttgcttctctagttcttttaattgtgatgttagggtgtcgattttagatctttcctgctttctcttgtgggcatttaatgctataaatttccctctacacactgctttaaatgtgtcagagattctggtacgttgtgtctttgttctcactggtttcaaagaacatctttatttctgccttcatttagttattaacccagtagtcattcaggagcaagttgttcagtttccatgtagttgtgcagttttgcgtgaatttcttaatcctgagttctaatttgatggcattgtggtctgagagacagtttgttgtgatttctgttcttttacatttgctgaggagtgctttacttccaattatgtggtcaattttagaataagcgtgatgtgatgctgagaagaatgtatattctgttgatttggggtggaaagttctgtagatgtctattaggtctgcttgttgcagagctgagttcaggtcctggatatccttgttaaccttatgtcttgttgaactgtctaatattgacagtggggtgttaaagtctcccattattattgtgtgggagtctaagtctctttgtaggtctctaaggacttgctatatgaatctgggtggtcatgtattgggggtgcatatatatttaggatagttagctcttcttgttgaattgatccctttaccattatgtaatggccttctttgtctcttttgatctttgttggtttaaagcctgttttatcagagactaggattgcaatccctgcttttttttgctttccatttgcttggtaggttttttttttttttttttttttgagacggagtcttgctctgtcacgcaggctggagtgcactggtgccatctcagctcactgcaagctccgcctcccgggttcacgccattctcctgcctcagcctcccgagtagctgggactacaggcgcctgccaccacgcctggctaattttctttgtatttttagtagagacggggtttcaccatgttagctaggatggcctcgatctcctgacctcgtgatctgcccacctcagcctcccaaagtgctgggattataggcgtgagccaccgcacctggcctgtttggtagatctttctccatccctttattttcagcctatgtgtgtctttgcacgtgagatgggtctcctgaatacagtacactgataggtcttgcctctttttccaatttgccagtctgtgtcttttaattggggcatttagcccatttacatttaaggttaatatttttgtgtgtgaatttgatcctgtcattaagatgttcgctggttattttgcctgttaattgatgcagtttcttcaaagcatcgatggtctttacaatttggcatgtttttgcagtggctggtaccagttgtttctttccatgtttagtgcttccttcaggaactcttgtaaggcaggcctggtggtgacaaaatctctcagcatttgcttgtctgtaaaggattttatttctccttcatttatgaagtttagtttggctggatatgaaattctgggttgaaaattctttaagaatgttgaatattggcccccactctcttctggcttgtagggtttctgccgagagatccactgttagtctgatgggcttccctttgtgggtaactcaacctttctctctggcttcccttaacactttttccttcatttcaaccttggggaatctgataattatgtgtcttggggttgctcttctcaaagagtatctttgtggtggtgtctgtatttcctgaatttgaatgttggcctgccttgctaggttggggaagttctcctggataacatcctgcagagtgttttccaactttgttctattctccccatcactttcaggtccaccaatcaaacatagatttggtcttttcacatagtcccatatttcttggaggcttagttcatttctttttagtcttttttctctaaccttgtcttctcgctgtatttcttttcttttttttttttttttttttttgagacagtctcactgtgtcgcccaggctagagtgcaatggcacgatcttggctcactgcaacctccgcctcccaggttcaagcaattctcctgcctcagcctcttgagtagctgggattacaggtgcctgccaccacgcccagctaatttttgtatttttagtagagacggggtttcaccatgttggtcaagctggtctcaaacccccgacctcgtgatccacctgcctcggcctcccaaagtgctgggattacaggtgtgagccaccgcgcctggcctcttgctgtatttcattaatttgatcttcaatcactgacaccctttcttccacttgatcgaatcagctattgaagcttgtgcatgcgtcacgaagttcttgtgccatggttttcagctccatcaggtcatttaaggtcttctctacactgtttattctagttagccatttgactaatcttttttcaaggtttttagcttccttgcgatgggttcgaaaattcttctttagctcggagaagtttgttattaccaaccttctgacgcctacttctgtcaactcttcaaagtcattctctgtccagctttgctctgttgctggtgaggagctgcgatcctttggaggagaagaggtgctctgatttttagaattttcagcttttctgctctggtttctccccatctttgtggttttatctacctttggtctttgatgttcatgacctacagatggggttttggtgtagatgaccttttggttgatgttgatgctattcctttctgtttgttagttttccttctaacagtcaggtccctcagctgcaggtctgttggagtttgctggagttccactacagaccctgtttgcctgggtatcaccagcggaggctgcagaacagcaaatattgctgcctgatccttcctctggaagcttcgtcccagagggcagccacctatatatgaggtgtctgtcggcccctactgggaggtgtctcccaattaggcttcatgggagtcagggatccacttgaggaggcagtctgtcctttctcagagctcaaacgctgtgctgggagaaccactgctctcctcagagctgtcagacagggacgtttaagtctgcagaagttgtctgctgccttttgttcagctatgccctgcccacagaggtggagttagaggcagtaggccttgtagagctgcggtgggctccgcccagtttgagcttcccagccgctctgtttacctactcaagcctcaccaaaggcagatgcccctcccccagccaggctgccgcctcgcagatcaatctcagactgctgcgctagcagtgagcaaggttctgtgggcgtgggacctgccaagcttggcacaggagagaatcaccttgtctgccagttgctaagaccttgggaaaagcacagtatttgggcggagagtgtcccgtttttccaggtagtctgtcacggctccccttggctaggaaagggaactccccgaccccttgtgcttcctgggtgaggcgacgccccaccctgcttcagctcgccctccatgggctgcacccactgtccaatgagtcccagtgagatgaaccaggtacctcagttggaaatgcagaaatcacccatcttcggcataggtcatgctgggagctacagaacggagctgttcctattcagccatcttggaacactgcccacttcttttttttttttttttttttttttttgagatggagtttcactcttgttgcccaggctggagtgcaatggtgcgagctcggctcaccacaacctccacctcccgggttcaagcaattctcctgcctcagcctcccgagtagctgggattacaggcatgcaccaccacgcccagctaattttgtatttttagtagagacagggtttctccacgttggtcaggctggtctcgaactcctgacctcagatgatctgcccaccttggcttcccaaagtgctgggattacaggcgtgagccaccatgcccggccttatccccatcttaatgatgatggaattgaagctcaaaaaatttaagtaactaacttgccccagatcatttgtctagtaaccagtggagctgagctatgaacccagaacccaggattgactaactccaaaaaatgtgctttcaaccatgaggacaatcctaagagtcacctgagctatttaattaaatgtggattctcactctcttgaccccagggattctgattttgcttctgtgggtttagggtacaggtgattcatgatcatatgttgagatgcattgagatatactacattgcttttagggtttcacatctgtatagggaggcatagggataaaattcattgaacgtttttttaactgtgtactgtgtgccagtccccttgatatgtataagcaagtgagatggagtccctaccctcaagacttggtctaatgggaccttggaaccctgccttgactctgtcagactacctcacttgagcaagccacttactctttaagccttagtttctctatctgtaaaatggagatagtcaattacttacttcagagcaaaaggcctgatctatgatcctgtgattcccaaggctcttttaagttgtgaagtcacagggtggactaacttccaatgctgagaacaatgatggggtggtgatgggtcagatagacaaataaatcaataattcaaccaccaataaatagtggaatatgtaaaagcatgcgctttggaatctggcagatccatgattcaaagctcgaatgtgcttgcctcttgctagttacgtaactgggcaaattacttcactgccctgtgtctgcaagtaaaatgaggacagtacttaccctataggactgctgcgagacattcaatgagagtaatgatgcacagcactcagtacagcagcttaaaaacaggtaacaccatgaagcactacagaagcagtgatcaataaatggtttagagacagtaaacatccaaagacgcagaagagttttacagttttacagcctactattttatagtttaaatttggttacattttttgttgtttttaatataacttacatggaaatctttttaaaatgtatatgatacgtatacagtggccttccctgccatcttatgtaatttaactcctctaggcatctaagcatcatctttgtcatcataaattattttactctgctggaaaagatcattgccttcaggacccactgaaatgtaccctaaatgtatccagattatatttaaaatatatttttctgcctctctgttaggtcatgtagttaatgcctaattatagttctttttcctctccttgtttaccctgtctaatctgtattgggcttagaaactagtggccaagcttgttaaaactgcgagtataatcagagtatgtcttggaaccctgtaagttagccacacgagcttttgtatgtggacttcatgaaatcttcttgcctacttggagacttattgacatttagatatttggcattgcctattagttaagttttaaattgactagatattactgtgtaaggtacagatacctgaaaaaaaattccattattctcagctttggaagttgatccaatctatgacttcacaacttaaaagagccttgggaatcatgggctcataggtctggccttttactctcaagtaaatagcaattgattattatctcttttttacagacaaagaaattgatccctaagtgtaagtagcttgttcaagtgaggtagtctggcaaagtcaaggcagagtttcaagtctcccaagcctgcccttccgctctgccacactgttcccaggaggaaacaatcatcttaggctgtagaaaggaaggaaaactatcaataaatatggttaaagattagaaaaatggcccagcacgatggctaatgcctataatcccaacactttgggaggattgcatgagcccaggagtttgaaaccagcctgggcaacatagtaaacacagtgacatccctacaaaaaaaaaattgctgagcatagtgatatgtgcttgtactctcagctactctggagactgaagcagaaggatcacttcagcccaggaattcgagggtgcaataagctatgatcacaccactgtactctagcctgacaacagagcaagaccctgtctcaaaaaaaaaaaaaaaaaaaaaaatatatatatatatatatatatatatattagaaaaatgagatctatggaggatattgtaactattcagttctatgcccttattttgatagatgtttttcctgtcactcctgccctcatttgaaggggtttataaccttagtatgccatcagtgagcctgaacatctctataagggaggaccaaggggcattataataagatccaaaaacatagaattataaaagatgatgatcttttcatcatggatgaaacaaggtgtagggaaggaactaaatggcattcaggtgacttagagggggaagaaagagccactgagaacgagggacatggaaacaggtttctgaaggaagatacatacttgaccatctctgtggatggtttcctgcctgccggcctgccatccttccttccacagctttgttaagatacaatttatataccataaatcaaaatggctttttaaaaaataaatcttcttaaataattcttttttattttttattttttttgaggcagagtcttgctctgtcacccaggctggagtgcagtggcatgatctcagctcactgcaacctccgcctcccaggttcaagcagttctgcctcagcctccctaatagctgggattacaggtgtgcaccactgtgcctggctaatttttgtatttttagtagaaacgtggtttgccatgtcggccaggctggtctcgaactcctgacctcaagtgatccaccggcctcggcctcccaaagtgctgggattacaggcatgagccactgcagccaaccaaaaaataaatcttattcttctgattgcaagaaagcacatatcatccacggtccccaaacactgagttaactactatttttaactctgttgatgtatcccattcttttccctatgcaaatttttattcttttttttgttgttattttaaagcaaacatggaaccatactctatatgacaatttttattttgctctttcctcttaatatcatgaggtcatgtactttgttttcatcttaaactcatttcatcagatgaattaaatctttattgtaaaagcttccaaagagaaattcctcatctggggttgaaaattcagatgccaacactggccaggcaggtcatataagaagcatacgtgttattcggtggtaaactggcaacagcatcctcttccccagctccagctgattgtggtcatgcaggaatgctggcccatcattaccaggtcttctgatttttttctaaaaaagagagctatctgaaatctagattgtgttgtgggaaatatcttaatgttttgcctcaaaatttaaaaagtacacttcaagccaaacaaaacctggctgccagctatattctctgtcccagacagtgagtgctaagagtttcacaagcattatctcatgtattcttcacagcagtcttgctcctctaatggttatttattaggaaccaacaatgaataaaaaatcaaaatccttgctctcttggagcttctgttggggagacagttactgctctggagaaaaaataaagcaggaaaacaagatgggggtagagggagagttcacagcattcccactctgctagcaagttatgtgctagatggtcagattatgactgggcaccgtggctcacgcccgtaatcccaacactttgagaggccgaggtgggtggatcacctgaggtcaggaattcaagaccagcctggccaatgtggtgaaatcccacctctactaaaaatacaaaaattagccagtgtggtggcttgaacccgggaggcggacgttgcagtgagccgagatcatgccattgcacttcagcctgggtgacaagagtgactctgtctcaaaaaacaaacaaacaaattatgcgctacccagtctttgtgctacttcctcaaccacagagaatgacaatgaaagaatcctagaatgttaaacccaaaagcaaccgtcacaattattgagattaaaaggtttgtacattttcaaatagttcttaatggtcttactttttttttttttttttttttttttttgagacagaggctcgttccgtcacccaggctggagtgcagtggtgcgatctcggctcactgcaacctccacctcccaggttcaagcaattcttctgcctcagcctcctgagtagctgggattacaggcacgtgccaccacgcctggctagtttttgtatatttagtagagacggggtttcaccatgttggtcaggctggtctcgaactcctgacctcgtgatctgcccacctcagactcccaaagtgctggggcataagccaccgcacccggccttaatggtcttacttttaaaaaatcctttgatgtcttctcattgctcatacttttgtttactttcttaattttaaaaataggttatacatgaaaatgacaaaattcaaaagggtatacaatcttatatactttaaaatatactttacttagtctatcctatatactttaaaatgtattttacttagtctaatcagccgtgatcatttatttatacgtgaggcatgacaggaagaaattgaggcacagagttggtatccaatggaaggccacccattgatggagaaaccaaaccccagtgagtaaaaccagactttgtctttcagaattcttgtgcataaatgaagttgggtagattcatcctgatgccactggatatttttcattttttttctttactttttgtatgcctgccagtctcagtgaaagataaggatcagggttcagaaagcctaactattgtgtcgtttcccaggatggagagcactatcatttggttcacatttttattaaaataagatgagtgattcactcacattacaggcaaaggatcctttaccaggaaaccatactttgaaaaacaaagctgatggctttaaggaacagtaactactaacatcaatttcctttcccatcaagtcccaaaagagtcagacactcttctttctctagctgcctcattctcttcccgatacatatccatataattatagatagggtacattacatatacccataaaagacaaaacagcaggaaagacaaaggtagattcatctgaagagatgtgtgtgtttatctatatccagtcttctttctggttcttgctgtttctgttccttacgtctgtttttttagttgataggtagccgtaaatccatcatcattggtggaagctagtggattctgacgagaaaacaggctgtggtcttcataagcacgcctacatgctggccaccaccctcccctgctcgcacacccatcaagaactggagaacttagattgttgcttttttatttttagtctgtcttggttccactcaccctcagtgagtaaccccgttagccactgcttctgtttatatttatttagaaaagaaggaaaatgcattttaagaaaatcaaatgcataatctgttccacttcttatttattctgtggctgctttggacagtggaaagctcagaggaagtataataacttttattcatttttgttttctgtggcttgctctcttaagttctcatcagacagctttgctaataacataaaatttcatcctaatgataagcctgattttaaattgcaaagaaaaaggtagtggggccaggagcagtggctcacgcctgtaatcccagcactttgggaggccaaggctggcagatcacttgaggtcaagagttcaagaccagcctggctaagatggcaaaaccccgtctctactaaaaatacaaaaattagccgggcacggtggcacgtgcctgtaatcccagctacatgggaggctgaggcatgagaattgcttgaacccaggaggcagaggttgtagtgagctaagattgtaccgctgtattccatcccgggtgacagagcaagactctgtctcaaaaaaaaaaaaaagtgggaagtattttttatatatataaatgaaatatacttttctcttcctaatctgtgtctagtcctgttaaaattgcagatacaggcttataatggctttaactgtttattacttttgttgtctcttctctattttcttataggcatcagtagcaagtcacttaaaatagaaagggcctgtcagtttgaggggaagcaagttacaagccagacagactacatctgaccctggagccaccctaggacaaaaagtgatagaaagagatggaatagctagtgggagatttaaatgttcacagtaatagtcactggccaggtgcggtagctcacacctataatcccaatacttcgggaggccaaggcagaaggatcatttgaggccaggatttccagagcaacctgggcaacatatcaagactctgtctctagaaaaaataaaaatgaaaaaattagccaggcatgatggtgcatgcctgtagtctaactacttcccgcctaggctaaggcaggaagagctcttgaacccaaggaattccaggctgcagcgagctatgatcataccactgcactccagcctgggtaacagagcgagaccctatctctaaaaaaattaaaataatggccagcacggtggcttatgcctgtaatcccagcactttgggagaccgaggcaggtggattacttgagctcaggagtttgagaccagcctgagcaatatggcgaaaccttgtctctacaaaatatacaaaaattagccaggcgtggtggtgtgtgactgtggtcacagctatttggggagctgaggtgggggggattgcttgagcccaggaggtggaggttgcagtgagccaacatgacgccaccgcactccagcctgggcaacagagcaagatcctatctcaaaaaaaaaaaagaataaaattaaataataaacaaaataataatagccagttgcagctaacatttactgggttctcactgtgggaattcactgtgccaggtgtttttcatccatagacgaaggaaaagcaggttgggttcccagagacttacagcaaaaagaaaaggacatcatagggagccagtctgtgtagcagagaaaggccagcctttgaatgagaaggcttgatctgatccaggaactaccacttatgcggcaattttgtcccttgcttgagcctcattttccatgtctataaaaatgggaattaataccattttcttttccctgccccacaaaattcttatggggatcaaaagtgataatgcatatgaaaatggtttgcataattctacactgtctgcaaatatgagccatcagcactattaaaagtgaggcaatagaggattggcagtgcactgacagtctgggaaagtggcgcacctgccttcaggcaggaactctgttattcattcatcaataaagaacaaaggcttgacaaaataatcatgagataagaaataagatcgtttcagccacccactggctggagctgaaggagaactgtgataaattgtgccttttgttatgcaggtgccatcccacctgtgtctgtgtgccttaaatgaaggaaagtaataaaagtaataacaagagcaggtactgttgattggatgcttatctatgccatgtaccagcaccttaatttaccatctcttcctttaaaaaaaaaaagattttttaatcctctcaaaaattcatgattagcattatcattattcataccattattactattattcactgtcattttcaattggctcgcctaatgtcacatggctagttagcagaagaaccaggatttggacccagatcggctgattcaggagccttgattattattattattttttttttgagatggagtctcgctgtgtcatgttgcccagactggagtgcagtggtgtgatcttggctcactgcaacctccacctcccaggttcaagcagttctcctgcttcagcctcctaagtagctgggattacaggcatgcgccaccaggcccagctactttttgtatttttagtatagacgaggtttcaccatgttggccaggctggtcttgaactcctgaccaagtgatctgcccgcctctggctcccaaagtgctgggattacaggtgtgagccaccatgcccagccttagcctgtactcttaaccattgcactatgtaagacccacttaggttttagggcctaactgccctttgtagagctctagagttttaaggtagcacctcaggccttctttcctcgacttctcgtctgggtgagagctgttgaagagaaagttggctaaaaaaggctttgtttttataaatattaaatattgagattccttacaagattttcatttgttatctctttgagacagggtctcactcagtcacccaggctggggcgcagtggtgcaatcatggctcattgcagccttaacatcctaggttcaagccatcctcccatctcagtctcttgagtagctgggactacaggcgtgtgccaccatgcacagctaattttttcatttttattttttgtggagatgaggtctcactatgttgcccaggctggtcttgaactcctgggttcaagcgattctcccgtcttggcctcccaaagtgccgggattacaagcatgagccattgcgccagacctagatttctattttttaaaatgtatatatattaaaacatttttttcaggccgggagcagtggctcacaacatccttattttacaggtgagaaaactgaggcctagaaaaattgtgcccagataggtataatcctttgccgaagtcagaccaagttcttttctctatcatgatgtgtctctgtagtaaacttttgcccccctaaaacaacataaaaaccttcattctggctttaaacaccccccagaaataaatttaaaattctgcctctttttcaaaggttgagtgaggtatatcaccattgggagggtgtgatgttttctcttgcctttagtcaccattaggagggattaaggtttattctccagtttagctcttgtgcctgtttaaccatttctgttcaattaagaacaggaatgggttgcaggagtttgtaacaacacctgcttcttggaggagaattataacttggccctgagttgtccgtttcaaagggcccaccctgtcctcctgtttccaaagaaaaactggaagtggtaacacctggtggagctgcatgagcacgtgagtggtggtgcaaattctaggctggagtcacttctttgatgggctgccggagcctttgagagcttatggtgccaagatcctgctctacattctagtgtccaaaactgccttccatttcctcaataatgggtaggaaactgtgtccatgccagagtagctagccccgttgctactagagaggctttcttttctcctagcactggtgcctccttccacaatgcatacggctgcccaccctcgccatatgcagcctgtgtttcatatcctcacactttctaagacaggacctcccccagaacaaagccttgccttggtcctccaatccctaatggccccatcgtgatgaacagacccccaagggttcgacacagtataggggattcttatcagaccaggcctgtggtttaagccaccagtggtggttcaggatggccatggttagcctaaaaacctgatcagattgccatggtatgtcctacatgaccctgggtagaatgttgagatcctggttagaaatgcctgcatttctttaaatctttacctgctgtatataaacagttcctggagagttgtttttgttcattttaaacgttgccataaaattgttactgtgtctgatttaatactttgcctagaacaaagatactgccaaatagaaatagactaaatacatttctagcttggtgtctggcttagtcataataaaatataaaactaaaggggcagccgggtgcggtggctcacgcctataatcccagcactttgggaggccgaggcgggcggaccacgaggtcaagagatggagaccatcctggccaacatggtgaaaccccatctctactaaaagtacaaaaattagccaggcatggtggcagacacctgtagtcccaggtactcgggaggctgaggtaggagactcgcttgaactcgggaggcagcgtttgcagtgagccgagatagcgccactgctcttcagcctggcgacagagcaagactctgtctcaaaaaaaaaaaaaccaaaaaaaaactaaaggggctttctgcccccattggaacacactgaagatgctctggggagtaatgagctggcaaagggtagtgttcataatggcccaaatactttaccccacaggtgtcattcgaggccattgcctcttattccttttgtaaggtcatttcccattcagtcaactaattatcatttccctccatttataatataaaacaacagtgctgccagaggagataaaattgaataacacagccttctcttcttctggggctttgcttgacaggaacatggccctagtagggtagcaatctttctgtgacatgtgataccaactgctacatggggagtgaagtcgtcagatgtcttgcctccttcttcccttcccccacactgtccctcactcccttccccctcctcacagagtagcactgagaagtatttactcagctgtggcctggtaacaaagccttggtgccccagggattggaaggggtggtgtggtcatgccccgaactatccatgtccttccgagcatctcttggcagagcagcctggctgaggatgagtgtcatttagagtgagccttcacaacccctgcataaaagaacataaaaacaattgcagctgaaaattggagagtccacacatgggctgtggtattctctggcctctgtggtagtactattgagatcatgcagccaacaaactagaggctgttcagtcctctgggactcccatggcttgtagcatttcattatctttagctcttgtccagcactagctcactcaaccaacatataggcactcacacaaatgaatttagactgagccccatttcatcccccataaatttagagctaaaagtctttgacttcaggctttagggaaggttttctctgaaggaatgaatatatggccccacttccttccatctggcactcctccatgggtattctttagtgacaccactgtgatcctggcaaaggtaccatttcccaggaagaggagaggtatccgatctacagctatattccaccacagttctgagcaaatgtggacacgcatggtggtctgcaaggaggatgtagaaatgactaagctgctcccacagagcttcagaagcaggacttgccacagcaagaaggcagaccagatgtcaaaaagacatccttttcctacaaatgagaatgagttagcccttgaatatattgggaatcaataatttctgactaattttcttagctaaagtaaattcatctaacactctctaggattagagtggatataaccaacagaagaatattttgagtcagggcagtgcttatcttgaaagcagtagtattcatgctagagttgtaacagcaataaagtgaatttctgtgaagtgaaccctaggcttcctttggttttcatggaaaaatcagtgacatggcctggcgcagtagctcatgcctgtaatcccagcactttgggaggctgaggcgggtggatcacctgaggtcaggagttcgagaccagcctggccaacatggtgaaacctcacctctactaaaaatacaaaaattagcctggcgtagtgatgcatgtctgtaatcccagctactcgggaggctgaggcaggagaatcgcttgaacccagtaagcagaggttgccatgagccgagattgtgccactgcactccagcctgggtgacagagtgagactctgttaaaaaaaaaaaaggaaaatcagtgatacattcttatgaaaagaaatattcaagctgattgaactgagcacttggtgcaaaggccaacaagcccatgaagtgtagtacactggtcatggtttatcatgtttactgacagttatagtacctagcacgtaggggattttccttttttcacactttacaactcctggtttctcctcatacccctgtaattttgcagaaatgcctcctgtgcctggagaccccctatctttgtgttcacacagtaaccagaactttttccctatgaatttttatttgggtcactgtgtgaggcatgtttttatttattcattccttcaacaggtgtttactgcaatgcaccaggcattgtgctgattgctttagctaagttcaaagattccttaatttcaggacttcaagttttaatcagttaataattataaaataatgctaccacttattgagcactttgctaacttttttcagaaaagtgtatatgttacctcttttgatcttttacaacaattccattaggtaggtactgtagttcttacacttttaagacaaggaaaccaaggttcagggaagttgtacagcttgtctaagtcatgctggtggcaagtagtggagccaggtttttgaagccaggtcatctgattgcaaagtcagagttctgcactaatacaactgccctgcccaactaccctgtgctgtttaaagtggcctgcctgaagggtacctgtatgtttaacttagatagaaaatctgtcagtcacctggtgtgaataatcctaacatcagaagtccttcacaaaccagctggatcccacctgctagggtggaacttgcaggaccttcagagcctgtgctaggcctaggtctgaatctcagccctcttcctagctgtttccttgagaaaatgattacacctcactgagccctagtttctttatttctaaaataataatagcaagtactaacagatggcccttacgatgggtcagacactgttctaagcactttacattaactcataacaactctgcaatgttcatactgtcatttcatagatggggaaactgaggcatggagagcttaaaagtcaagtaacttgaagtcagtggcaaagctaggatttggacccgaacaatctaactccaaagtccatgctattaaccacaatgctatgctgtgctgcctctggagaagataggatcaagggtgtaaaacacctctggtctggagccagccacataattggtgagactagtgcaaggcttagaagaagaaagtttagcagtctgaccacccacaaaaggagacacacaaatttgtggagagtgttctgattttgatcttacaccaaagccttattatgtctttgcctttgaacttgcaggacctactggctgacactcttctaattgtggggggatctagagaaggtgtctactgatacacaatacttacctcccctgcacctgccaggtagaagagtggctggcaggtgggtggggatgagagaccacggtgtggccaccagcacagtggtcccccagcccatgccctctggcctgaggctgctgtgctggagcctcagtcttccctgttgacagtaattagaacttttcagactcggtttcttacatggaaaatctcaattcacttgaattgtctccttgatccagttcaactggagctatttagttcctgcagttagtttggaggggaaaacaagctcttaagcctcacacattatagctgataagatcaaggtgctgacagtgttagctgggtaggctttggagccagactgcctgggtttgaattccagttctacctcttaagtgtgcacaatctgagtttttgtgtctgtgaaatgaggataatagtcgtgaagattagtgaggtgacatatgtaaaccccttagaacagtgcctccccaagaccaagtgctcaataaatgttagctgtgttattgttaagcccctcctgccatcagcctcccttctctccctcccaccctgagatcttgctcagggaagacaggtccccttcctctcccctaccctggaccctcctctctttccttgctcaccagcttatttcatccctctaaactttctcatcctcatctgtgaaatgggactggaaataatggagtctacttcataaggtagtatgctgtgaaggctaagtgagttaatttttttttattttttatttttttgaggggggaaggagtctcactctgtcacccaggctggagtgcagtggcatgacctcagctcactgcaacctctgccttctaggttcaagagattctcctgccccccaagtagctggattacaggcacctgccaccatgcttggataatttttgtatttttagtaaagatgggtttttgccacgttggccaggctggtctcgaactcctgacctcaggtgaactcttgccttggcctcgcaaagtgctgggattacaggcgtgagccactgcgcctggcctaagtgagttaattcaagagctgagcacagatctccatggctactcactctctttacagttattgctggagcacaaagggctgtgagaagggcctttgagatcttggacagttctaagagccaaagggcccaaaatagacaggagcattagggtgaactggtgcccaaatgcaggctgcagaagctagggggactgctaccttgttcatcataatggggagcctggaacagagcaggcacatgggaataggaagtgagtggccactgcaggagagtgttcaaaacggatttggctcaggcaacccaacagagaactttcaaggcagaaaacttttaggtgtttaagtgtccaaactcagcaacagccaggctcatgcctgtaatcccaacactttgggaagctgaggcgggaagttcaagactagcctgggtgacggcacgagaccccgtctctacaaaaattttttaaatgcgcagggtgtggtggcatatgcttgtagtcccagctacttgggaggctgagatgggaggatcacttgagctcaggagttcgagactgcagtgagctatgccactgcactccagcctgggtaacagagtgaggcccccatctcaaaactaattaattaattaattaattaaaatttaaaataaaaaaaactcagcaacaaataccttcctcctctcttcttctcacctccagaatttgaaaacagaaccaaaacaaactcccattgtttgatgttactaagttctagacattctgctaagcactttatagacatcatctctcttacacttgactttaaccctgagaagtgtcagtgtcacttgcattttacagatgagaaactgagacttagagagattaagcaatttgcccaagattacatacctggtgaatcgcagagccaaaatttgaatcctagcctatggagcagaaagggaacaagctcccatatgcctatcagtgttctgattttgaaataagtcttaccacttatagttctctcaatacccactgtacaacagctgaggagtgtctcgaagtagcagaaatcatctgcccttgacattatctggtcactacttcagtagaattagaactcctctctccacatcccaacacagagtctgcatggaagaataataataacaactaatagaactactctctccacaattaaaagttgtttatttgcttgcattttcattaatctctttatctgactactgtcctcacttaacatttagaagagtcaagttccagaagtggtgagcaggatgtattctgtttttcatatttttaagagcttttgttgtgttagagaagcacgcagtgatttttgtaaatcattcttctgtccttggaagcaagtacttgaagtacatgagttagaataatatcaaaaacctgaagagggcctagggtctagaaaccaggaagctaatgttgactcctagcattgtctttcttaattaagtaactctctctctctctctctctcattttttcattttccttcattctgttatcttcccaaggatattttgtaggtaatttgggggataaatgtaagttcctatgaaacactctgactctccctaagaatgctatcagatatatccaccaaagtttagcctagaaaagcacgatgattcaaagatagaactttcctttatttactccctgccctgccagaaatcactcttctcttttctctacatggggagttctggagtgagaataaagtgggaacacattagactcagtggattttctcccttcccttcgcctttttcctcaccccaagcctgagaccacgagtggcaatgactccctcccttgaagaacaagacctcctgccaggctgtgcccgaggtcaggcaagtgggaagaggagagtgccacaaaaccatcttgatcctttgacctatattgacgctgagtctgttcctttggtgtttctgactttggcagtgtggttagtcaaactctctgtccccaccttgaattaagctttgatgaaaaagtactaggaacccaggcctttccctggagatttggggtttttgtcttggaaaagcatcaaccaaactaacgggggcaggagatctggattcctgtggcttgggctaacttaggtccaaagaaaccaagtgcctgtgatcatcatcttcattccccaaatgtagccatgccctctggattccctcctctcactcatcctcctcccaattaggcaggcttccgggtggattgctctcactttagcattaccaggcccttccatattcgaaatgctttgatatatgataatacttacacattcttactccttggctgatctaaaatcttttgccttcagtacatgcagcaacaaaataacttaagcatcagtgtatttcttctccctcaggatcctataaatttctctgagattcacctctctgggttctctgctggaccacagagcctcatcctggctcacctctcccaaagcacaaagcattgcttctgtatatcaggaatcatttggttgccttgactgtatatcttggacctttgtcttggcttcctataataggatgaccagatttgtgttcagccattcaaaagaagccagcctgctgcagtactggatgacagagtaatgaggtctgtgggtttctatgctgtactcttctccctacacagcaagactgtttgcgttagtactgcttccagatattctgtggatggtctttgggcatgtggtgggaaacgttaccatgccagagaatttcagcaaatttaaccggctttgaaatgacttgttcttccagatttttatatacaaggaaaaccaaactaaagaagactgatgaaggtgcctctcttgtttgctctcttcacccgaccaattttcataccagtgaagctcctttggtcaaaatggtgtaactggatgcctcccaccctggaaaagctttgtagaaatactgatcttaaaatctcacacctggaggttagagactagcatacccttcacactgacttgcttttaaaagaacagctctaccaagaccaggtctgaaactcatgaaatgaacaaaaagagggcagtgacttgaaatgcagagacctaatgtgttcctctccatttccacttcagatttgctgaccatgaaagaatatcactgtttgctgcaattactgtgtcctgatttcccgctggagctcactcagaaagcagccaggtacgtctcctggactcttgaaaccaactcagctctctgtgggccactgcttcctagagaaacctggagtgtatacaaatgaaaaaaaggagcatttagggaagaaactggcagtgggagaggggtctatttgggatgtgccccaaaacataatacattctgcatttccaaagggaagcgaaatgatcctttgtggtttctgtggggagcctcagggtctgaagatagagttggagggtggtgagatgaagaggcagaaaaagcccagacccctccaatacccccacacacacacaccctagaggatattctgagaaaagaggggctgcatttgtgtgttttcacgctactgtaaagatactacccaagactgggtaatttatgaagaaaagaggattaattgactcacagttccgcgtggcctcaggaaacttacaatcgtggtggaaggcaaaggggaagcaaggacctttttcacatggtggtaggagagagaagtacagacaggggaaatgtcagacgcttataaaaccatcaaatgtcttcagaactcactcactatcacaagaacagcatgggggaaactgcccatgtgatccaatcaccttccaccaggtctccctctcaacacctggggattacaattcgggttgagatttaggtgggaacacaaagcctaaccatatcagggggcaagggttggcagtgacttgtgatgaagagagttgaggttggggactggaagggcataaaggtgataaagccccagttgaaggaaaggcacattatattatttatgccagaagaaggttttcaagatcagtccagaaccaggacttggcagaaatagttagaagcccctaatttctgtgttgggtttcaccatcattcacaatttttaaccacatgaggtaattggactatgcctcagttaacttttacttacttaactcaaaacctgagctaggccagacacggtggctcacgcctgtaatcccagcagtttgggaggccaaggcaggcagatcccctgaagccaggtattcaagaccagcctggcctacatggcgaaactccatctctactaaaaatacaaaaaattaaccaggcacggttgcgcttgcctgtagtcccagctattcgggaggtggaggcaagagaattcgcttgaacctgggaggcggaggttgcagtgagcagagatcgtgccattgcactccagcctgggcgacagagcaagactccgtctcaaaaaaaaaaaaaaaaaaaaaaaaaaaaaaaaacctgagctagggttgcaaatggacgtacagcaaaaatcatgtttatcgaagaatgcctaccttccctatatcatactgaatgcatttaccttcattgttctatttaaatttgtttaccttaactatctcacctaatccttgtaaaaactgttacttccctttaaaatgatcctttgtggtttctgtggggagcctccggctctgaagacagagttggagggtggtgagagtattaggcaaacaacaaaacacacacacaaatacatacccacactcccacacacacccctagaggatattctgagaaaagaggaggcaagggttggcagtgacttgtgatgaagagggttgcggttggagaccagaagggcctgaaagcagctgggcgtggtagctcatgcctgtaatcccagcactttgggaggccgaggtggatggatcacctgaggtcaggagttcgagaccaacctgaccaacatggtgaaaccctgtctctgctaaaaatacaacaattagcctggcgtggtggcaggcacctgtaatcccagctacttgggaggctgaggcaggagaatcacttgaacctgggaggcagaggttgcagtgagccgattgtgccactgcactccagcatgggggacagagtgagactgaacgtcaaaaaaaaaaaaaaagggagcatgaaagtgatgaaccccagttgagggaagggtactgttactgctcacttcactgaagtgggaactgaggctcagacgggtgacaatgttgtgcgaatatactgatagcttgtaagtagcagtggcagaactggaaccgcagtcagcctgaatccagagatgggggatcgggagcacaaggagtctcttcatgctcccacctccctgtgtcatggcatcatttctgctttgtggtttgacccactgaaaacaaagctgcattggctgcactgcaccaagaatcacctcgctccttttgaaatgtgccaaccagctcctctattgacttggaagatgggaactccattgctcccagtgacagacaccagcctcacggtggggcacggtgttttgcagctaacagctcatgacctacttttgctggtcatgtgcaaaacctgtttagtgatcacacatgcaaaattttgtaggtttttttctccctcattattcagtggataattttctttcctgatggcaactggccactggtaaaagccgcagttcaggttttataattttaatttatctgctatccaaaggagatttggatattttttttcttcactgaaaaaaaaaaagtatgggagattatctcttgtaatttaaaagcagccaaatggagttagctttaaatttccatgatcgttcccctttgggcagaaatcattttattaaaaacatttttgtttgtttgtttgttttctttgagacagaatctcactctgtagcccaggctggagggcagtggtgcaatcttggctgactgcagccttcaccccgcctctccctgggttcaagtgattctcctgcctcagcctcctgagtagctgggattataggtgtgcacaccatgcccggctaattttttttttttttgtatttttggtagagacggggtttcaccatgttgcccaggctggtctcaaattcctgacctcaaaagatctgcccacctaggccttctaaagtgcctgggattacaggcatgagccaccacagccagcctgggcccagattgttttaaggaatattcagccccaaaatctggggagataaactcagcatccttaaagaccgaacttaaggccgggcacggtggctcacgcctgtaatcccagcactttgggaggccaaggcaggcggatcacgaggtcaggagatggagaccatcctggctatcatggtgaaaccccatctctactaaaaatacaaaaaaattagccgggcgtgttggcgggtgcctgtagtaccagctactcaggaggctgaggcaggagaatggtgtgaacctgcaacaactatatcctatattcatttgttcatttgtttattcatcaaatgtttctttttaacagctttttgggatacaattcacataccatacacttcactcatttaaagtataaaattcaattgcttttaatatatttccagagttgtgcatccattaccacagtccattgtagaatgttttcattaccctaaaaagaaatcctacaccccttagccattactcttcagtccccactccaccgtcttccccaaccctaggcaacccctaatctactttctggctctgtagatttatccactgggcatttcaaataagtagaattgaggccaggcacagtggctcatgcctgtaatcccaacacttggggaggctaagtggggaggattgctcaacatggtgaaaccccatctctaacaaaaatacaaaaacttagccaggcgtggtggtgtgcgtctgtggtcccaattacttgggaggctgaggtgggagaattgcttgagcctggggggcagaggttgtagtaagctgagattgtgccactgcactccagcctgggcaactgagtgagactctgtctttaaaaaaaaaaaaaatcaaataagtagaattgtatatgtggtcttggccaggcatagtggctcacgcctgtaatcccagcactttggaaggctgaagcaggaggatcatttgaggtcaggagttcaaacccagcctggccaacatggtgaaacctgtctctactaaaaatacaaaacttagctgggcatggtggtgcacatctataatcccagctactcaggaggctaaggcaggagaatcacttgaacccgggaggtggaggttgcagtgagccgagatcatgctgctgcactccagcctgggcaacagagctagactctgtctcaaaaaaaaaaaaaaaaaaaaaaaaaaccacgaccaggtgcagtggcttacgcctgtaatcccagcagtttgggaggccaaggtgggtggatcacgaggtcaagagatcgagaccatcctggtcaacatggtgaaaccccatctctactaaaaatacaaaaattagctgggcgtggtgatgcacgccagtagtcccagctacttgggagcctgaggcaggaaaatcgcttgaacccaggaggcagaggttgcagtgagccgagatcgcgccactgcactccaggctggtgacagagtgagactccatctcaaaaaaaaaaaaaaaagtgttttttttgtgactagtttcatgttttaggttggtgtaaaagtaattgtggttttgccattattttcaatggcaaagactgcaattacttttgcaccaacctaatagcacaatgttttcatggttcatccatcttgctgtatgtatcagtacttcatttcgccaaatgtttcttgagtgcatattttgtgccgggagctattctgcaaatggggatacagtcatgaataagatatagttcctgcccctcaaagaacttgatatagaaggggactgcttaggtactggtcattggctgccaccactctgtgacgtatgaccttggttttgatcaatcactccagaatactgacctcttttccctttcccatgatgtgagggagcttatgagagtgaggcttcaaaatgcatcttagccccccgcagccacagctttgcatttgccccagctgtctcctcagacccttccaaacaatctgatacatgaaagcaccacaagatttgagtgtaggtggtagaatcctgtaagaaccaaaaattctcgataccaaggtagaattgtacagttattgataccaaggggcttctggaatggtattcctctatttgcggctggaaacttacccactcctcacctagaggcctgctgtttgacagacacctcagacctttctgtctgagcaggaggaagcatcgtagccagtccatatcaatagcagtctgagggaattatgggaatggcagtaacaacagaagggccaagggtaacccacatggcactggctgcagttagagatgaattcagaattaggataagtttgttttctccccgagtatgagcatcaagcttctgtgtcaacttctcctcccaatgccatgctttccccactgtactgcagctggtgcatatgtagaaaaattgtatgtatcccagaaagcatcccctgattttgtaaactattctcattttgtcctgaagatcagggtcccagcttccccacacacatacctatgcatctgatcagaactgcaaatggaggtggtagagacttcaaggcagttactattgctagaagaggaactgccctctcccatttcactgccaggcttactttattcaggacactgaagtctggggacaggctgcagaagcaggctccagtctgtgatgatgtgtgcgtaaaagaatgtaatccacatgcagctggaagccggagcctgttcaggggcatggtgtctccacatgcgcctgccttatgtgctacaagcatcatggccaggccctggggcagcaggtgtgagctggaaaaacaggaaaagaaaaagcaaacagactccatgacagcagccaagccagagatcccctccacctcacatattcctgcagcaactggagtagttcttttatccccagatgatcaccacagcatctcccactccccatcctccatggactggaagctttctggatggttaagagcatgcagttggaaccagacttcttgagttcaaatcctggttccacaatatactagctgtgcccttgagaaaggtatttaatttgagcctgtttcctcacttgtaaaatgggaataataatagttgtaatgattgaaggagaagtatatgatgtgcttaaaatggtggctggcacagagtaaacttgtcataatcgttagaaatggtaatattaaccttgacctagaagaacacaggccccatggcattagaaagatctactgtacatcccacctgtgccccattaactggatgaccttgaggatatctcttaacttctctgagccctgtttttatatctgtaaaatggggatgataataataatagtaactaactcatagggtgtttgtaagatttcagtaacaccaacaaaaccatgaacactgcttaccacattgtagacattaaatcagtaataattttttttttagatgaagtcttgctctgttgcccaggctggagtgcagtggcgtgatcttagctcgctgcaacctccgcctcctgggttcaagtgattcttgtgcctcagcctcccaagtagctaggattatagatgcccgccaccacgccttgctaattttttgtatttgtagtagagacggggtttcaccatgttggccaggctggtctcgaactcctgacctcaagcgatctgcctacctcagcctcccaaaatactgggattacaggcatgagccaccacgcctggccagtagtaatttcttgctgttacaattatgttggtattattaatagtaccagattaaaagaaaaatgagatgttcctgggtttccaaaggcaatgcttcctggcctttttgcacttcacagcaatcagaaaataatatataacaaaaatctccagtaaagacaagacttcttgtgattggcctgcaggctctggcctcctcccagctgggccaaggggaccatcacatctgtaagtcatttgaggccgaagtgacaaagggttgggaagctctgctccaagggtgaagatttaaagcactggttctcaaacttgagcatgcatcagagtcacctgcagggcttgttaaaccacacatggccggaccacatccccagagttcagtaggtttagggcggggctcaataatttatatttctaaaaaattcccaggtgatactgatggtctgggaaacacacgttgagaaccactgatttaaagtattgcctgccattttttttttttttttttttttttttgagatagagtcttgctctgtcaccaggctggagtgcagtggcatgatctgagctcactgcaacctccgcctcccaggttcaagcgattctctcgcctcagcctcccaagtagctaggactacaggcacgcaccaccatgcctggctaatttttgtattcttagtagagactgggtttcacactgttggccaggatggtcccaatctcttgaccttatgatctgcctgcctcggcctcccaaaatgctggcattacaggcgtgggccaccgcacccggctgtattgcctgcattcttattctggctgggcatggtggcacacgcctgtaatcccagcactttgggaggcaaaggcaggtggatcacttgaggtcaggagttcgagaccagcctggccaacatggtgaaaccccgtctctactaaaaagaaaccccatctctactaaatacaaaaattagtcgggtggggtggcacgcacctatggaatcccagctactcaggaggctgaggcaggagaactgcttgaacccgggaggcagaggttgcagtgagctgagatcgcaccattgcactccagcctgggtgacatagcaagactctgtccctcccaaaaaaaattatttaaaaaatgttattattttttgaaatgaggtcttgttctgtcacacaggctggagtgcagtggtgcattcatagctcactacagcctcaaactcctgtgctcaagtgattttcccacctcagcctcctgagtagctaggaccataggcacgttctacaaagcccagctaattttttattttgtagagatgggggcagtgatcttgctgtgttgctcaggctggtctcgaactcctggcctcaggcattcctcctgcctcagctttccgtaaattattttattttattttattttattttattttaagatggggtcttgctgtgttgctggggctagactcaagctcccaggctcaggcagttttcctgcctcagcctcccaagtagctgggactacaggtgcacaccaccacacccagctaagaactttttaataaagaattcctacaaattggctgggcacagtggctcacgcctgtaatcccagcactttgggaggccgaggcgggtggatcacctgaagtcaggagttcaagaccagcctggtcaacatagtgaaacctcctctctactaaaaatacaaaaaaattagccgggcatggtggcgggcgcctgtaattccagctacttgggaggttgaggcaggagaatcacttgaacccgggaggtggagattgcagtgagccgaaaccgtgccactgcactccagcctgggcaacaagaatgaaactctgtctcaaaaaaaaaaaaaaaaaaaagaattcctacaaatcaataagaaaaagattaaggatctcagtagaaaaatagtccaaagatataaacaggcaatgcacagaagaacattagtaataaacctttgggcatattttcatgcccacactcactagtaatcaggaaactcccaactaaattgagataccacttcatacctatcaaattggcaaaaattttaaagtctcataatacaaatattggtgaggatgtgaaatagtgggaactctcataaactgtgtgtgggagtgtaaattgttacaattactttcagacaatttaggcaaatttttaaagttcaagagctactcctgggaataaggaaacatgcagtattgtttgtaatggccgccattggaacaatctgcacgtccctctgctgaaggaaagaataaagtgtggcatattcataccatagttgtggaattctttccagcagctaaaatgaatagctatatatgcatcaatcctgatgaatctcaaaatatcaaagttacagaatgacacagagtttgagaaaaagcaaaacaaagctatataatgttttaagaacacagacatttgcatgagttaattatagtataaagacatgcagaggaatgctagactcccaagttttagtaaatcatggtgatccccccaggaagaaaggtagaggataggatgagggaggggtgcacaggtggctgaaatggtatctgtaatgctgcattttacaaagcttttaaaaactgaagcaaagatagtaagacgttatggtctgataaaattggctagtggggacacaagtgtttgttatgttattctctgtagttttctgaggttctaaacatttcctttaaataaaaaatgatggggggattaggtagagagcaatgagagcaaaaagcatttcagggaaagtaagcagcatggaaaagaagctaggctctcaccaatgatggcctggaggaaccaagagaagccagtaggtctggaatttgaggcatttgagggcagagggagggaaagtggggctttacaggccatacattgggtttgggtctttattctaaggtctgtggaccagttcacccctagctctcaggcttcttgggaagttccagagtaatgacaccttcaggctgtctacagggaagcagcagcacccaggccaaatcttccagtccttctgcgggcagctgctctaacaaacactcaggctgggagaagggaaaggggcagcaggaaggcttcattaccacgagacagcacagagtccactctttcttaccagaagtggctgcaggtggtctcggaactgtgactagcgtcagagaggcctgtatttgaattatagcttttttgctcctagtttgtaacctgagtcaggtttcttaattcctctgaatgtctgcgttctccataaagatactcactgaactgacctcataggattaatacgagcagaaaatgaacttatgggtgtgtagtgctgacagagtaagcccttggtgaatattcactattattatcatcatcatcatattgtttcccacaccctctggatcaagcgtcttaggcatttcagggcaagtagggtttgggataccctggaggtgcgggctggagctagggcagagcaatgacctggacaccccacgccacttcaaggccctaggctagaggcagcttgtgcagcacgagtgtgcctccaacacagtccagaagaggagcaaccctcaggaaatggcccaggacaccttcatagcggcctttttcctcccacctggagaaggtaaccagacatcgtgtcatcgctgcttctctcatggccctgacattcaaacaaaaaccctagaggtgcactgtgagcccaaacagacatggggacacccttcagccaccccatgactgccaccttgacctggggacacccttcagccaccccatgactgacaccttgacctgaggacaccctccagccaccccatgactgacaccttgacttgcggacacccttcagccaccccatgactgacaccttgatttggggacaccctccagccaccacatgactgacactagtcatgtgacctcctcaaagaagtccagtcatggaaagtggctcttctttctggccgtggctgagggctggcttcccccaaaagtaaactggaaactagatcgctggcttctgcctgagacctctgcctggtggatgctggcagcacgcatttcctctgggctctatttttatttgctcttttgggctctcccagcactttaaaccagatagaatatacttactgattacagccggcgctcattctgagcacctgttagacactagcatatataacatcatcatgctgactctccacaagaatcctgggaaacaggaactatgattatatcctcttcacagatgaggaaactgaggctcagagggaaattgtcacttggccagtgagtagtggaactaggacttaatcctggggtcaactaatccagaacttcaggaaaaccggtgcagcccgtgccactagaccagggaaactgaccctaattaggggtgaataggaagttggcaagtcagtaggttcaggctggaagctgttgcttccttggcacccttagaactcccagccagactgcctatcccagctgctggaagtcagcaggggagggagaaagtggccagtctctcagaccagccacgtgctctttctccactccagttgcctgtcctaggctccaccccacacatggttctgctcagcacagcctgaaccaaagtgcctctacttctccccaagagtccctctctctagcccggaggcatggtccgcaagggtccctccatgatccaatagatttgtgcagactctcactggcagcagctccctgttggctccacttcaaagcaggggcggccgggcacctccaggtgtcagaagcagctggcacgttagcagaaggcctctggcaggaaggggtgttgagccaactgccagcaactggaaaacagcacatggggatgacctcgtctccaagaagattctttcccgagccctctgggagtggcaatgagcttgagttcagaaggaaggagctgtctgtggggatagaagggttgcaggcaaaggcaaagaggcaaagacagaccaggagcttcctgcttgccttttcccatagttctgctgagattccaaagcaagatgcagatgcccacagccagaaagatcccataggtgggttaaagacacagatgcctagaactttcatggtctcagcattcatttggagacagacagcacagcatatgatgtgattaaaagcacctttcagtaagtcttctgcagccatagacctctgaacatcaaactgtccccccactagatttaacactaacaggaggagctgttagttctgtccacccttgggacaacactgtcagagctggaagaagccctttgggaagtatgagccttcaaacttctgcttgaacatttctggcaatacacatctcattcctttacaaatcagccacaatcctagaactaagcagcttgaaaatgtctctagagccaaactctagatccccgtggcatctccccaagaggcagtcctttgagagttgggtctcagccttcacttcctccctagtcttcacttctaagcaaaagatctaaatgcagccatttatccagtatcctggtttttagactgtccatcagcctgaccctcttctccaggactctagtttactccccttaaacggactgtccagacctgaaggtagtagtatttgaatgacagctcttttgctcctagcttgtaaccttcgccaagtttcttaatccctctgaatgtctgcattctccataaagattgtaagtatctttatgagagggattaagaaactgctccaggtgccacctggccagaggaaaaggggaccgtggcttctctcactcatttgttcatgcatttcttcattcaacagacgttgactgagtgcctactatgtgccagacaccataccagagtcaagccacaagcagggagacagaggtgtcacttggtagatcttatgttcccaggacaaagacaacagtgtgaggaggtttccgagaactgcagaagccagtagcaggggggcctattctaggctgggttagaaaaggtgctttcctctttcatcttccccaagagatgctgtggaggcttcagcctgaagaatatggagatatccggtaggtgaggaggaggcatggagggcagggagcatcatgggtagaagggacagggagcattatggctagagggacagacttgtctggagggcatgagtaaggacagcttcagggaggatggaaggactagtgtggccagaatgcagtgggggagtcgagggaggcagggggcagatggagcgggctcacaggccagatccaaatgggggaacgtgtcctaagggcaatgggaagactgtgaaggtttttttttttttttttttttgacatggagtcttgctctgtcatccaggctggagtgcagtggcacaagcttggctcactgacatggccacctcccaggttcaagcgattctccagcctcagcctcttgagtagctgggattacaggcatgagccactgtgcccggcctctgtgaagggtttccaacacaatggtaaaatggtcacattcacattttaggaaaatctttctgcccacaggatggatactcaattagaagaaggctcacgcctgtaatcccaacactttgggaggcctaggtgggcagctcatgaggtcaagagatcaagaccatcctggccaacatggtgaaaccccgtctctactaaaatacaaaaattagctggacatgctggcgcacgcctgtagtcccagtactactcgggaggctgaggcaggagaatcgcttgaacctagggggcggaggttgcagtgagccactgcacttcagcctggtgacagagtgagactccatctcaaaaaaaaaaaagcaagaggagtagttgcagggaaactgggtaggaggtcatgccatcatcaagaaaagagaggtgaaggctgggggtaggatggtggctgtggacgtggaaagaagtagatggattcaagagaaatttcagcaatagcattgataggacttggtgactggttgattggcttggagcagagggtggcggggggaagtttccaggatgtctagtatgcccagcgtttctggttgaggagagtcatagccggtgttgctgttaacacaagctcggatccatttggctttttaaaaggtagccagtcttacttcttgcagttgaaaaaaaaccctcagtcctttatacatgtgctgctgggatccagccacatgtcccccagaaagaaagccctcgcctctgtctgcacccgcttcactcgccccctactccctcctgctcggcatatgtttcagctccccagtctctgagactcagactcttcacctgtagaatggaaataacaataagacccacccgtaggactgttgtagaataaaatttaattaatgtagtcaaatgccttaatagcctgccatgaggtagggtactcaggaaagatacctgcctctataggcggatcacttgaggtcaagagttcgagaccagcctggccaacatggtgaaaccctgtctctactaaaaatacaaaaattagccgggcatggtgacaggcacctgtaatcccagctgctagggaggctgaggcaggagaatcacctgaacctaggaggcggaggttgcagtgagccgatctgcaccactgcactccagcctgggcaacagagcaagactcaaaaaaaaaaaaaatgcctctattgttacccgtattaagggcacctgcagggctgccctgctctgacggacactcctaccctcccacggtgtgcgccccctcttctgcaacggcccatctccaaagggactgctgatgtttgaggtcaagatggcccctagcagaaagctgcagaccacttctgaggctggaagggtgtgccctgtttatagcttctagtcccatctgtggctgaaagaggaagatgctagtggcactcagcattaaggcttccgcgaggctgcgaggcaggggtagccctttgggaagtacgagctcaagcttctgctccgaggcaggctctggaatgggcctattggtgagaattgcaaatggaggtaacttctgtaattagacagtggtgatggtggcgctactttgtgaatatactaaaaaactgaattgtacgcttttaaagggtgacttttatggtgtgtcattatatcacaatgtaaataaatagcaagtggaagttgctgctatgggagtgctgtgttccaactgatgatcaacagaagccatggaacacggggaaagccttgggctccctggtggtttcctgcttggggatattcacagcccagtgctgttctgtcgtaattcactttagactattggggctccagctgtcctgagaacagggcagtaaaggaaagtcagtggcttctcatgtccagagcctttgcctgccctgctgagcctgccaaggaaaagctttgaggtgctggtggcccttgctccctgagcgctcccgggggagctcactcttcctctgcagtttggaggtctttgctaaccccagtcctctctagctgcccgctctctgctgtctccctgctccctcaatccagatgtcaaaacagattctgccatctgggtggggagggagctgttctgctgcctgggttttccttgggttatgagatggggtaaccacttggcctttggcactgcacttagtcctgtgaactactgacagagggaccagggcaccctcttgtggccctcagcggcactgcttcttcccgccctccagccttgaatttcttccagctggaattctagtgttgaactctggtggtggaggcagctgtcgttctccccaggagatgcctaacatatcagtaacaagaaagaaaataaatcagccacagaaactaggaggtaaaatgttagtgtttttgctctgcagctttattttcaaagaggcagtgtgctctcatggaagatgtgtggcctgtggagtccagcaagctccccagctgtgtgtgtgactttggcaggctgacctctgagcctcagactcttcacgtgtagaatggaaataataagacccacctgtaggattgttgtgggataaaatttaacgaatgcagttaaatacctcaatagcctgccacgcagtagggcactcaggaaatggcacctgcttctattgttatctgtattacaataaagactaggcaggaaccactgtctctcttcaggaagatcgcagcaaagggagtggcaccacaatatcgtagtctctgtgaagccctttccccagcagtgagcaatcctggctttctctggggctgatccagttgccagtctgggaaacctctgactcagggaagtggagagagatttagaaaaatatgagagagcaaaagaaaactttttttgttttttttttgacagggtctctctctgtctcacgggctggagtgcagtggtgtgatctccgctcactgcaacctccgcctcccaggttcaagcgcttctcctgcttcagcctcctgagtagctgggactacaggtgcccaccatgcccagctaatttttctatttttagtagaagtggggtttcaccatgttggccaggctggtctcgaactcctgacctcaaatgattcacccatctcggcctcccaaagtgctgggattacaggcatgagccaccgcgcctggccaaaaacaactgaaaaaagaaaaaaagaaagataaagccagaaggacctgatcagaaacagattgggggcccgccccaccccatctgatagcttggcgcctgcctggcatgtgatggagcccagcaaacgctcgtttccttctcttcttgtcctggctcagatgaggtgctgagcagaggatgaacatagccttggtcggatccctttatgagtcagacggttttcttcctgtgaggtgggtcctcagtgggagggactagagacaggaaaaccgttgggtgggcaacctgtgaacatggatgcaaggaggagcagggcggcagcacaagatgagtgtgggttttgaccctcacaagtgcagattccccaatagctctttgccctctccccttgtctgccatctgtgccccagggtggcggtgtctgtcgctgttctggccctttggtagcttattaaatctcagtaccacttgccaagaccctttaaaccccttagctgttctttttgccttttctgatcagctgtatttattctgaactaaatggtcctcacggcagaatgaaaggatttactgcttaagtatatgaaaagaaaccttggctgcattacagttgcaccctctcctcgccaccccctgcccatgctccatccgctagctggtgccactgagactgaaccgggagcccgctctgggtacagtgtggtcagttcagtttggtggcagagtccaattgatggagcagtgaggtgactgggaggagcttgcttttgggagccctctcctaaatgtcctgctgccccaggggagactggcggcccaggaacagctctctctctccctctcccccgcacttttcccttcctccctctccctctctccctcccctccttaaacctctcccccattctctctctcagattctctctttccccttcaggattgtgctcatggacgatgccatggactgcttgatgtctttttcagatttcctctttgccttccagatccagttttactactcaggtgagtgttccggggctccatctggctccgcacaggaccctgtctccctgtcctgccctgctgccctgcccatctgtgtgcctggcacacacgtttctcttccccacttcctttgggggtgtgcttcactgcgggtcgctaacaggatgtctagtgttcagtggtggtcacaagattcagtctgcagagccgacttcctcagcctcctgaagacactgaacaccgcagtgttttcagtcagcaacgcaacaaatcagtttaagtgataatgacaataacaacatccatagcatccacagcattcactgcttactgaaaacttactatgtcccaggcacagcactgactttaatcttgacaacagccttgagagagagtcctttcagagacaagctcacagaagtagtagccagtcatgcagctcataagtggtggagaccagacctgaaggctgactccaaagccagcgttcccaacctcgctgctattttactgccttcaagggtctctcccttggcaactgatcgtgcgtttgggtgcacattctcctccaccccacagctttaaaaaagcatacaccagtcctttgtcacactcccactctgctccccaattcacacagctgcacccttaagtctctctggaatcagatggaataaatatagacaaataaatataaatatacaccagctcacgcacagagacatcaaatggagtgccgggtttacaaattgctgactgtgttcataaacaaacttgcttaaaacaggctcttccagtaaatagaaggctgtccttagatcctagaggtggccttcctgccaactggtgtccccagccagccctggcctcatttgggcgccacattctgtttacttgatggcagcccaagggctgtacagttaggggctggagcctggggtctcgccacctgctcttagcagcaccagtcatttcccatttctctgaagctcttgggccctagagaaggagcagccatgtctgggagaacatttttccctcactgtctccccagccctcttctcacagcacccccagagggatgggacagccaccacattgggctgggagcattactgacactgcccagcggtgtgtgtagagacgagatgggccataagtcagcagttctaacaatggctcaactacgaaatttgaaaaccatttcaaatgactgactcatcagcagctttcaggctttctctgttcctcgctggtattccaacacgctttcttgaggtagagaggcaggtggccacacaccatggggcttaccagtgggagcatactcatgttcactcctccaaaaaatatttatggccttaatatgtgccaagcacagtgctaggcaggagaggccaacaaggcatgaccccgcctttgtgcattccagcaaggagacagattagacaattaatgacacagaaagctcctcactggctaagtgccagaaaaaaaaaagcctatggtgctatgaaagtgtgcaatggcaggtctcacctggtccaggaacaactgagccaaggatgggacatttgagcaaaaacacagattagtgtcatctctcatcaatgtgttgtcaaacaaggttgagaacttctgctctcaggacaccatgccctgagcactgaggctggtgtggaactgggctgacagagaagggaagacatagtgaacagacaaaacatgtcctccctgcctgagccgtccacacccacacccccacccccacggttccagaattcctggacagtgtggctgccatctatgaggacctgctgtcaggcaagaaccccaacacagtgattgtgccgacgtcgtccagtgggcagcaccgccaacgacctgccttgggcggggccggcacgctggagggcgtggaggcgtcgctgttctaccagtgtctggaaaacctgtgtgatcggcacaagtacaggtgaggaacgggcatgcagcccccagccccccagccccagggggtcggactgctggctgcggaacagagctccgcaggatgttctgcgcggcccaggcattctagggcccttgctggtcataatgtaacagtgccatttgcccccaaaccagttgttgactgaaaggctctcaattagctcacttcaaaaggactgctttcactcaggcaagaccactgtagttgaccaatttactgggtgacagactggccttaacattttagagagaaggaaagagtactccttgtataaaacttttctacacaaagagaggggtaagctgtcctgtgtggcacaagtacccttagggactgagcaacaggtttggtttcccgtagccatttcccacccccactccccaccccggtgaaagcaccagttagtgaacatgccagcccctcctgaccatagtgaaggcctgatcccccagggccttggggctcccaaggcaggtccctggcttggctgtgggtatcctcatgaacctgaaagtatggatgcagaggtggccctgaggctggctaggctctgaatgtggcatctctccttcttagctgcccacccccagcacttgtcaaagaggccctcagcaatgttcagagactgaccttctatggattcctcatggctctctcaaagcaccgtggaatcaaccaagccctcggtaagtcagagctaagcagccgtcagcctctcctgccgcacaacacagggagcagctggcctctgttagcaacacggctccagaggggaaggggcatcaccatctctgccttgacttcccagggccggactcaatcccagggagcaggaatatggcgacaaaacatggctcttacacattcccatggtaggggacagccctccctgcctgcagccctgccccaacatgaaaccacctccccatagcagaagcgcccagcccctcctcagagaaccccagctctgctttggggagcagcctgcaggtcgggcagacacaggactatttactcagtgacgctagagattatatatcaaagagacctgaatcccatttataaacaaggcacaggtgtgtctgcggagaccttttttccaagctgaaaaaaaaaatctgattaatctgaaagggagaaaaacaaaagtaggggaagtctgcagtggcccagtttttcctgcctgctgttttttttcactgagccttctccacccaccccactgttcctcctcccacagccactgctctcctaagagaagagccagtaagcctccattctactacagtttaaggttttttgttttttgttttattttgggacagagtctcgctctgttgcccaggctggagtgctgtgtacaatctcagctcactgcagcctcgacctcccgggctcaagtgatgctctcacctcagcctccctagtagctgggactacaggcatgcgccaccatcctggaaaatttttgtgttttttgtacagactgggtttcaccatgttgcccaggctggtttcaaactcctgggctcaagggatcccctcaccttgctctcccaaagtactgggattacagttgtgagccactacgcccagcaaggagttcttttttgtgtctcgagagatcctcctgctgtgcttgggatcccaggtgcctgagtctcaaggaaaagacacacagcatcccccttccttttgccagttgagggaatgggattaagggaaggaaagttaacattcactaaatgccaaccacagcaggctaagtactgtgctggatgctttatattttttatcttacacaatatacagttagccagggatgctctgggatacacaagcacaaaccccagcaggctgaactgcatgccacccacagcctggttattctgagtcagtgcttggggcatgcacaggtctggggagccctcaactgaagttggtagccaaggttacccactggactaagactagaaaggaggcaattgacaggccaggcgtggtgcctcacgcctgtaatcccagcactttgggaggctgaggcaggtggatcacctaaggtcaggagttcaagaccagcctgaccaacatggtgaaaccccatcactactgaaaatacaaaaattagctgggtatagtggcccgcacctgtaatcccagctactcgggaggctgaggcatgagaatcggttgagcccagaaggcggaggttgcggtgagccgagatcacgccattgcacgccagcctgtgcgacagagcaagacagtctcaaaaaagaaaaaaaaaacaaaaacaggcgagagtcaggaatcaagagtaagggggaggcgggtgggatctgccctggtgttctttcatactcctcgttatgaccactctttcttcccaccagtagcagccactaggaaggagaagccaattagcaactgggtcacagcctgaagtaacctcatcccccttttctaagggcctttaaaaaggacactggctgggtgtggtggctcacgcctgtaatcccaacactttgggaggccgaggcggcggatcacctgaggtcaggagttcgagaccagcctggccaacatggagaaaccccgtctctactgaaaatacaaaattagccagttgtggtggcacatgcctgtaattcctgctactggggaggctgagacagaagaatcacttgaaccagggaggcggaggttgcagtgagccaagatcgcatcattgcatttcagcctggacaacaagagcgaaactccatcaaataaataaacactaatagccagacatggtggctccacctgtaatcccagcatttggggaggctaaagcaagaggattgcttgagcccaggagttaatgaccagcctgggcaatatagggagaaccccgtctctttagaaaaaaaacaaaaattagctgggtgtggtggcatgtaccattggtctcagctacgcaggaggctgaggtgggaagatcgcttgggcatgggaggtcgaggctgcagtgagccatgatcactgcactccagcctgggtgacaaagcaaaactctgtctcaaaaaaaaaaaaaaaaaaaaagtcactctcattcaaccacttttactgcacactaacattgggtggttggatggaatgggagacagaaagaagcatgtggtctcaggcctcacctgcatctccagcgtatgaaatagaaatccggagatacactggttgacgcgtcacggaggtcagccctgttcccttagtccccagggcaccccacaaatgagagggttctatgagatgtactttgaaaaccactaacttagggcaagaggggccaggaggcatcatctgaaaaagatttggaaaaaggggaaatctgcctgtgccgggttaattctggccctgacccagccttctcctcttgcccctgggatcctccttggagaagcagaggcagcattttttttttaaccatctgtctccaaagtggggtcatcctgatttagggacacaaaattaggtaatgtctgacctttgggcttagcctggaccatatccttttcagcccagtacctgaggcctcaagaaggaactcaactcccagcaccaggtcacaaccaccacctggtgttggaaggggatcaccacactccttggctgtggtgtctgccccaggcagggaaagtaggcagtgggattcaataaatgtatcaagcaacagcgagcaccttcctgctccgtgactgttcttggcccctctagcagtcctcagatctttagatcggccctcgcagggtcagcagaacaggcagccgtgaaggtgaggggcatggaggaatctgttgcctggctgaagggccctcagattaactactgtgcccccaatgatctcctaggagctttgcctgacaagggggatctgatgcacgacccagcaatggatgaagagctggaacggctgtaagtgtcaagtgggaggatactgcccccttgtgggggccagacgggtcggacacggctgtgccccatctggggccaacaccacttgtctgtaacatcccacatctgccagggaagggtctgggggccagtggaggcctgaggtgtccctccctctgagtcctttgggggctgcagcccaggggtttaccctagtgttaagagtgggcatggaggccctgctctctgtacaggaggcctctcgctgccctccaggcttcttcccttcttcaggctggcccaggtcccaggcctggtcaactcggtcacagccagtccagaggccagttgcctgccttcccggacccctccccgggttggctctccctggagacctctccatcattcccgaaaagtggatggagagagtgatggctccactgaagagacagacgagtcggagacttgaggagtccaaagggtcctgcccacagcgccctgtacctgctcccacccagcccttggtgtgcccacccagcctcctctccagcaccttgctgtgctgccctctgctgctgacaaggtgaataacagccccaagaccagccagaggggctctgatgatcagcccagccagtggccccggaaggtgaatggcctgctctccctggccctatcagcctgtgaacttcacttaggccccaagctgacagactgtgctgaggccaccttgtcacgccgtagcctgttagtcctcctaacctcttaagagcagtctcttctgagccagcctctgcgggtcccccaataaggttcatctcctcacagcaactccattaagggggagaacccgaatagccacgcagggccttgcaccatcaagggtgacacctgcgacgcaagtaccaggaggacataaccgctgtggcctgttggagaacagccagtagccttggtaatatgaagggtgggccagaagatgatttcacttgcaaaaactgcttcaagtcttgacccctttgtgtctaatagctaaacaaacatgtgaaacgaataaaaagtccctcatgtctggtaactggtgagtctaaagctcctaggctgaggggagaagggagagggggagtttgggttttcggtgcttttctggtaggactaggaggtaggccagtggcccactcagacctggggacctgcctcagacaacgagcagaggggcctagcttcgcacaagagcaaccttccagaggaaaagtgctcacagctggaacggccttcaggaaacaggttcagagggttcaaggccaggttcccataactttaaagaccgtggccataaagggttaatactgcacagccttccagccagggtttcagtcaacatttgccaagcacctgcttggggttagaacagtgggatgcagctgtgaaagacagacagacacagcctggggcagacacatcccagccaagactggaggcaggtaaggacgagtgtcttcaacttctttggattgagggctgaaggggcggggtcccccagaaagcaaaacccacccagaagcccaagcagaacaggactgcctcctctgaaggtggatgtcaccactactaggcatacacatttccttgggctcatccctacccagaacggatcattacaggaactgcctcccaaacccctgcagagctgaggccaagactaggcattccagccccgaagctgctccaggatgcagtggctcattgcctgtaatcccagcactttgggaggccaaggtgggccaactgcttgagcccaggagttcaggaccaccctgggaaacatagtaggaccctatctctacaaaataaccttagccaggcatggtagcttgcacctgtagtcccagctacttgggagacccgaggtagatcacttgaacccaggaggttgaggctgcagtgagccatgatcgtgccactgcactcccgtctgagtgactgacagaatgagaccatcttaaaaaaaaaaaaaaaaaaaagctcaggctgcgtgatgagctctgtaggcccacaatgatgcacagcccataagagacatggttctcaaatcctggtgtcctcagaatcacaggaaagcctactgacgatgcaaattaccaagctccagagagtctaactctatcaacttgggatggagtccagaaattccagatgatcccaaagctgaatgagtcccaaacctacactctgcaaatccctggcttacagccccctggctccctctgcccatcctttctaatcatccacttcccagaccagtggtctgtaactaccgtgaggactcctaaggtggcacagagatgtttcagaagcccccaagagaaaggggtggccaagctaaggatttacacacaaacacacaccttttcttccctaaatttaaagggtcccattaacgtctaagagtatgtgtgtgtatgtatatatatgtaattttttcttttttgagacagggtctcactttatcacccaagctggggtgcagtggcgcgatctagtctcactgcaacctctgcctcccgggttcaagtgacttctgcttcagcctcctgagtagctaggattacaggcatgcaccacaccgcccccaccccgctaattttgtatttttagtagaaatggggtctcaccatgttggccaggctggtttcaaactcctagcctcaagtgatccacccgcctcagcctcccaaagtgctgggatgacagccatgagccactgtacccggcgttaaatatttcttaaactccactgaaacccatccccagtcaagcctactgccgtgacaaggggcaggactgctgaggttgctcgctcgccctcagccagcgagttaaagggccaactaatgccagctctttcctctgcgtgccacagggtggtgaggtcgaagctgcaccggacctcacggcagcacagagccaaggagccaggggcctttggctttcagagaagagagaagcaggaggccctggagagagtgtcctcagcttcggtaccgacgccctaccattaccggtgggagcccagagagtgaggccaggggccggcactgggcagggaggcaggatccagaggacactgcttcactcagaccaacagggagccaggccctgcaggggctttattttgacaccactttgtttcaatacaaacagtccagaa

SEQ ID NO: 818 - DNA, 12829 bp, Homo sapiens
ctgcttcactcagaccaacagggagccaggccctgcaggggctttattttgacaccactttgtttcaatacaaacagtccagaaagaaagtcaagtccctctgggggaggggcaaggggaagagtggtctgtgttgcttgggagcccaacctacaacccaaaggtgggggctgggctgagactgccggtgcggcaggggaagatggcaccaagaatgacagtgcttggctcagctgccagagggtgaggcccacagctctcactggcgggtgctgtccaggccaagcccagaatgatgcagaggaaggagctcagccccaggagcctgcctctgcctctcacatcctctgcttccctggccagcatcaagctcacagcatccagagtcgaatcacagcagacaagaccctccatggccaccaacccggggaagaagggataaagaatgtcacagagggtcctgcattccacagcagatggtacagagggaccctgagacaccctgaaacaatcttccaagtgcttactgtagaaaggggtggtgagacgggagaacccaagggtctccggtctgatcccaaatgaaacctttaggtaccaggtaaagtttccagcccttggtaacgcccagacaaaggtccttcccctctcctggcacccagaagaggccactggcagcagcagcagcagcaagtccgcagcctctttccccatgggacgggtctacagtgaactccttccaggcctccccctggttccagaggatggggacccaaggcctcgaactagaagaaccctagagccagcaaaaaaagccttctaccttccgctttccctacctggggaaagtctggacccagaataagccatcgtgggggaaccccctttcccagtatggcaggataagtgagcagcagctgtgggggcaggacagaaggacaagagtctaacacacggagggtggtgtgagagggaataaagggctcagtccacaggcagaggacaagggctggtactgaccattcccctcacaggagtgagcgcctcaaaggccaccccacacacacaccacacatacgaagtaacaaatcctccccagcttccacaaggcaaagcatccccagcctgggaactgtggagttcttgttgccgtcaccatcgtaagcctgagtcacagagctcggatcagtaggaaccgtagcgatcctgggggcgaggggggagaaaaaaaaaaaaaaagtcagaggctctaagctgcagcagcttcccagcaaacacactgcctgccccagcaccccacagcaagactggggaggcaggggctggacagcccggtgaggcaggagtccacggtgagagctggggcagcggccactcgggcacccgacaacagggaagccctgcctggcctcacagaagctgggaagagaagagaaagagcggtacaggtgacaaggccagggaagatcatggcagacacagaggcatcttggagaggcccggccctggcacggagctgaaaggaaggaagctgccctccaagaaaatgcctctctctagactcttgctttttcgtttgtggttttttttttgagacaagagtttcactcctgtcacccagactggagtgcagtggcatgatctcagctcactacaacctccaggttcaagcgattctcctgcctcagcatcccgagtagcgggattacaggtgcacgccatcatgcccagctaattttgtatttttagtagagacggggttttgccatgttggtcaggctggtctcaaactcctgacctcaagtgatccacccatctcagcctcccagtgctgggattacaggcgtgagccaccacacccggccgaaaatgctcttaaggctcagaggggctgagcagtagcagtgtctctatgtggtggcgaagggcaaacctcccagcactcctcattaggccccacttcagcctcacctgcaaggaattcatcacaccattggccagcacagccattttcccagccacagacttgacaccctgcttaaactgggcaatgtccgctgtaggcagcacgttccccagagatacacttcctgtaaaacaagagcagggtgacccagagcccagcaagaagcccttcccagtcacagcagggccctcccgccctgctcccaggcctcacttggtgcctgccaccccaccagggccctacctgctccgtgagctccatccatgtccccaaagaggtctgaagagctgatggcactgctgcctgagagctgctgcagccgagacctggcctcatactgtggtgaggaaaaggccaggcctggggatcttggggctgatgacccaaggactcacacaggccaggccctcctggtgctaaagcccaaagcagcggcagggagaaagctcatgcttctgcctgctgcctcggacctcagggcagacagccccacttacctctgcatccacctcccgcccaaagaacatgtcagatgagatggctttggctcctgcgaatttctgacgcgcctcactagactcgaggcctgagctccggctctccacttccctccggtttgtggctctgaggggaagatgtggaatatctcggactcctcccattatcatcaggggaggcagagtacagaggccaaacagagcaccagtggccttttggtgatgggttaccaggtcccattctgtctgtggctctgtggctctgggcccctctcccctggtgaggagtcacccttctccacattgaggccaaggcccagagagcttaggaacctgcactaggcagggtggaaatacagcctgcagtggcctaggctcctgcccaaaagcacacagcttcgtcagcattcaggaggccacacaactgctgctaccctaatcctagtgacaacttgcctagtactacaatgagcatatgtgtcggtctgcctggctttatacctactcttgtcataactatgaatagcaaactgccccctttactctcaaaagcatcctggtgtggaaagggagatggttgctctcatctcacgctgagtatgtggacactgggccaggtatttccggagaccctatgaagtagttacgttcccattttatacggggataactcacagatattatgtcaactaaacagatcccagattaagatggagtagggttttaaaaaataagaagggggctggagacataaaacccctgaaaggaggtcaggactgaagcatacaatcaggctcctccggccagagaaatggaccccaagcaaaagaagctgccaggccctctatgatgacaaagcacaactcaaaccgaagcctgactgctgccctgtctaatgaggcaggcaccagccactggtggctatttacgtttatcagaaattaaactacatcagaaattgttgctcagttgcaccaaccacattttaagggctcatagccacatagtagtggctaccatattaaacaacacagagaacattcccatcaacacagaaagttcttctagacagtgctgccttagaattctctaccttcagcttgtttaaaaaaaaaaaagaaagaaaaaagaaaaaacagcccactctacctttctgaaataggccggatgcttgagatggtcacttctggctccttctcctctaccctgtccataccccaggcagcatctgtatcccagcgggagccaaagctttcccctaaggaaaagggattgtccttgtacctagggagacagtagagtggctcagagaagcctgatgaggaacacagcagccaagtttacagctagaaaacagccttactttgggggtccagaggcgaaagtaccaacatcgtcaaacaagtccagctgcgagcgagaggattttgcactcactggggtttcctgctcaatcacctgcatctcagacagcacggagtgggagacagagctgcgcagcaaagcagagccaggcatgagaccaaaggataggcatcagcatcaccgcacaagagacaatgcccagcaactgggttctccttcacggagcgtcacccagagccttctgtccttacccaagcacagggctgggccagaccccaacagaaggctagctgtgtgtggtgacctgtgaagcacacctcagaattctttacacatcagctttgtttattccacgtaggagttccctggccagtgacggtttgcctgttataatttaattttatttatttatttgagacagattctcactctgtcgcccaggctggagtccagtggtgcaatcttggctcactgcaaccaccacctcccaggttcaagcgattcttgtgcctcagcctcccgagcagctgggactacagtgcacgtcaccacacccagctgattttttgtgttttttcagtagagacagggtttcgccacattgcccagcctggtctcaaactcctgagtacagacaatccacccgccttggcctccaaaagtgccaggattataggcgtgagccactgtgcctggctcgtgttgtaattttaatattgtgcaccagatgccagtggtctctgtcctgaacaactccctaccttgtgcactatgaaccccatccttcactgatggggttcacaaagcaaaggaatggatgaagaaatgccccagcaccagggaaatgaacataactgcatcaaagaatgagttcttcatcatcctactctttattaaaaaaaaaaaaagccaggcaccgtggctcacacctgtaattccagcactttgggaggccgaggcgggcagatcacgaggtcaggagatcgagaccatcctggctaacatggtgaaaccccgtctctactaaaaatacaaaaaaattagccgggcatggtggcaggtgcctgtagtcccagctacttgggaggctgaggcaggagaatgacgtgaacttggggggcggagcttgcagtgagccgagatcgcaccactgcactccagtctgggcaacagagcgaggctccgtctcagagagaaaaaaaaaagcacctcaaagcacaaagactggccttatgcactaagacctagaattgctgtctcgtttctcaaagaaaaggggtctagggttggcaggcaatacaatacaactcttgatgcctctcattcctctgtcaggctccacaaggacactttaaggactaatttgatttaaatcaattcattaaaaaatatctatagcttttagctagaagaaccccaaggagtgattattttgcaatagggctgagttgggccgggcatggtggctcacacctgtaatcccagcactttgggaggccgaggcagccggatcacctgaggtcgggagttcgagaccagcctgaccaagacggagaaaccctgtctctactaaaaatacaaaattagccaggtgtggaggctgaggcaagagaatagcttgaaccccggaggcggaggttgtggtgagctgagatcacaccattgcactccagcctaggcaacgagattgaaactctgtctcaaataaataaatagggtgagttgggtttaagtaaacaattgttgcactgctaaaaaactgttcatatgccttaaccccttggtcatcccttaacccagtcatctattaacccagtcattcctatgtgactgaagcagggaaaggagggagacccaatgtcctttcaagttaaaatgttatgctctggctggatgtggctcacgcccgtaatccaagcactgggcgccgtggctcacaccggtaatcccagtactgtgggaggccgaggcgggcagatcatttgaagctagtagttttacaccagcctgggcaacatggtgaaaccccatctctactaaaatacaaaaataagctgggcatggtggcacatgcctgtaatcacagcttctcaggaggctgaggcaggagaattgcttgaatctgggaggcggaggctgcagtgggctgagatcacaccactgaactccagcctgggtgacagagcaagactccatctcaaaaaaaaaaaaaaaaaaaagaaaagaaaagaaaaaagaaagccgggcaccgtggctcatgcctgtaatcccagcactttgggaggctgaggcaggtggatcacttgaggtcaagagttcgacatcagcctggccaacatggtgaaaccccatctctactaaaaatacaaaaaattagccagacacggtggtacacacctgtaatcccagctgcttgggaggctgagacaggagaatcacttgaacccaggaggtagagattgcagtgagccaagatcgtgccattgcactccagcctgggtgacagagtgagactttgtctcaaaaaataaaaataaaaagccatagcagccagacatggtggctcacatctgtaatcccagtactttgtgaagccaaggtacttaaacccaggaattcgagaccaggctggacaacatagcaaaaccctgtctctacaaaaagtaaaaaaattagctgggcatggtggctcccggctgtggtcccagctatttgggaggctgaagtggaaggatcacctgagcccaggaggcagaggttgcagtgagctgagatcacaccattacactccagcctaggcaacagagcaagaatctgtctcaaaagaaaaagaaagaaaaccacagcaaaccgagtggttctgaaacaggaaggattccacccaaactgagggcatttgaaatgtgggggatatgtgagggtattacagggagcacaaatggcatctctagacaggaattaaggatgatactaaatgcaccgcaattctcagggaggtctggaaaaataaactgtcccatgactcaaagtgccatcaagaaaaaccaccctagtctcttgaagatactgaaataacacctgatcctgtgttttgttcacatacctattcagtcattcaacttactgagcacatacctactatgcgccaagcactgtattagggactttagaacaataagccaagtgatctattcagacttggagaaacaataagcctagcatcccaaactgctaggaaggccccgcaatggttcccagaaaacaacggcatttccctgccacacccggagctgagcctcaccttcgggataccaagcccatgcccaacctttctgcctgctctcgcttcttcccttccagattctgtagcttcttttcctctttcttacgatcaatctggagctcctggtaggccagacgcatggaggcgacccttagggggaacaaaggtgtcagtggccaccacccatcctgacctgtccaacatacccacccaccaagccccgcagaagcctgaggccccggcagcaaacacttacatggactcctccgcctgcttcttggcatcggctgcctgctgctcacggagcttctctgccacctgagcctgccgctcaatctcactgaagctctggctgctcaccttctgggcccctaggcctttcttggcacccagctgggaacagaatcatgtaaggggccttcccaatcacactctcctcagatccctcccaggttcaggcactgtagccacacccacaaggaaaaggcccttcttaaaatttagggtaaaaaacaggagcccaaccagcatggccaagacaatagtgctccgctggagctgggcatgggcggctcacacagccccagcagagcccgggcctgaggacggcagttaatgctgacagggccaagtatgtgccaagcactccgccaagcactagatgtgctccatctcaccgactcctcccagcagcccttgaagacaggctttaaatccctttaaatctttaaatccctttcacaggcgaggttcggagaaacacagtacctttgccaaagtcatatagctggtaagtggtaaggtcaaggagtgaacccaggtagcctgcacccagctcctaacccctctaccataccacctctccccacctacccctttcttagctgctgctggcttcttcttgccaatgatggagcttttcagttctgcgtgagaaacgggtaggcatgagctaagacaaaggcagctcagaggcagtagctcagtatacaccatgcagcttcatggcaagagctcctaagaacagcttcaggcaagggaaggcaaagctgccaccaccagctccaaccagcggtgtcaaagccaaagacagacgtggctggggtatttactggcacccagcagagtgagacaggaacctagacctgaagcaccagagacgtccgaagcaccagagacgtccaaattccctgaaccaaaacaaagactgcgaggcagggagcatatggtgagcaccaggctccgcttctaaagcaggaagctgagaacaggggctgggctccccaagcagctgtcagttacctctggcaggaagggcccctttagctgacagatacacggactctggaggagaaacagacttgtggctaacaagaggcccaccccagagcctccacagagctcccaagcccagcggtctctatgaagccctgcttcagaccaagctatgccagccttctcatggatcagtctgacagtcactctgctgggttccagccccaacccccaagagtcaacagaacaaaccgaggtcagcaaatggactgttcgccctgaaccaagtctgaaagacactaaggaaaatgtaggaaagagttaaaggacaggctggggtactggctgagaaagaacaatgtcacctccagccttcggcagctcagagctgtccctccacccccggaaatgcaccagacaagccagccctgcctcagagcccagggataggtgtccagtctcatgctggcctccccaacactttggctagacccagccccacactcagaggcagaccccaggccttatacaccagcccacccagattcatcaattcaaagggcttggctctaaaatcagtgttgcatccactatttcaatcacagtccccactccagagaatcagatagatgctcagtctcctgtggcctctgtccacacggccaggcagtaggacctctgaaaagaacatttgaggtccaccctctcccagacaccccacgcctgcccgctggcatactgacccagtgaggctttgggtgaggtgccaagcaggtctgtgttggggccatgctccggctctgtggatgcaatggtaggagttagagatgagctcctagcttcctgcaacctccccttgaaagaagtgatgggacaagaatcggtggctttcctcagcttgccaccaaaagataaaaggaatatctaccacttcctccaaggattaaaatgaatcccggcccacccaaagatacaggaggacccctgctcctattgtcatggccagatgtccccttccaaaccctgagtcctctcctaggaccagggcacctggttggaatctgggctgaactcacgtgccaggccactgctctctgtagacggggctggctgctgggtccctgaaggctcagtggctggcgcatcccaggcagggggctgaaaaggaggccagatcacagatgcctcggtgagccactcctgctggcaagaagcaccaagacctacaagcaccttgtggacaagaaatcatactccaaacccatgaggaaagggactggagggtagcaaacaagatcacagttgctattcactgtggaagaaagcaggaagacaagcagcccccaccccaaccccttcactatttacttagagccagagcccattctcctaacttaaagacagttaactaccaccacctaggcaggcacagatctaaaggctcctcatatatgaatatatttaattatcactacaacccctatgaaggagctacatcgccattttagaaactgaggttttgacaggttgagtgacttggccaccatcacaggaatgcggagtagagaacaggaattgaagccaagagtctaacttcagcacccagggccagtaaagaggaaaccctcctcaaaggggtggggcggggaggagagaatcctttcactgtccccaagcacagtgcctttttttttttttttttttttttttttttttttttttttgagacggagtctcgctctgtcgcccaggccggactgcggactgcagtggcgcaatctcggctcactgcaagctccgcttcccgggttcacgccattctcctgcctcagcctcccaagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccactgcgcccggcccacagtgcctttcttataggggaagaatccaggaaaatttgtttggggcaccggacacctcttgaaacttcaagaagctgcctctcttccccgccagcccaatttataggagtcgatttctaaggagggctacactgcacctccatttatggaggaggaaacacctaggcctacccagcaggaacagtggacttcatacgtggtgtccaagacatcacatcaaagcaaatggaatctacaaccatgatcacagaaggcctgggccttggtaaattgcctgtcaagaacaactgggaaaacggttccttgtgggcactcacttgagtgtgttctgtgaagaaatcagagtccttcttctctggggagtgattaggaacggcactactcatgttgtctatccaaagctagaaaggagaagacacccctaaaacacagggctctgaatactcctaaccctcctgccccagccccaagaacaggcacttacatcagtgccatgcctagccagggccgcactccccagctgccggatcttctcccggtacatctgggcagctcggctattatatttggtgttggcatcattggctgtgcatccatgttggcgaaaaaaagccgtctggagagcaaagaagagagcagcgcgtgctacgggtgattctcaagaaggaaacgtgttggctgtaggagacatctccttatgacagcgaagttattatctatacaggatgatacacgctactgacaccggtttttcagagataaagtttctcgaaattcctgcaaaaaacaccttgcagcgggccatcctctgatatgactgaagtccaggccccactgaacgctgcctgagcacaacatcccatacccagcctccccatccttcatccagggcaggcccacaagacccaatgactgtgaaggctcccaactcctgtggcttttccccaagaacacctgcccagtttaattggaatctgaaacccatttaagagaagctgtgaccagtttcgaagttttcagaaaatagcttatggtggtgttatagaacagagaaccctctgaacagggaaaacgacagggcctcttagggagtcgtgcaaagttagtaaccaggcagaagaatggaaggtgagggaagtagaaggagctttaccgcattggcattcccgccgacctgcatacacctcagctggaaccagttccagttggaatccaactctgtggacctgtgtacaagggctgcgtctcacccactagcagataccagcaggatttccctggcaacccggatacctgtcacttggcctcaggctgctgtaggcacccaggaaacattaatcagccatcaccccatttcctccacactaccctgtccatgaaaactctcctcttcgttcatttactccaaagagtactaattatgtccccagatccgaaaggaggtcacattctcaggcacgcacgcctggatttggctttcccctaatggatggtcacagtctcactagagacatactggtctaacaacatatcagcaacaacaaggtcaatgcctccctttcccctcaactaacgctcagagtctcaagcctgaccgtcaaaaaagaggaagttttggcccagaggcggagacggaccgcccatgtgccaaagggcccacacaggtggttccctctggcaggaggctaccggaccctctcggcccagaggcttcccaccgaattcagagcggcccaagtcgaggcagccactctcccttgttgcccagacacccctggccggccgggtggaaacacggcaaccgcgcggagagcctacctgatgaagctcagatggacgcccagggagcggtgcaccccggaacagtcaatgcacaagaaaacaccgtacgtgatgctggcccaactcggattcttggcgccgcagtcgaaacaggcctgggtggaggcggcgatgagcgaatcgtcaggggccccgagtaaaggccaggcaccgacaccccagaaacataacccacctccgcccttctccctccctcaggccccagcgggacgagagactccgcgcgccccctgctcacgcaccttgttggttggaactgcgcgaagcctcttaaaaagagtctggatttcggtcttgttcggctccgccgccattttctctccttcccagacacaaccgcggctgacgggtcccgccgcgggccaatccacggcggggagggcgggctcaccaggccggcctcagcggtgcctgggccagccgaggggtggggtgattggagtccgatctggaccaatgggcagccggcgggacgggggcggcgacgacaaccgcggccgcaagaatcaacgccgcgccgggccaatccgcagccggggcggggcgacggcgcgcggaccggcccaaacctcctcgcgcgcgtagt

SEQ ID NO: 819 - DNA, 12829 bp, Homo sapiens; identical to SEQ ID NO: 818

SEQ ID NO: 820 - DNA, 8939 bp, Homo sapiens
gtggtgtttttgtttttgtgtgtgggtgtgtgtcaagttttaatacacgctagaacaagccacaagagggtgctgctaggccagaactacactcaccccaagcccaccccaggaaccccaaagcagaggtcaggaactgagtccacagctcctggggaggcccaggcacccctgaacgcttctgtcacctctgacctcccatcttgccctcagcctagactcgtcccttccctaccagtcccttccctagacaaaggcccctcccctccctgggtcccaggacttcctccctcaagggacagaggagcagccagagagcgacggttcagggccctgagggtccggctctccaggagaagctgggctctgaaccagggtgggtaaacgttgcagaagggctgtcaggacactcaggcgcccacacactccacgtagttggcagggtacaggccaatgcggccactctgcaactggccttggcaccagccctgctcgtcctcctcactcatcttcagcagctcctcccctgggggaaaggggattggtcactgccagtggccctggcccaggccctgttcctgcaactgggtcaaggactgagggggatggtgtggtcccagagcccagctagcaaagacatggctcaggcagaggcaggtcaaggtcagcaagctgccccaccccagaccctgaatgcagccaccaggcaccagctatctggacctggaacagctgaagggacagaggactggcccttaagaagtgggtatttggcttccctttctgacacccctgctcaggcagataaggcagaggctgaagctaggaaaggggtcccagggtacctgctcggaagctcagctcatcagcttcctggccagcgtagtcatagagtgccctcacccgaaccccggtggcagccttccggggactctcttcatctgaccactcctcatcctgccccgtgctggagaggggaggcaaagggagcagctcagagtgcaaggaacacggggctggagatctcacccaggatcagggcaaaggcctccctacccccagaggcacctgggagagtcaggtgaggtactaaagattctagctctacctcgccatgcccgactgtgagcaaagaggcaattcctgccacacgcagctgatttaaggcataaacgagagggaatgtgggaaatgcccagcaaatctaaaccactatgagaaccagtatcattacaactactaagtaggccctcaggtccctggcaccaattttcaacccatttcaggtgtgaaagaaatgaaaccaaggagaaaggaaaggagggcgggaggcagagctgtttctttgccacagccgcgctcctggctctcaccctggggaccccggggactggggtgggggtgcggtgccatctcttgtaggcacaatgctggtcagggtaacctcatcagggctccggccacccttctctttccggctgattgtcctctgtgtgtccaaggaccactcctgtggggacagtgcttatagtcaggtggggccatctgaaccaccttcacttacttcatccctagccctggccgagctgagtgggagcccatcccacctcccatccccaccccgcctggaacacatgcctcgaactgtggccagttcatggccatgcctggcccgtgggtgctgcgccaccagcgcagatcctcttcgtcactggctgcctcaatgccctggtgcaagtcacggtggagttcatggaacctatgacccaaggcacacccctcagtctaggaagtctagaccctgcatccctcagtcccagccagggcctcggggagatggaggagacccagtactaccccagatctccatgcccaccaggcagttcatacttctcactgctggaaaggtccaggtgctggtgtaaggtgagcagcatatccttgaagaaaagaagccgctggcgctcggcggcctggcaggtctcaaaggcctgttccatgtcctccatgtagcgtggagtgtagcgatgcagctctgccagcgtctgctcatactgagcttttgtctgggtgggagaggaggggcctggtgagaaccagaccttcttccacccaggactccaccagtgtttaccagacactgccataggctgctagacccagggctagccactaggggcaatcagtcccaagacccagctcctgccctcaaggaccccagcagcctaacaagggaggtgacatcaggcacagcatataaaagagtctggtgaggattgaaatgaggtcaacctacaggaaaggatgggagaaatcagaaaaggcttcctggaggaggtggaaactgcagcatctcaggatggggaggatttgcatatccagagctgcaggaaaggacacttcgggcaaagggtactgtgcaaggaaaagagctggaagttctcaactgctgaagtcatcccagtgcctgaaactccatttctttccctagtaaagcatcaccttttgtcaggttcctcctttaaatgatcatctggagagagggtggcaggtgaggaatagggtaataagggtgctggggactggacaagatgttcagggagcaagattcattcaggaagccgtgccctgggcgggggccagggctgggacctgtggcctgtaccttctcggcctccttggcacagcgttccacccgttcctgcagtttgcgcagctgctcctgggagacggcgctgtctgcctttgcgtggctctccctcgtctgggcggtcttctcatccttccgggctgcgtggtagcttttcttggaagcctcaacctggcatgcatggagaccactctggaccctggatgccacaccttggccccctcgatcccttgcaaacaaacaggaaggagcctgtctcggatacctcccccacccagcctcacctccttcagcctcttcagccagggcttctgggccttgcggaagccgtcctcggccgcccggctctcgcggaagccgcccagcacaggccggtggaaagccccccgctgccaggcgcgcacccgctcactgtcctgcccttgcagcttctcccgcacctccaggtgcagcgcgctcagccgctcagccgccgtgaaaaaggcatgccaggccttctccagtgtgccatactgggggcctgcagggagggacagggcttaggccaggcctgggtaccacccaaaatgagcctagcccctctcactgggtgtgaggcatggaggcatggggtacgcgcatggggtgcaaaggtgaatgacaaccctgtcagctgggcttattgaatgaggaccatgtgccttatctcactgactccttgtctcagccaccatcgtgaggacagcgacattgccaacattgaacaggcaaaacactgaggaccagagatgtgaactcgcccaaagcattatggctacaacaggagctgagggccgggcacagtggctcactcctgtaatcccagcactttgggaggccaaggcgggtggatcacaaggtcaggagatcgagaccatcctggctaacacggtgaaaccctgtctctactaaaactacaaaaaattagccgggcatggtggcgggcgcctgtagtcccagctacttgggaggctgagacaggaaaatcacttgaacccgagagggggagactgcagtgagctgagatcacgccgctgtactccagcctaggtgacagagcgagactctatctcaaaaaaaaagaaaaaaaagaggagctgagattcaaacccatctctgttgtgtaaacactacactccattgcctcaaaggaagagcctgtgtgtgccctcgaggaagacagcttgcagggtggaaagatccatgctcccagtcagagggcctgggctcaaccttcagcacttcctagctgtgtgcctttaggcaagtcccttagcctctctgagcttccagtttctcctctagaaaatgcataaaacaggcccaggtgcggtggctcatgcctgtaatccaggccgggcacggtggctcacgcctgtaatctcagcactttgggaggccaaggagaaaggaccgctagagcccaggggttcaaaaccagtctgagcaacatagcaaaaccctatctctacaaaaaatacaaaaattagccaagtgtggtggtccatgcctgtgatcccagctattgtggtcccagctattcaggaggctgaggtgggaggatcagttgagcgtgggagagggagaggttgcagtgatccatgattgtaccactgcactccagcctggtgacagagtgagaccctgtctcaaaataaataaataataaacaaaggaaagaaggccagatgcagtggctcacgcctgtaatcccagcacttggggaggctgaggtgggtggattacctgaggtcaggagtttgagaccagcctggccaacatggtaaaaccccgtctttactaaaaatacaaaattagccaggcgtggtggtgggtgcctgtaatcccagctacttgggaggctgaagcaggagaaccacttgagaggcggaggttgcagtgagccaacatcatgtcactgcactccagcatgggcaacaagtgcaaaacgtctcaaaaaaaaaaaaaaaagaaaggaaagaaaatgggtaaaacaaccatctccacagggttgttgcaactatcaaagtaactcatgagcatcctttataaactttaataacaccacagccatgaggatgaccaggaggatcttccctttctaagggagggtagacgtggaggcctcaaacttcccacgagacgtgcaaaaagaagctggcccgacagtcctgcactcagctgccctctgccccctgcgagggcctggctcacccttctccacggtccccctccactttcgggcccagtcagccaactgctgggcataagccttctcgatgcgggcgcgctcctggaagcagctgaccaggtccccgcacagccggtgcccgtcctccacccgctgtaccgtgcgcctgtagttgccagcctgggcatacaggaaaagggtgccatcaccagggagaagcttcctttggggctggggctgtcagatgggctcctcccctagacaagtagctgagcccaggacccagctgctcacctcccagaaactgccccctaaggcctcccctccagcgtcctcttctggagccatggtgtccccgcagcacggaatggtggcggatttggggctgtggagggcagaggggtaagcaggaaagctggacattatgtttctggggataggaaaagaccctctctatacctgggcctcgccccactgccatccccaccacccaaggagtcatcagagctaggacttagcaggcagggtgctgaagaccctaagaagggccaggatgggtgaggatggagtctcaaagctcttcctctcactgctctgcacttccccccccgcccccccacatacctggggcctagagatcacttcaaggacccgggtgtccaactctcaatgctgccaccgtgactctgccttgaaggagaacagagcgggggtgagggtgggggcctagagcgtccagggcggtgcccggcacccccaatatagcaactgctgtcagaagcgccggattccagggaggagaatgccaggcaggtcacacgatccagccagggattaaatggcaggcgggggtgggcggtgggcagaaggccccactcccccaactgccgatgagaggactcctgcccaggctagggcctctgttgccttcccttgagtgacaagacaaccctgttacccgagaggccaagtcagagggtgcctggccacatcccagtagctccctgtactgaggagggcacgaagggaaccaagaggcctggcttctgtgttggccaggaagcccgaacaagtgtatgtaactgtctcctcctaaggaggccccagctccctctaagatggaactcctctgtgtgctcagctgccatgccagggctggtgtgaaactcaaaccaagcaacgcaccagaaatacgaggggccctgcagtcacggaagatactcatctcactccacacatccactgagggcccgcaaggctccgtggggaacacacaacccgggcctgccctccaaaggcctggcgtccagggcagcatggggaagtgagaagcgatggccaactataagaatgtctcccaggctgggtgtggtggctcacgcctgtaatctcagcactttgggagactgaggtgggtggatcacctgaggtcaggagttccagaccagcttggccaacatggaggaacctcgtctctactaaaaatataaaaattagccaggcgtggtggcgggaacctgtagtcccagctacttaggaggctgaggcatgagaatcacttgaacctaggaggcggaggaggttgcggtgagcagagattataccaccgcctgggcaacagagtgagactgtctcaaaaaaaaaaaaaaaagttccctagaatcgcagaggacggcaagccaattccaaccccagagccatggccccagggactcaaggacacagtggcatgtggctgctcccctcctgcctctgggcagggtctcagctgtccccagcactgactgactcacagaccctagaaggaaatcgcttcctctctgagcaggcccaagggacacagccagacccaggaggacagtgtgcgccctttgtccccaaagcagggcgctgtcacagcgcttcctccaaactcatgcacctctgcttctccttcaaacctccaattaaggcatcttctcctcagtcacttcccctgtttctctgtccttgctcctgtagccccgggtgacccttcagccggggtgtataacccatggagttgtggctgacaggacagtgtctatcttcagtcaccgacagaggcttccaggattctgatttgtgtgtccccacgcgctggaatcagcaataattagttaagtgagaaaagaagcgatgtccacctggagcgcaggaaacgcgcccgctccagcagctgtgggaatgcttggtccaagtgggcttccccctctgctaacaggagacagagctaggggctccgcggagacccaggcaatggaggtgcccaccaggggcctcacaagctcgtcacttggttccctctgcagtgtgtcctgtctgcccagaaaggacctgacagggcgatggagagaaagagagctgctgccatgaatcacagggctctggagccgccccagtccagcctcaggagcctggggccccttgcctgttccagcctccgagttccctgctccccagagagctgccccccaccccttccctctctctggccccagaacagagcaagctgtgtgtaccgggctggcacagctccctccggcctcccagagcaaacacaggcccaagccccgggtgcagccaggccccacagccccagcctgacctctcagcaagcaagcaaggagggcttgcaccttggcccccattgagcaggttggcaccctgtgcctcctgagctcagcagagacccaaatcagtccccaccgcaggcaagagctcagaaagcaggtaatgcaatcttcccagccccgggagccagcacgttcggctccgagaggtcttcctgggcttggcagggtctccttgcagctgcacgggccaaggtaggaagtccctggttcagggaagacccagtctccctacctgaggcctgaaggtacccggccccagaccagccccaacctcttccagaagctgggggcttgcccctgggagggagctcagccattctgcctggcccatccctggaacctgagtcacaggctgcgcccaagggcttctttcccgggcagcccctcccggtgcgcccgcagctctaggatttgaggacagagcgggggggaggggagggggcgtcagtaggctggtccgaagagggacagcgaggttagaggggctggaaccagaagccagagccagccaggagatcaggaggctgggggagggggtggcgcagccaaagcgggaggaggcagggccagggaggggcataacaaaggggcacttttggaaacccgacctgccggccggggtgcctgcttccagatgacgcactccgaaccccagcctccactccagagctcggcgcccagaggctacgcgcctctggcctcaacccttatggaccgcgcccctcgacaggaccccttgccgcccggagctgcataactcggagcccgtggagccacgcggagcggcagggccaggcctagccaccgaagctctagacttcttggccaaacttgttgaacttggtcttggcgggggtggggccactgatcaccgccaaggggaggggacgccccctgcctgggccggccttgccgtgggctccagatggtggccccgggcagcggacccaggaatcggggctcgctgcatagggcgagggatcgccagggagcgaggaccctctggggcctcggggcgggcgcgaggcgagcggacgggggccctcgaggggcccctgaagacggctcagccctccagcgccggcgccgcctcccccgggcggcctgcggaattgcgaagcccgcggcaccgcagatgggacggcccctcggcgcggctacggcccttcccgtcggcacgcagagcggggtggccgggggctccctgggcgggagtcggctccattgcaaacttcagaagccggagcaggagagggcgggctcgagccaccgcacccgccgccgcctacccgcgcgtcccctccagggcactcaccgcgtcctccctgggcccctcggcgggtgggggtccggccacgctccggcccgagtcctgccgctcctgggcccgcgccgcggcctcccggagcgcgccgggccctccccc

SEQ ID NO: 821 - DNA, 8361 bp, Homo sapiens
gtggtgtttttgtttttgtgtgtgggtgtgtgtcaagttttaatacacgctagaacaagccacaagagggtgctgctaggccagaactacactcaccccaagcccaccccaggaaccccaaagcagaggtcaggaactgagtccacagctcctggggaggcccaggcacccctgaacgcttctgtcacctctgacctcccatcttgccctcagcctagactcgtcccttccctaccagtcccttccctagacaaaggcccctcccctccctgggtcccaggacttcctccctcaagggacagaggagcagccagagagcgacggttcagggccctgagggtccggctctccaggagaagctgggctctgaaccagggtgggtaaacgttgcagaagggctgtcaggacactcaggcgcccacacactccacgtagttggcagggtacaggccaatgcggccactctgcaactggccttggcaccagccctgctcgtcctcctcactcatcttcagcagctcctcccctgggggaaaggggattggtcactgccagtggccctggcccaggccctgttcctgcaactgggtcaaggactgagggggatggtgtggtcccagagcccagctagcaaagacatggctcaggcagaggcaggtcaaggtcagcaagctgccccaccccagaccctgaatgcagccaccaggcaccagctatctggacctggaacagctgaagggacagaggactggcccttaagaagtgggtatttggcttccctttctgacacccctgctcaggcagataaggcagaggctgaagctaggaaaggggtcccagggtacctgctcggaagctcagctcatcagcttcctggccagcgtagtcatagagtgccctcacccgaaccccggtggcagccttccggggactctcttcatctgaccactcctcatcctgccccgtgctggagaggggaggcaaagggagcagctcagagtgcaaggaacacggggctggagatctcacccaggatcagggcaaaggcctccctacccccagaggcacctgggagagtcaggtgaggtactaaagattctagctctacctcgccatgcccgactgtgagcaaagaggcaattcctgccacacgcagctgatttaaggcataaacgagagggaatgtgggaaatgcccagcaaatctaaaccactatgagaaccagtatcattacaactactaagtaggccctcaggtccctggcaccaattttcaacccatttcaggtgtgaaagaaatgaaaccaaggagaaaggaaaggagggcgggaggcagagctgtttctttgccacagccgcgctcctggctctcaccctggggaccccggggactggggtgggggtgcggtgccatctcttgtaggcacaatgctggtcagggtaacctcatcagggctccggccacccttctctttccggctgattgtcctctgtgtgtccaaggaccactcctgtggggacagtgcttatagtcaggtggggccatctgaaccaccttcacttacttcatccctagccctggccgagctgagtgggagcccatcccacctcccatccccaccccgcctggaacacatgcctcgaactgtggccagttcatggccatgcctggcccgtgggtgctgcgccaccagcgcagatcctcttcgtcactggctgcctcaatgccctggtgcaagtcacggtggagttcatggaacctatgacccaaggcacacccctcagtctaggaagtctagaccctgcatccctcagtcccagccagggcctcggggagatggaggagacccagtactaccccagatctccatgcccaccaggcagttcatacttctcactgctggaaaggtccaggtgctggtgtaaggtgagcagcatatccttgaagaaaagaagccgctggcgctcggcggcctggcaggtctcaaaggcctgttccatgtcctccatgtagcgtggagtgtagcgatgcagctctgccagcgtctgctcatactgagcttttgtctgggtgggagaggaggggcctggtgagaaccagaccttcttccacccaggactccaccagtgtttaccagacactgccataggctgctagacccagggctagccactaggggcaatcagtcccaagacccagctcctgccctcaaggaccccagcagcctaacaagggaggtgacatcaggcacagcatataaaagagtctggtgaggattgaaatgaggtcaacctacaggaaaggatgggagaaatcagaaaaggcttcctggaggaggtggaaactgcagcatctcaggatggggaggatttgcatatccagagctgcaggaaaggacacttcgggcaaagggtactgtgcaaggaaaagagctggaagttctcaactgctgaagtcatcccagtgcctgaaactccatttctttccctagtaaagcatcaccttttgtcaggttcctcctttaaatgatcatctggagagagggtggcaggtgaggaatagggtaataagggtgctggggactggacaagatgttcagggagcaagattcattcaggaagccgtgccctgggcgggggccagggctgggacctgtggcctgtaccttctcggcctccttggcacagcgttccacccgttcctgcagtttgcgcagctgctcctgggagacggcgctgtctgcctttgcgtggctctccctcgtctgggcggtcttctcatccttccgggctgcgtggtagcttttcttggaagcctcaacctggcatgcatggagaccactctggaccctggatgccacaccttggccccctcgatcccttgcaaacaaacaggaaggagcctgtctcggatacctcccccacccagcctcacctccttcagcctcttcagccagggcttctgggccttgcggaagccgtcctcggccgcccggctctcgcggaagccgcccagcacaggccggtggaaagccccccgctgccaggcgcgcacccgctcactgtcctgcccttgcagcttctcccgcacctccaggtgcagcgcgctcagccgctcagccgccgtgaaaaaggcatgccaggccttctccagtgtgccatactgggggcctgcagggagggacagggcttaggccaggcctgggtaccacccaaaatgagcctagcccctctcactgggtgtgaggcatggaggcatggggtacgcgcatggggtgcaaaggtgaatgacaaccctgtcagctgggcttattgaatgaggaccatgtgccttatctcactgactccttgtctcagccaccatcgtgaggacagcgacattgccaacattgaacaggcaaaacactgaggaccagagatgtgaactcgcccaaagcattatggctacaacaggagctgagggccgggcacagtggctcactcctgtaatcccagcactttgggaggccaaggcgggtggatcacaaggtcaggagatcgagaccatcctggctaacacggtgaaaccctgtctctactaaaactacaaaaaattagccgggcatggtggcgggcgcctgtagtcccagctacttgggaggctgagacaggaaaatcacttgaacccgagagggggagactgcagtgagctgagatcacgccgctgtactccagcctaggtgacagagcgagactctatctcaaaaaaaaagaaaaaaaagaggagctgagattcaaacccatctctgttgtgtaaacactacactccattgcctcaaaggaagagcctgtgtgtgccctcgaggaagacagcttgcagggtggaaagatccatgctcccagtcagagggcctgggctcaaccttcagcacttcctagctgtgtgcctttaggcaagtcccttagcctctctgagcttccagtttctcctctagaaaatgcataaaacaggcccaggtgcggtggctcatgcctgtaatccaggccgggcacggtggctcacgcctgtaatctcagcactttgggaggccaaggagaaaggaccgctagagcccaggggttcaaaaccagtctgagcaacatagcaaaaccctatctctacaaaaaatacaaaaattagccaagtgtggtggtccatgcctgtgatcccagctattgtggtcccagctattcaggaggctgaggtgggaggatcagttgagcgtgggagagggagaggttgcagtgatccatgattgtaccactgcactccagcctggtgacagagtgagaccctgtctcaaaataaataaataataaacaaaggaaagaaggccagatgcagtggctcacgcctgtaatcccagcacttggggaggctgaggtgggtggattacctgaggtcaggagtttgagaccagcctggccaacatggtaaaaccccgtctttactaaaaatacaaaattagccaggcgtggtggtgggtgcctgtaatcccagctacttgggaggctgaagcaggagaaccacttgagaggcggaggttgcagtgagccaacatcatgtcactgcactccagcatgggcaacaagtgcaaaacgtctcaaaaaaaaaaaaaaaagaaaggaaagaaaatgggtaaaacaaccatctccacagggttgttgcaactatcaaagtaactcatgagcatcctttataaactttaataacaccacagccatgaggatgaccaggaggatcttccctttctaagggagggtagacgtggaggcctcaaacttcccacgagacgtgcaaaaagaagctggcccgacagtcctgcactcagctgccctctgccccctgcgagggcctggctcacccttctccacggtccccctccactttcgggcccagtcagccaactgctgggcataagccttctcgatgcgggcgcgctcctggaagcagctgaccaggtccccgcacagccggtgcccgtcctccacccgctgtaccgtgcgcctgtagttgccagcctgggcatacaggaaaagggtgccatcaccagggagaagcttcctttggggctggggctgtcagatgggctcctcccctagacaagtagctgagcccaggacccagctgctcacctcccagaaactgccccctaaggcctcccctccagcgtcctcttctggagccatggtgtccccgcagcacggaatggtggcggatttggggctgtggagggcagaggggtaagcaggaaagctggacattatgtttctggggataggaaaagaccctctctatacctgggcctcgccccactgccatccccaccacccaaggagtcatcagagctaggacttagcaggcagggtgctgaagaccctaagaagggccaggatgggtgaggatggagtctcaaagctcttcctctcactgctctgcacttccccccccgcccccccacatacctggggcctagagatcacttcaaggacccgggtgtccaactctcaatgctgccaccgtgactctgccttgaaggagaacagagcgggggtgagggtgggggcctagagcgtccagggcggtgcccggcacccccaatatagcaactgctgtcagaagcgccggattccagggaggagaatgccaggcaggtcacacgatccagccagggattaaatggcaggcgggggtgggcggtgggcagaaggccccactcccccaactgccgatgagaggactcctgcccaggctagggcctctgttgccttcccttgagtgacaagacaaccctgttacccgagaggccaagtcagagggtgcctggccacatcccagtagctccctgtactgaggagggcacgaagggaaccaagaggcctggcttctgtgttggccaggaagcccgaacaagtgtatgtaactgtctcctcctaaggaggccccagctccctctaagatggaactcctctgtgtgctcagctgccatgccagggctggtgtgaaactcaaaccaagcaacgcaccagaaatacgaggggccctgcagtcacggaagatactcatctcactccacacatccactgagggcccgcaaggctccgtggggaacacacaacccgggcctgccctccaaaggcctggcgtccagggcagcatggggaagtgagaagcgatggccaactataagaatgtctcccaggctgggtgtggtggctcacgcctgtaatctcagcactttgggagactgaggtgggtggatcacctgaggtcaggagttccagaccagcttggccaacatggaggaacctcgtctctactaaaaatataaaaattagccaggcgtggtggcgggaacctgtagtcccagctacttaggaggctgaggcatgagaatcacttgaacctaggaggcggaggaggttgcggtgagcagagattataccaccgcctgggcaacagagtgagactgtctcaaaaaaaaaaaaaaaagttccctagaatcgcagaggacggcaagccaattccaaccccagagccatggccccagggactcaaggacacagtggcatgtggctgctcccctcctgcctctgggcagggtctcagctgtccccagcactgactgactcacagaccctagaaggaaatcgcttcctctctgagcaggcccaagggacacagccagacccaggaggacagtgtgcgccctttgtccccaaagcagggcgctgtcacagcgcttcctccaaactcatgcacctctgcttctccttcaaacctccaattaaggcatcttctcctcagtcacttcccctgtttctctgtccttgctcctgtagccccgggtgacccttcagccggggtgtataacccatggagttgtggctgacaggacagtgtctatcttcagtcaccgacagaggcttccaggattctgatttgtgtgtccccacgcgctggaatcagcaataattagttaagtgagaaaagaagcgatgtccacctggagcgcaggaaacgcgcccgctccagcagctgtgggaatgcttggtccaagtgggcttccccctctgctaacaggagacagagctaggggctccgcggagacccaggcaatggaggtgcccaccaggggcctcacaagctcgtcacttggttccctctgcagtgtgtcctgtctgcccagaaaggacctgacagggcgatggagagaaagagagctgctgccatgaatcacagggctctggagccgccccagtccagcctcaggagcctggggccccttgcctgttccagcctccgagttccctgctccccagagagctgccccccaccccttccctctctctggccccagaacagagcaagctgtgtgtaccgggctggcacagctccctccggcctcccagagcaaacacaggcccaagccccgggtgcagccaggccccacagccccagcctgacctctcagcaagcaagcaaggagggcttgcaccttggcccccattgagcaggttggcaccctgtgcctcctgagctcagcagagacccaaatcagtccccaccgcaggcaagagctcagaaagcaggtaatgcaatcttcccagccccgggagccagcacgttcggctccgagaggtcttcctgggcttggcagggtctccttgcagctgcacgggccaaggtaggaagtccctggttcagggaagacccagtctccctacctgaggcctgaaggtacccggccccagaccagccccaacctcttccagaagctgggggcttgcccctgggagggagctcagccattctgcctggcccatccctggaacctgagtcacaggctgcgcccaagggcttctttcccgggcagcccctcccggtgcgcccgcagctctaggatttgaggacagagcgggggggaggggagggggcgtcagtaggctggtccgaagagggacagcgaggttagaggggctggaaccagaagccagagccagccaggagatcaggaggctgggggagggggtggcgcagccaaagcgggaggaggcagggccagggaggggcataacaaaggggcacttttggaaacccgacctgccggccggggtgcctgcttccagatgacgcactccgaaccccagcctccactccagagctcggcgcccagaggctacgcgcctctggcctcaacccttatggaccgcgcccctcgacaggaccccttgccgcccggagctgcataactcggagcccgtggagccacgcggagcggcagggccaggcctagccaccgaagctctagacttcttggccaaacttgttgaacttggtctt

SEQ ID NO: 822 - DNA, 8939 bp, Homo sapiens; identical to SEQ ID NO: 820

SEQ ID NO: 823 - DNA, 50082 bp, Homo sapiens
tttgagagcaagtcatttatttggacatgatcccaagaaacacttgtggggagtagggggtgtgagacagggaagggtggaagccagtacaggagtgtgatcaagcccattacctgggattcactcctgcttgggattatccatcaagaggggtgaggtagctggggtgtttataagccagcttcattagtcactgaacactgcatgaattcacagccatatgggcaggtacagtaggctctgagggtcagagaagacccccagaaggataaggaagcacaggagctggcagccagatgtcaggctggcatgtactgaagttgagaacatgggcagtcagtagcagtgtctggactcacatttggccacccaaatattaatgagattcagttactccctcaacttgctcaccagcagatgcaggagtgagagtctgggcaaacaggccctctcacctagcgtgagatacatgggcagcaggaggggcaccttcccatgaatcgcccatgcaggacccctggaaagaagatgacagaggtcttggcagccccaaaatagccctgtgaccaagggaccccttcaacctatgctgatcacccacctgctgtgaaggagcgtgtcccatgttagcctctgtagatgggagctactcacctgggccgagggtgtgagttccttactccggcaggtcacctctctcagcacctcggccagctcctgcaccctctgcacgtcctccaagccggtggtgactgcagacagtgatcccagcacatgctctctgaccttggcacgggggagaaaggcagggagaggaaatgtaattctgtggctccatgaagtagtgtcaggaagatgcagggtcaggagtgaccagggttattagggggttctttttcttttctttcttttttttttttttttttgagtcagagtctcgctctgtcacccaggctggagtacactggcatgatctcgactcattgcaacctccgcctcctgggttcgggcctcagcctcctgagtagctgggattacaggtgcgcaccaccatcaccagctaattttttgtatttttagtagagacagggttttgccatgttggccaggctggtcttgaacttctgacctcaagtgatccacctgcctcagccttccaaagtgcaggtattacaggcgtgagccaccgcacctggcctcactggtggtttctaaagccctgcagacctctgtctgccttgtatgatgtgtgattaggcagataacagccccctcaagatgcccacattcacatccctgaaacctgtgaatatgttactgaatgtggcaaaaggcactttgactaagtcattttggagaagcaattaagttaaaaattctgagatggagagattatccgaacaggtgggaccaacgtcatcatacgacccttctaagagggaggtaggaacgttaatcagaacaggagatgggtgatggaggcaggggtagggggaagaaaaagagagggaaagaggatgaggtaagggtggggagagacagagggagaggagaggactttggagatgctgcgtggctggctttgaagataggagtcaaggagtgcaggcggcctctagaacccggaaaaggcaaggaatggcttctctcctggagcctccaggtttgcagctctgccatcaccttacttttggcctagtggaccccattttaaacttctggcctccagaactataaagtgaataaatgcgtgttgcgttaagccatgatctttgtggtcatttgtaacagcagccctagcaaacatatataggatgtctcaagctttctccaaatcttcaaattgaatctgtagaatttggcactatttgaaaataaattgtgtctcagcgtggcacctgtgaccagaatggcatgaaattcagaaactggatgactgttggtctggcatggatgggaggtctcaccggaggcttggggtccctgtgtgcctttgcagcagtggggacaagaacccccctacccagccctccactcctgtcttgggccaggccacgggcttcagggtcaagtgctttctacactacaaagcactaatgaggggctggtgaggggctttggtaggagcagagaaaaactaagaacatcatttcagcactgcccagtagaactgtcatttgtaactttatttaattttaataatgacttagatttaagcagcagccacttttgatggggcagagacaccgtggcctgttgctcacacctggctcagcctgacaggctttcccgaagcttccaagtatgagtgcatctgccatccattccagggacagccaggcctccatcccggctgtgtcttgggttgaggaaagaataggtcagtgtggcaggagactctttgcagaatattccagaagggaaactcagataatgggtaatctcacatttgcttctgcaggccctgaccccatcgtttgtcacctaccctgggtaaagatgtcaccggctctggaccctccggcaaatggactcacccagcaggagcccagcaggggacgagatggcaggaggagagagagctgggaggggtcattctcctgatgccctcggccaggtcaccgggggctggccgcctcattcttcaaaagccacagctcctaccagagagtccctctgtgggcagccgccccctggatcctgctcacggcaggccgggcctctggggtcctccacgctgtctagtttgttccctaagccctgcacacacctgtctcaacagagcccttgttaacatcttctcagcttcccagtgagagtttgacatctgtcttgtgccaggccccgggcatttcatggggagaccttgggttaggctgtgtggtctgtgtgcttggggaccacaggatgtccaggggaagcttcccattggtacttctcagagtgaatgtgaccaagaatgagagctgtgtgtgtgtgaaagtgtgtgagtgtgtatgtatgtgtatgtgtgaaagcataattgtgtgtgggagtatgtgtgtgtgtgacagcgtgtcagtgtatgtgtgtgagcatgtgtgtgagtttgtgtgtgcatgtgtatgtgtgtatatgagtgtgtgtgtgtgagcatctgtcagtgtgtgtatgtgtgtgagtatgagtcatatgagtgagtgtgtgagcatgtatgtatatgcgtataagtgtgtgagtatgtgtgtgggagtatgtgaatgtgtttgtgagtgtgtgtgtgtgaacatgtttgagtgtgtgtgtgtgcataagagtgtgtgtgaaagtgtgtatgtatgatgtgtgagagctaatgtgtatgtatgtggcagggggtctggggtaagagggctggaggtggagggggaacctctaaactgggtttgaacccaggcttcaccacttaccagacacagggacacaggcaggcacctctgattctcttaccctctgtttcctcagctgtaacatagatggaggcctcaccatttacgtcccagggttgtagtggggattacagatccatgaagccctaattcagggcctggcagctcatagcaggtgcttgatacatgttagtttctctcggtaagcgaccacaatgacaatccggcttcctgtattaagtacctaccaggcctctagcaccacactcagtaccttcctgcaaacctttcagggagccaagagaagtctttcttctcttctccgtgcccacaggggtgtgtgtgtgggtgtgtgcatgcacacacacgaacacaaactcatgtggcacatgctgggagtggacacaatcatacgttctgcaatagtttatcatactaggttgtaacaatggaacggccatttttgtagattaaaactgattgaatgttgacggtcttatctagttttttagttgcagtgatcgtaattcttatttaactcttactacaattgtatgaggagactagtattcttctatatggggaaactgagacttagagaggtttggtccctggcctgtgacaatgcgaatggtaagtgacaaagccgggacgccatctgtggtccaactccaaaccgctacccatgtgaccgaggacagtcccctttctgctctggggctctgccttgtcatctgaaacatgaaaagcaggggatgatgtgttctaaactccccccatcccagaggcctgtgcctccatgagggccagccgagaaagcaggttaccaaggaagaaggcattttcttcactttatgtcactcacccaaaagaccagagagggaggtggtgtcagccgcttgggagacaccacaggtttctcccctgatccatgaaccttgatccacagcccaaatggccgcacgcagaccctggggccccagaggaagggaatgaaaggagccccccagcttcccacgggtaccttctgtctgacgtctatgctcagtgactgtcctgagccctggctttcatgctcttggttcagcatggaggacacagccttggccagctggaggagctgctcggggccaccctcgccttgcagagctgtggggattttctctgacacggcagcctggaatgctacatcctcaacacatgtgtctccgagtgccacctgttaggaaatcagaaatatgctcagaacctgctaggaagaagctggcctctgaagtcaggggtcttcatgtggggtcagagaggcttggatgcctttggcctggcctgtgggctctcgagcacttcctgaggctggagggcacccagacctgctcgcaccaggcagctgacagccacccaaaccaagccttggttggctccagcctggcgcaagtcattgctctaccactggccgccctcctctcttggtctcaacctcttccacccccacctggcctctgacgcttgaaatcttcttggaatcttatccaggctcttccttgagtccttgttggctaatcttggtcctacttcttctgagctctctgaaggtgctggcctaactcatgccagagtcattctccaacccccctcacccacccaccagctcccaggaccctccccctattctggccactaaatcataacatctacaaaggtagagaccatgtctgttgtgtccctggctatacccccaggacgtggcccagggtagatgctctgtaaatatttgtggaaggaatggatgaatcactgacttatctggctatgcccctggctatcttccatccggccatccttttagtgaggttcatatgggtggagaatttttctcagtaaagaaacagtgaccactgccaccacctaccttagccatggcctgggtctgctgcgtgtcccctgcacgattggtggcagaaataactactgtcagcacaaagtcattgttctcctctccaagtggcagatacactgatgggagggcaggttcagggccacagtgtaggcaggaacctggcaaaaccagaaattgaccgatgagggggcatcgctaagccccaggtagactgcaacccactcaggtagaggctggtgacagggacacaaaagccacagctcttgaaggcatggtaggctctcgggattccacactttcaagtatgagacagtcacgtatgctgattcactgtcttctctaagcaactgcaggttgctgtaactttggaaaaattttactaaaatccataaaaaattgcaggaaaaacatcccatttacagttttttttttaaaaaaagtcaaggtggtaaaccaaattataagaggaagaaaaagaaggaggaggaggaggaggagcaacaatgacaacttaaaacttagctcaggggcgaggagttcaagaccagcctgggcaaattaggaagacgttgtttctacaaaaaaaagtaaaaattaggtctcgaactcctgacctcaggtgatccacccaccttagcctcccaaagttcctgggatgactgacatgagccaccacgcccagcctgggactcgtttttatgtagccacactttcctgcctccgtgctcacttggatgatgggggagaggtactaaagaggaatagcctattggaattagggcagctgtcctggcctttccctctggcgggacgcagtttgaaataacatccacttaccttgcttgaactttttcctttcagactcagccccattcacagccctcttaacggtgatgcatttccacatctattagacagggcgctcgtgaaaactacactctcttaggtattacaatagctgacgtgcactttccctaatcaaggtgtagtgtttatgccgttgtgatgtttgatgctggatttgggggaccatcctggcaacactactggtggctgactttggtggaaatttacaatctgattagagcattttcagagcacagaatgacaaagctctcccgggcgtgtggcttacatctgtaatcccagcactttgggaggccgaggcaggcagatcacctgaggtcaggagtttgagactagccgggctaacatagtgaaaccccatctctactaaaaatacaaaaattagccgggtgtggtggcgggcacctgtaatctcagctactcgggaagctgaggcaagagaatcgcttgaacccgggaggctgaggttgcagtgggccgagatcgtgccaccacactccagccttggcaacaaggcaaaactctgtctcaaaaaaaaaaaaaaaaaaagaagaagccaaagcccagtgggtggagatcagggctcagatgagccctccaaggaccaatcactctccaaatggaagaataaatgcaatgtgagtggctccctcatctctcctgctaatgccctgtggctgtcctggggtgtgagtggttagggtgaaagcagggagactgtgtagggttttatgcattgtggatggggtcttccatgtttgtcacctgtacacctttgcaaaaatgttctttcagttcagctagtcctgcaattatcacccattccctggggctgcttgcaaagcagcgtcaatgaaattgttgaagattctgttaaccagacccatctctgtcttcctgaatagctccaggcttctgggagtcccagctactacaagtgtgtgtgtgtgtgtgtgtgtgtgtgtgtgtgtgtgtgtgtgtgtgtgtgtgtgtgtgtgtgtgtggtgagcaggggttgggggatggtgtcttggtggtggccccacatggtcatacttttgggtatcctcgttcatttcactccatcactgtcccccacgccagggcaatggattttggcttccagttgtggaagagctattgatgagaccttcttctcatgtctctgtggactgatggctgagtcagtgtcttgaggctaggggttgaggtttaggggagccctcatcctaccaacctctctcgcacacggaacatattctttgcagctcccagagagaacaggcccctgttctgcaagaagatgagcccaggagctgagggaagagcagagtcttcagccggtacctgattccagacagaagcagaactccaggggtcccagggctgtggaggcgttgcagaagatggcaaagctcgtcagaacggtgccctcctctggggcaatagtgcaggcaggcacctcacggggaggcacagtgctgatcacataggtgtcctccccataggcatgcctggtcagtgctgggagtaaagagagatcatgttcagggggccacgtggggcccacaaactccatcctgctgttagattgccccctgagctcattaaacacaaagattcttgggctctacttcaaacccagaacttcagacatctctggatctgggaagagcccagaaatgtacatatctaacaattaaacaatgaaaccccaaaacaactccccctgatgcaagggatcccagggcctcactttgagaaactgggcagagataggggaagataattagacagacctgagcttgaattttagttctgccatttgttaaccgagtgacctcagacttgaccttttcttttccaattttgttttcctaattttttttctttttagagatagggtcttgcactgtcacctaggctagagtccagtggtgcaatcataacttactatagccttgaactcctacacttaagtgattccactgccttggcctctcgagtcagctagaaccacaggagtacaccattacggctggctaattttctaatttttgtagagacagggtctcgctctgttgccagggctggtcttgaactcctggcctcaagggatcctcccgcctcagcctcccaaagtgctgggattacaggcataagccactggacccgggctgagaacttgacctttttgagagtcagttcctcatctgtagaatgaggctgatgataatagcttccgcacaaagatcttgtgaggtgggagtatgctgggaaaatgctcaagatcacagagccaggaaagaccagaaccaggatccggaaacaggctgagcccaccccgaagcccacactcttcccaggcgccgagatcactgttaagagccacgagtggacctgcagtcacatcccacatcacctggagtagccacctacattttcagagagcgcatgcctggaagagctgggcataaagagaatttgaacccataaaaactcattccttggcctagacccaattcggaaagtttggggtggacccaagagtgtgcatgtttaactaattccttgtttatcctgatgtgcatggtctgtgggccacttcgggaaaaatggaagcaaagcaatccttcctaaaaagaatcatcacctccattgtttgtgtgtttgagaatctatgtttctcacacagggcttgttttaaacgagaagccctgaacaatcctggcagggtgtacaggttgcacgaccccagaatgacctgcttgtaacactggggttatctcattcatcctgcaaaataaccattctgaggcaggcatttcgattatcccagtttatatgtcaggaaactgaggcatagagaggcgaaatcctctgcctagagtctcccacgtagaaagcggaagtggtgcgatttacaccagagcctgcgctgtggcctctgcactaagctgatgccctggctgggtatggtgactcacagctgccatcccagcacttcaggaggctgggacaggaggatcgtttggctccaggagttcaggaccagactgggcaacatagtgagatcacatctctctatttcaatatttaaaagaaaaataaactgacacccaatatctgagtgtttctgggtttatctgggttccctgagaggagataaaagggaggtttcgcacctgtggctctgattcggatgacctctccccgggactgcagaaacgagctgttcaacagcaacgtggaggtgttgctctggaggagggttaaggaccttggccaaaatcctctgagtctgcaggcatccaggaggggctcagcctgaaagacaggatggcccagggctgctgacgctacagccaggccacaggactgcagcaggacagtggcttctgggtgctagacagcctttcagatttattactgatgaacggaggacaggcagccccagctccccaagaagtcacctggaatatacactttccagcctcactgcggtgtctgtcttagattgggctccccggaagcagagcctgagatggggatttgtgtgcaggttatttatttgtttatttttgagccaggcacagtggctcacacctctaatcccagcactttgggaggctgaggtgggtggatcatctgagctcaggagttcaagaccagcctggccaacatggggaaactctgtctctactaaaaatacgaaaatcagccgggcatggtgttatgtgcctgtaatcctggctacttgggaggctgaggcaggagaattgcttgaacccaggaggcagaggttgcagtgagctgagattgtgtcattgtactccagcctgggtgacagagtgagactctgtctcaaaaaaaaaaaaaaattaaaaagaaaatatttttgagacggagtctcactctgctgcccaggctagagtgcagtgtatgatctctgtgcactgcaacctctgcctcccaggttcaagtcattctcctgcctcggcctcccaagtagatagaattataggcacgcatcaccataccccgctaatgttttcgtatttttagtagagacggggtttcaccatgttggccaggctggtctcaaacccctgacctcaggtgatctgcctgcctcggcctcccaaagtgttgggattaaaggcttgagccaccatatccagccttgtgtgcaggttattgatggaaggaggattcacagggaaaagcagtgcagagagggaaacagcagagaacaaaacaaggcaaaaaacagttactggaggcatccagcctctgcctggtcacacggagagccctgaagtgtaagttgcacaactgaaatcaccctacctggggacagagaagctgggctattagaccctccacccatcagtcgttggccaatggtcaggccacaaaagctggagttaggatcgtccgcctgggaagcaggacttttgctgagatgccaagagcacccgctgcaaagtttctccagagcttatgctcctttgtgcccatttgccctgctgtcaattccctgattttctccccagcccaataccctgagtcccacaccacaggctctgaatggaattgacccaaccctggcccagtaccgggcatgcgacacgggtgtgctgaaagcgcaagggagatttccattcttgagtggttgtcactgtgctcacctgctctgttggggtgttgtccaaataccagctgaacatagccactggagagtcctcccccatggtgaccctgagcagaatgtctttgctggcattaactggcctgcagttcctctcacagctgaaaggcagacagaggacagagtgaggaagctccccgaggcattgctatcatctggatgtttgtcccctgaaacctcatgttgaaatatgatccccaatgttggaggcggggcttcatgggaggtgtttgggtcatggggttggattcctcatgactggatgaatgcctccctcgggagcgagttcttgctctattagtcaccaccggagctggttgctaaaaagatggccgggagcagtggctcacgtctgtaatcccagcactttgagaggcccaggcgggcagatcatgtgaggttaggagtttgagaccagcctggccaacatggtgaaaccctgtctctactaaaaatacaaaaattagtgggatgtggtggtgggtgcctgtagtcccagctactcgggagtctgaggcaggagaatcatttgaaccagggagatggaggttgcagtgagccaagatcacaccactgcactccaacctgggtgacagagtaacactccatctccaaaaaaaaaaaaaaaaaaaaagagcctggcacctcccacccttctctgcacacaccaggtccccttcatctttcactgtaagtggaagcagcctgaggcccttatcagatacagatgtccagtcttggattttccaaccataagaatcatgagccaaataaatctcttttcttctttcttttctttttcttttctttttttttttttttttgagacagagtctcgctctgtcgcccaggctgcagtgcagtggcgcgatcttggctcactgcaacctctgcctcccagattcaagcaattctcctgcctcagcctcctgaatagctgagattacagacaggcaccaccatacccaactaatttgtattttcagtagagacagcgttttgctgtgttggcctggctggtcttgaactcttggcttcaagtgatccacccgcctcaacctcccaaagtgctgggattacaggcatgagccactgcgcccagccaaccatttttctgtataaattacctagcctcagatattcctttataacaatgcaaaatgggccgggcgcggtggctcacacctgtaatcccagcactttgggaggccgaggctggtggatcacgaggtcaggagatcgagaccatcctggctaacacggtgaaaccccgtctctactaaaaatacaaaaaattagccaggcgtggtggcaggcgcctgtagtcccagctactcgggaggctgaggcaggagaatggcgtgaacccgggaggcggagcttgcagtgagccgagatagcgccactgcactccggcctgggtgaaagagcaagactccgtctcaaaaaaaaaaaaaaaaaaaaaaaaaatgcaaaacggactcagacaggcattgtgaccactggcctggtcttttgtccagtccttctcaagtcctttgagagggtaggaaatggccctttttcaaattaaagatggaataaaagccgcccctgccccaaccaacactgggacgtagccttggttgtgaagatggactgagtcatggcctgactgaattcccatgtcattcactgacagcgtaatgatacggaaggtgaatgaggctgagacaggacctgggttctaatcctgtccttgtcacttatgaagggtcaccttgtgtgcatcacttaaactttttttttttttttttttttttttgagactgagtctcactctatcgcccaggctagagtgcagtggcacgatctcggctcactacaacctccacctcctggttcaagagattctcctgcctcagcctcccgagtagctgggattataggcgctcaccaccatgcccggctaacgtttgtatttttttagtagagacagggtttcactgtgttggccaggctggtcttaaactcctgacctcaggtgatccgcccgcctcggcctcccaaagtgctgggattacaggtatgagccaccatgcccagccgaatcacttaaactctctaagcctcagtttcctcacctgcaaaatgaggggatagcctagataatttctgtgattctttttagttcagataatagtaaactaatgctgtggttcaacagcacgcctgccatgcacacattacttccattgtctctagcttgtccaatgctcacaatagccctatgagtgacatattagcatccccacatcacaggtgagctaaccaggccccgagagcttatgtgatttgtcctaagtgatgtaacttctaagtgggcagatagaatgtgaaccatcgtgtctggatccaaactcttggccttctctataatgtctctgtgaaggccaaagcaactccatttcagatgctaatctgccacgttgactactgattaaccccaattccaggaatgcctctaagatttctattctctctacagttctttgtgtaagagcatgtacttactatgagtgctgccctgaaagagattcacatagtattcttacctttccctacgactgtcctacacattcctttcctatggtatataagccctggttctggcgggtaatggcgctggctttcaccatcttgtcttgcagctgccctagacatcatggtttctgttcgcaagtctcaattaaatgtttctttctaagaaactaaatttgtcagcttctttctctggcctctctgcttcctcgaactttgcgggaaggtttgcatagacctgccctccacaggacggtcccccagtttcccctttggtctgaacttgatgacagctcttgaacttcctacttatctcctcatgtctgccctagtccaagtgtgcaggacattctctatctgcctctccaatccagtctcctcccacgtgcggctctgacctgggagactgagctctatacactgcatcacccaagctgccacaccctccagcttctaactgggtccagccaatgggaaccattgatagaggattggagggtgagaggagagagtttggggaatttattcacggctttccctgctcttttccctgatgggctgcaggtgagagatgctgtgcttctccaaccaaggccacagctccctacgtatgtagtcctgcctaatcttacctctgcattcctgggggtgataatggcttcccttggttgtagtcctgccttgtcgcccctgcttcattgccttatacctgccctcacctgtaaatagtcccttcatcagctctcttccattcattcctggtttggctgagccatcagcttcctgcagggactggctgatagtccaagcaaacttgacctcctaccttgactcctgcaagagcctgggcaatctccctgggtcttctcttgccctcttccaagtcattctccactgagccaccagagcatattgaagtcacatgcttagaactcttggttgcttggcttggcatggtggctcattcctgtaatcccagcaatttgggaggccgaggcaggtgggtcacctgaggtgaggagtttgagactagcctatccaacatggtgaaaccctgcctctacaaaaaatacaaaaattagctgcgcacggtggcatgtgtgcctgtaatcccagatactcaggagtctgaggcacgagaaatgtttgaacctgggaggcggaggctgcagtgagctgcgatggtgccactgcactccagcctgggtgacagagtgagactccatttcaaaaaaataaaaataaaaataaagaactcttgggtggtttctctgtatcactcttaggaaaaaggctaaaatcttgatatgaccggcaaggccccacttgagccaggccctgcctacactaccagctccttcccacccttctcttctccatcctcaggacattggcctctttcgctccctgatgattctctgctccctccctttgcccgctctgttcctgctccagctgccccttccctgccctgtgaatttctcctgaacacctctgctgagctgcagttcctgagagaagtctctctaaccccagtcagggcagttttcatagaggtgcgctctctgccttcttcattcgtgtccagaagtgctgatcaccaggtggtagtaacccctatgacaacagagaccaccacagcaagccttgccccaaggcagccccagcctcagtgggtcctcagtaagtgttggctgaacgaatgaatcaggaccctggaggaactgcccacgtgccccacctgactcgaggcctgagttcccagggcgcagacacgtagaggcactgctctgccctgttctccagctcttggcctctcagaacagccaggcgcagggtgacagcagagtcaggcggcggcaggcaggatgctggaaccaccagctccctctggtctgtgcgaagcagctgcctctcaacacagctgctccacagagcccagcaagaccctgagagaaatggacagacactatgatccatcaggagccctgaacgtggcacacactgctagcttctggttttgaaaggggtcatgaataataacatcagctctaaatagacattttaattttttaatgtcagttttattatttatttattttgagatggagtttcccccttattgccaaggccggagtgcaatggcaccatcttgcctcactgcaacctccgcctcctgggttcaaatgattctcctgtctcagcctccagagtagctaggattacaggcatgcaccaccacacctggctaatttttgtatttttactggagttggggtttcaacacgttggccaggctggtctcgaacttccaacctcaggtgacccacccacctcggccttccaaaatgctgggattacaggcctgagccaccacacccggccaaaacgtcacttttaatgcaggttgcagaaatggtgctatggaaggatgcttttgggaaaaagaaccatgcttcacccaaactctgagcaaatctgcaggatgtggttggcttgtgttgcactggtgctcaggaaggtgtgtagcaggagaggggccaggaggatctgtggccctgggagaaggtccagggcagcttcttatcccggtatatttgtcattccatgtggatgaggctgtccacagcgccaagtccctgtgggctactacggcggcctgggaggttgtactgccatctgggaggctgctgtgtcacctcctgctttatgttagcagcttcctaagtttctgtatcctctgcccttcaactctattgacagatgtttactcatcaatacctcacctcccaccatctccaatatggtgacaggcatatagcagcagagaggccaggaagatctaaatccccaggagaatattcccaagattcctgggactattccaagaattccaagattccctagatctacagccctgggagaacagtcccaagatatgttccctgagcatatttccaaaatatgttcagggttcaggctcatcagctcggtcgcctaaactctggacttgcatactctgtattcagataaggagaatgaatattcagagggatgtcattaccacgtaacaattaacatcaaaagccttaaaatgttgcatgacttttgacccagttattccatttctacaaatttatttatgaaagtaaccacagttgtaaatagagattgaactgtataagagcaaacaatgtgaaacaatctaaatgtccaaaaagagggtaaagaaatgatcgcacatcagccgggcactgcggctcacgcctgtaatcccagcactttgggaggccgaggcaggtggatcacctgaggtcaggagttcgagaccagcctggccaacatagtgaaacctcatctctactaaaagtacaacaattagttgggcatggtggcacgtgtctacaattccagctactcgggacctgaggcaggagaatcgcttgaacctgggaggtggaggttgcagtgagccgagattgcgccactgcactccaacctgggtgacagagcgagactccatctcaaaaaagaaaaaaaaatcacacatcaacattatggtctattgtgcagctattaagaaaatcaatatagagacgataccacgacattataatatgcaaatatgcaggttacattgttcaatgagaaaagggtaaagaaaacagtatgaataacatttctttctttctttctttctttttttttttgagacggagtcttactctgtcgcccaggctggagtgtagtggcacaatctcagctcactgcaacctctacctccaacattcaagcgattctcctgcctcagccttttgagtagctgggattacaggcacccaccaccatacctggctaatttttatatttttagtagagacggggtttcaccacattggccaggctggtctcgaactcccgtcctcaagtgatccccccacctcaacctcccaaagtgctgggattacaggcatgagccaccgtgcctggcccatttattttatgtctaaaagctaaaagaatgtgtatgtagctaggctatattcctgtaaaaaggaggataccatttctacaatgtgagcgctagtgctgccatcttggtttgttggaaaatgcctgactcacttcccccttctagattctctccctagggatataccaaagggctggggaaaggggaggagtccacaccagagaagaggagcactttatcacttttgtttggaattgtcagcgtatggaccagcttttcaggtttcattattgttttaaaattctctagatccccttgctgcctgcattcagggccacccttggtctgtcactgctttctcccaccttctattttttttttttttttttttgagacgcagtcttgctctgttgcccaggccagagtgcaatggcacaatctcagctcactgcaacctccacctcccaggtgcaaacaattctcctgcctcagcttcctgagtagctggaattacaggtgtgcgccaccacgcctggctaatttttgtatttttagtagagacggggttttgccaagttgaccaggctggtctcaaactcctgacctccagtgatccacctgcctcggtctcccaaagtgctgggattacaggtgtgagccaccacgcccggccccacctcctatttccatggaatttgcaagctctggcatgtacaagttatacaaaatgtaggccatagggaaagctggtgcgaagattaagaaaaagaacagcaaaatctgaccactgctcaccacttcttagtgaaacaggacaattcaagaactctatcattggccaggcgcggtggctcacacctgtaatccgagcactttgagaggccaaggcgggtatatcgcttgaggtcaggagttcgagactaacctggccaacatagtgaaaccctgtctctactaaaaatacaaaaattagctgggcgtggtggcaggcacctgtaatcccagctacttgggaggctgaggcaggagaatggcttgaacccaggaagtggaggttgcagtgagccaagatcacaccgttgcacaccagcctgggcaacaagagtgaaactccatctcaaaaaaaaaaaaaaaaaaagaactctattgtcacctaccacatgaccattggaagcgtaactccttgtcattgtctggccagcccagggtcactgtcgtgaaaggatccacatatggaccaggttggatgtacacctccatatcgcctttatctttctgcaaaaaaaagcagccagctggtgagactccaactacagttagctcaggctcactgtggggtgctgttggcattcccctttcaccccagagcagtctgcaccaagagcagctgcagtgtaaggcgtggggtggagacagaccctggccaatccccctggcttccttcccctcatggggcgtggagttggttgctcaggatccctgggcaagtcacgttattctgagtgttggctcggggtacacggggtgttcctggagtaagttctggtgggacttgttaaacagcttgggctgtggagcttcttgctcaagccccgaagtcctgacctgaaataacacagggctccagtggaactcaagccccagtggcctcccgtggcctgagaataaaatccaaatttcttgccttggcaactaaggctccgcgtgatctggcctctgtccacgtgtccataatctcctacatccctccctccaacaggctccagccacgctggcttcaggccatcgcctgcctctcagatctgcccactcagaaagctcttgttctgctttcaggcatggctggctggcttatcttcatgtgtccgcttacatgtcacctctggagaggccatgtctgaccacatcagccagaccaccctgttcgttgctatcgttgcactctattggttcttattagatacttaccacaattcctaattctatgataatttgtttgttggagttttttttttgagacagagtcttactctgttacccaggctggagtgcagtggcacggccatggctcactgcgcctcaacctctcaggcccaaactatcctcccacttcagcctcccaagtagctgggaccataggcatgtaccttaatgcctggctaatttttaattttgtttttttttttttgagatgagggtctcactttcttgcttgaactcctgggctcaagtgatcctcccaccttggcctcccaaagtgctgggattacaggcgtgagccactgtaccgggccgatatgttcgttagtatcactcagtaagcttcctgaaggcggagaccatatgtgcttattcactattgcattcccagcccctgataccaagccttgaatgttgtagatgcacagtaagtctttgttgtagaataagtgcacgcacgaacaacgtcaacagcaaggagctgaactcagtcttgttataaaaactgaagagcttggtctgttttcttttcttcctgctttctaatataagcattaaaagcgataaatttctctctgagcactgctttagctgcattccacaaatgtgcataggttgtattgtcattatcatgtagttagaaattttttctaatttcccttgtgatttcttcttgacctattgatttttttacaagtgtgctgtttaattgccaagatatctaacagatatctacatatcctagatagctcattatagatttacaacataactctgttgtgattagacaacttgctttgtttgaattcagtcattttgggcctcttctcaaatggaagaagcctcagggattcctagtgctctgggtattggtaccaaaaaaccaaaactcaaaactaaaacagagtgcttggacatcttttccttgtgaggttaaacgttttttaaagacaatactcacactctttccttcagcattcatcccagatggttcttggagaccggaaggggctgtgaacacagtgggaacgggtatcaagctttggttggaaaccttataaaaggctgtcaaaatatagagtcagagagtcatgtggaaaatgccaccaggggcgtcagcctgtctttgaaaatggtttaagggaacatagcaaacattcaggtcctagggaaatggattaaaagtgagtcatcttgtccaccactggactaaagacacccctttggtagttgagaaagaggcagctgccagtgcagataaaacacaagatttagagtcagacagatgcagctatgcactgctaatgtgtgtttttgttttgttttgtttgttgtttttgttttttgagacacagtcttgctctgtctctcaggctggagtgcagtggggcaatcttggctcaatgcaacctctgtctcctggttcaagtgcttctcctgcctcagcctcctgagtagccgggattacaggcacccaccaccacacccagataatttttttttttttttttttttgagacggagtctcgctctgtcgcccaggcgggactgcggactgcagtggcgcaatctcggctcactgcaagctccgcctcccgggttcacgccattctcctgcctcagcctcccgagtagctgggactacaggcgcccgccaccgcgcccggctaattttttttttgtatttttagtagagacggggtttcaccttgttagccaggatggtctcgatctcctgacctcatgatccacccgcctcggcctcccaaagtgctgggattacaggcgtgagccaccgcgcccggccaacccagataattttttgtatttttagtagagacggcgtttcaccatgttggccaggctggtcttaaactcttgacctcaggtgatccgcccatctcaacctcccaaagtgtagggattagaggcatgagccactgcacccagcctgcactgctaatgtttaactaccagtaaaggaggtgggagtgagaagccctgatttgtagggtttgtcaatttccatggtataaatgttcccaccaatctataagcctgatgctactgaatatagagtgaggagagatgggcacgctcacctctggcaagtgggtggagtcggcaccacacactaccctgttgtcagatcctcttactggcctcccattggctatgtgaaccgggcaggtgagttatcctctctgagtcttggtttcctcatttgtaaaaatacctggagtccatccccatttctcagggctccaggaagactgaatgtggtgctgtttatagaattgctttgtaaactatacatctagaaagaatgtcatcctggctaacacagtgaaaccccatctctactaaaaatacaaaaaaattagctgggcttggtggcgggcgcctgtagtcccagctactcgggaggctgaggcaggaggatcgcttgaacctgggaggcggagcttgcagtgagccaagatggctccactgcactccagcctgggcatcagagcaagatcctgtctcaaaaaaaaaaaaaaaaaaagaaagaaagaaagaaacaaagaacgctagtttttcaagtttaaacaatggaaaaagatacaatcaattgatgtctctgaaaatatatatatttttgagatggagtctagctctgttgcccagcctgtagtgcagtggcgtgatctcggttcactgcaatctgcccctcccgggttcaagcaattctcctgcctcagcctgctaagtggctggggttataggtgtgcaccaccacacccagctaatttttgtatttttagtagagacagggtttcaccatgttggccaggctggtctcgaacctctgacctccagtgatccacccgcttcgacctcccaaagtgctgggatcacaggcgtgagccactgtgcctggcctactgaaaatattgaaatattaatgattaatatctaattaaagtgtagtgcttaaagtaggaacttagagttatttcatgtgattcactaaggccctggatatattaaggtctgagtaccactgatctttaaaaaattctctcccagtgaattctcattcacacaactataattccaaaggcatgtaaaactgtacaaatcaaggctaagatgccagagaaaggggactttcttaaccttaagaaggaaggcagtccaatcaccctgaatgaaaaaattaggagaaacatttgctgcctttgatcctgcatgaatcagccatgtgacttctgcaaagtcaattaaactttctgggtctcaaatcccacatctggctgtcgaatttccaggcatctatgatcccctcccttggtagcagcatctacgggtgatattttccctaagaaccatccctccccaactctcaggccttggtttgggtgaagctgaccctacattgtactccagcgtgggcgtgagaccctgacctgccaaactgactgctgcttcccctggtctcagcagctggtccaggagaaaccatgaactgagcttcagccagcaagaggcagcctcaggacttctactagaaatatccatcaagacgtactctttctcctctggggttaaagatcaaagcctggggtcatcttgctactgctgggaagagagaatccaaaagaagtcaacacagaaccagaggaggaaagaggcaggtttctgaagacactgtctgagcgactcatccagctgtgtttaagaacaggtctactccctgggcttttcattttcattttcttttttcttttttttttttggtcggggggtggggacaccatctcactttgtcacccaggctggagtgcagtggcatgatcttggctaaatgcaacctctgcctcccagattcaagcaattctcctggcctcagcctccccagtagctgggactacaggtgtgtgccaccacgcccagctaattattgtatttttagtagagacaggctttcgccatgttggccaggctggtctcaaactcctgacctcaagtgatccaccacctcggcctcccaaaatgctgggattgtaggcatgagccacggtgcccagctggcttttcattttctgagctgataaaatttccttttgacccaagccagtttcaccttcgtttctgtcccttgctacttgaattgtcctagcaaacacattcaagtgaaccctacctctgtgatggctactctcagctagttccccaacagccattaccccagccttcctcctggcagccagaatccaccttctcccacagaaactgaaaatgctgggtatctgcttttccagtgcactttatagcagcggacctgaccctactttggtcatggtatctgaggtgatgattgcttagagtgagtgggaaagatttttcccctaataaaaagaggtgcacaggaggaaacccctgctcccgctgctggtacgctgcgttgacatgtaatatccggaactgcagcagtcactttgattccttgagcaacaagcctaaggcagcaccaaagctctaaggatggcagacgagaaagatagactgagcctggtttctcgctggcatcactgagccaccgaaccaaccctggaagtgcttacctcctaacttcttatgtgagtcaagaaagccctgaatctgaagctacttaggttggaccttctgttacttgcagcttaaagcatcataatgaacgcaaactcttgttttagaattctgtgtcagtggttggccgggtgcggtggttcacgcctgtaatcccagcactttgggaggctgagacgggcggatcatgaggtcaggagatcgagaccatcctggctaacatggtgaaacccggtctctactaaaaatacaaaaaaattagctaggcgtagtagtgggcacctgtagtcccagcaactcaggaggctgaggcaggagaatggtgtaaacccaggaggcagagcttgcagtgagccgagatcatgccactgcactccagcctgggtgacagagtgagactccatctcaaaaaaaaaaaaaaaaaaaaaaaaaagaattctgtgtcagtggtgaaatgttttactgtaaacatcattgcctccttagaataactggagaattctaaccatctgtagaacaagatacatattcagagccgtgtttggaaaggcccctcactggagcccaagcaggtgcaatgctctggactcttggtaaaaggttttatgctcccttgcagaaacaccttgcctgtgatagtgatgttcccgatttccaaactcaggttggagaaggcattcctcaccagcatggtgaccagaaaggtgcctgcaatacaaaggacccagagtcacagccattgtcatgaacttgaccaagaaaactctcccagcttgcttctctagtccaccgatgcctccaacgaaatctttcacctctgagcatttaatgaatccctgctgtatgtcaggcatggtgcaaggctctggggacacagagatgaaggagcttggttcttgtcctcaagggccttatcatgtagtagacacataggacagtgaacgccaaaccacgggaggaatcggcatggggcacagtgggcattgggtgggcccgcttcaacctcaggagagaaagaaatggttcacaggatagagccagggctggagctaaattccaaaggagaagtaggttctcgatagataagactgcagattcccaagagggagacacatagcaggattgtcagaagcgtggagacagtggaaaaggatattttattttattttactttactttattttatttttgagacaggatcttactctgtcatccaaactagagtgcagtggcacgatctcagctcaccacaacctccacctcccaggctcaagcaattctcctgcttcagcctcccgagtacctgagattacaggctcatgtcaccacgccaggctaatttttgtatttttagtagagacagggtttcaccgtgttggccaggcttggagaaggatttgtaagatttatttagatacatgtgtgtcccatcccttctccctcatggggaaggggctatgggtaggggctaccttctgtgttctcaagcccagagagaaatgcttgagagaggagccttccttggaaagcccggtatgtgtctgtttggggtccgcatggacaggcttcatactcatgcccttgaaggaacagtctgtgacgggaagacgtgcgggtgggaaggggacgggaggaaggggctccatttctgcgtctgggaaataattgcatttggctgggagtcggccaagacatgggtcagaatgttctgtggaccagatgtgtgccttggggagacggatgctgacgaggggagggagaatgaggagagtccaacagagaggggaggtggccagggagaagcagccagggcgtgtgaccagctaaaggggaggcatcccccaccaccccaggaacaaaggcctataaggcccagctgggggccccaagaacccagagaagctcctacaagaaagaggcagcttgaaacatctgctagccctcaagagccaggccagctaggactcggccagcaccaccaagtgcaaatgtccctgccctgtcccgttccctttccatccttccactcccgccacccctggagtcatccaaatctgttggccttaggggcaggaacagtctgttaatcatctaatagtgagcaaaagtcacaaagcacatggatattttatcagagagggatcatcttcccctgtggagtgacctttatagcagcgactttcatggcaggagtaatttttataggtgacaaagcaaaacctgcatctggcttataacccacgcgtggtgtgattttccagctgcagcagcctctagactttccctcttccaagctggacccttggtatctggcaaagcccggatggttttcttctcaaacctattgtcccttctgctatctggtttgtggagttgcttgcagagggcatggtaaccccacacctgcacagtatcacccgttttctaacacacttctgagatccagggggagctacgggcaggtcctggatgggctggagactctgccattctcatcacatttctgcctgctgatctcatccgggccctcaagaactctctgttccttacagattaaatgcaaatgggcgctgtggccacctcccctggctggtgcctgccagtctgtcctcccgtcagcatcattgcaaatacttctgagatagaccagagatgggacttggacccctgccctgcctcatcgaggactctactacaagctggttggggagggtggcccatggcaggcacagaccccagtcagatcatccagacgttgcaccacaaatcttgctcaaggtgccatgcccactgagtgcagaccttgaggaaacgaaaacaaacagctcccaccttaaatcttactcaagggagttaaccctatagcccgcacacacagaagaccagaaaaatgaccatctttaccctttgcctcattataatactaaaaatcatgcccgagggtggagctttaacatgctaatgagacataccacacatcaagaagcatgtgaccagactgcacaggcgctgaacattccccacctccacatgcttaaacatcgcccttttcccatcctacctcctttcagaatgccgggagtggtggctcatgcttataaacccagcactttgggaggtcgaggtgggcagatcatatgaggtcaggagttcaagaccagcctggccaacatggttaaaccccgtttccactaaaaataaaatagtcaggcatggtggtacatgcctgtagtctcagtgactcaggaggctgaggcaggagaatctcttgaaccagggaggtgaaggttgcagtgagctgagatcacgccactgcactccagcctgggtgacagagtgggactccatctcaaaaaaaaaaaaaaaaagacaggccgggcacgagggctcacgcctgtaatgccagcacttcgggaggccaaggtgggtggatcacctgaggttgggagttcaagagcagcctggccaacatggtgaaacccctctctactaaaaataccaaaaaaattctccgtgcgtggtggcgcatgtctgtaatcccagctgcttgggaggctgaggcacgagaattgcttgaacccaggaggcaaaggttgcagtgagtcaagatcacgccactgactgcactccagcctggaagacagagcaagactccatctctaaaaaaaaaaaaaaaaaaaaaagaacgccttctggactttttggggagtcagcccctgaacctccactccagtgctgccttctttatgtttgaacataagcctctaacaaaagcctcgtccaggaaagtttgagtacatcagagcctaagaccccatggtcggcaacacttcctctctccatccccatctctgccattcttggtttttacctctttcccgctagggcatcacctgcagttccccaaaccacactcttctctagagatgtttgaagaaatctgaatatgcctggtctcttacaggggccctaaatgggggtgattttgccccccaggggacatttggcaatgtctgacatttttgtcatcatgacttggggtgctggtgttactagcatctggtgaataaaagccagagatgctgctaaaactccttcagtaccagcccccaactgtaacgaggaatgatccagctccgaatgtcagaagtgccgaagtggagagctgataactcaacgatggcagattacatctggctgttccttatcttatgacccaggcaggatgctgtgaaccaaatctatgtcccggacacactggaaaactggccggcaggaccctgggcaccaagtcacaaagggaagaggaggggcatcagaaggggagccactaaccccatgtaccttcaaccggaacagccaggcggcaaatcccaaatggctctccaaagctcacttgctcgtgggagaaggttgcattgagtccagccacctcaaaggtcagctcttccggggtgccctgagccaatgagatggtgatcaataggtcctgtccaagctccaaatggtcagaagcccaggaggcctgcagccctgacagcagctccaccaagtggactgtaatgtttctggagattgtagaggtggtggtgttgccggtggcttggatctccaggcggtgcctcccagggcccatcagtttctgggtttctctgtccaggatcagattgtacggtagcgagcccttttgggtggtggactcggccagggttatgtcacccaaaagcacagtgtaagtcactcctgttcctaagtggggtaagaaaaattaaagaatgttggtaacaaccatgcggttgataatactatggcagctcagagtcagtctctgaagcctgattctggatacaaacttggatacagatgcagacataaagaaatatgtaaggatatgcccccttctcaaatattaatggtggttatccctgagtattaggttaatgactgatttcgtctttcttttgagacagggtctggcgctgtcgcccaggctggagtgcagtggtgcgatctcagctcactgcaacctctgcctccccggttcaagtgattctcctgcctcggcctctggagtagctgggattacaggcgcctgctaccacacccagctaattttttgtatttttagtagagacagggtttcaccgtgttagccaggatggtcttgaactcctgaccttggatttgcccgcctcagcctcccaaagtgctggggtgacaggcgtaagccaccgctcccggccgtgattttgtcatctgggggtccgctctgttcatttgcatattctaacttatttatactatacatgtcttacccgagaacctaaatatttgtaattaaaaaattaccacatttagttgccagggatgtcctggtcgggggaggaggaggaggactaaaagggagcatttcttaagggtgggggctgatttttatgcatgagaattagctttgggtcttgttttaagcaggagcaagtaaagccattccttcatcctacactggtgaccgcccagaaccctgcaaaccaacatgagaactcagcccgttcacgggaagatgggggctcccttgcaggttgcagatggttgttcttactggatgataaatattgcggttgactcttaaaatctgacttaaatcaacaaattaggattccttccaataaaaaccaagctagcgtagttctcatctgggtgatgatgatgataactacgatataagccccatgagaatgggaaccctgactttcatatttactgctgcctcgcccacacccggcagagtagtaggcactcaattatattagtaggatgagtaaataaatgaaggattattttgtttcctcaggggaacatatgagccctcttcatccaacaaacatgcaagaacagaaggggtttcctgagggctgtgttaaagccccattatgacttccacagctattgctatgagagggctccaggtgggatgtgaggtcaaaccgagccacctgctcattgcactagctctctgctgccctgtttacatcaacaggcctctattctaatctcaaactggtcctgggcttcaggaaaaacgctgccctgggtgaggatgagtcttagccaggagagtctctattgagagaaaggatgataatttaaaatatttaacaaccagcacagcatgggcgccaaccaattagaatggatgctctgataaatcagaatagacactgcgaccaacaaatagatgccatgaccaatcagaatagatgctgtgaccaatcagaatggacaccctgacccatcaaaatagacatgacaaccaatcagagcagtctctgtgaccgattagaaaacacaggctgggcgcggtggctcatgcctgtaatcccagcactttgggagtccgaggcgggtggatcatgaggtcaggagttcaagaccagcctggccaatatggtgaaaccctgtctctactaaaaatacaaaaattagctgggtgtggtggtgggcgcctgtaatcccagctacttgggaggctgaggcaggagaatcgcttgaatccaggaggcggaggttgcactgagctaagatcatgccattgcactccatcctgggacacagcgagactccatctcaaaaaaaaaaaaaaaaaaaaaggaaaacacactgtgggcaggcacagtggctcatgcctgtaatcccaacattttgggaggccgaggtgggcaggttacctgatgtcaggagttcaagaccagcctggccaacatggcgaaatcccatccctactaaaatagaaaaaaataaaaaattaacctggcatggtggcacgcacctgtagtcccagctacccaggaggctgaagcacgagaatcactggaacccgggtggtggaagttgcagtgagctgagatcgcaccactgcactccagcctggatgacagagcaagactctgtctcaaaaaaaaagaaaagacactgtgaccgatcagaatggacatgacaatcaatcagagcagtctctgtgaccaatcagaaaacaccctgtgaccaatgagaatggacctcagccataacagttggcatggctataccagtgggtgcagctgaatactggccttggccaggggcaacttgattgtgccaagctagtcgatgctggctgtactgagatgggctcaggcccagttggtagcagtcccagtgccacctcatcctagttaaattcccaaaaggaagtgactcggaagttcggttctacagggatgcaaagaagggcctttggaaggctaggagcactcactaccttactagccttctgactctgggcaaatgttttaacctttctgtgtcttcatttcttcatctgtaacatgaagataatactactatgtaatgagtagacaagtttatgcaaagcacttagaacagtgcctggcacacactaggtgctaaataaatgaataaatgatagtttaaaaatgaactcggtcaggtgtggtggctcacacctataatcccagcaccttgggaggccaagctaggtggatcatctgaggtcaggagtttgagaccagcctgaccaacatggtgaaaccctgtctctactaaatacaaaaaattagccaggtgtggtggtgcatgcttgtaatcccagctacttgggaggctgaggcaggggaatcacttgaacccaggcggtataggttgcagtgagctgagattgtgccgttgcactccacctgggcaaccagagcaaaactccatctcaaaaaaaaagaactcagtaggtgatccttgttactatttatttacttttttttgaaacagggtctcactctgttgtcctggctggcatgcagtagcatgatctcagctcactacagcctcgacctcccgggttcaagccatactcccacctcagccacccaagtagctgcaactacaggcatgtgcaaccatacctgactaatttttgtactttttgtacaaatggggtctcaccctgttgcccaggcttgtcccgaacttctgggctcaagcgatgcgcccgcctcagcctcccaaagtgttggaattgcaggctcaagccactgcacccagcccactatttattaaggtctgggagttggatagatttggaggaaatcagtgattttatagcttgccttgatgtgcccaattctgcagactcacctccatcaagctccacctgaatccacagaggatccccaaagacagcctggcagagagggccggctcctgactgggacaggccggagcatgcagtcacactgagcgtctccatcttgtctcgcacggtcacctgcctctgagctgtcacatgccactcactggttgtgcattcagcaaacacggtgaattccccaggagatgtgaactggtgggtcacattgctggacacattgccggccacagtcagggacatgaccagtgttggggaaacacaaagacacgcatttacacatgcactgacagggtttggatctgcgctcctgcccaaatctcatgttgaattataatccccaatgttggaggtggggcctggtggaaggtgattggctcataggggcgttttctcgcgagtggcttggcaccatcgccctgatgctgttctcttggtagtgagtgggttttcacaagatctggttgtttaaaagtgtatggctggccagccttggtggcttatgcctgtaatcccagcacttcgggaggccgaggcgggcagatcgcttgaggtcaggagacagagaccagcctggccaacgtggcgaaaccccatctctactaaaaacacaaaagttagctgggcgtggtggtgcacacctgtaatcccaggtactagggaggctgaggcaggaggatcgcttgaacccagaaggcggaggttgcagtgagctgagatcgcaccactgcattacaggctgggcgacagagtaagagcctgtctcaaaaaaaaaaaaaaaaaaaaaaaaaaaaaaaaaaatccagcgagtactagtaacactagcaataatagtaacaacttagactatgtcgttcctggcctgaaaaccctcctattatcctctgtagtgggtgctacagggaatcccccagattccacccttcaagcctgagcatgcattcccccagtacacctgtgagctgtggctgagggcttacagctgaatccatgtccaggagtcccttttagccaaagggagctgcctcgctcaaacctacctcccctcccatggacatctgcaccccacgagtgctcagtgccggggtataatggtctggctctctggcctcaactggaagcaactctgagggccatctctgctcagaggtttctgcaggatcgtcagggtctctgtggcccctgcatcccagttcaactctcctcttgccccatcttactactcccttcccatgctccacaacagagtctgtttcctggttcctgtgagacaaagtagcaaactcaaggagataggtgtgctcatttctgttagccagcataatcacaggaagcccctgactgcagtgacaggcagccctccagaacactttgaagacaaaacagaatagagtgctcggcttccacgtctctagcctgagtcactatatccctaaaaagataaatgactggtccttttcttacatataagataatgtctcgctgggtgcagtggctcacgcctgtaatcccagcactttgggaggccgaggtgggcggatcacgaggtcaggagattgagaccatcctggctaacacggtgaaaccccgtctctacaaaaatacaaaaaaaaaaaatttagccaggcgtggtggcgggcgcctgtagtcccaactacttgggaggctgaggcaggagaatggcgtgaacccgggaggaggagcttgcagtgggccgagatcgcgccactgcactccagcctgggtgacagagcaagactccgtcttaaagaaaaaaaaaaaaagataacatctgagatggctggtgattatgcttctgcaatctacaacaagattttttttttttttttttgagacagagtctttctctgttgctcaggctggagagcagtagcaggatctccgctcactgaaaccttcgcctgccaggttcaagcgattctcctccatcagcctcctgtgtagctgggaatacaggcatgcaccaccacgtccagctaatttttttttttttttttttttttttagtagagatggagtttcaccatgttgaccgggctggtcttgagctcctgaccccaagcgatctgcccaccttggcctcccaaagtgctgggattacaggcatgagccaccgaagccggccaacaagatatactttagtcatctagaggcagatgcactcttgcacccaaactttgatgtgattttacgtggactgaacctccacaacccatatagaagctgtgagctgaaacactgttttggagcagtctggcagaacctctttgaaagacctcccaggctgtagttctcagtctgtcgtcctgaacaaaactaactttaattatttaaaaagcttgatttttctttagttgacagaccccacctacgttagactggctagcatcaacagctcttcaggaccaggctcctgctgagtttttcagcatctttcattcttccacagagtcctgaactccaggcatggcgaggtccttgcagttatttgaatacgccacatgctttcaggtccatgctactctcttttctctagatccattgctcttgccttataattctggttccccgagagaggactttagctctaggtcactctaaggctcctgctgttttgtggattattagtttcagacaaatctctgcacgcccaatatcagctgtgcgcagaagcagccgattaacggaagaacaatgtcaatccctagatttgccagaaggtggcgctcagctaaccaacgctggattcacacagatttcaccaaaagcaaattgttctgtaaggcccgtaatacagtttcagaaatgtggaaaattttccatgacaaacacagaaaaaaaaaaggccctccatgcaaatgaatataaggcaaggtaaaaaggagcttctaacagagaagtcttctgactcctaagcaatgcaattcttcccaggagctcttattatttatcaacaatggatacgaagggtttgatttaaacatctcacctcttagactaatgatgagttaagaaaaaggaggctgcaccaacacataagagaaaagcacagtgatatttacacaaaaaaatgtggcttccgtacattcaaaaatcaaaattcatgctattttccctatcataacctgagttctgtggctgctagtattgataagaaggcatcagaaaggcatttcccagtgtttataaaaatgatttttaaaaggtgggtggtgaccaggcacaatcgctcacgcctgtaatcccagcactttgaaaagccgagatgggcagatcatctgaggtcaggagttcaagaccagcctggacaacatggcaaaaccccacctctatctactaaaaatacaaaaattagctgggcgtggtggagcatgcctgtagtcccagctactcgggagacagaggcaggagaatcgcttgaacctgggatatggaggttgcggtgagccgagatcatgccactgcactccagcctgggtgacagagcaagactctgccaatcctccacccgccccccccccccccaaaaaaaaggtgggtgggtagtttcaaggtccaacaaatctttaatgtaaaggaagatggactatttgggtggggcaatggtggaggaggtgccaccatctatttcctttgaaagagaaaaaaatgtcagtgattgttgtttagagctaatgcccagagagactgcaaatgtcaaacagtgctgtgtcttagattttaatcgcacaaaaacttccagagaataatacaacaaacacccttggattcgccatccagacttaacaaacattaacatttggtcccatttgcttctgttctaaaccactgtttatcactgaaaagtcctgtgtagctgtgggtcatagcggggctacatttaggcaattttgacttatgccaaattcaagttctacaagatttgggggctgaaagattgtgtaacttacaatctgtcgttttctttacaaactcatagcagtcaggaagaaacccacagaacagtggcataggtatttgtatcacccagatatttgcccccaaaacatcactgtaaatagtttctcatttgacaccatgaaacattcaaggcagccacgaacacaaatgtgacagggggccatgtgctgtggctcacacctgtactaccagcactgtgggaggccgagggggtagatcacttgtggttagaggttcgacaccaacctagccaacgtggtgaaaccctgtccctactaaaaatacaaatattagccaggcatggcggcacatgcttgtagttctagctacttgggaggctgaggcaggagaatcgcttgaacccaggaggtggaggttgcagtgagccgagatcgagccattgcactccagcctgggcgatggagaaagaccctgcctcaaaaaaaaaaaaaaaaaaaaagaaagaaagaaaagaaaagaaaagaaaacctatgaggtagagtgtttgcaaaagtagcagcaacagttcctcccatcccatatagaagcacctcgcagtgtggctccacactccttctatcagtaggtggggtctattcctccacctcttgaatctggtcttggccatggaacttgctttggccaacggtatcttagaaaatgtaacacaagcagagatttgaaaaaatgtttgcgcattgggctccgctgctaggaacactgtgtgaatgagcctaggctaacctgttgagtgatgagcagcatatgcttctagctgacatccagctgaccactaggcatgtgagtgagtgaggtcttcccggacagcctaccccagccaactccactcagacaagaaaagccgcccagctctccaaagaaccgtaagaaatggtaactattgttttaagccaccaagttttgggttggtttgttatgtggcaaaaaaactgatgatacaacctggctcaaggctcagagatttctcttacctcggcgggttgtagggatcaaaagtgtggctgtctcctgtactaattatacaggacaggtttcctatgtagggtgagaggagccacgtcagggagatggtgacattgtcaaagatgaaactctcactggacaccatcagctgcagggctgtggattaaaacataaaatgctgcatgcacttgtgaagcaaaattgcacatttctgtttataaccgactctcttctggctacctgtccagtatttttatgtgggtctttttttttttttttttttttttctcacagggtcttgctctttcacccaggctggagtacagtgatgcgatcatggctcactgcagcctcgatctttccaggctcaggtgatcttcccacctcagtagagactgagtagctgggactacaggtatgtgctaccacacccactaatatttatttttattttttgagacagggtttcactctgtcgcccagggtggagggcaatagcatgatctctgctcactgcaacctctgcctgctaggttcaagtgattctcccacctcagcctcccaagtagctgggattacaggtgcatgccactacggctggctaatttttgtattttttggtagagacagagtttcaccatgttggccaatggtctcgaactactgacttcaagtgatctactcccctcagcctcccaaagtcctgggattacaggcatgagccaccacacccagcctaatttttagattttttgtagagacggggtttctccacgttgtccaggcttgtctccaactcctgggctcagactatcctcctccctcccaaagtgctgggattacaggcgtgagccaccgcgtccagccaaggggagcaactttgaatgagggagtctcttagcacacagagatcagcccacgtgggtggctgctgtctctgttttcaggggaagctggacatgccataaaatcagagggacatttctatgctcaagcaagtcggggactcaccttcccggcactggtactgcacccacaggtaactgccctgagtcggacacaggtttccaaagtaggtctcatctgctgccacctggcatgactgtagctcctggcactggcctgggaagcacgcacatcccagcggaagcaggaatggtgtgcaagacaaaagaggatacattcaacagagctgtacagagatgaatggcctctcacccactcattcatttacccaccatccgcccaacaaatagcttttgatatctcctgaagaccaggtactgggctaggtactcaggtgagggagaagtaggatttctgtcctcaagtagttcagggtctagcatcctggtctcaaacttcagcttgcaacagatccccctgtgagtcttgtgaagataccatattccagaccccaccctcagcgattctgattcagtaggtatggagtgcagctggagaatatgcatttctaaccagttcctatgggatgctgatcctgacattgctggcccagggaccccacttcaagaaccactggtccagcagcgtctagagagatggcccaaaatagaaatctacacccagagaaccggcagaggaggcaagattaggaatcctgcgtctatcatggtaccacatgcccacagaagggaggagcagggacagcccattccagaagcttcagggtcatccagcacctctccctcctgcccagcgagatctgttagatgcccacagggaagcctgggagaaagaaacaggtccagaacacccacctgtgcttctcccagttacctgctaggtcccacttcttctgggcagttggccctgggcccacagagccaccctcaccctgccatgcttgtatcacagcgaactacattttccaaactcccttggccactggctcccaggtaggcttggccaatggccggcactactgaaagactggagggtggtgtattcatttccaatcactgttgtaacaacttaccactaacttaatgacttaaatctacatagatttggctgggagtggtggctcacacctataatcccagcactttgggaggcagaggtgggcagattacctgaggtcaggagctcgagaccagcctggccaacatggcaaaaccctgtctctactaaaaatacaaaaattagctgggcgtgatggcacatgcctgtaatcccagctactcaggaggctgaggcaggagaatagcttgagcctgagaggtgaagattgcagtgagcagagatcacgccattgcacccaatcctggattacagaacaagactcagtctcaaaacaaacaaacaaacaaaaacgcagatttttgtccaggtatggtggctcatgcctgtaatcccagcaatttgggaggctgagtcaggtggatcacttgaggtcagaagttcgaggccagactggccaacaagatgaaactccatctctaccaaaaatacaaaaactagctgggtgtggtggcacgcgcccgtagtcccagctacttaggagggtgaggcaggagaatcacttgaaccagggaggtggacgttgcagtgagctgagattgcgccactgcactccagccaaggcaacagagcaagactttgtctcaaaactaaaataaacaaaaataaagcagcacagattttttaaatctcacaattctgtatggtggtcagaagtctgggtgggctcagctggcctctgctcatatcacagggccgacaccaaggtgtcagggctgtgtttctttttttttttttttttgagatggagttttgctcttgttgcccaggctggagtgtagtggtgcgatctcggctcaccgcaatctctgtctcccaggttcaagcgattctcctgcctcagcctactgagtagctgggattacaggcatgtgccaccacaaccagctcattttgtatttttagtagagatggggtttctccatgttggtcagcctggtcttgaactcccaacctcaggtgatccacctgcctcggcctcccaaagtactgggtttacaggtgtgagtcactgcccctggccattttttttttttttttttgatacggagtctcgccatgtcacccaggctggagtgcagtggtgccatcttggctcactgcaacctctgcctctcagattcaagcaattctcctgcctcaccctcctgaatagttggggctccagatgtacaccaccatacccggctaatttttgtatttttagtagagacagggtttcaccatgttggacaggctggccttgaactcctgatgtcagatgatccacccacctcagcctcccaaagcactgggattacaggtgtgagccatcgtacccagcctcttgctttttttaagcatctcttctcccttgacacagcagttcccccagtggaagctccaattaactggcagctgtcagcatttaactagactcagaccctaccccccaggattctgattcagtaagtatggggtgcagctggagagtgtgcacgtctaacaagctcccaggggatgctgatcccgatactgctggcccagagccagctggaacagagcatgcagaaatttcaaccccatttgcagagtgcatacaaggtgctacactcttcccccaggttctcctgaccctcacaggagccccatgaaacttagaaagattctgcaacttgcctggatcacccaggcagcaggggctgagctgggatttgaaccccaacctgccgcccttttgccatgtaccctgctgcccacatcccagggggttctgccccatccttggactcggtctaagcagtttgcttagacaaactgggggtggcagcagggctcaccttccagctcacaaattaaaccacgcataatattcaacatccccttgtaatggataaactgcctcaagacgcagaggccacgtccctgctgaggtttttttctaatactgttgttacccagcgagaccatcctgggctctctctccaccatcacggttcatactgcagtccacacctgagcctgccacctcatgtcctcaccaccttgtcccccagtctttctcgtggctggatcctgcacttccctcacagccaggctcctgatgccgcccccgtaaagctttcctgagccccacctccaccccgtgatctggggggcccctctgatcaaaagggaacacgagccaccaccacatctctgttctcagattaaacagactcaaagagaggtctaattccagaacttgaggacagagttttttctatgactcttcgtagccacatataatccacttaaaaaaaaaaaaaaactaaatctgatctaattccaggatttaacacgccttgcagacaaaatttaaaatcccttcaggtccccagatgccttgaggctcagaatgtggcccaaagacatttgggatcctaagtggcatcacttgggagtgagttggaaatcaagtcggaggtttttaaaaatttttggttcactgcaacatctccaggacatagaacagtacctggcacatagtaggtacaaaataagttttgcatgactaaatagatagtgtttgctcttctgggttgcggcatttatcacagcattagttaattgcctgtatatcactgtctccccactccgccgcaagctctttgaaaaacagagcttgggccaggtgcggtggctcatgccggtaattccagcactttgagaggccaaggtgggtggatcactggaggccaggaggtacagaccagcccgggcaacatggtgaaaccctttctctacaaaaaatacaaaaattagctgggtgtgagggtgcttgcctctaattccagctacttgggtggctgaggcaggagaatcgcttgagcccgggaggcggaggttgcagtgagccacgactgtgccactgcactccagcctgggcaacagagcaagactccatctcaaaaaaaaaaaaaaaaaaaaaaaaaaaaaaagcaccaccaaaaaaaaccaagtgtttattggctaactgaatgaatgagggaccagggtgcttagatacagaccccgcgggatcctctctgcgctcctcctccgactcccacaacagggctcccctctaacgtgctctctgagctgtgggtaccacatttcaggaacttgcagctgagcctttgaggaaacagctcactaagccccagcagtgccttggtgaggaaggtacatccattctcccgtccggggccctttctccttgcaggggccacagcctcaggaacgctggagtaagaagagtcagtgaaaaccagccagctgattttagcgtttcctttccccatgcctgctccaaaaggcaggaggacagaggagccattctcagttccccgaggcaggagaaagttctgggagtactggcgtccctccctgaatcttcaaagggtctttgggcagaagcagaggctcagaggagagtgccaaaaggcacaactggggaggctggcccccaggacctgaggcttgcagcctggccacacggggctgtgtcctcacttagccaagaagcagcaggccacttgctttcctggaccctccagcggggacagtggtgactgcagcagaaagaagagggtttcccgatgtcctggaccagggaagtctctgaggagtttttacctcctagcagggtgcaagaaacccccataatcccggaaattgaatcctagtcactgggcaagcgcaactcagaagtagatttaatctgatttagaaaaacaaagccctagagtaactctcccacgtgaacaagataccatctatcaggagcttggcttcagcgttattcacagtcacagagattaagaaccaacctttctcaacaggagaagagacaaatggcggcacagttacacaacagatgaaacaaataaaccagcacaacatgtatcaagacggataatacatctcaaaaacaagatgttgagcaaaacacaggaaccaaaatgaaaagaaaaatgcattctatagaacgacacacaatatgataccatttatataaacattaaaaccctgcaaagtggccaggcacagtggctcacacttgtaatcccaggaaggccaaggtgggcggatcacctgaggtcaggagttcgagaccagcctggcaaacatggtgaaaccccgtctctactaaaaatataaaaaattaacctggtgtggtggcgcacgcctgtagtcccagctactcgggaggctgaggcacaagaatcgcttcaacccaggaggcagaggttgcagtgaaaagaaattgtgccactgcattccagcctgggtgacagactgagactccgtctcaaaaataaataaataaaaaataaattaaaaaaatagatttaaaaaaaagccctgcaaaagcaacagtctgtagtgtttaggaatacgtgcctagaaggtgaaaataaagcaggcgcagtggctcacgcccgtaatcccaacatttggggaggccgaggcaggcggatggcctaagctcaggagttcgagatcagcctggtcaacatggtgaaaccccgtctcttctaagaatacaaaaactggccaggagtggtggcacctgcctgtaatcccagctactcgggaggctgaggcattagaatcgcttgaacccaggaagcagagattgcagtgagctaagatcgggccactgcactctagcctgggcaagagtgagactctctctcaaaataaagagagggatccacaggagtctcctagtgttgtattcatttttctttttcctttttcttttctttttttcttttttgagacagagtcttgttccatcgcccaggctggagtgcgatgatctgatttcggctcactgcaacttccgcctccagggctcaagcgattctcctgcctcagcctcccaaatacctgggattacaggcatgtgccaccagcccggctaatttttgtatttttagtagagatggggtttcaccatgttggccaggctggtctggaattcctgacctcaggtgatccacctgccttggcctcccaagtgctgagattacaggcatgagccaccacgcccgactgtattgatttttctaacgagggaatcttaagcaaatgaggcacggtgttcagatctgatgaaggtgggtagtagatctgtgggagttcattacagtattttctattcttgtctatacgtttggagtatttcaaaaatttaaaaattaagttaaaaaagtgatgtttcctgcatccagcaggggtcgaggcacgccatgcccaccagatccatggctgtgtttgatgtcggggagggtggaccacagccccctgcttccttgctccgtgcgatgggcagggactggccagttttcccccatgttggaggcccacggtcagagatgaagattatcagaggcttccggaaccctttgctgagcacagaataccagcaactgccctctgctggccgccagagctgcagagcccttgggccctacctgccacctcctccttgacgttggcccagctgcatccctgctccagatctgaaggacgcccggcatcctgggtgcagaaatggggattctggcgcccgtagacggcatcctggacctggatgacctgccccaagccacagtgcacggtggcattgagtccctcgcaggccaggctctggccaacccctgaggcaaagggaaggcaagacattaggggggctcacggttacagacaggtgagtgccggttcacgggaagaggagggtcccgggggttgggctgagatgcaagaacccgataggagccgcttggcaggggtgataaattgaatatgattgtcggcagcattgtgctgagccaggttccctgggatcagatccagcccagccacacactgctgctgtgtgaccttcagcaagttagttagcttctctgtgcccccactctcatactaaacctcatgcaggccgggctccgtggctcacccctgtaatctcagcactttgggaggccgagacgggcggaccacttgaggtcaggagttcgagaccagcctggccaacatggtgaaaccccgtctctattaaaaaaaatacaaaaattatctggggatggtggctcgcacctgtaatcccagctactcgggaggttgagacaggagaatcacttgaacctgggaagcggaggttgcagtgagccaagatcacaccactccagcctcagtgacagagcaagactccatctcagaaaaaaaaaaaaaaaaaagcgggaaagacagaaacagagatgagacaggtgggcaggcaggaaggtgggcaggtggatggggacagggcagggatgagtgacggagcatcacgtgggcagagagagatgcatagagacagggagagaaagctgcggacagaggtaaggtcagaaaaacacacacaggtcagctcttcagcagggagatggggacagaaaccggcaggccctgaagagcgagagggagacagagagaccacagaggcaggaagagagtcagagaccaagggagagaaagagaaagagttagagaaaaacagaaggggaagaaagacccagagaaaactgagacaggggaggcggcaagagaaagagaaggtcagagagatggaggcaggaacaggagggagaggcgagcctggagagaggcctgcaggcaggcagggagacagggtgggagatgggaactcaggggcacgggccactcacggaactcgcacatgaaggcgaaggtctgggcgcagtccgaggtcacccactcagaggaagggcctctcccgatgtggccgcaggtgtcaggggcagcggcggcctgccctccatgccagttgctgtaggtcacattggaggtgtccaaccaagtccccggccctggaagggcaacacgaccaccaggactcagtaactgtcttcaaactccatttatacaaatgcaggactcacgcctgctctgccgctgctgggcagcaggtcagcaattaatgttgatgggatggagacctctctctccaggaccaataaagttctcttcctcactgtcatcatcaaacactcaatgtaagaactggaacaccaaattggagagcttgcaaaaggtgctttgattaaataaatgaggctgccagctctgtctaaccataatcaataatttatttattttgagatggggtcttgctctgtcacccaggttggagtgcagtggtgccatttcagctcgctacaagctccacctcccaggctcaagtgatcctcccagcttagcctcctgagtagctgagaccacaggtgcaagccgctatgcctggctgatttttttgtatttctggcagagacagggattttgtcttgttgcccaggctggcctccaactcctgagctcaaactccacccacctcagtctcccaaagttctggaattgcaggcatgagccaccacacctggccctgagcacagtctaaggaagagccaggggccaggcccagtggttcatgcttgtgatcctaacattgtggaggtgggaggatcacttgcacccaggagtttaagaccagcctgggcaacctagagagaccttgtctctacaaaaaaaaaaaaaaaaaaatttagtcaggcatgctgcctgtggtcccagctactcgggaggctgagttgggaggattgcttgagctgaggttggggctacagtgagccatgatcgtgcccctatattctggcctgggagacagagcaagaccctgtctcaaaataataataataataataataataataataataataataaagtccagaagtgggctaagggatgttttaacatatcatcttcttcataagctgtgtcccttgccaagtacacctgggcagtgctgagttaaaacatgagcagttattgttactttgggcctcttcagatccttgaaaatactgatgtaactctttaaaaggagtgtgtgtgtgtttatgtgtgtgtgtgtgtgtgtgtaaaacagaaccatgtcgaggacaccagagagctagaaaacactaaatatcaaaatttactatggattgggcatggtggctcacgcctggaatcccagcactttgggaggccaaggtggatggatcacttgaggccaggagttcaagaccagactggccaacatggtgaaaccctgtctctattagaattacaaaaattagccataattccagctactagggaggctgaggcaggggaatcacttgaacccgggaggcagaggtcgcagtgagccaagatggtgccgccactgcactccagcctgggaaacagagtgagattgtctcaaaaaacaaacatttattatgggtactcagaaacgtaattattaatttattgaaagagactcatgcaaatgaaatggttttaaaaaatccaaagggtctaaaatgaaagtatcttccctctccaagctatgggcttctccatcattgttatgtttctcataaatgattccaggatgaattgaattgtatccacacatcagcatctatgagtgcctgaaatctacttacataaatgtcatgtgattgcacacagtatctggcccttgcttcttaaatgacattaaatattggaggttgttgcctatcagcctagttagaactacctcattttctgcaacagccacacggtatccctggagaggtgttaataggcacacctcctctagctggatgtgaaaggatgttcaatacacagaaatcggcaattgttgcatctacacctcaagaaaccattcaggagacattgtctgcaggggcgtcttaagaattcaaatccccttggctgtgggttttcttaaatgagcttcccggtagctcatttattaaaacacttccatccacgctggtgttgttctgtggctgttcggcacaggccatgtctcatttctcaaacccagtagcttctacaggggcaaagagaacctctgggtaccaaggtgcccagtaggaaagtcaggcttagcattgctctgactggtagagaccccactgtgcaccaccagctatgtcatgttgagcacgtcttttctctctagacttcattttcctcctccgtgaaaggagagtagccacgcttacctcatgggatccgtgtgaggcttaaatgcaaatgttttcttgtccattctctctctctctttttttttttttttttttttttgagacagtttctctctgtgttgtccaggctggagtgcaatggcacaatcttggctcactggaacctctgtctcctgggttgaagggattctcctgcctcagcctcctgagtagctgggattacaggtgcgtgctaccatgcccagctaatttttctatgtttagtagagatgaggtttcaccatgttggccagtctgatctcgaactcctgaccttgagtgatccacctgcctcggcctcccaaagtgctgggattacaagcgtgacccaccacgcccagcctccttgtccattctcaattgtgtctaggcactgggaaaacaaaaatggccagggtatggttctttccttgaagggcttgtagtctaggagggagacagacaacttagctgtttaagccacagcaaaagtactgccttggaagtgtgaacagggccctgcaggctcgtagagaacgactcacctgactgcactgggtgggggaaggagccttcagagaataaaggaggactaagactttcaggaccattaaaattagactgtgaatggaactatgctaagcacttggtctgctttaatgtcagagcaagtggggaaagacaagtgggacactttaaaaaatagcttagtcattattttctgagactcagttttctcatctgtaaaatggggacataaggccgggcgcagtggctaccacctgtaatcccagcactttgggaggccaaggcaggcggatcacaaggtcaggagatcgagaccatcttggctaacacggtgaaaccccgtctctattcaaaatacaaaaaattagccgagcatagtggcatctgcctgtaatcccagctacttgggaggctgaggcagaagaatcacttgaaccagggaggcagaggttgcagtgagccgcgatcgtgccactgcactccagcctgggcaacagagagagactctgtctcaaaaataaataaataaataaataaataaataaataaaaaatggggacatgatttttctcattgttattgtaagaattcaacatgatagtgacaacgaagcactcaggatagtgcctggcactatcctagcaagaatcaaagcagtcagagtattactattaggaacaggcaaagaagcgaacatttctagagggtcagaatttgatgtgccagattctgtgctaggcattagacatgaattatttaatccacaacacaaccaaagggaagggtatccataccatgagaattaggtcgtattaatttgttccatgtttctttgggtgagaagtgatggcaagaattgcaaacacaagtttctcataaaacagcgatcacggcacctaccctccgtggttccattccgtgccaagttccacgtgagtccaatccaccattccctgtcctgggagatgtgcttctgcagaaaccactgggtgccttcgtcctgaatgaagaccaaatggcctccttgcccctcgcaccagctctgggcatcacggaaggtgcgtccgagtggcacaaattcatagcaagcatctctgaaggccacctggctgttagagcaaaagctgccttcctctggcttaacagtggtggccctaagcctcagagcaagcaccaggagtaccaagcccactgcactcat

SEQ ID NO: 824 - DNA, 54000 bp, Homo sapiens
gcgcgggcttgcgggcaggggctgcagggaggaggagaggacccgcgcccgcgggggctggcggaggcggggccgggcttccggacagaggccaatcgctgccctcggggcctccagcgccggctctgggccgaggcagccagagcgcggaagaggtgcggggggctgtagggggctgcaggggaccgtgggcagtggaggaggcctgggcgcggcggggggccggggggcgcagaggctgcccgaacgcctaggaggtctcgagggtgggtggcgtacagcggggcgggggcgcaacccagaggccgaggctgggggctgggggaggggcgccggactggagtgcaaaggaggggcgaggggcgcagggggctggaggtcagaggttgcccaagcgcgaaggaggggaggggtgcggggcgcgggagtaggccaggagcgcttaggggtgagtgcgccgagccagggcaccgagtgctggggaatacaggccgtccaggcgcggcggggcgcggggagacggaggctgccggagtacggaggacagacggggcgcgggcgtagggctgggaggcttggggaggggggcgcgggcccaaggcagaggctgcgggagcgcggggcaagggagaggtgcagagcgtggagggggctcgggggcgcttggggaggatgggcggcaggccgggtcggggaggaggggcggcgagaggcgcaggggtaggccggggggctgcactggagtgacgagggagggggcacctggccggggggcgcgggcagaggcagcccaagctcggaggaggtgcagatactggcgtccgggagcgcaggggtggtccagggagtggagaggggtgaccggggggcgccagctggggtggaggaagaggatgcccagaactccaagcaggtgcgcggggcggcggggcagctgctgacaccgctgaggtcgggtggtgtcccgggggcgttgtcgttgctgggcgcatgggtgttaagacgcagcggggtcgcaggtgactgtggggaggacagggggtcaaggggcccctggccagagggcacgaggctgacctggagcgccaaggaggaagtgcggggcgtggaggtcgcaggggcatcgggggaggcaggggccccgtggggcgcaggtgacatggagtgggtaggaggccgggggtgacactggcggggcctgcagccgagggtgtcgagactgccacgctgtcgcccccaggcctggaaatccacgcggattcccggagacggcgcctctgctctgcgggttcgtggcgaggaagtccacccactgctcccgggcgcaggtctgcaggtccgcgcccactgcccgcggcgccactgaccatgtcgggtgagtagctcaagctgcttcagttcagcctgcctgttcctactggcttgggtgacagattggtctgcactggggagaaccccactttgaccgcaggattgccccaaaccccgagtctcccccttactgcctcgcccaggtctctctggggctggagggaatggagataccagcctcagctgctgggagggggtgatttacagcaagtgaagggggccttgggatttcaccagtttccttttgtaaaatatagtcctgaaactttcaatgggcttgtttcttgggaatagcattgaactgcctgagactgtcactgcctggaaggccgatgggaagaagtctgttctcctgaaatggccctaaagctctgggaagaggctgccttgagttcttagaactcagaccacggttttaatttctgtttccagtacagatacagggatggcccggcttggtggctcaggcctgtaatcccagcactttgggaagctgaggcgggaggattgcttgaggccaggagtttgagaccatcctgggcaacatagggagaccacatctctaggaaaaaaatttaaaaatcagctgggcattgcggcacctgcctgtagtcccagctactagggaagctgaggtgggagggtcctgagcccaggagttccaggctgcagtgagctatgagtgcaccactgcactccagcttgggtgacagagtgagaccctgtctctaaaaaacaacaacaaaataagaatccaggttaatcctcctgcaggcagagggctggctggcaagaatggcaggaaaggcctgcccccgccaaggaccggtgagccccatctccctgcccttgggttttgtggacatcagatagactggttgacttaagaggcctagatatgtgaacagagtgtaacctcttcccataagaaagatgctggttctattttctatcattaaatcattaagacacctccttcttgtaccagaccacactggatcattctatgagtgcattttatgtatttatttttaaatgtatattttttaaattttgtagagacagggtcttgctatgttgcccaggctggtcttgaacttctaggctcaagcagtcctcctcctttggcctctcaaagtgctgggattacaggcacgagccaccacgcctggccatgagtgcaatttaaaacacacaaacagaacagatgacttttttattcagaggagagatttggtaaatcacagagctgcttctctcctgtttgttcccactctggacttagagatgaaaattgtcggggcagggatcttaagggctgttttcatgaggtgtactggaagagtctgttccaaggaatggcagaaaagattctctgttctagggacgcgtttggagctctctaaagtgaaagccacacatttccccaagcctgctagggtctgtataatagcagcattcaagacggacattcgcatacatcttggtcagcctcgtgccagaagagaagactcaactctttgcagaaaacaaaaaccacctttgagtagaaaagggctgagaaggaagctgctaaggttattttggggggtgatcagaagattccttgagtgcaggggggcaggcaaggggtagaaagaaactgttgtcacagattcataaaattctcagccactgtaatctccagactggacttgattttgtgacaatgtctcctttttgtgggctgtggtgcagtgacaggttttcttgctgtttttccactccatgccgttgctgaaagtgtccgccgcagtggcacttggagtggaaactccctctttgaatgcagtagcattggataattgtggatgttctctggcgtctggcgccgcaccaggacttgatcaccagttgtttcttcaaggcaaggcgatgtggaagctaagccctgtcaatcaatgtttcatcttctgttctatttcaatctgctggtctgtctttgcactttagatgggttttacagtgtcctggatgggaagcggctaaccttcaggaggtgcacatttttgttccaaagcaaaagtctgagtctcggatcccttgttgctggagagagctcgtgtgccaactggtgttgtcttgtcattgtgtgactgtggtcaatattccctccactctaaaccaaagagagaaacagggtatccagtagttccataaaactctcactctaaatgcagccctgtctgcattctcttttgtgtttgagatcaaggtgggtgtgggcagggctggttcctcctgaggcctctctcctgggcttggtcctcacagggtcttccctttgtgtgtgtctgtgtcctaatcgcctctttttttttgagatggaattttgctcttgtcgcccaggctggagtgcgatggtgcaatatcggctcactgcagcttccgcctcttgggttcaagcgattctcctgcctcagcctcctgagtagctgggattacaggtgcccgcccccatgcccggctcacttttgtatttttagtacagatggggtttctccatgttggtcaggctggttttgaactcctgacctcaggtgatccacctgccttggcctcccaaagtgttgggattacaggcgtgagccaccacgcttggcctaatctcctttcttataaggacaccaatcctattggatcagagcccaccctagtgacttaattttatcttaatctcttctttaaagaccccatctccaaatacagtcacattctgaggtcctgcaggttatgatattcatatatgaattttggaggtgcacaagtcagcccataataggataactcatttatttgaatactactgtgtttttctgctggggctgccataacaaagtcccacagactgggcggcttaaacaacacacatttactctcccacagtcttggaggctggaaatctgagatcagggtgtgggcagggctgtttcctcctgacgcctctctccttggcttgtagatgttgtctttctctgtatctccacaaggtcatccttctgtgtgtgtgtgtgtctgtgtcctcatctcctcttgtagtgaggccagcagtgctactgtattagggcccaccctagtgacctcattttaccataatcacctctttaaagaccccatcttcaaatgcagacacattcagaggttctgtggggtagggtttcatcctaggcgtttcaggatgggttatcatccgtctataacacccattaatcctcatgttttccctgaggtccccatgaagagctataaagccagcgcatgtggttatcaatcaatgatcactctgccatttctcttagttgtcactgagatcctcatgaagagattaaaaaaaccagcgcacatcgttatcaatcattgatcactttgccagttcgcatagttgtcactcacgtcctgatgaagagataaaaagcccatgcgcatggttatcaatcattgatcactctgtcatttctttcagttgtcactgagatcctcatgaaggggtaaaaaaccagagcctgtggttatcagtcactgattgctttgccatttctcttagttgtcactgatgccctcatgaagaactataaaaccagcacaggtggcgatcaatcactgatcactttgccattcctgtgtgttgtcctctgcaccttgctttgggccaattcacttgcatcatccttttctctagacagccagagggccctccctggcaatggagatgagaccttcttacaggttttggaaccctcaaatagctcctcataagcctcaggataatagaaaaggctgcatatcacctttgtaatccgggccctctgaccccatctcttcctgtgggtccttgttctccagctgctgttgctacgctgtgaggaatgcaggatgcagcatgcaacctatcatctccacctctggccttggctggtggattttttctgcctcttccttctttgccttattatttttggttcagtttcttattggaggcaggagacagtagctattttgagggcttttgttggtgttggagtcagaggtgacctcggacatttaattactcgttgaagccccggtttacttgtttttgaagcacatgtctgtgttggaaagggaattaatgagagcgcagaggtatgccctatctacacactcctggagggatgggagccatattcattcttgtttgttgctccactgatttcttgatggataagttcttcctggccatttatccctgagcttggatggtgccctttcaaaaactgctgccagccataggacttgccttgcagtatcgaaacacccatttcttagggctaatgtttctcatggagctgtgggtgtctgaggacagagcttgtaccttgtcagctgctgggcccagcacctagcagattctcgtgcctgggaattgcctgggacgtgaacccacagtgaacgtgtaatgcactgagagcacgtcattaggcccacacagacatcttctgccccttcaccttctttgtcttctgcctccagcttcaatccttcactctttctctaagcagatgcccttatgtgtgcagcttatggcatagcactgtggactgggataagcagtgtcccccataaaactcatgtccccccagaagctgtgaatgggacctgtgaacccaaaagtatctgagacaggtctcaatccatttagaaagtttattttgccaaggttaaggacatgcccgtgacacagcttcaggaggtcccgacaacatgggccaaaggtggtcggggtacagcttgcttttacacatttcagagacatgagacatcagtcaatacatgtaagatacacattgctttgatctgaaagggtgggactacttgaagcaagggggttgcggggggtggtgccaggtcataggtagatttttaaatgttctgattagtcgaaagagttattatcaatagaagagaatgtctgggttatgataagaggttgtagagaccaaggttttatcacgcagatgaaacttccaggtagcaggcttcagagagaatagattgtaaaggtttctcatcagacttgaggtctgtgtggatgtttatggtggtcagcttttcctgaattccaaaatggaggaggttatgatgaggcatgtctgaccctctcctcattatggcctgaactcgtttttcaggttaactttggaatgcccttggccaattaggtagttgcgaggcctagaattttagtttaggtttacagaccttattgggaaatagggtctttgcagatgtaattagttaagcatctcaagataagattatcctggaatatttgggtgggccctaaatccaatggcaggtgtccttctaagagatagaagaagagacacagacacagaggaggccatgtggagttggaggcagagattggagtaatgtggccacaagcccagggacatctggagccaccaggagctggaagaggcaggaaggacccttctctagagtttggttttggaatcctggccttcagaactgcaagagagtaaatgtgtgttgtttaagtctcccagcgtgtggtactttctcacagcagccccaggaagctcattcatgggtttgctagggaaaggagtcagcgatgagcccaccagtaagcaaaatgagcacagcaggtaagatggcacaagagatgaagggtcctgtgtcataggaggtgagggactgtgatgagaagggtcgtcttggggagcagggtttgcaggaagatctctgagggatgggtggttttttccatggccaccatgtgctgggaggagagcaagttccaggtgagttaagggagtggtagtagccccatggtagtagcacacatcataggatgtgcttgaagacccagaggggttgagctggacgtggggactgagtgtgggggatgagatgaccagcagtctggacccagcttacatttgcagacaatgagaaaaccattggcgttgggttggctttcagggcagctgatggctttcactgtgtgttgggggagaaaatgtggtttttaaggaccgaggagacagataacagggaccagaatctacagggtggagcagagaatgcaaaggagggaagctgtggctcagggtggttgatgcagagacccattttaaatgttttctagtctggtgcggtggctggctcacacctgtaatcctagcactttgggaggccaggacgggaggattgcttgaggccaggagtttgagaccagcctgggtgacagagcaagagaccccatctctacagaaaagttaaaaataaattagccaggtgtggtgagcatctgtagtcccagctactcaggaggccaaggcaggaggatagcttgagcccaggagttccgggcttcagtgagctgtgatgctgctgctgcactccagccctggtggcagacagagcaagaccctgtcaaaaaaaaaaaaaaaaaaaagccaggcacagaaggacacctgtagtcccagcactttgggaggctgaggcgggtagattgcctgagcccaggagttcgagaccagcttgggcaacataacctgtctctaccaaaaatataaaaaatagctggatgtagtggtgtgcacttgcggtccctgctactcaggaggctgaggtgggaggattgcttgctctcaggaagtcgaggctgcagtgagctgaaatcatatcactgcgctccagcctgagcaacagacggagaccttctctcaaaaaccaccaccaccacaacgtaatgaacaaccccaacattttctgttgtgcctctcggttaagatctcaggttagttatgcaagagtagaatgtgggattggaggcaagtggacttctccttaccccagaattcatgtcataaatgctctgcacagacgaggcttctgggactcttggggagacctaggaggtgggtaatagggatctgaatctacacggtggagctcatgacccaggtcagatgatgccaagtttcattttatacattctctgttcttcttctctgctccttaagagcgcaggtcagtaagtggggttggaaacagtggactcttccttactggggtataggagttggcacgctaaatattctgcaaagcttgctcttgcaggaccaagcatctaaatagtaaggtctaacctcagtcatctgtttctggaggaaaatcccaaagcatggcctttggagtgtgatttagccctcattctcagattcagtggtgaagttcagaggggagccaatccctctgagcatctcgaaggtggacagaacagtcagctcaggaggaaatctcaaaacaacgcccctcctcgggagttctcttacctttgtcattgtagttcctaaaggatgcactccttttcctttctattctttaattcacagggtccttaaacatggttcctcagatttcaataatctatacattggagatcacaaagaaatcttaatactgccaatgaaaggctaaaaattgtaaatggcactttattttcagtttgacattactttgctgatgattcttttcataatatatatgatttgatttaccttattttttactttgccatctgctttgcaattaaatacacacacacacacacacacacacacacacatacacacacacacacgttttctttttaaagacagggctctgctctgtaacccaagctggagtgcagtggcacaattatatctcactgcagcctccaacttctgggtcaaacaatcctgccgtctcagcttcccaagtagctgggactacaggcatgtgccaaaaaaaaaaaaattaaattaaatgaatgcaagtccattctcagtatgaaacacatactgaaataactgcctgagaaatggtacgtggtagataaatgtgcagcagatgtgctaattggcctgggtatagaaatttagctatttggtctgggtatacaattttaggttgaggaccattgcactcagagtttagatatggtggtttgttttagtgtccactattcatgataagaagtctcagtctcatccttaataggattgacctgtatttttattttactttcattttcttggcattttcacaatgttctccttagccttggtgtttttaaattccaggaatatattgtcaggaaaaggactgctgattttctttctttctttctctctctcccctcctctcctctcccctcccctcccctcccctcccttcctctctctctttctttcttttttctttttctttctcttttgttgcatactctctgggctttttaaatctaaagactgactttctgctgttgagaacatttcctgtttaatttctttgaaaacttttcttctctctattttttttttctattctcttattctgaaactcatgttggtgaaccttctgaatcactcctgtaggcttctagctttctgaaattttccatttgtccctttattctactttctgagagatttcctcaatgatgttttccaaaccttctgttatttcgttttcatttcagcaaatcatatttttaacttctaataactatttcttatccttggagtgatcttttctatagcatttgattcttggtttatagatgtatccctctccccctgatcttttgaaagaatactaattggtgcagtcagaatttttatgtctgcctgtctgttccttgaacttctattccatgaaatgtctggtatttctggggttcttcccattccaccccataacttttcagttttctcttttgtggtgaaggtgtttttcaaatatctggtaatggtttatatctatatgtataaaaatgaggaatgtcggttgagctgtacccacttgccgactcgtctgaatttgtcaagcttatgctataggttgggaattccacttctgtgtgatggtaattatttttttcttgggctttttgtttcctttagaatagatcctatcatctgattttgcccctggtgatgggtatatttggcctctgagaattctgcagaatttcagtgacttctccagtttctcttattggctgatggttttctcctgcctctttgttggcttggggttcacacttgccttccttagcacactttttagtctgttctccttttatctcagaaagaaggaaagagaaactaggagctccacatccaccatctttgcttggaagattcctggtttacacttttaattacgtgattgaattgatgaaaatggatggaccttgaaaacatcatgctgatggaaagaagtcagacacaaaaggccatatgatgcttaattccatttacatgaaatatgcagaacaggcaaatccacagagataaaaagtgattggtggttgtcacaagctagggaagggagaaaggggagatactccttaatgagtgcagggtctctttttggggtgatgaaatgtcccaggattagatagaggtggtggatgtgcaacattgtgatgaattgtgttctttacaatggcgaattttatgtcatgtgaaatttactgtgataaataaaaaggaaatatgaaattattccattttcaaaaggctacatagtgtttgattccatttataggaaatatccaaaataggaatgtagagacagaaagcggactcatggttgccagaatggggagtgactgcgtaatgggtacagggcctccttttggagtggtgagaatgtcctcggattgcctggagttagtggttgcacaacattgcgcatggactaaatgcgagtcacttgtgcactttaaaatggtttgttttatgttatgttaatttcccgttaattttttgagagtttgcatggaaaggtgaagctctaagcaggtcgtatgtttaggtgtggggatacccattatgctgcttagaaatatgttcacacttagggctcagcactgggggttctacttggtaattctttctgcttccacactctttcaagatatgggtcagagaaaccctggtgaggacggggtaggggattggatctctggctctgttttgggcattgtgtgattttcgaggtctgtgggtgaagctcacacagtacctttaccttggccagctctgggctttgcagatgccagtcccgaatgcctgcttcctctcccaactctgtcctctgcttagagacaaaagaagccttacagacagctgaatgggtccatgacagctacgcctgttcttgggaagtaattttgatcagagctcaggcctttggaaatgtctaaagaagtagtaatcaccattattatcattttaaagctagtaactaagaaaactatagatagattatagataatggtagagataatttataatctatagactgtaggtagataggtagatgattgaaagattgatagatataaataagtagatacatagaggacatatatatgataggtagatggtaggtatagatagatggatggctaatagaaagatgataggtagagagatgatggagatagatggatgatagatgatagatatatagatgatagataaatagatatagatgatatatgataaatagatgatagagatacatggattagatagctagatagataatagagatacatgatagtaagatagataataaataatagatgtgaagaggattggtagatgataggtggatagatggatggatagatgataggtagatggatagatagatgatggatggatggatagatagatatatgatagatagatgaatagatgatatagatagatagatagaaggatggatagatagatgataaagatagatcgattatagtaagatagataatagatgtacagagaattggtagatgatggatggatggatgaatagatggatagatagatgatagatggatggatgtatagatgatagatagggatagatagacaatggatggatggatatatgacagatagatggatagatggatggatggatagatagagatagatgatagtaagatagataataaataatagatgtgcagagaattggtagatcataggtagatggatggatgaatggatggatagatagatgatagataggtagatggataatatagatattatccaatgatagatagatgatggatggatggatagatagatgatagataaatagatgaatggatggatggacggatggatggatggatggatgatgggtagatggatagatatggactgatgaaaggtatcttttgttctacagaattaagttgtaaagtttgctgtctgtaattctcactcccaatggagatgtcaggaattctcgttctttcttcgttcaagggtggggaggaggagtctacaggagcagctgtaacaggcacattttggaatttaccccattggaatgtaaaggtcaaggaggcagccctgtaccacacgtctgggacgcttgtgtttgttatatttagtgcgaattgtgggttggctttgcttggagtgctgcttccgggaaaggcgctgtggtcgcctacatgctgagcattttaatttccatagacagtacactgggctgcacactgcatgggacttctcggcattgctggctgccctcctgactgttgtctttctcctggcaacaggggcttgggtgcccaagaatcaagtggtttaaaagtcattaccaaagttcacatcagtcttgtgcacagagaattaaaactgctgtaaattatatctgctgtgagagctccttcctctcatactgaggcattaggaaattgaatccattctacctaatgaaacaatgtacttttccttatgttgtctctaccgcctcatacatccctgagttgaacttgaagtctttgtaagaaatggtctgtccagaatttaaataacatgtttggctgcttctttatggagcacgattcttttctttcctttctttcttttttcttttttctttttttcagagacagggactcactctgttgcccaggctggagttcagtagtgtgatcatggctctttgcagccttgacctcctgtgctcaagcgatccgcctgcctcagcctctcaagtagctaggactacgggcatgcaccacctcgcctggctaatttttttttttttccagtacagatgaggtcttgctgtgtttcccaggctggtttcaaactcctgggctcaaatgatcccccttcttcgaccctagcactgggattacaggcatgagccactgcacctagcccaaagcacagttcttttgagtgagttgggttacatctttgctgtaactcaggtcatcaagccatcacttccactttttgccttttgttttcacctaagatctaaacactttgggtgagttttcaagagtcaaacacaacataaaataagggatagtagctatgagtttccatggcattgcagcatcaggaaatgggcatagcagttgggttgactttgtcccttgtttaaggttccttcatactcctcctgtgttttgttttgtttagaatgaaaggaagcatgtatgcgaattagaatactgaatattcactgcaagtcgtgattttttttttttttttgagacagggtctcactctgtcatccaggctggagtacagtggtgcaatcacggctcactgcagcctcaaactcccaggctcaagtatcctcccacctcagcctctccgagtagctgtaactgcaggcctgccaccacgcccagctaatttttgtatttttcgtagagacagagtttcaccatggtgcccaggctggtctcgaactcctgaggtcaagcaattcacccacctcagcctcccaaagtgctggaatgacaggtgtgaaccatcacgtctggcccaagccatgaatcttgggagaggagaggaggtgactatggccccgtcacccctgctgtccctcaggagtgtaactctggtgtttctgttgattttcacagtgactgatcaggcttttgtcacactagccaccaatgacatctactgccagggcgccctggtcctggggcagtcactgaggagacacaggctgacgaggaagctggtggtgttgatcactcctcaggtgtccagcctgctcaggtaaggctcagagatgcggcttgtgcccagctgggtcctatagaaggagggtcacctctcccctaagaggtcctaggagttattctgacgactgactgcccttcttcataggcctggatggccggcagtcatgatgggcatctgacgtttgtaaggaaccttcgaatcatgtgaaaatataggcgtgtgatcggcttcacaatactttaaaaaacaatactgggtttggttacagttcattctcccaaccatggaaactgaaaattcaattcttttttgtttgtttgttttttgagacagggtctcgctctgtcgcccaggctggagtacagtggtaccatcttggctcaccgcaacctctccctcccaggctcaagcgatcttccctcctcagccttctaagtagctgggaccacaagtatgtgcccccatgctcggctatttttatttttatgttttgtatttttggtagagacagggtttcgccacgttgcctaggctgatcttgaactcctggactcactcagtccacccaggttggcctcccaaagtgctgggattacaggcatgaaccatggcacccagccaaggagtcttttcttataatttccttttataattctctttgtctttaattctcaaataaagcaaatacataaataaatgcgtctaatgaataaagcataaggcttctcttaaatgtcatacattatgtaagcaataatctttttctttcatcaaccatggaccacttaaaaaaattgattttatacgaatgggacgaggaggcatttaatatggtagatgtagcaggaattgaatgtcatattctttgacaatgaaataataaatccagacattaatagctaaactaaaaagagaacaaataaaaaaccaaccagtgtgtcctcagacgtttgaaactggaagttttaaatgaaataactcaatccgggtacaaatgaaagcttgaattatgtactatttcagaaaatcactgcaatgtgagtgctacctatacaaagcaaagacagcaactacagtggtacaagacagaaaatttaaatcagtgaagaaattatccagttcaaatatatatgtatatacacacacgtatgcatatatatgtgtatatgcacgcgtgtgcgtatatatgtgtatacgcacacgcatgcgtatatatgtgtatacgcacacgcatgcgtatatgtgtatacgcacacgcatgcgtatatgtgtatacgcacacgcatgcgtatatgtgtatacgcacacgcatgcgtatatgtgtatacgcacacgcatgcgtatatgtgtatacgcacacgcatgcgtatatgtgtatacgcacacgcatgcgtatatgtgtatacgcacacgcatgcgtatatgtgtatacgcacacgtatgtgtatatgtacacgtatgcatatatatatacatgtatgtgtatatatttatatatacgtatgtgtatatgtacatgtatgtgtatatatttatatgtacaggtatgcgtatatacacatgtatgtgtttatatttatatacatgtatgtatacctgtatgtatatatgttcaactatatatttttatatacatgtatgtatatatttatatatacatgtattatatatgttcaaatatatttatatacacatgtgtatgtatatttatatacacatgtgtatgtatatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatacacatgtgtatatatacacatgtgtatgtacatatatttatatacgcatgtgtatttacatacatttatatacgcatgtgtatgtacatacatttatatatgcatgtgtatgtacatacatttatttatgcatgtgtatgtacatatatttatgcatgtgtacgtatatttatttatgcatgtgtatgtatatatatgcatgtgtatgtatatatatacatgtgtatgtgtatatatatgttcaaatgtatatgtatatacatataaaatatatatatttgaactggatttcactgatttaaatttaaaatatatatacacacatatttgaactggataatttcaaatatatatatttcatatatatatttgacttggataatttcttcactgatttaaatttaaaaaaatatatacatatatgtatatatatacatatatatacacacacacatatatatacacatatatatatatatatatatttttttttttttttttttttttttttttgagacagagtctcactctgtcgtccaagctggagtgccatggcgcgatcttggctcagtgcaacctccatctcctgggttccagtgattctcctgcctcagccttccaagtagctgggattacaggcatccaacatcacgcccggctaatttttgtatttttagtaaagacaaggtttcaccactttgcccaggctggtctcgaacgcctgacctcaagtgatctgcccgcctccgcctcccaaagtgccaaagtgctgggattacaggtgtgactcaccgtgcccagccccaaatatttttaaaataataatattaaaaaagcaaacagcagtaaaaaattcataaagataaaatgacaaaactaataattgggaacaagaaacaaattcaaggattaggttaacaaatcttcagggaggccaaggtgggaggattgcatgaggccaggagtttgacaagacaggctgggtgacatagcaagaccctatctctacaaaaaataaaaagagttagccaggtgtggtggtgcgcacctatagtcccagctagtcaggaggctgagatgggaggattgtttgagcccagaggttcgaggctgtagtgagttatgatcacaccactgcactccagactgggcaacagagtgagctcctctctctaaaaataaaaataacaaataaaaatgaatcttttattcgagaaaacataaatgtacaaaattgaaattagaaagaagtcatttggaggcagttttaaaagcaaatagtatatagaaccctttacagtagtgacactgggagtattgaagaagtgcttgatccttctagggaaatcggtgagatgttggttgttgtcatcagaagaaatagaaaccttttgtttgacaataactatgagaaaaactgaaaatgttaccaaaggcttatcttgtagaaaggccctggtttgggcaattttaagggaagttctgttaaattgctcatgatgaattaatttccctgctgcataaactgtcacagagcctagcaaaagatgaatatgttcacttattttaagaaactgttataatcttgacacccaaacttgatttacaggtttgattgtgtttacatttggattgagaaagccctcaaatacaggatgttaataaggcaactctagccctgtagtaaagaaataaatagtgcttacactaagaaagcaaagataggttattattttaaaacctattaatatcattcaacacattaatatgttagagaaagtcaatgataagatccttttaaaataaaaactaaacatataacaaaaagaattccaggccggccacggtggctcatgcctgtaatcccaacactttgggaggctgaagcaggtggatcacttgaggtcaggagttcgagaccagcctggccaacatggtgaaccctgtctctactaaaagtacaaaaaaaaaaaaaaaaaaaaattagctgggtgtggtggcaggcacctgtaatcccagctactcggtgaggctgaggcaggagaatcacttgagctcgggaggttaaggttgcaatgagccgagatggcaccactgtgctccagcctgggtgacagagcaggactctgtcaaaataaataaataaataaataaataaataaataaataaataaataaaaatccacatagattataaatatagaggtaaacatttaaaacatagagaaatcttagaagaaagtagatgaaagtttctcagcactgctgctatctgggactggagggttccatgtggtggggtgtcctgtgtactgcagggtgttgagcagcgtccctgggctccgcccaccagatgccggcaggagttggcagttgtgacaactaaaaatatctccacatgttgatgaaggtggatgttttgttcatctgaaagctggaaatgctggtgtaaattaaacaagatggaagaggacaccagaactgctgtgtgtcagagatattatgtgttaaagataaaacaaactgagggccacatttaaaatattataatggagaggttcttattgtccatcacgtacaaagaactctgaaaacactttaggggtttgcacgggctcgtctctagcacgccagaagcaaagatagacagacaaatacaaaaataggtattaaacacgagcaactggctgggtgtggtacctcacgcctgtaatcccagcactttgggagactgaggtggacggatcacttgaggtcaggagttcgagaccagcctgaccaacatggtgaaaccccgtctttactaaaaatacaaaaaacattaaccaggcgtggtggcgcctgtaattccagctactcgggaggctgaggcaggagaatcgcttgaacctgggaggcagaggttgcagtgagcccagatcgcgccacctgcactccagcctggtgacagagcgagactctgtcaaaaaagaagggaaaaaaaaaaaacctgactatattaaggtccaaaaatgcaccagtgagtggaaaggtacacatagcacatccagcaggttccgtgttttattttaaaagccggcgggggcgacggggtagaaaaatgctgttaaagagtgtaattgagttgcttgtaacacaaaggataaatgcttgaggggatggatactgcattttccatcatgtgattattacttattcctgcctgtgtcaaagtagacttaaggttcactcaagaggaactttaaaatattcagaaacaacatggcagaaatcgtgggaaggttcagtgttgcaagtcgggttgaggttttgtgggaccttttattatatgtttcgtagtcatggggagaattgagggatggcgctctgcggtggtcagggcagtggaagacgagcagtgagcaatgaccgtaaatgaccaggggtgtgggtggtgggagatcgcccctcccccaggctgtgtggtacaagcgtgttatggagtgatcttgcagggaaacctgctttaaactaattgtattcatgaaacataattctgcttccaggagtttattttagggaaatgagcagagctgaacaaaaagatgtaaggacataaatggcagtgccatttgtagtgaggtggagtgctgtttctcttgccctccccccagcccggatctttacgcaactgtggtgaagatgccataaattccataaataactgggccaaaagcagagggagatttgctgaaggaagggtactttttcagagaaatagttaccttaaatacagagcagtgaaatcttacaaataaatgtcgagtccaagagaaatgctaagagatagaaaaggtccgagagcttcaatatctgtcaaataggagagaaagaaaaagaaagaaagaaagaagtaactcctattatatttcagctctgagacaaagtttagattgaaagtgttccagatattgagcagagtggatgaagaaagctcaaatgtagacaccaagtggtaaaatttcagagcagcaaaaatgaagaaaaatcctaaatgcctttctgtatcaatctggttgtgacaattgatgtctcaaaattctggtgcaagataactttgaaatgaaagttctgtattcagctttagtaccgtaatttgaaagcaaaacaaagacttttcaaatttgcaaacgttaaaaatgttatccctcaaagatctttgaggaaaaagttagttgattgactcctgcaaaatggaatgtaatccaagaaaggcgagagtagccaagcacagtggctcatgcctgtaaccacagcattttgggaggctgaagtgggaggatcgcttgagttcaggagttcaagaccagcctggacaacatagtggggtctcatctctactaaaaaatttttaaaaattgctgagtgcagtggcacatgcctgtagtcccagttactcaggaggctgaggcgggaggatcactggagcctaggacattgaagctgcagtgagctatgattacaccactgcactccagcctgggtgacagagcaagaccctgtctcaaaataataataataatgataatgataatgataataataaatagaagagagcacacaggaagcagtgctgaataaataaatgtataaaacagagttaagtctgaatgtgttagtgcacagttacgaaaataatctggaattaacatttcacatgggaggtaattgaaagagcagagaagaaagaatgagcatatgttcatgtttttgtttcgtctgggaagaagacataggtaatgactatatttgatagaaaatataagcttaaatacgtgtgctgacagttgaaaggtggttaccaccagaaaactagaaaagatgtgtacaagtttcagagccttaatgggaaatgcgtggattgaagaaaacctgattcatgcaatcagaggtgggtgggaaagaattacactgatgtcaggcctctgagcccaagctaagccgtcatatcccctgtgacctgcatgtacacatccagatggccggttcctgccttaactgatgacattccaccacaaaagaagtgaaaatggcctgttcctgccttaactaatgacattatcttgtgaaattccttctcctggctcatcctggctcaaaagctcccctactgagcacctttcgacccccactcctgcccaccagagaacaacccccctttgactgtaattttccttgacctacccaaatcttataaaacggccccacccctatctcccttcgctgactctcttttcggactcagcccacctgcacctaggtgaaataaacagccttgttgctcacacaaagcctgtttggtggtctcttcacacggacgggagtgaaaactgaagaaatagaaaatctgatatatgtaaaaaagggaaaataatataaaatgaaactgcaggactcaatccaaatataaccgtgatcataataaacatgaatagattaaaattcctttttaaaaagataggctttctgaatgggaaaataaacataaaatccggacatacagtagtgtaggaggcagcttaattaaaaacaaacaaaatgttgaaaataaatggatgcatttgatatgattctgttccactatccaatctaagtaatggtcaattgttttatagattgttcttcagttgtttgttgttgttgttgttgttttgagacagagcctcgctctgtcgcccaggccggagtgcagtggcacgatctcagctcattgcaacctctgcctcccaggttcaagcaattctcatgcctcagcctccagagtagctgggattagtttcccgccaccgcacccggctagtttttgtatttttagtagagacggggtttcaccttgttggccaggctggtctcgaactcctgatgtcaggtgatccacctgcctaggcctcccaaggtgctggaattacaggcatgagcccctgtgcccagccttcagtttggttttgtccagtgttttctcatgattagactgaggttatgcatttttggcaaaaaaatcatcagaattgatgtaagttttcagtgtgtcatgctatggagtgcatgatgtctgtatgtcctgacctggtgatgttaaatttcatcacctggattaagtggtgtctgttggaattctccactgtgaaattattatgtttttcttttagtaatggaaaatatcttggcatagacattatacaaacagcctgtttcttctctaaaaatcagtgagtcttgtctgcaacagttgttactatagtgtttgcctaatcgtggttttctacttccctcattccttctatttcaattacttggaattatcttctaaattaaacctgccctttctttctcacatatttgtttattcaatagttatattaggtcaggcgtggtggctcatgcctgtaatcccagcactttgtgagactgaggcaggcagattgcttgagcccagaagtttgagacaagcttcataaacattgtgaaaccccatttctaccaaaaaatacaaaaaattagccgggcatggtggcatgcacttgtagtcccagttacttgggaggctgaggcaggcggaccacttgagcccaggagttcgaggctgcaatgagctatgattgcaccactgaactctagcctgggtgacagagtgagaccctgtatcaaaaagaaaacttatattagtgtaggctcatgaatatttatttcatattttgggcttgttgttttttgttattgattacattatttcagctttggcaattgggtgcttcccctagctggccccctgtattctttcaatatgcccccatccttttctagcacttgcttaatttttctgtcatcccaatatgttccagactatgatgaagtgggatttaagcaaaaataaataaataaatggaacagagcaaatttcactttgataaaatggacagtctttcaagcttcgagtctcaaacttgtatgcaactaacaatgtaagctttgaatacagaaagtaaaaattgatagagattgttatggacatctgttagtttctaccagctcagcatttacatttctctgcctctgcagcttacagagggaaactgtcttcctaagagctggcccaagtgcatgcatcttaagacagttctgttcaatttgtcacatttttcaagtatgcatgcatttctttttcataatattaatatttattactatatatgaatactagattgaaagcccaagcattcagtttacacacagaaattatgcaattatatatcgcttcacaaaggcagtgaacacattacattctacaaaatctacttcacagaaatttaaaaattctaaatatcaaaaggtacagctgaagaaacaggtataaatttggcagccagtaattttgacagggaagttgcagcttgcatgactttatttttttgtttgttttttgagacagagtcccactctgtcgcccaggctggagggcagtggtgccatctcggctcactgcaacctctgcctcctgggttcaagtgattctcctgcctcagcctcttgagtagcaggaattacaggcgcccaccagcacgcctggctaatttaaattttttgtttgtttgtttttgtttttttgcttgtttgttttgagatagagtctcgctctgttgcccaggttggagtgcagtggtgcgatctcaggtcagtgcaatctccgcctcccgggttcaagcgattctcctgcttcggcctcctgagtagctgggactacaggcgccaccacacctggctaatttttgtatttttagtagagaaggggtttcaccatgctggccaggctgatcttgaactcctgacctcaagtgatccggctgcctcggcctcccaaagtgctgggattgcaggcataagccaccgcgccaggccttgcatgactttaaatatatgaatatgaaaatattgaacttagagtaatcattgtgctttgtgttgattgaaaaatataacaatggctatcaaagaagcatgttcaaagatgcttaattcacttcaaaatgtcatacaaattgtggtggtttctatgcacctctaaagcttccgtcatttagctcaggtacattactaaagtaatatattaattctaccggtacagtggggtttcacaccattggcatttgcattcaagcatgcagaggcttttgggcacaagtggacggtgtgcacagctctaagccatccgtggaaatgtgctctgaacatggagaccgcagtgagggctgtggggattctctttgcattccacgtttgtgagcagcaaaacagcaccctcttgaaggaggaggtggttctgtgctgaatattcacccgctgtcccactatttggcacatgtctgttccagggtcatcctctcgaaggtgttcgatgaagtcattgaagtgaatctaatcgatagtgccgactacatccacctggcctttctgaagagacctgagctcgggctcaccctcaccaagcttcactgttggactctcactcactacagcaagtgtgtcttcctggatgcagacactctggtgagtgaagactctctgcttgataggaaaccctccaagaccacatctctatccttaagcaggctgtcaacttttttttgtgtgtgtgtgacacagtcgctctgtcacccaagctggagtgcaatggcacgatctcggctcactgcaacctccgcctcctgagttcaagtgattctcccacctcagcctcccgagtggctgctattacaggcacccgccttcatgcccggttaatttttgtatttctgtacagactgggtttcgccatgctggccgggctgtcacctcttactggtagattcctgtgaggccatgtgcatttctatttctaacacagatgttcagtctattataatcaggcataacatacccccgagcactgtgctagaccctgctgaagagaacaggggattggaagacatgttcctaccccaggaatgaattataaccacagtattttacacgcacaaaatagaatcatgagggaaaaaacttgtgactgggcacagtggctcatgcctgtaatctcagcactttgggagcttgagatgggtggatcacttgaggccaggagtttgagaccagcctggccaacacggtgaaaccgtttttactaaaaatacaaaaattagccaggcatggtaacaggtgcctgtaatcccagctactcaagaggctgaggtggggggatcgcttgaacccgggaggcggaggccgcagtgagccgagactgaagcactgcactccagcctgggcgacagagcaagactctgtctcaaaaacagaagcattggtaaaagaagcattgcggcgggttctgcgtgttttgcttcaccaggtgctgtccaatgtcgatgagctgtttgacaggggagagttttctgcggccccggaccccggatggccggattgcttcaatagcggggtgtttgtcttccagccttctctccacacgcataaactcctgctacagcacgccatggaacacggcagctttgacggtaagtcagggcagcccggacgcttagggtctctgttgcacacactcaactctgcagatgtaacacgaagtcagccgttgaccatacagtcacacctcgctcagcgacagggatgcggtctgagaaatgtgttgttaagtgattttgtcattgtatgaacgtcccagagtgtatctgcacacacctggatgatgtagcctactgtatacctaggctggagggtacagcctattccttctaggctacaaacccatatagcatgggagtgcactgaatgttgtaggcaactgtaacataatgggaggtatctgtgttctaaacatacctaaacatcacaaaggtccagtgaaaatacagtataaaatcttatgggaccaccgtcagatgtatggtctgtctttgaccgaagcacttttatgtgttgcatgactgtacttggcattgaacatgggctggccgtggtggctcatgcctgtaatcccagcactttgggaggccagggcggacagattgcttgaggcgaggagttcaagaccggggtgggcagatggcttgagaccaggagttcaagaccagcctaggcaacgtggcaagaccccatctctacaaaaaatacaaaaataagctggatgtgatgctggcacctgtagtccccaagccctgggaggctgagttgggagcagcagctgagctcaggagctcaagcctacagtgagctatgattgcaccactgcactccagtcaggttgacagagtgagaccctgtctcagagaaaaagaaaagagcatggctgtgttccaataaaactttatttataaaaacatgcacagtgtgtagttgcttgacccatggtagaatatagggagaattaaaaggaggcaacctgaagccgagtatttgttgaaatgggcgtcagtagagaggaaatgtgctggaatttttgtaaagtaaaagaaaatactggagcagtgaagaattgcctctaggtaaaggggaagttaatgaaactggcaaaaatgatgggaaaagcattgtcactaccagggagaattcattaggggaccagtggaatgctttggactccatatgcaattttagcattcattctggggactcctggtggagaattttggagggaatatgcacttatttttatcaatggcttgggttatcagtcttttctgagaaccaagagaatgtgtgcagctggcagacagaagaaatggaattagtaaccctgaaggcaagtgtttatgttgagagcttcaggcacatctcgcattcttggagtgaaccaagccatactttgctaacctgcttttgtgtttgctcattatgtaggggcagaccaaggcttactgaatagtttcttcaggaactggtcgaccacagacatccacaagcacctgccgttcatctataacttgagtagtaacacgatgtacacttacagccctgccttcaagcagtaagttctccaccctggcgaatcctgccagatctgccactaccgatccaccttccctcctggaagacataccagctgtcggcatatttaaaaactctatctatctatctatcatctatctatctatgtatctatctatctatctatctatctatctatctatcatctatctatcatctatctatctatcacctctatctaggtagatctaaatatctatttatctgtatagatagatacctatgtctatgtgtctgtgtatctagatctctatgtctatctatatagatatatatctgtctatatagttatctacctatataggcctagacatctgtttatctatctatctatctatctatctatctatctatctatctatctatccatatctatctatttagatctggatatctatctgtatacatagatctatatatctatatctatatatgtatctatatctagatctagatatctatatacattgatctatctaatctctatatctatgtagatatttatctatctatctagacctagatgtctatctatctagacctagatatctatctatctagacctagatatctgtctatctgtctaatctatcatctatcatatgtatctattcagatagatctggatatctatctataaacatcttatctatctatctatctagatctacatcactatatagatacctatatctatctatctagaactagatatctatgtatctagatatccatctagatttagatcttcatccatatagatatctatatctatctatctagatccagatatctatctatatacatagatctatatatctatatctgtatatctatctagatctatctagatatctatgtatatacatggatctatatatctctctatgtatctagatctagatctctctctatatagatctatgtatctagatctagatctctatataggcatctatccatctatgtagatctagacatctatctatatattaatacatagatgtatctatctatatacgtctttatatatgtatatacacacacagaaacacacacacacatctcgtttcctgcttgcttgttgctgtaaatgatagctagccaaggctctacgacaatgatccccaaagtgtggcccaaggaaccctgaccccacaactctttcaagtgtcttcaaagtcataactactttaaaaaaagaatttgaagatgtgatttttttccctttttgctgccattttctcatgcatctatgctgagagtttacagacactacatggcatgtgataaggtaataccctgaacacagatggagctaggaagaaccagctgtcgcctcttgggaaaatggatggcactcttctcacaatgattttttttaatatagaaatttttttaatgaaaaattatgaaatttatgttactgcataatggtttgattttttttaaagggattgataaatatgctttctaatttctcagttttaatatcgattattctaaatatggagagagagaatccacagggacatggccgagcacagtggctcacgcctgtcattccagccctttgggggccgaggtgggcggatcacttgagctcaggagtttgagaccagcctgcgcaacatgatgaaaccctgtctctacgaaaaaataaaacaaaacattagccgaatgtggtgtcgcacaccgctagtctcagctactcgggaggctgcggagggaggctcacttgaacctgggaagtggagtttgcagtgagccgagatcgtgccactgcactccagcctgggtaacagagcaagcctcagctcaggagaaaaaaaaaagaaagaatccacacggacaaagctctttgggttcctaaaagggtcaagggtgaggggaccagaggctgtgaaattcactgctccagaagatatggctataaatgaaaatagagaatctgagaatcaccttgggaatgaataattctagagtctgcattctctacagaggacacggtgtccctaaggaagagaaattgattcttgggagtgaaatcttgttattttttactgtataatcacagatgtaatgtacagaacatagatatgtcatgtgacttttgtgttcatatttcatgaggaggtgatccacgaaaaaaaagtttaaaaaggctcctggaggatggtgatgatgaacaacaaaaaagttggcaaggggaacatttagaatcctgtaaaagagaaaaaaagccaattgccttgccgcttgcattagccactgtaaaagctatttttttttgcccctgtcgttttaaggatatgatgatttgggctgctgtacttcacgtttttacaaaactgatttatttttcccgttttgggaaaaaatgtcaatggattacgattatgttttttgatatatagaaaataaaataactgcaaaaactgtgatttaaaaaatatatctttatgcaaaataactgcaaatgaaactactactactatgctgatagcagtggagtagtattattgatgatatattgattactatcttgatagtagtggtatgctagtattgctcagatattgattactgcattgatagtactagtatattattattgattatatattgattactatagtagtgatagtattttgttattattgatcacacattgattactgaattgatagtagtagtatgttactattggttatatattgattactatgctagtagtagtatattgttgactatatattgattactacattgatagtggtagattattattgattatatattgagtactatgttgataatagtagcatagtattgattacataacgattactacattgatagtaatatattgttattgatcatatattgattacatgcattgatagtagtagtgtattattattgattatatattgatgactatgttgatagtagtaatcttattatgggtcatatattgattactgcattggaagtagtagtgtattattattgattatatattggttactatgctgatagtagtagtatcatcagtaataataatcaataatggaaacccattgggacaagtccttcagaggctgtctttgaggagccccatggtaggtggatgctttctgggtgtcttttatcacatctgagtggaaatcagaatcccttctgtttccttctcagattcggttccagtgcaaaggtcgtccactttttggggtccatgaaaccttggaactacaagtacaatccacagagtggctcggtgttggagcaaggctcagcgtccagcagccagcaccaggcggcattccttcatctctggtggacggtctaccagaacaacgtgctgcccctttataaaagcgtccaagcgggggaagcacgcgcgtctcctggtcacacagtaagtgggggattcccttaaaacccgtagctgaggacgaggagaacatccttgtcaccaaggtctggcgtggtttttttttgaaatgccccttttttgtctaaatactgtatttcatggaaaagaatactgagaagcaagcacctgttaaaaaaatttttaagttttagctcaaaatagagaatgcctaatgactggagatcctgttttgatgtgtaggcctggtgcagaaataggttattgaaattagccatcctcatcagagtaagagacactcatggacaagtggttcacaatgactgattacgacgtcattcgggtcaacactttccacttgaaaccatcatttgagatagcagttggaggaagtgtctgaagaggattttgtaaagttttgattgacaccaatttgattgcaaagaatataatgacagcccctcggtgtgctaaatggtggagtatctgcagtgtgctgaatgtaggctgcatctgccttgcagaagacctcttgcaattaggactcaggaaacttcttattcctaatggcttttttcactaaagtaaaaaaaaacttgagcttttttttttttttttttttaactagagcatttgtactagagtaccagagtattttttaactagagtaaagaaaactagagttttgtttgtttgtttgttttttgagacagagtctcactctgttacccaggctggagtgcagtgacatgatctcggctcactgcaacctccgccttctgggttcaagcaattctcctgcctcagcctcccaaggagctgggattacaggtgcctaccaccacgcccagctaatttttgtgcttttagtggagacggggttttgccacgttggccaggctggtcttgaagctctgacctcaagtcatccacccgcctcagcctcccaaagtgctgggattacaggcgtgagccaccaagcccggcctttttttttttttaactagagcatttgctagtacaacagagtctgctatcagcacatgcattgcctgggaaattgaaaagaatccctattttaatttttagtatggttttttatttgggtggatctaggctgctttttaaggactgctgaaaatttctctcaccgagtgacactagcaatggacgtttatttgtattcacttcacaaacattgacttgtcacatatttcctgctgggcgttttgctaagtactggattattaagtactggattactaagtactggattactaagtactggattgcataggagggaattttaaggcttagtgtcaaacggtcctgagaaagaaaacatttaggacaattatttaatgattggcagatgggagctgggagccctggctacacagggccccacccgccccccaggacagcaggtgaattgaggagacatagggaagactcactccacgtgtgtgtttttgtgcagctttgccacagtgatgtgggggggccgtgtgcggattcagcctctggtgttggagagccgtgtgaaaattcaacacccagtgcgggcgtgccgtgtgcaaattcaccactgggttctaaccagcctgctcagggccttccggagccgacccagatagtggatgagaccctgtccctacctgaaggacgccgttcagaagatgtaagtacctgcattcctcacaggtgtgatagtcagacgctggctcgcagtgagagagcagagagagccggcttccctggctccctggggaggggagatggaggggaagggctggtctttggcttgctgtggcattcaaggctctgcatttatttttgcattacggcacaccgaatcaagctcacctgctgaaagatgtctatgccccaatccctaggacctgtgaatgtcaccttgtgtggcaaaagggcgtttgcagttgtgattaaatgagggaccctgagctggggaggtatggtcttggattctgggagtgggctcttagtcatcacaaacctcccttcaaagaagaaggtggaagtgtgaaggtcagagaaggagtgtgaagctggaagcagaggccagagagagaggggattggaagacgctgggctgctggctttgaagatggaagaggaggccacgagcgagggaatatggtggcctccagaagctggagaaggcaggaaatggattctcccctaggtccccaagaaggaaccaaccctgccgacaacttgattttaatccactggacttctggcccccagaactatcagatggtcagtctgccttggtgtaaaccacccagtttgtggctgtttcttacatagcagcctcaaaaatctgatgccacaaggagacagatgctcagtctctcgcagtttacagattctgggggagccagagctctttcaggttcaaaaagggaggcttccgtcagtgccccctcaacccaactgcctggccgtgcatcctgagaggtttcagccgaacccctgacttgaacagtggttgaagtgaagatgaattcctgccggggttcaatgttcaaatgaatgttgacctgcacagtggtgtctgctgaggccgagtctgcagcactttgtccccatcgaagaaaaatgaaaatacaccttacttgcaaaacaaataatggaggccgtcatttctccagctccaatttctaggtgaatactttggaataatatcttgtgtttaaagatttcctggggccaggcacggtgactcaacacctgtaatcctaacactttggaaggctgaggtgggaggattgcttgagcccaggagtacgagaccagccggcaacacactgagacctcatctctacaaaaaaaagtcaagaaattagccaggcatggatgtgtgcacctgtagtcccagctacttgggaggctgaggcaggaggaatgcttgagccttggaggtcaaggctgtagtgagctataatctcaccactgcactcccgcctgggtgacagagcgagacactgtctcaaagaaaaaaaaaaagaaatcttttttttttttgaggcggagtctctctctgtcacccaggctggaatgcagtagcccaatcttggctcactgcaagctctgcctcccgggttcacgccgttctcctgcctcagcctcccgagtagctgggactgcaggtgcccgccaccgcgcccggctaattttttgtatttttagtagagacggggtttcactgtgtcagccaggatggtctcgaactcctgaccttgtgatccgcctgcttcggcctcccaaagtgctgggattacaggcgtgaaccaccacgcccggcaagatttcttgttttaaatctttaccactgatcctaacaagtttctcaacagaattattttgagatcatacttagggaaggatctggggactgggctgaaggaaagtgattcttttctgtatacttcagatagctccgggagagccgtttcttgttgcttataaacaagtgacctttagattttgcacacattgctctggaagacaccacacgcttcactgtactctggcgtaaattatgctctggcaactttatgcatgaagaatgtcggagtggtgatttcacattgacccaaacacattgaaaagatgtttaggttcagatggtgaagactgaggaggtgtaaaatgcgcttttctggtttttcattcctcatggtgtgccctgagcataccatagcctgggcctggccccaggacgtgcctcatgcgagtcaagtcaagagcctctgcttgttcctgctggaatgtgaagaattccatcagtggagcccttacatgatgtgcaaaacggctgcaattgtgctgagccatgctcgtttcaggatgtctaaggaaaaatcgcatttacattaaatgtttagtaggcaaccaagtttagactgtaaaccaaagagtatccaagaatgctgtggcattcaaggctcatgcttttatgtgcattacagcaccttaaggccaataaaggggaactcccatcccctgttgatgtgtattgaaaataattgaatgctcaaactcctagcctaaaaaagaaatattatcgaatgcttcgaaaacataaatttaggaagtgtattttgccaaggttaaggacacacccgtgacacagcctcaggaggtcctgacgacatgtgcccacggtggtcggggcacagcttgcttttatacaatttagagaggatgaggtatcaatatgcgtaagaagtacattggttcagtccggcaaggcgggacaactcaaagtggggcgggggcttccaggtcataagtagatagaggcaaatggttgcatttttttttttttttagtttctgattggtctttccaaaggaggcaatcagatatgcatttatctcagtgagcagaggggggactgaatagaatgggaggcagaggccctaagcagctccgctcccagctggacttttccctgcttactgatattggggttccaagatttactttcttcacaagactctattgagtcctcagaaaacggttttcaaaccatctttctgatttccggttgcgtaattttaatcttattccgtcactgaatcttgtacattagtggttttgcaaactatggcctgaggtctctctgaataaggatcattttaaaggattgtgtttttgcagatgatcttagaagcattcttctttttctttctttttttttttttgagatggagtctcactcgatcgcccaggctgaagtgcaatggcgcgatctcagcagctcactgcaacctccaccgcccgagtccaagcaattctcctgcctcagcctcctgagtaggtggacaggcatgagccaccacacctggctaatttttgtatttttagtaaagaccgggtttcaccatgttggccaggctgttcttgaactcctggcttcaagtgatccacctgcctcagcctcccaaagttctgggattacaagtgtgagccaccatgcctggctattaaaaacattcttaacagtttattctgaaccacagtgagcactccctcattcgtaagggcagccaccctctttcagaagcaagtgtgtattctccacccttcagcccctggagggatttccacggattgtcacagcccctgaaaacaagcttcccagggcaaacagtggttttccagagactccaaaagggaaaacagtcaggacgctccagtcccagctccagcccaagttgtagccacaccaatctctgcaaaaacagaaccatttccagagtgacagcacttagcactctggtttctctaaaacagcgcccgtcatgttcaattcatattaatctcgatggaattgttgccgtggatttttcttgacataagtcacttctacttttactttggattcataattgtcgatgaggtggcaacttaaacaatagatatgtagcttcgtgtttgtccgtccgtgagccacctttcaatcagagccagtcaagccaaacctaggagagactttcccgtggagggattggggcttctgaggaaagctcatggagagaatcgtgatgacagaattgaggatcatcctgccttgatgcccaaggaggtaagcaaggacacaaaagcacgctcatttcaccccagttaggtggtgtctattatcaaaaagacaaaaaatatccactgctggtgaagatgtggagaaaggggaactcttttccactgttgatggggattaaaaataagcacagccaggatggagaagagtatgaaggttcctcaaaaaactacaaatagaactaccacatgatccagccatcaccactgggcatttatccgaaggagaggaaattagtatattgaagggacatctgccccccgtccatgtttttgcagtttattcacaacaggcaagatacagattcaacccaagtgtttgccaaaggatgaatgggtaaagaaaatgccatgtatagatataccatggaatactattcaaccataaaaaagaaggaaatccatcatttgcagcaacatggatggaaatagaggacattatggtaggtgaaataagccagaaacagaaagttaaacaccacatgttctcactcatctgtgggagctaaagaaatttaacctcacagaagtgaaaagtaaggccaggcacagtggctcactcctgtaatccctgcactttgggaggctgaggcaggatgattgcttgagatcaggagtttgagaccagcctgagcaacatagcaaaaccctgtctctgcaaaaaaatacaaaaattagctgggtgtgcggtacttgccggtggtcccagctactcgcaaggctgaggtgggaggatcgcttgaacctgggaggtcgaggctgcggtgagccgagatcacgctgctgcactccagcctgggcagcagaacaagaccctgtctcagtagaagagagtgtactagagactaggaaaggtgggggaaggagaagatagggagagatttgttaaaggatacaaaattacagctagacaagaggaatatgttgtcatgttctatagccctgtaggatgactatagccaacagtaatctatagtttcaaatagctggacggaggatattgtatgttcccaaaagaaagaaatggtacatatttgacatgagggatatgctaattaccctgaccggatcactgaatattgtaggtattgaaccatccctgtgtaccccatgaatatgtacaattattatgtgtcaatttttaaaaagtaaattttttttttttaaaaaaaagtatgttcaacagccagcagccacgagaaggtcatcagctggtttcatccacagcaagagattgctggctccaaatccccaccccatcctcaaggggcaatattgcagaaaggaggagggtgggaaaaaaatctcaagaattggagaatcgccggtttccagggcccagaacaagacccaggaggagatgaagatcacccttgcaggtagaagctgtccctgtctgggtagtgctggggacagtaggtggcccttctgctgtctgtctgagcatgagctcaaggccaagggtaagatgaggggaaatgacccccagctgggctgagcgtactttgtttagggtatttaagcagttctcaaaagtgattgcagaacctgtatctcccatctcagggactctgcccagcctcacccctccctccaccccactgtcatgcccacgcttaggcttcaaaacatcaatggaagatgatagtgcagtgcccaactgcaggcccttacatgaataaactgtacatcacagagggggcggcaagggaggggaaaacagacagatccagctcagatggaatttgatctgaaggaaagtgataaagtgaagaagggatctgtcagccctgcaagcggccccaggcacagcgtgaaggggaggcagggagaggtcatgctggcctcagacttggacgctgaaatgtttagttacagccggaggggggacgcctgcataggtcctagggaaaggaggggacacccaggcattggagacccactgtgtagacgactgcgagacatgcttaaatatttagcagaaaggaagagaaattcgaatagagagattcaggaatgggaggaagggatggaggtgaaatcaaagctgtttaaatacagatgctcttcgatttacaattggtttacatcccaacaaacccatcgtaaactgaaatatcttaagtcaaaaatgcatttagaccaggtgcagtggctcacgtctgtaatcccaacactttgggaggccaagtgttggcagatcacttgagctcaggagttcaagaccagcctggccaacacggtgaaaccctgtctctactaaaaatacaaaagttagccaggcttggtggcgtgcgcctgtaatcccagctactcgggaggccgaagcaggaaaatggcttgaacctgggaggcggaggttgcagtgagctgagatcacaccactgcactccagcctgggtgacagagcaaaactcagtcccaaaaaaagaaaaagaaatagaaatataagcataaacttaaataactggggagcgttatgttggctgactgcaacacagatacgaaaaaccctgacagaataaaaagaattctaaccaaaaaggtattttgggccgggcacggtggctcacacctgtaatcctagcatgttggtaggctgaggcaggcagttcacttgagctcaggagtttgagaccagcctggccaacacggtgaaaccctgtctctgctagaaatacaaaaattagccggaaatcgcttgaacccgggaggtggaggttgcagtgagctgagatcgtgccagtgcattccagcctgggcaacagagtgagactccgtctcaaaaaaaaaaaaaaaaaaaaaggtattttggagttcctgtgtccacataatttcatccttcgatctcaccccctattctccccacctctccatcctaaggtcggtgaatactgcgtcggggaaattgacctaaaaaaatttgttatggtctatatattctctgatgagggtatttttctaaaagcaatgaagtcttcaggcttttaaaaggaagggattggggggcgaggggagggagagcatcaggacaaatagctaatgcatgcggggcttaaaagctaggtgacgggttgataggtgcagcgaaccaccatggcacacgtatacccgtgtaacaaacctgcacatcctgcacacgtatcccagaatttaaagtaaaagcaaaacaaaacaaaactctttttaacaaaaggtatgttgattgattggagattattatattacggtcacattttccaagataatatttgataacactgaacaaggagttgaaaatttgagctgttttgtatactagttatgtgactttggataaatcaataaatatttctgaacatcttaaaaaaaaaaaaaagagggatgctgtccatacggtatctgatatatagctcaccctccgcatctatgggttccatatctgtggattcaaccaaccttggatcgaaaatattggggaaacaaaattgcatctgcactcaacatgcacagacttttttctcttgttattattccctaaacaatacgacatagcaggtatcaacatagcatgtgcattgtaataggtatggtaattaacctagagatgatttaaagtctatgggaggatgtgcattgcttatatgcaaagacagttccatcttgtatcagagacttgagcatccgtggattttggtataaccaggaggtcctggaaccaatcctccatggatatcaggagaaattccatttcattaattcgtactcccggtggtctttgaaatgagtcgtgcaacatcactgtcacctgctgtccatttagtgagttactctgggttttttatttaggggagctgaaacacagatttttaaaaaaagtttattttcataaatcgcaataatgtcataaaagctgagtgtgcgtctggggctctttagtccagtagctactttggtatatataatgatggcaaggttgacgtgttttggttttgttgttgttgttgtttttgagacagggtctcgctctgttgcccaggctggagtgcagtggcacaatctcggctcactgcagccttgacctcctggactcaagtgatcctcccacctcctcccaggtagctgggactacaggaggtgccaccacacctggctgatattttgtattttttgtagagatgggtttcaccatgtttcccaggctactcttgaattcctgggctctagcgatctgctcatcttggcctcccaaagtgttgaaattacaggcgtgggccaccgtgcctgccccagatctgtgttttttaaagtaaagctgaatattaattttttccacatacattaatgtattaaggaaaaagttgcaattagtatcttctccagcgttttgtcttctagtatttggggtagggaaatgtagttaattaaaagattacagatgtccttcagtttttttttttttaagctatcaagtttttttactctttttgtagtgcatcttattttattcataatacacctttttgttgaagtatgtcttacttttttatttatttatttatttttttgagacagagacttgctctgtcgtccaggctagagtgcactggtgcgatctcggctcactgaagcctccgcctcctgggttcaagcgattctcctgcctcagcctcccaactagctgggactacaggcatccgccactacacctggctaattttttgtatttatagtagagccgggttttcagcatgttggccaggctggtctcgaactcctgacctcaggtgatccacctgcctgagcctcccaaagtgctggcattacaggcatgagccaccacgcccggcctctactaacattagtagaaccgttgactgtgtcccatatatctatgacacagttatctgcattttctgtcaatctttctccccatacttcagtctactgacctattttctagttaactgatctctttggctatgtctaatctgttgttaaacccacattctagcttcagttattatgtttttagttcaaattaacatcagatttttagttcaaataacatcaatgtagtttcaatactaccttgaaaatttttatctttttccccatcttatttaaagtatttctcacatttaattatagtccatgtctgataaattacatatctgggtttcaggtgggtttggttttgttgtttaattttgcttgctcttgattttcactcatttggtcttttcttgttgtatgatagttaattttttaattgacagccagacatggtaaatgaaaaagaattgcaaagacaatttgtagctctgaatcatattatcataacccaaagaggatttttttttttaattcatgtgatttgatgtgatttgtccataccctgaggtagtttgcccagaccctatctggggctgagctggagggaaattgggcttcagtgtttgtgatgaccagtctatttctggttctcctctcagtgaggtcacaaaagaaagcttgtggtgtgtaccagggtccctcattggtcctgattattaatatttatggacccctcagcctcctagcactgctggcaactctactcagtttctcagcttcccagcctcttatttgccctgagtggaagtaaggtaccaaatgtgacatttacctcttctgtttgtctctggtatcttcactcttaattttgtgctgccttagtagctctctgatgcacttaaaaaaaaaaaaaattctaggccaggtgtggtggctcacacgtgtaatgccagcactttgtgaggccaaggcaggcagatcacctgaggtcaggagtttgagaccagcctggccaacatggtgagacccccatctctactaaaaatacaaaaactagctaggcatggtggcacgtgcctgtaatcccagctactcgggaggctgagacaggagaatcacttgaacctgggagggagatgttgcagtgagccgagatggtgccactgcactccagcctgggcaacagaacgagactccgtctcaaataaataaataaataaataaataaataaataaataaataaataaaattctatatacattatttgtgcagcctttttaggtatttttggcagaagacttagtgtgaaacaacagcttcaccatttgctgaaagtggaaaaaatctcatttcagttcctgagctgatacatatatatttgtatttttagcattcaccacctccagcagtaataactttcacaaatttatagcccataatgcaaaggagtgcttccttttttgctgtaaatgttatctccttggattgtgtactggaacattctgtgtctgctgtctatctgttccctgcctcgtctgcctttacgatgtcctctctcagctttcatcttcccacacagagcattttgttttaagcatctctgcatatctcagcctctttccaatgacctgagaattcttctctggcctgcctccagtttcagagtcccttctttcaaggtgaccccatcttcagtcaggcttttaggggatacatcagtagaatagttattacctaaggataaaaagaaatgcagtttgtaaaagtcacattttatattcatgcattcacaagcttgccaaaaatgttcttaagagcggactttgagattgctgcattctcatcttaaaatttctctctgcatgatatgcaagggggaagtgtctactttttactagtaaaaataatggccatatttattcataaaagttggtttatgtttcggctgttaatattacttgttaagtaagcctctgggtcttgattagaaacattagcaagggctgactgaacttctcttcctcgtttaaattcgtaagattaacacatctgcagaaggcaagctgagaacttgcatcattatttcatcctctgtaatcaaacatataaccccgagttaaatcccttccgaggaaggattatacttcatgatcggccccgtggaacttatttatgtgtttatcgttgggagaaattagatgacagaaacagattgacattttccctaatccatttccaggaatggttttttgagcacttattctttgcctgtctggctgcttcatttatccatcacaataagtgtctgtgtgacatctcactgaaagccccatgactcagagagtcatttctgcaggtccttttccttgatgggtcagtattcaaatccaggacatccctctaccagccctggttgaagaaggaaattattcatttttatgggattcatatggtttatgataatgcagttattgcattcgtcattttttcccaagactcattttggtgttttgcaaggcgcatacccaaatcccgctctctcacttgctagttctcgtatgttgggcagtatctctgtctgcagattaaactttgcagcagtaagagggaaggctcaacctgtctgcctcatagggctgtcgcgattaaaaggaatcagggctgagaagtttatgagtgtcactcagcagccagccatgagcagccactaaaaaaggagtcctgttatcatggttgtctgatatctttgacaacttataattttgtgttacaccataattcttagaacttaattttatatttggattttacatacatagctgagatctgaaagaagaagcccatattttatttaatgttaatttttaaaaatttctctccagctgtattgaggtaccactgacaaataaaaattggtgtgtatttaaggagtacaatttgatgctttgctgtatgtatacattgtgaaacaatcattgtatcaaggtaattaacattttcatcacctcgcataaatgctgttttctcctcctcctcctcctcttcctcctctttctcctcctcctcctcctgctgctgttcttggtaatgagaacacataagatctactctcatagcaaattttaagtacacaatcctatattgttaactgtggtcaccatgctgtatgttagatccccagaacttatttatcttgtgtaactaaaacttcatattcattccttcaccaacatgtcttcattctaagcaccccgcccccagcccctggcaactactgttccactctattcttctgtgagttatttaaagtgcactttcggaggctgggcatggtgactcacctgtaattccagtactttgggaggctgaggcaggcagatcacttgaggtcaggagttcaagaccagcctggccaagatggtgaaaccccatctctacgaaaaaatacacaaaaaaaattagctgggtttggtgatgcatgcctgtaatcccagctactcaagaggctgagataggagaatcacttgaacccaggaggcagaaggttcagtgagccaagatcatgccactgcactccagcctgggtgactctgtctcaaaaataaaataaaataaataaataaataaaatcaattgcactttcgtgattatgagttagaatagtcaaattaaaaaaaaggttcatgattacagtgttctcttttacatcttaaagtttcagtaaatctcactaataatgacttttgggggtgttcagtttttatagataccttttttctatttctttctgtgctcctgttcctctgccttagggcattgcacatgctgatctgctttcacgtgcatttttcagcatgttcttcttcttacttcatttccagtcgttctacatcattggcttctactcagccttcaggcttcattttagatattacttccctaggagtgtctccccctttagaccaggtgaggtctcttgataacattttctttcctagaattgataaccattttctttcctagaattgataaccattttctttcctagaatttctcatggcttgccattttgtatttgttatttgttgattttctgtcttctttgacagtaagcttcatgaaggtgcagatcatatctgtgtaggccactgtttaatcttcactacctacctctccataaacacctgtgaaatgcatacattcatgcctcgattaggagaatgaactggacattctcctaaaagggaatgctaggatcagaaatttgggagctgagtatccgagtgactgatctccaccccagctgacatcactcaaaatctctgggatcatggcctgcgggtctgcatttgaaggattacaattctctgaagttggcctggtgcaggcaagaggggctcatgttgaggctcaaccccatccacccccaagaattccacagtgtgttttcagtgaggatgtcagtgttctcttatctctgttgctcacactcattaagctaactgctttgtgacctgacctgatgggggccccagtgtttggacacaggtttgcttcttgaccctgtatttgtcaaggtaggctagctgctataacaaacagcccccaaataagtaaaagtttatttctcatttgtatcacagccagctggggtggccaaggtatcctctaccccatgcagcctttcagggatccaggatgctcctattgttgtgcaccaccttctagggcagctcttctcaagtgagactccttgggaggattaggcgctgttgctgacggcagccactgtacgtaatgcattaagtaatctcctccccatctagcatggtgttagatatggaccatccttgggagagttgagaaaagagtcacctgatttgttctctgtttggttttattttcttatggaggcccagttcagagagggtggagggatcttgtttttcacctggctggtggtagaagagaggataggaatatcttattcctctcgttgcccagcccagaggtgactcacatcacctcctcacattcactcacatcacctcctcacattcactcaatctgcttgtgggaatcacttccatggtcctgtccaggtgcaaggaggtcacaaaatgcacttagacattagcccgagaagaagaagaaacaaacacaggtattggtgagcatatcaccttgccccagtcctatcccatatcaagttgtatttgcaccatagaggcagaaaaaaatggagtgggtattttcaattaagttgcatttatttgcacgaaggtttgacttaacttgcctttgctctttctttataacagatgatagcttgtcctgaaactgagactcctgccgtgataacgtgtgacccactgtcccagccttcccctcagcctgcagacttcacagagactgaaaccatcttggtattcctcatctatatgacctacacatggccagctctcttattgcttgttattttctcacagggtctatccccattacataccagtgggggcgccataggcttttaaaaattcctcccttttttttttttttttttttttttttttgagtggtttctcccacctggaataagttgtgttataattagtctatttctctattatccaggtggataaggaatctggctgtctgttcgaacttattgtggggttttctttttcgtcattttgttattctcttccactttgcttaaaaaaattaataagaaaaagatacagcgtctatatagcatctatgtctccattaatttttttaaacttttgataggacttgcaccatgtctaaaatcaatattccatgactatggattttattttaattctttttttctctaagtttacccttatgaatctgggcttttattgccacatatcatcagaaaactggctttatggacacccccctgtttttaaactctcaaagagactatcttagtaaaatgcttctgtaggcatttggtataaacaagtcaaatctctctctgaaaatttaacttccatgaattgcataagaacttgtagcatctcctcttgtctgagacttggtggatggctcagaaaaagtgaggggagagaagctgagctatttttagcattcccagaaaagaagatcgagtacagtccatcagtttttttaaaaaagttaattatagtgccggccgcggtggctcacgcctgtaatcccagcactttgggaggccgaggcgggcggatcatgaggtcaggagatcgagaccatcctggctaacacggtgaaacccccgtctctactaaaaatacaaaaaattagctgggcgtggtggtgggcgcctgtagtcccagctactccggaggctgaggcaggagaatggcgtgaacccgggaggtggagcttgcagtgagccgagatcacgtcactgcactccagcctgggcgacagagtgagactccgtctcaaaaaaaaagttataataaagatgaggtcttgctattttgccgaggctggtctcgaactcctgggctcaggcaatcctcctgccttggcctcctaaaatgctgggattacaggcatgagccaccgcgcctggcctcaacccaataatttgattttattttaccccaggataaagagttctccatcatttaggttagggctacagttccctgcagcccaccgcagactaatgatggaatggttatgttttagcagccagcaaataaagtcgaaagtgtctcatccgaggaaaccttcgaaccaagccaggaactccctgctgaggctctcagggaccccagtctgcaggatgcactggaggtggtatccaaattcttccccttgcccaaggctcccggtgggggccatccaccgtcactgaggtcaactgcatgcacacaacagctgttaatttttcagcctcatttaacaaaaaataagaatcggcttccctcttcccctgcctctgattcttctgtcttctctctggcatttgcctggggtgatcggccgactctcttttgccatcttcaagtctgatcatcacgctttttctctctttaaaagctgttctgcagaagggatcaggagggaagttgagggactgtggaaattaatgcgtagcaatccattttctgaaatgaagagattaaaagctgaaaattggagggagtggggcatgctaatgttcgaatccaaatggggcatgcaaataatttcttctttcaggatgaaatgagagatgcatgctttctgttccttcctcttagagatgttttcatcttcaactacgttctctccattgatgcatttaatgaaagcaattgctaacgttttctcttgctctttaagcatgatctaataatgccatttggtctttaagtaacaatcaatacagctctagagctaggtttaggtctagactgaaagttggtattgaacgcatgtttagagtgtgacctactgtgttggctaaatgccttccctggacagtcacccttggagaaaatgtgaacttgtttttctcattcttacttggttactgttcaaatgcagcattttgaacttaatttctagagctgttggttgaggtccaggtttcttataaacatgtgaatgtatcccttcagcatgttccatccttgtggtcatcatttgaggctctgtgaattgaatctgtagttattagtgagtgacagggcatcagtgtgaggttgggtaagacctacgttggacagctcagccatgtggtaggtttgggatcctggatgagttcattactttttctttttaaaaattattattattattattattatttagggacagggtcttgctgtgtagcccaggctggagtgcagtggcatgatcatagctaagcagtcttcctgcctcagccttccaaggaaatggaactacaggcatgggccactgcaaccagctaattttttatttttattttttgtggagttggggtttcactatgctgtccaggctggtctcgaacacctggcctcaagtgatcctccttttttggcctctcgaaatgctgggattacaggcatgagccaccgcgcccagcctgagttcattactttgcttcagtgttcatgaggtggagactgggttgcccacctcacagaattggaaggaggggtattaaaaaggagagtggtatagggaaagccctagttagtgcttggctcataaagatgaggaagatttcggtcattgatttgctaaaccggggcactttgacctcctgtgtgtccacactgtcctctaggggaactttatttagtatcttgtataataccctaattcataacattggagcagcttgttgttttcttggatactcatctcttgttagcagaaatgtcacaatcactgtgctgttttgtcttgaaaactagtataaggttgggtgctgtaggtcctgttaattccagaaacatttcattctcaggaactgaatggatctaaatgcaagtgctcttagaggggagaaatgctgcagtatcctgaagtggactttttaatttatttgttaactcttgctatcaccttaatcaataggatggctgtctttaaataaaatataatatatgggaatgagtgtagaaggcagaatcttatatgtaaaaaccttctaaaaacactgcggcaagtaattagagaagaaagtagtatatgcctatggtgtaaaaactcaaatttatctttctatatatctatctctatacatatcatgtatctatctatctacctcttatctattttctttttttttttttttttgatggagtctcactctgtcacccagtctggagtgcagtggcgtgatctcggctcactgcaacctccgcctcccgggttcaagtgattctcctgactcagcctcccgggtagctgggactacagtcacccacgaccaagcccggctaatttttgtatttttagtagagatggggtttcaccatgttggccgggctggtctcgaactcccgacctcaagtgatccacctgcctcggcctcccaaagtgggattacaggcataaaccaccacacccggctatctatctattttctatcatctatctcatctatatatccattcatcctcacatctagataatagatacatagatatagaagagataaaacataggtagtagatagagatgatagataaatgaatgatagagtgatagatgatagataggtagataggtagagagatattttagataaatagataaatgatagagtatagaacggatggatggatggatggataaatggatagatagattgatagaaagtagataggtaggtagagatcatagatagataaataggtagatagatgatggagtgatagatgacagatgatttattgataaatagaatggatggacagatggatggatggatggatggatgagtggatagatagaacataggtagatagatgagatagatgatagataatagatggttggtagatgagatagatgataaatagatgatagatagatagatagaaagatgtgtgtgtgtctattattgttaccatctttaaatttttaagagtctttttctagttcttggtaagaagtgtttaaagcaaatgtatttgttctttttgttgactcatctgaatgccaaacaaaatgtgtgtgtgtgtgtgtgtgtgtgtgttgttacacacttgcattttcatctgttttttcacatgacccttaagaaggcaggaactctgccattgaaaaaactatctgaattattatttaaattcctttgccaagcagtccaaattcttataggctttacttacaggaggtgagttgttttttcatttaacgtagtttggttattcactgtcatacaaaacagaagttttggtgggtgagagtattaaattagtgtgtgtgtgtgtgtgtgtgtgtgcacatgcgcatgtgtgcatgtgtgtgtttaaaatggtttagtggctagaaatgaaaacaattcttcagaaaaagagaacatatacaattacattttataaaatttcaaaacacttaagcaaaaaaaattatcttctaagcatattatactaaatctagtgtatatttagctcaaaagaaaagtgctgctgggtgtggaggctcacacctgcaatcccagctcactgggaggccaaggcaagaggattgcttgagcccgggaattcaagaccacactgggcaacataatgagaccccatctgtgcaaaaaatacaaaaatcagctgggcatggtgatgtgccctgtagtcccagctactgaggaggcagatgtgggaggatctcttgagcccaggaggtcaaggctgcagtgagctgtgactgcaccactgcactccagcctggacgacagagaccctgtctcattaaaaacaaagtgctagtgattcgcaatctctttttgagaactgagatgcatctttctgcgggaccctacactggatgggttttagcagtctttccctcgataatggacagctgcaaaaaccatctcccactgactgtcttccctaggtcgacctggccgtctctgtttcccagatctccatcgaagagaaggtgaaggaattgagccccgaggaagagaggaggaagtgggaggaaggccgtatcgactacatggggaaggacgcgtttgctcgcatccaggagaagctggaccggttcctgcagtaatccggcagctggtgggcgttgtgtgtagttagacaatgtcctgttgggtggtcctgttgcgtggagatctcctctggtcctttcaaagggaaacgctgttgaaccttgtgcctctatttatgcttaatccatttgagtgcctcacacaaaaaacgtagagtatagaaatccaccttaaagcccctcgccccaacttctccaccaacgccttctgggctttcttcagaggtcacttctacccttgaagctgtcggcaaaagcgagcagtaataacattctagtagactctcgatggtggtctccgctcttgcccgaaggacctctgaagtacgctggagctgtgttgtacaggtgctgtgagacctaccctattcagaattaaacctcactgcaaatttcctcccatcacgaagctaacaacactaatatacgtatttagcacctctgaggctttgccatggagacccatttctgtagggctaaggaaacatttagacgtggtgactgactttcatttggacttggcgaagtgtatctgagaaacacctcggctgtggtctctctgctttaaatcctaacaggacttcctagagcgttgacagaaattctactcgtggacgttgggaagaaagattgtaggtggcttggggaatgtgggtggcttagaggatctaaaccgattcacttcctggttgagaagcaacgagggcttgctctaaatcgtttagaggataacaggatctagagatgctctctgcttgacaacaaaagtcagggtgcagtcggtccacccttgactgctcttggcttggtctctaccctcactacctcagttctcaataacttagtgaatcactgccctcctcaaagccatttccactcagctctttccagagaattctcagttttatgagacgggaaactttatttcacgagaaagcctcattgtcagaagtatcttcattcaatgggcacaatatgctgtgtatctcaccaggtagctgtcaggggccaccgagagtgtcgttaaaaatgggcatggttgtaataaaggaggaaagtgcgacttttgaaatgtttggaaggtttatttctcatgcacattccagggaaaagcagagagtaaattagagacgggataggaaggccgtgggagaactcgatcctagcctgtgtcagctggatgtgtttacgtggagaggcgtggccactttttaggtcacctgaagcagtttagcctttggatagaggaacctgcctgaatttatggcattagtggtggcatttttttgtgtacaagatgtgggtgatggaggggctgtttctttttccgtgtgggtggttaataatcgtcagtctcggagggcgaggctcgtaggatatttcaggtgagtcagggttggatggtcatcggctttcagaaggagaccacgggaatgttcagggaaacaatgtcagcttctctgaggaccagaattcatgttcacgggcagtgatgagttggcttatggagtgagtccagtctggaattccgccgtgcattctagcctgtatcatctcatttggacaaatgctggcacgttgaaattaaaatgttaaaaaacagc

SEQ ID NO: 825 - DNA, 54000 bp, Homo sapiens; identical to SEQ ID NO: 824

SEQ ID NO: 826 - DNA, 54000 bp, Homo sapiens; identical to SEQ ID NO: 824

SEQ ID NO: 827 - DNA, 54000 bp, Homo sapiens; identical to SEQ ID NO: 824

SEQ ID NO: 828 - DNA, 54000 bp, Homo sapiens; identical to SEQ ID NO: 824

SEQ ID NO: 829 - DNA, 14430 bp, Homo sapiens
ctgagctcataaagcttcagtccttgtccacttttattcccatgacttaagtggaaacctgaacgtggtttaacaacttaaaaacaccatgtgctatactgatcaaaacttccaccttcctctgtctttcctcttctttcttcagacctcgcatgatagaaaatcaaagttggtgatttattttttattatgttaaaggtgacagatcttggcttaagaaaaaccagatttgtgactaaagaaaacattttcttggagctttgcattgttctggcttaaatttccttttaaaaagtaactttccgtaagttaaagttagcactttcacaaatactagcagagttactaaatgaaatattaacatcaaaacaaacatgattaacgaagaagtattttattattttgctgcaaagctgttgcttcactgtataaaaatagcaccagcaaatgcagtgtatcgcaaaattaagatagtggtgttcctcatctgacactgtacaagcaacaaaacctcttcacttccagttatttccaatggaaagatcattaagtatttcatcccaaatccaggtatggatacatgcaagttacaatattatataaggcttaagaataacaatgttatctttgaattatgtaatttttataactagtttttaccatggataatttcatgaattctgaacactagagcctagtctaaaaatcataggatattgtgaaaaagacgcatattatatttatctataatcattagaaagttaaagggcattttctttcattagcagtgttaacagtagtttttttttccccatcggtaatactaaaagtttctattctaagtcttctatccaccactaatttaagacaactctgctggcttgcgttatttcatactagtttatttaggagttccattttcactcctcaatagattttatgtatttctcatatgcttcttcactcataagttcatctagttctgaagggttactcagtgtcatcttgatcagccaacctgcaaccaaaagacaaccttatattccacattaactttttaaaaagtcaaattcatccaaaacgtaaaataaatttctgagcgcctcaatcttgtattctttacaaaaaccatacattatttgttcatagaactttaaattttagccttaagaattaaaatacttgtatataacaaatgaaaataattatggctagaatagattccaccataataaattaagaactcttaggttgtaataagcatcagaaaatgacatttaaatctttaagggccgggcacggtggctcatgcctgtaatcccagtactttgggaagcgaaggcaagcaaatcacttgaggctaggagctctagaccagcctggccaacatagtggaaccccatctctaccaaaaccacaaaaattagctgggcgtggtggcagttgcccttgatcccagctactgggaagctgaggcagaagaagtgcttgaacccgagaaggggaggttgcagtgcaccgagatcacgccactgcactccagcctgggcgacagagggagactctgtctcaaaaaaataataaaaataagtccttaaatatatgatccaaatacacaagaccaggtatgtctttaacaaatggaacactaactactgaggttaacgggattagaaagcagtagtaattagaagggctaggtgacagacaaaagagaactacaacctaatcctagctttgccatttatcagccatgagaccctgacagataaatcctttggagcctctattcatctacaaaatagagaaaattgctgttagcttacctgattagattataagggtgaaaatgtgagaaaaccaaaaattaatgcaaaatatatatttttttacctcccatgtcacacaatatgagtggctgctttatgtctgaaaaagtaaatactttgcagatgtttacaccaaaaccaaagaatctacaactgatatcaagaaactgcaaaataaggtaatgcttttatcatcagagatttttttttctttttttgagaaggtctcgctctgtcactcaggctggagtggagtggtgcgatcttggctcactatagactgcagccttgacctcccaggttcaagcaattctcccacctcagcctccctagtaactgagactacaggcacattccaccacagccagctaatttttgtatttctatagagacagagtttcaccatgttgcccaggctggtctccaactcctggactaaagcaatccacccaccttggcctcccaaagtgctgggatcacaggcgcgagccactgcgcctagccagaaatcttaaacataactttaagtattcaactaacctctgtttttcttttaaagcagaacatctctatttagtaccaagaagtagaaaaagatgaagtcacaatcagctaaacttgctttaaattctagataaaatatttactgtagtagtaattccttgagaaatttctagcaacagcttaccatcttcataacaagatttgtttacaagtcctggattttctgcaagagcttcattaatttcagttacttctcctgataaaggagaatagagttcactagcagctttcacactttccaaagcaccaaactcatctaagtggaaaaaaaattaaagaaaacatgaaatgttaaaagtcagttacttgaaaacataaaatacgaaaaagtagattcctgtcatacagctatgattttaaaattccaaatttcttttttttttttttttgagatggagtctcgctctgttgcccaggctggagtgcagtggcgcaatctcacgtcactgcaagctccacctcccaagggttcatgccattctcctgcctcagcctcccgagtagctgggactacaggcgcccacctgccaccacgcccgtctaattttttgtatttgtagtagagacggggtttcactgtgttagctaggatggtctcaatctcctgatgccgtgatccgcccgcctcggcctcccaaagtgctgggattataggcataagccactgcacctggctcttttttttttttttttttgagacggagtctcgctctgtcaccaggctacagtacaatggtgtgttctaggctcactgccacctctgcctcccgggttcaagccattctcctgcctcagcctcccaagtagctaggattacaggcgcgcaccaccacgcccagctaatttttgtatttttagtagagacagcgtttcactgtgttggccaagctggtcttgaactcctgacctcgtgatcaacccgcctcagcctcccaaagtgctgggattataaccgtgagccaccgtgcctggcctacatttctttaattaaaaataaaaccataagttttgtcaggctataataaccacgagaagggtatatattgtctcaataaagtggacctatctgtgtgtcctggacacagtaaataacaaatggtgatgtgcctgaatgccagatgtgtgtaggttcagtaaaactccatgttcttgcaacttagctgtggctcagaaaaaaacaaaatgaaaactttagaatgttccagtgacagtgaagtaccctgtatcagataacaattataagctctgggccaggcgtggtggctcatgcctgtaattccagcactttggaagaccaaggcaggaagatcacctgaggtcagtagtttgaaaccagcctagccaacatggtctctactaaaatacaaaaaaattagccgggcgtggtggtgggcgcctataatcccagctacttgggagactgaggcaggagaatcacttgaacccgggaggtggaggttgcagtgagccgagaccatgccattgcagtccagccttggtgacagtgtgagactccgtctcaaaaacaaaaaaaacggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaaaaaaaaaaaaaaaaaaaaaaaaaaacaaaaaaaacacaattatgaactctgaactactggccaggaacggcggctcatgcttgtaatcccaacactttgggaagccaaggcgggtagatcacttgaggtcacgagttcaagaccagcctggccaacatggtgaaaccccgcctctaccaaaacctcgaaataaataaattaattaatttaaaaaattagcctggtgtggttgtgcatgcctgtactcccagctacttgggtggctgaaaaaggagaattgcttgaacctaggaggcggaggttgcagtgagccaatgtcgcaccatcgcattccagcctgggcaacagagcaagactccgtctcaaaaaaataagaagaaaaaaaaaagaacagtttaaaaaaggctgaaaagttaacagtcttagggaccctataggacaatatcaagtgatatgacgaacatgtctcaaatcagagaaggaaaaaggaatgaagtgggaagagaaagaaatcatgactaaaataagaagtctccaaatttaatcgaaaaaaaattcaatctacagattcaagaagcttggtaaatcccaaaagcagccaaacgtaacacacactgtgtgattcctttcatataaagaataggcaaaataaacctatggtgtagaaacgagagaagaggtcatctatttgactaggaaggtttatttaagtgtatacatttgttaaaactcactgaattgtacacttctggtccatgcatttcactgtatgtagattttacatcaagttaaaaaactacctttagcagaatgtcttaaaagggtattcattagtttaaggatattatctaacatatcgatattaatagactttttttctctcttttttttaaaacggagtcttgctctgttgcccaggctggagtacagtgatgggatctcggctcactgcaacctccgcctcccaagttccagcaattctcctgtctcagcctctgagtagcaattacttttacaccaacctaatacttgggtcaaaagcactctaattggctgggcacggtggctcacacttgtaatctcagcattttgggaggccaaggcgggcggatcactcgaggtcaggagttcgagaccagccttgccaacatggggaaactctgtctctacaatacaaaaattagctgggcgtggtggcacgtgcctgagacacaagaatcgctttaacccaggaggcagaggttacagtgggccgagatggtgccactgcactccagcctgggtgacaaagcaagactgtctccaaaaaaaaaaaagcactctaattaatccagggtacaaacaaattactattcaatgtaaacaaaattcatggcatggatcattctaagatcctaagaacactcaccttgtttgttcaattttgtcccaacttcagggagactacaataaacaacatctcccaacgcttcctaaataaaacaagacaaaaccaaaaatctctaagaagttataactaaaccctccagtaaacagaataagccaaacactgaatcccctataatgaagatttagtatatattttatactggaggggctacattcttgagttttccttaaaatcctttaaacatgtaaaaactactctcagtcaggtgtggtagttcacgcctgtaatcccagcactttgaaaggcccaaagtgggtgttatcacatgaggtcagaagttcgagaccagcctggttgacatggtgaaacccagtctctaataaaaatacaaaaattagctgggtgtggtggcaggcacttgcaatcccagctactcaggaggctgaggcaggagaatcacttaaatctgggaggcagaggttgcagtgagttgagattgcacctgtatactccagccttggcgacagagcaagactccatgtcaagaataaaaataaatggctgggtgcggtggctcatgcctgtaatcccagctcttagggaggcagaggtgggaggatagcttgagcccaggagtttgagacctgccttggcaatatagcaagaccctgttctccaaaactaagtaaaataaaatgattttaaaaaactattctcaactcaggagctgcaagagaccagccgccagccagatctggctcacaggctttagcaacctaacacaagcctcctgccccacacaagactgctagctctttgttttatttggttttgagacagagtttctctcttgttgcccaggctggagtgcagtggcctgatctcagctcactgcaacctctgcctcccaggttcaagcgattctcctgcctcagcctcccaagtagctgggattacaggtgcccaccaccatgcctggttaattttttaaaattttttgctagagatgcagtttcaccatgttggccagctggtcttgaacttttgacctcagataatcaacttgcctcggccttccaaagtgctaggattacaggtgtgagccactgcgcccggcaaacactgctagctcttctgggcatgaacatatttggtgttcttccacctctgtagttttatgtacaccattgcccccaaagcatttgctgaaatcctgctcactgattctacaaatcatagtcctcacaccttgtactccctgaagtccctgactccagaaagaagtggtctctccatcaggtaagtgaattacaaccccaccgttccgatgccatcatgtaatgtttgcaagtcattctcatgtaggtaattcccctcacaaataaactctaggaggtaaggacgacatcttacacaacatctcaaaaactatccaacactgggcctcatagtaggtatacagagatgccaaggaagatataattgtgattatcaacacacaagcatcttacatgtctgaggaattttgtacagtcacgtgccgcctaatggcattttggtcaacaacagaccacatatatgacagtggtcccatgaaattataatatagttagtatcacttgtccaaaatgcttgggagcagaagtgttttggatttcagattttggaatactcgcattatacttaatacatgagcactcctcatccaagattctggaatccaaaacgctccaatgagcattttctttaagagtcacgttggtgctcaaaaagtttcagatttttggagtatttcagggattagagatgctcaacctatgccatatttttactgtaccttttctgtgttttgataggccaagtgtgttacgattgcctacagtattcagtacagtaacatgctgtacaggtttgtagcccaggagcaaaggctgtaccatacagccaaggtgtgtaataggctgtaccatctaggtgtgtgtaagggcaccctaggaggctcacagaaggacgcaatccccgaggaggcagttatcagaacatagctccatcattaagtgacacgagtgcattcccatcagttaacatccccccttccccgcctcacccaatacatacatccagttgaaaatcactgaacacgctaggatttggcttctcattttctcttaaacagtatcgccatatggaattgaggggaatttacagagaaaagatgggctgaataaaagccttccctttgtgtcatctgtgcctattgaggttttctttcttcccgtcctcctggtcacgtgtgtatcactggacccacaaaatggtggcaacaccctgctcttctttttcctctttccttaattgcccagtacaaaacacacacatttccttcttgaataggacatgtttcctactttcagtgttaagcttgcaacatctcttaaaacaccacataatgccctaactaaattatgttttacttaattcaactctggttggttttcttactttctttctttctttttttttttggagatggagtctcactctgtcacccaggctagagtgtagtggtgcaatctcggcttactgcaacttctgcctcccaggttcaagtgattcttctgtctcagcctcctgacgagctgggattacaggtgtgcaccaccaagaccagctaatttttgtattttgcagtgacatgatcatggttcactgcagcctcaacctcctgggctccagcgaccctcctgccttagcctcctgagtagctgggaccacaggcatgagcaaccatgccaggctaatttttttttttaacttttggtagagacggggtctcactttgttgaccaggctggtcttgaactcctggcctcaagcaatcctcctgcctcagcctcccaaagtgttgggattacaggcatgagccacctcacgcagcctaaacacttttaaaaaggtagagataaagcaaatcatgcaagagcacactgggacaaatatttcaatataatccaatacctgtgcaaaattgctgattcccactgttccaatgccattttctgttgttacccattcgtgtttctctgtgaatttacgcactaaaacagaagaccaacatttcagaaaagcagtagcattacttcttaagaagcacttttcattaccattgctttcaaaagactttcccagaatttctgtttgacctgttgacactacctttaaatagtgcatggctcaggaaagaatgaagatcatgtatagagatgacgcatttaaacagcagtaccatttaagcaaagatggcttcatctgaacaccttgtgcatcttttggagattggattatctgctttaacattacttagcctaaatcacaaaagaaaattttggagcatatttcaaatgtatacttaactattactggtctgtcttgcagaaaaaaaaatctgtgcctctgaagacaaatttggggtgatgaggtttagggaggcagcataaagatggctcatataagaaatgatttaacctaaaaaaaaaaataacagtaataatcaggtgcctctttaggcagagttgacctaagagagcttcagtgcagcttgggttacaaagtaaaattttacaggaatgaaactgacctcctggaacaactataatttgactaagttcttaaaattctactttaatcaaattcaagcctaaccttgaagatagcactaccatcgcttaaagaagaaaattaagatcacaactcaacagtcttctcagagctaagccatgggttggtggagaatcaagctctgctcaccactcactggacaggttcagccctcgacttactgagcacttctctaaagatacggtcaaacgattcagggaatcctgaaagaaggaccggccaatgttcaagagtaaaaagagttatttaggatataaagttaaaagtacttgccttagagaataatattttttaaaaagcatatgctatattaaatacagttcatattctgacaccaagtatttttctaaaaacaatgcaacgtaagttcatagaaaaatggttaactcaaatactgttttaaagaggcctcactggctcattttaccccttacccaaaggatagtagtacttaaaacagcattcaattgctttggttacagctctgatacgcagcacaacgtaagtagagtgtataattattatttttattttttatttttgtagagatgggggggtctatgttgtccagactggtctcaaattcctgagctcatgatcctcccacctcaacctctcacagtgctgggataatagtgtgtgagccaccgtgcctagccaagtatataattcaatattgctttcttttccccttaattatgaaactttctaaagttcataccccttcagtggaagaagtcaaaaaatgtgtcactaagaaatttattttgcttcattccacttcaaagaactgaatgtttcaggtcactctgacgttcaggtaagaaagtttaagatgtgtacactgtgttttgactgaaagactctccctaccatctttactaactacttccggtctagattcagaagtccgttcctgcccaaaggcttgtctaaccaagtctaggttcttaggccagccaacatgctcttacggcaccctgtaccactatcccccagcacacacacggtgctgaacatactagagatcatctgtcagtctccccaggaagtaggctgtgtacccaccaagaaacagcaaggtttatcttattttcatttgttttcccaattttaaatacagtgcttgccacatagcaagcactcaaaagctgaaggaatgaaataattttttttttccttaaattatcatgtcgcaggccaggcacagtgactcatgcgtgtaatcccagcactttgggaggccgaggcgggtggatcacctgaggtccggggtttgagaccagcctggccagcatagtgaaaccacatctctactaaaaaaatacaaaaattagccaggtgtggtggcacactcctgtaatgccagcgacttgggaagctgaggcatgagaattgcttgaacccaggaggcagaggttgcagtgagctgagatcacgccactgcactccagcctaagcaacagagcaagactcagtctcaaaaaaaacaaacaaaaaaaatccctgggcgtggtggctcatgcctgtaatctcaacactttgggagaaaaatatatatatttttccccttaaattatcatgttgcaggccgggcacagtggctcatgcctgcaatcccagcactttgggaggccaaggcaggcggatcacctgacgtaaggaggtcaagaccagcctggccagcatggtgaaaccaagtccctactaaaaatacaaaaattagccaggtgtagtggtacacgcctataatcctagctacttgggaggctgaggcaggagaatcacttgaacctgggaggcggagattccagtgagccgagattgcaccattgcctgggcgactagcgaaacttcatctccaaaaaaaaaaaaaaaaagttgcagaatgacgtgattttttaaagtttattaagaggattctgaggaaaatagatagtatatagttatttgtctttaacacttaattctctcactctgctacaaatcgccggttatatgccaattatgagcagtttgaagctaaaacaccttttcaaagtaagcactggacaactataaacaccacctgagactaccttctttgaccttgccatcttgcctacctgtgaagataattttaggagtaaggctgctgtgaccctcattttagcaaccgagcaattactaattgtaattagtacaattctccttaacaaggagcagttagtgtctcaaacatttgggtgtaaagaaaattgttggccccaagtttagagggagacggcaacattacaggtaatgttacccctcagtcctggccaacagcagtggctctcgcctgtaatcccagcactttgggaggccgaggcaggcagatcacctgagatcaggagttcaagaccaccctggccaacatggtgaaaccccgtctctactaaaatacaaaaaattggccgggtatggtggcgggcacctataatcccagctaccctggaggctgaggcaggagaatcacttgaacctgggaggcagaggttgcagtgattcaaagacctaagtctttattttactaagcatgctgtttaggctaaaggcaatgattagtacaattctcctttaacccttggcccgacaggaagaagtggatagattaggtaaataattactttctttttttgagacagagtctcactctgtcgcccaagctggagtgtagtggtgcaatctaggctcgctgcaacctctgcctcccgggttcaagtgattcggcctcatcctcccaaggagctgggattacaagcacgtgccaccacgcccgactaattttttgtatttttggtagagacagggtttcaccatgttggccaggctggtcttgaactcctgacctcaggtgatccgcccgcctcagcctcccaaagtgctgggattaaaggcatgagccaccgtgcctggacaataattactttctaactgggccttgaaaaaggtggtttttggcctcggaaaattaggagttgtgagcaatttatgaaaattttgcattttcctttttcaatgtcactagtcagataaaatattttatattagtattagtcaatttttcttctcttttttttttgagatggaggtgtgctcttgtcgtccagctactccacaggctgaggcaggagaagtgtttgaacccgggaagcgaaggttgcagtgagccaagatcctgccactggatgccagcctgggcgacagagcgagactccatctcaaaaaagaagaaaaaaaaaaggaacgaaaaccacagacttgaaactaaattcttatctgagaaatgctttacctttgtattcaaattagtgatgtagggatccctatcagaaacagagcggacagactattagcaagacagcataagtaaatctttatgctacaaattttggaataaatttatcaaccattccagctccaaacaggtttctaaaacaatgagctaatgagacaagagccatcactgatctacgcaatcgaagcagaggagcagtcagtgtatcaaacatttgggcgtaaagaaaattgttggcctggcgcggtgacgcacgactgtaatctcagcactttgggaggctgaggcgggtggatcacttgaggtcaggagtttgagaccagcctaacgtggcgaaaccctgtctctactaaaaatacaaaactcagctggaggtggtgacgggcgccagtgaacccagctactcgggaggctgaggcaagagaatcgcttgaatctgggaggtggcgcttgcagtgagccgagatcacgccgctgcactccagcctgggcgacagagcgaggctccgtctcaataaaaagaaaaaaaaaaaaaaagaaaattgtttttcccctgcaataattgtgctgaagtagcacaaatggccgaaacattcatgggcaggtttcccagttatttcaagtccgtttgagttagggctcatttcagcaagcacacacatgaatgatccaatacaaactttagcagaacttctgttgagtccagaagactttatcttacttgttttggggaaatagctgaatcttcaaagttatgattgttttatctagtaaaaaaatctagatctggcgctttaatttttttttttttttttttttttgaggtggagttttgctctgtcgcccaggctggagtgcagtggcgcgatctcggctcactgcaacctctgcctcccaggttcaagcgattctcctgcctcagcctcccgagtagctgggattacatgcgcatgccgccacgcctggctaattttttgtacttttagtagagatgggatttcaccgtgttagccaggatagtctcgatctcctgacctcgtgatccgccctccggcatgagccaacgcgccctgcctggtgctttaattttaataagcgcttctgttttaattttacttcggagttctcagtaacggtccatttagtaaactaaaggcctccccatttggggtctcaacgatgcacgcagatgggagataaacttaaggccaccgagacgcttaagcgacacgtgcctggcttctgcagcaagcggccgacctgcccgccggacccgccgggccacccccgcctcggtgtcccgcaggcctcccctcccggctgcatgcaatccctagggcaaaggctactcgcgggtcctcccgctacttaagggggagaagcggccgcagagccagggatcccaacagaaataagaagggggcagggtccgcgctcgctccgccccggtggctcaggagcggtgccccggcgtcctccgtgtcccgctgggcccgggacaagcagcccaggcggggagggagcagccgcccacgtgcccgccgcgcttacccgagagcagagcgggtccagtgcgcagcgtacggacggcgcccacccccagctgccagggcctcggcgggcagggcgcggcgggtgacgggaccgcgcgcagggtgcagagcagggcccgcacgctccgcaccactcgcagcgccatgttcgcaggggtgcgggggtcgcagcgctacgcctcggccacccgcgccgggaggcggggcggggaggggcagttcgcggccggagggagccggctg

SEQ ID NO: 830 - DNA, 14430 bp, Homo sapiens; identical to SEQ ID NO: 829

SEQ ID NO: 831 - DNA, 43829 bp, Homo sapiens
gatgagcttctcactcacgttcaccgagctggccaacatcgccatcccacagtgcggggtgctgaacttcaaggccctgcacctcctgctgcacggcatcttggagcacatccacatggccgagctcaagaaagtcctctcaggcgatgaggacttcctgcagacctcgcaggtggtcatcatgcccagggaaggagacgcccagcctatcctcaaccccatgaagaggctcagcaatgtcttcgaccacgtggtgagccgcctcgacaagttggagaaccagctggccctgctgcaggacctgccctccactgcccagctgctggaagccagccagggcactgcccggcccgtccaggacctgtggcatctgatcaagctccggaagatggtggagggtcatgatgaagtcatggccaaggtacgcccccagcctccagacacttcttttcctcccttcaccactggctctctcctgggacgtcttttttttgtttttgagactccgtctcgctctgtcacccaggctggagtgcagtggtgtgatcttggctcactgcaacctccgcctcccgggttcaagtgattctcctgcctcagcctccctagtagctaggatttcaggcacatgccaccacacccggctaatttttgtatttttagtagagatggggtttcactatgttggccaggctggtctcaaacccctgatctcaactgatccacctgcctcggcttcctaaagtgctgggatgacaagcgtgagccactgcgcccagccttctcctgggacatcttgttgcttactcacctacgatgggccatctccttatgcagagtgggaagaagggtgctttagagtcaggcacaaccaaaacgccaagcttgcagcctccatcaagtattgcaaagaagccagacacaaaaggctacccagtgtatgattccatttatacgaaatgtccagaataggtaaatccatggagacagaaagcagtggttgccaggggcttggaggaggagagaatggggagtaattgctttgtggatatagggtttccttttggggtgatgaaaatgttttggaactagatggaggtggtagttatacaacctcactgatgtactaaatgacactgaattgttcacttaaaaatggctaattgtacattatgtgaatttcaccccaatttttttttgagacagggtgtcactctgtcatccaggctggagtgcagtgactcagtcatggctcactgtagcctcgacctcccagactcaagcaatcctcccacctcaacctcccgagtaactgggaccacaggtgtgcaccactgcacctggctaatttttgtattgtttgtagagatagggtctccttatgttgcccaggctggactcaaactcctaggctcaagtgatcctcctgctttggcctcccaaagtgctgggattagaagcgtgagctactgtgctcagccttaccccaatttctaaaaaatgcctggaggagctaccatgggagaagtaccagagtagtcacggtgaacaggcacgcccggcctagcaggggagatagacacaagtgagtgagaatctccaagaaccagccctgtgaggagcagcaaagaggcattccttctgccttacagaagaggaaactgacgctcagaggagctcagtgattggctgaaggcccagcagctggtgggcaagggagctgcgcgctgaggcgtggcctctgaccctggctcacctttgactgctgacccctgctaaccccgaccagcacgtggacagtgttcagttactggcagcccaagaagaaataagaaagggaaaataagccgagcacagtggctcacacctataatcccaacactgggaggccaaggcgggatgatcacttgagcccaggagttcaagaccagccttggcagcgtagtgagacctcatctctataaaaaaatgaataaattagccgggtgtggtggcgtccacctgtagtcttacctcaggaggctgaggtgggagaatcacttaaccccaggagttggaagctgcagtgagttgtagtcactctcctgaactccagcctgggggacagagcaagcccctgtgtctaaaaatagtaataataatttggccaggcacagtggcgcacacctgtaatcccagcatttcgggaggccaaggtgggtggatcacctgaggtgaggagttcgagacaatcctggccaacatggtgaaaccctgtctctactaaaaatacaaaaattagctgggcatgcttgcgtgcgcctgtagtcccagctactcgggaggctgaggcaggagaatcgcttgaacccaggaggcggaacttgcagtgagccgagatcgcaccactgcattccagcctggtgacagagcgagactctgtctcaaaaaaaaaaaaaaaaaaaaaattagccaggtgtggtagcaggcacctgtaatcccagctactcgggaggctgaggcaggagaatcacttgagcctggaaggcaggtgttgcagtgagttgagatcgcaccactgcccttcagcctgggtgacggagaaagtcttgtctccaaaaaggagaccatccagcgatgactgccttcctatccctggaggcagcatgtcctagtcctctctgagccagaactgtgcccgttggtgtgtccagctggatctccctgggagtcagggccattttcagagcgttcccaagttaccactcttctctttcaaattgaggggaaactggctggatgtggtggctcacacctgtaatcccagcactttgggaggccgaggcaggtgggtcacttgaggtcaggagttcgtgaccagcctggccaacatcatgaaaacccgtctctactaaaaataaaaataaaaaaaaattagccaggcatggtggcgcatgcctggaatcccagctactcaggaggctgaggcacgagaatcgcttgaaccctggaggtggaggttctagtgggcggagattgcgccactgcactccagcctgggcaacagagcaagactccatctcaaaaaaaaaaaattaaaaataaataaataaattgaggggaaattgacctaacataaaatcaaccatttaaaagtggacattaaacactgaattaatgaaaattcggtggcacacgatatattgacattgttgtgcagccagccacctctatctagttctaagccatttccatcaccctgaaaggaaaaaaccctatttcccctttacttctcctccctgcaacccctgacaaccactaatctgctttctgtcttacggatttgcctattctggacatttcatctaaaggcataatctgtgtatttcatagagacagaaagtagattagtggtttccagaggctcaggaaggggggaacagagagagactgtaacagggacgggatttccttttaggagaatgaagtgtcttggaagtagatagtggtgtacataccaaatgccctcaaattgcacacttcatttttattttatttttatttttttgagacagagtctcactctgtcatccaggctggagtggactggtgcaatctctgctcactgcaacctctgcctccaaggttcaagtgactctcgtgcttcagcctcctgagtagctggaaatacaggtgcgcgccaccatgcctggctaatttttctttgcatttttatatatatgtttgtttttgagatggagtctcactctgttgcccaggctggagtgcagtggtgtggtctcagctcactgcaacctctgcctcccaggttcaagcagttcttctgcctcagcctcccaagtagctgggactgtaggtgcccgccaccacacccagctaatttttgtatttttagtagagacgcggtttcaccatgttggccaggatgatcttgatctcctgacctcgtgatccacccgccttggcctcccaaagtgctgagattacaggcatgagccactaagcccggccaatactaaaatatttttatactttaatattatgggtattttaccacaaaaaaaagcagagattggcagaatagataaaaaacaaacaaacacacaaaaaaaaaacatgacctaactactatatgaggtttgcaagagacacatttaagattcaaagacacaaatagggccaggcacagtggcatgcacctgtaatctcagctctttgggaggctgaggcaagaggatcacttgagcccaggagttggtgattgcagtgagctctgatggccccactgcactccagcctgggtgacagagtgagatcctgtctctacgaaaaaaagacaagacacaaatacgttaaaagtaaaatgatataaaaagatattccagcggggcacagtggctcacccctataatcccaacactttgggaggctgaggtgggtggatcacctgaggtcaggaattcaagaccagcctgaccaacatggagaaacccgtctctactaaaaatacaaaattagtcggatgtgatggcacatgcctgtaatcccagctacttgggaggctgagaacggcttgaacctgggaggtggaggttgtggtgagccgagattgcgccattgcactccagcctgggcaacaagagctgaaactccgtcaaaaaaaaaaaattagcctggcgtggtggcgggagcctgttaatcccagctactggggaggctgaggcaggagagtcacttgaacccaggaggcagaatttgcagtgagccaagatcgcgccaccacactccagcctgggtgacaaaagcgaaactccatctcaaaaaaattaaaaaataacaaaagatattccttgcaagcagtgaccagaggagagtgggatcttctcagacaagatagacttcaagacaaaaattgttactagagacagggctgcctggggtggctgagggcaagttatgagggccttgcaggcaggatgggcagataccaggatccaaggtgccggcactccagaggcagcttgccccctggcctgccttgatggatgaaggcttctaaaaagcagctcaacagggcaacccacccagctcacaaaaggggctcgtggacaggttcagacctagctgtacagccttcaggactgtttgtgcagctaaggaatgtccccatcattagagaatcttgccttgtcccagcctgattgaagttgcccgaggttcccacaatgacccattgaagggggttgccatggcagctggttctagaatgatgcaaactgcacagctaactgtctgcacccaccaactagtgaggctgccggggggtcgcctggcaaacaaacgtgttttacaatgttcctttcgcgagtcccagtctgcctccttcaggcctcggtttttctcccctgtaataataacctcttgcagctggcctcacaggcgaaaacaagggatgatgtcagctgtttgttgttgaaactgtttcgtctaaccctgtttccataacattgtgggtccaaggcttagggtatttttttaaattgtagaaaacctttaacttattggtctttttgagggaatgagatgcatcgccactgcattacaactaagccattaatcctgtagcttcatcaacattaactggttcactttcatgatgccaatggggaatcagttctttctacagatgttcaagagaaaagattgccaggtgtggtggctcatgcctgtaatccccgcactttgagaggctgaggtgggaggatcgcttgagcccaggagttcaagaccagcctgagcaacatggcgagactccctttctaccaaaaaattttgaaattggctgggcatggtggtgcacctgtagtcccaggtactcaggaggctgaggcaggattgcttgagcctgggaggtcgaggctgcagtgagctattattaatattacagcctggacaatggagcaagactgtgtcaaaaaaaaaaaaaagagaaaagccttttgagaagagtgcaagttcttttatatatttacaaaacctttattcactcaatttttttgtttgtctttattttttaagattgtattacttgattttattttacactaggtggtgggcacacaaagcaatccttaataaagttgacaattagcttcattcaacatttttaataatgcacatataaaaaaagtattcatcttacaaattcttctgcaatccaaacatataatagcttggagaacatttagaaaacaaaagccaatgtaaaaagacagattaaaacaactagaacagtacaggttttatttatatggctcgaattttacaggtttcttactgtatcatcagtgtcagaaatctgttctgtcagctggctccattgttctggatttaaagaaataccttttcttcctggtttcatttcaccttcaggatccatccaatattctccaatatcaattagcactttgcctttaaaatcttgaacgccaacgtacctcattttcccaatctgaaacatgttaccatctctgctgctgctcctctgtcagaagatgacagagctctccaagtttcgcctgtcttttgcttctttacaggtttttctggagcaacttgctttttcctctttaagtttttgtcaacctcactgtcagaatcactgccagaagagtttgaagaaacaagttcctttgctttaggcatcgcttcgctcggctctagcagtggaacaccctcttgctcgttcgctcatgactgactcgtttgtttttatttttaaggcagggtctcactctgtcgcccaggctggggtgcagtggctcgatctcagctcactgcagcctcaacctcccgggctcaaccctggaggcaatcctcccacctcaacctcctgagtaggtaggactacaggcctgtgccaccacactggctaatttgtattttttgtagagacagggtgttgccatgttccccaggctggtctcgaactcttgagctcaagtaatcctcccacttcagcccaaagtgctgggattacaggcttgagccactgcgcccaccctctgttaaccttttttttgtttgtttgtttgttttgagacggagtctcgctctgttgcccaggctggtgggcagcagcatgatcttggcttactgcagcctctgcctcctgggttcaagcgattctcctgcttcagcttcctgagtaactgggattacaagcgtgcaccaccatgcccagctaattttcgtatttttagtagagacggggtttcaccatgttggccaggctggtcttgaactcccgagctcaggtgatccacccgcctgggcctcccaatgtgctgggattacaggcatgagccactgtgcccggcctctgttgacttttaaatcataacatttgtcttaagactagtggtaactgccaggtgtggtggctcccacctgtaatcccagcactttcggaggccgaagtgggcggatcacctgagctcaggagttcaagaccagcctggccaacatggtgaaatcccgtctctactaaaaatacaaaaattagctgctagtcgggaggctgagacaagagaattgcttgaacctgggaggcagaggttgcagtgagccgagattgcgccactgcactccagcctgggagacaaaatgaaactccatcttaaaaaaaagaagaagaaaagattagtggtaactggttttgctttgtttttagccttaaagtgtttttggctggctttgtgaagtccattcgtggacttctgccctcctaatttgttcttggccattgtcagacttggttggatatgtgcacgcagcttctgcagctcaggtgatgccatctgcatgcactgggtccaggaagtccccgggagagggatccagtctaaggggatgctaacaacctattgttgctttctttatttctaaacaccctccccattttactccctcagaaactacaaagcacctgctgtatattgtacaggttaaaatgatgtcacatttaaattggatttttaaggctgggcgtggtggtttacgcctatgatcccagcactttgggaggctgaggcagaaggatcacctgagctcaggagttccaggccagcctggccgatgtggcaaaaccttgtctttactaaaaatacaaaaattagctgggcatggtggtgcgtgcctgtagtcccagccactcgagaggctgaggcacgagaatcgcttgaacccgagaggtggagatttcagtgaaccgagatcgcgccgctgcactccagcctgagcgacagagcaaaactccatctcaaaaacaataaataaaatacaaataaaaattgggtttttaactattttgtaacattgcttaaaggtgtggaagacactttggggtgttagaggaccaaggttgccatgattgcagtaatggtaacgaacactcagatgtcattggtgtcaccttcacagtgtcgtgaagtgctcttacattcctcgtttccgtggagggaaatgttagcattcctgttttccaaagtcccacatgtgaccgtgtggacaagtctagctgcttgtctgagggggtgtttgccttagcccctttttcaggcctcttaaggcctttgtaagtactgggccctagctgaaccccagcatccttaaagccctcttgagagagagagagagcaggtttggacaagccctgcctcgaggactatggcatgggtcagcttctggaagggcaactgtcggggacgcactttcccttgaactcagcaccatccaagccctgaatgtggcccagtcaccctgggcagaaaaaagacctcagccactttccccacagctctctctcctgccccttcttccccaggacaggagtccagagcatgtcccctacatgtgagacagcaggtgggtcttgggtgagaaacctctcactgcatatcacacagagggggaggttgtagtaagctgagatggcaccactgcaatctccacgcaagatgcagggagtctggctctggcgcccaggctggagtgcagtggcacagtctcagctcactgcaacctccacctcctgggttcaagtgattcttgtgcctcagcctcccgagtagctgggattacagctgcccaccaccacacccggctaatttttgtatttttcgtagagacggggttttaccatgttggccaggctgatctcgaactcctgacctcaggtgatctgcccactttgtcctcccgaggtgctgggattacagacatcagccaccacacccagcctcgtttctaccttttgactgttatgaatatgctgctataagcattcatgtacaaacttctgttttgtttttagggacaaggtcttgctctgttgccctggctgaagttcagtggtgccaccatagctcactgcagcctcaaactcctggtctcaagcgatcctcccatctctgcctcccaagtttctgggactacaggcgcttgccaccatgcctggctaatttttaagttttatgtagagatgtggtcttgctgtgttaacagcccacgctggtcttgaactcctgacctcaagcactcttccaccttggcctccgaaagcagtcggattacagacgtgagctaccatgcctggcccatgtgtgcaagtttttatatggacctatgttttcatttcttttgggaatatacctaggattagaatcagagatcatctggtatctctataatcttgtgaggaactgccacactgacttctaaaatggctgcacaatttacattcccagcagcagtgtatgagaattacgatttctccttatggttaacagcacttagtatctgactttcgcttctgaccatcctacagagtttgaagtggtatctcattgtagttttgattttcatttccctgatgacgaatgatgttgagcatcttttctttttatgtgcttattggccatttacacatcatctttggagaaatgtctattcagatctttgcccatttttaattgggttatttgtatcattgagttgtaagagttctgtatatattctgcatatactgggtcagatatatgatttgcaaaatgaggttttctcccattttgtgggttgtattttcattttcttgctggtgtcttttgaagcacaaaaggtactttttattatgactttaatctcttcacttgttttaggtttactcggattgtctatttctgcttgagtcagttttaatgattttctaggaatttgtccatttcacctaaattatataatttgtccacaggcaattattcatagtatttctttataatcctttttatttctgtagagttgatagaatgccctctctttcatttctgattctaataatttgagtctgattcttggccaatctagctaaaagtttgtcaattttgttgaccttttcaattaaccagtgtttagtttcattgatttttctgtactatttttttatcctctatttcattaatttcaccatattctttgttattttcttatttctatttgttttaggttcagtttgcttttctttgttccagtgtcttaaggtggaaggttaagttattgattcaagatctttctttgttaatatagtcacttacaacaataagtgttctaagtgtctaatcaccactttagctgcatcccgtaagttctggtgtgttgtgctttcattttaactcatttcaaattagtttctaatttctatttctattgtgatttcttctttgacatatttcttttctttttttttttttttttttttgagatggagtctcgctctgtcacccaggctggagtgcaatggcgcgatcttggctcactgcaagctcagactcctgggttcacgccattctcctgcctcagcctcccaagtagctgggactacacgtgcccgccaccacgcccggctaatttttttttgtatgtttagtagagacggggtttcaccgtgttagccaggatggttttgatctgacctcatcatccgcccacctcggcctcccaaagtgctgggattacaggtgtgagccaccgcgcccggccttctttgacatattccttttgtgatttcttctttgacatatttgtcatttagtagaatgttttttaaatttttacatgtttgtgaattttcaatagtttcttctgttgcctttttttttttttttttttttttttgagatgaagtcttcctctgtcaccaggatggagtgcaatggcatgaccttggctcactacaacctctgctcctgggttcaagcagttctcctgcctcagcctcccgagtagctgggactacaggcacgcaccaccacacccagctaatttttgtatttttagtagagatggggtttcaccatgttggccaggatggtctcgatctcctgacttcatgatctgcctgctgtagcctctcaaagtgctgggattacagatgtgagccaccacgtccggcctgtttttgttttttgtttgtttgtttgttttaagccctgtctatgggagccattggcaatccaagaacttttttattttatttttgaattatagagacgggagctcactatgttgcccaggctggtctggaactcctgagctcaaatgatactcctgcctcaagctcccaaagtgctgaattacaggcatgagccaccatacctggcctcttctgttgctttctaatttaattccattgtggtcagagtatgtattttgcataatttcagtccttttgaaatttgttaaggcttgttttatggctttaccatatggtctaccctggagagtattctatgtgcatttgagaataatatgtattctaccattgttgagtggggtattccgtagatatctgttatgtctagttggtttatactattgttcaaatcttctcttttcttgctggccttttgttttgttaattttatttattttatagtgacagggtctcccttggttgcccaggctgctctggaacccctgggctcaagccatccttccactgcagctacccaaaatgctgggattacaggtgtaagccactgaacccagcctcttgctcttctttttttctttttcttttctttttaatttttttttttttttttgagacagagtctcactctgtcacccaagctggagggcagtagtgcaatcacagctcacttcagcctcaacctcctgggctaggaagatcctcccatctcatcctcccagggacctgggactacaggcatgcaccaccacgcctgtctaattttggtatttttttgtagagatgggagaccgctatgttgcccaggctggtttcgaactcctgggctcaagtgatccacctgcttcagccccccaaaatgctgggattacagatgtgagccactgcacccaggatactgttctttttatctcgggttttgttttttcgagatggagtcttactccatcttgtgtgacttactcagatggagtcacacaggctggagagcagtggcataatcttggcttgctgcaacctctgcctccggggttcaagtgatcctctcacctctgcctcccaagtagctgggattacaggcaaacactaccacgcctggctaatttttatatttttggtagagatggggtttcaccatgttggccaggctggtctcaaactcctgaacttcagatccactggcctcagcctcccaaagtgctgggattacaggtgtgagccaccatgctggaccttccttatcttagttattctattcattactgaaaataggaaattgaagtctcaaactattcttgttaattaactatttctccttttgtaactgagtacccccatttttctaaaagatagtttattttaaaaattattttctcttcctttctccttccccactgctccccacttcctacttagccctttagaaatgcaaagagaggcctggtgagttggctcatgcctgtaatcccagcactctgggaggccgaggtgggtggatcacttgaggtcaggagtttgagatcagcctggccaacatggtgaaaccccattagcagggcgtggtggtgtgcccctgtagtctcagctacttgggaggctgaggtgggagaatcacttgaacccgggaggtgaaggttgcctaggtgacagagtgagactctgtctcaaaaaaaaaaaaaaagaaggcaaagatagtctttgacccctccttcaccagtcactccctacagggcaagttcatgtaactcctggagagttaagaaacagacttagagaccaaagcacgccccttataggactttcacctgggaacttccactctccagggattgcctgagagctcagtctcaccaggaggacatgttgaaagcgtgcccatggccacttttacaacttacttcttcccaggaaggtgccaactcagctgcccagtagataagacatcacgctcaaaaggagacccctgcccttgctggctgtatcccctacgtcttaaaagtgcccactttttctccagaagtgaagcggcacgtttaaagccagggcgctttgtgccccttccccaagctagaacttttttattttatttttgaattacggagacgggatctcactatgttgcccaggctggtctggaactcctgagctcaaatgatactcctgcctcaagctcccaaagtgctgataattcggaataaattcactttctttttggtaccagaccttgctcatggtaactgaaccctgcaatgcagcgagcaaccaacgtgcttttcagttacactttcagttctgtcagtgtttccttcatgtattttataaagggctctgttaagtgcatgtatgtttataattattatatcttccagatagtttggccctctgagtggaaaaaaactcagtttctttcacactgttctcacaacacgcttttttttttttttttttttagatagagactcacttcgttgtccagtctggagtgcagtggtgcgatcttggctcactgcagcctctgcctcccaggttcaagtgattctcctgccccatcctcctgagtagctgggattacaggcacgcaacatcaggaactgctaagtttttttgtatttttagtagaaacagggtttcaccgtgttggccagactgttatcgaactcctggcctcatgttctgcctgacttggtctcccaaagtgctgggattataggcatgagccaccgcgccaagctcgcaacacacttctgacaccagatgtgtgaggatttctccctacagcaagcaataatttctgcaggcagcctgcttccccttttgccctccagagccaggctccacaggagcccgagagatcctttaaaatgtaaatacagaccgggtgctgtggcactttgggaggatgacgcgggcagattgcttgagctcaggaattcgagaccagcctgagcaacgtggtgaaaccccatctctaccaaacaaaaacaaaaacaaaaacaaaaaaaattagctgggcgtggtgatgcacacctgcggtctcagctacttgggaggttgaggcaggagaatcacttgagcccaggaggtggaggttacagtgagttgagatcgcgccactgcactccagcctgagccacagagtgagactccatcttagaaacaaaaagtaaatgcaaccctgtctctcctgctcctgatcctccagtggctcctacccagggatgggctgtgcttcctccctggctgacatctatcatagaagaaagggcgtgagatgcttcatgacgagtaactcctggtttctggatatattcaaatacagagttgcctccttctcatccaggccacttggagatgagagcactgttgactttagtagcatctcctggtccccttgtaggttccagtctaggccttgggagagccaagaggacctcttgaacaacggctatcatcagaaagcttctgcacttcacttaccttctcccccagccatacccggcttcacattttctcctcctcttttgcagtcaatgcagaccctgcaggacttgctcactgatcttcatgcactccaggtcaccatcacagccctcagaaaagaagtggacatgctgaagaacatgcttgacaaggtaggccctcccccagcatcctccatgccagctgcgttgctcaggcctctgggggttggagcaatgaggaaaatctaggaagcttactgttaggccaagagtgcagctgtgagggtgtggtcatgtggaccctccaattggccagtgccaccgacttctctgtgacccctccatgctttcttttcttttcttttttttttttaagacagagtctcactctgttgcccaggatggagtgcaatggcatgatcttggctcacggcaacctctgcctcccgggttcaagtgattctcctgcctgagcttcccgagtagctgggattacaggcacgcaccaccacatctgggtaatttttgtatttttagtagagacaggggttcatcttgttggccaggctggtctcgaacttctgacctcgtgatccacccacctcagcctcccaaagtgctgggattacaggtgtaagccaccatacctggccgacccctccatgctttctaccccagtgtgttaaaacgttagttgtaagtgacagaaatcacgttcatcctggattaggcaaaataagggatttattgtctcatttactaaaaggtccagggacggccagatctaggtactcatgcaatacttatatttctttttttttttgagatggagtctcgctctgttgcccaggctggagtgtagtggctcgatcttgactcactgcaacctccacctcccgggttcacgccattctcctgtctcagcctcccgagtagctgggactacaggcgcccgcccccatgcccggctaattttttttgtatttttagtagagatggggtttcaccatgttagccaggatggtctcaatctcctgacctcttgatccgcccgcctcagcctcccaaagtgccaggattacaggcgtgagccaccacatccggcaatactgacgtttctcagtgaaactttcctcccagttggcttcattctcaggcaggtgctcctcaagtcttggcaacagcagacttatattccaccaacctagcaaaaagaaaacctcttccccttctggaaagctctgtccacatggaaagtggaataatcataatagtgcaggcatacatacaagctccttctgtacttctgtagccaaaaaccatcagccaagtattttctaacaccctaccatgcatggaaggacatggagtccccgagacatgaggcagctgtccccgtcacaactgatgagtcacagctggggtctgaagccagctctccacacccccaggtttaacaacttcccccaaatagtgtaattttctgtatcatcccggcttcacagatcagggcctgtatttgatcatcatggcaactgtgggagctttaggcatgggctggatggctcccatctaagcagaaagaacgctgttaaaagctgcatcatgagctactcaaaagggccccttagacaaagctgttggagaaaccatgccttctcggcggggcctggtgtctcacgcctgtaatcccagcactttgggaagccaaagcaggcggatcacctgaggtcaggagttcgagaccagcctggccaacatggtaaaacccccgtctccactaaaaatacaaaaattagctgggtgtggttgcaggcacccgtaaccccagctactcaggaggctgaggcacgagaatcacttgaacccaggaggtggagattgtagtgagccaagattgcgccactgcactccagcctgggtgacagagcaagactccgtctcaaaaaaaaaaaaaaaaaaaaggtggggtcggtggggcggcatggtggttcacgcctgtaatctcagcattttgggaggctgaggtgggcagatcacaaggtcaggagatcgagaccatcctcgctaacacggtgaaaccccatctctactaaaaatacaaaaaattagctggatgtggtggcaggtacctgtagtcccagttactcaggaggctgaggcaggagaatggtgtgaacctgggaagtggagcttgcagtgagccgagatcacaccactgcactccagcctgggcaacagagtgagactctgtctcaaaaaaaaaaaaaaaagaaaaaagaaaagaaaaacaatgccttattggcctgtctcttggaggtgtttttgttgttgttgttttgttttgtattctttttgagacggagtctctctctgtcacccaggctggagtgcagtggcacgatctcagctcactgcaacctctgcctcccgggttcaagtgattttcctgcctcagcctcctgagtagctgggattacaggtgcaagccaccacgcctagctaatttttgtgtttttagtggaggtgggggcttcaccacattggtcaggctggtcccgaactcctgaactcatgatccacccgcctcagcatcccaaagtgctgggattacaggcatgagccactgtgcccggccctcttggagattcttaatgtgcttttgctcattcaaggctctgggaagtcctgccgtacagaaacctgttgaaatgttttttatttatttatttatttacttatttttgagacaaagtctcactctgttgcccaggctggagtgcagtggcgccatctcagctcactgcaacctctgcctcctggattcaagtgattctcctgcctcagcttcctgatagctgggattacaggcgcatgccatcaggcccagctaatttttgtatttttagtagagacggtgtttcaccatgttggccaggctgctgtcgaactcctgacctcaagttatccacccaccttgacctctcaaagtgctggggttacaggcatgagacactgtgcccggcctgacatgctttcaagcccagcatttcccaaacttgtttgcccatggaaccctttcccactccttgggaaacactggatttggaacccgttcttccttctcaagctcttagtcacctagagccacgggaaaaggcaggggtgggacagaacctggacccccagtccacagactcagttcctttgacaggtacacccagaaagaatggacatctttgctgaagacttcaaaatacagaactggaagatggttgcactgcagcgggaagtggtgagggccaccatccctgtcttcccccactccccctgggaccccccaacctcccgggtcctgggtgctgagggtagggaggtgcaaggaggagaacacagcctggaaaggtttctttgcaggtgtgggggacactgccccctccaggctcacagccctcattttctacccccaccttgcaggcttctctccagaataagtttaaaaccatccccaaaaccgaggacatggtgctctggagtggccttcatgatgccatgttcacctcagtgagtgaggaaggaaggggaggttagcaggaagctggggagcaggcgggtggctgactgagagtgggaggcggggctggaagccagcagagcccctctgccccctcttctgcaggaaattggttcatcaccactggacctgtggcagtctgtagagcagctcccagaggctgccctggcccagaccaccaagtaccttgaagctactcgtgccatccaggtctccgagcccgtccaaaacccccagctactgcagactgtctggcattatgaggtcccagagctcctcccggagggctcatctgcccaagcagtttcactcagcagagcccaggagccagcgcagcctccggccctcacgcctgagtctgcacctgggtgcacaactgaatttgcacctgggcctgcacctgggactgaacctgtgccaggactggagctggggctggagctggagcctgtgcctgccctggggcctgtcccagggcccagtgtgacacctgggtccttgccagcaccttggcctgtgcttggacctgtgcctgccccaggtgcccagcctccaccactgggagactggcctgcactcccaagacgctggcctcttccccaaggctggcccagggtgggctcttggcctctgtgggacttaggtgtcctgcggccaactcagccccaaccctccagggccccaccaccagccactgagtttggctcattgtggcctcgaccactccagccatatcagtctcgccagggagaagccctccagctcgcagctgtccaagtaaagggggaggaaaatgatgtccccagcctaaggggccttcgggagagggcccgcaaggatggggcccccaaggatagaactcgcaaggatggggtccccaaagatagaggtggcaaggatgtggaccccaaggatagagctcacaaggatgatgtccccaaagatagaggtggcaaggatgtggaccccaaggatagagctcacaaggatgatgtccccaaagatagaggtggcaaagatggggaccccaaggatagagttggcaaggatggggcccccaaggaagcacagcctaaggctccccagtctgcccttcaccggctgaaaaccaccgctgccatcgccgccgctgccgccgcagcctacgccgctgccacatcctccgctgcccaggcagccaaagttgctgccaagtttgtcaaggatgccccagccaccaaaatggccgccattgcaacagacacggctgcagctgggcccctaggggtctttgcagatgtcctgggtgcagggccttcccggggagccacagaatcccagatcttgggcgatgattccgaaatctacgaaatcctctctccctcctactctgctgccagcatcggtcccgatccagccctgtcccaggccatggtggctaccaagcaggccatgagccctgaagacaagaagagggctgtcaagtattccatgagccacatagcccagatacctgtcaaacacgactctctgaaggaagaatttgcccagctgtcctgtaacctgaaccagcgcttgagttatctaggtaggcctggtctggccctgggaagggcacaagggagtggggctctccctgcagcctttgagaagtgtgtcctgtccttcactgggctccaccaacaaaatctgcattccaccattagccattctttcctttggcttaagcatttggctcttaacgagtctattcttttctgttgaatgtacaatgaggtcttatcttagggcagggaggctgttagggtctaaagttggcacgaggaaaatggcatgccaaaattactctcaaaaactcttgtggccaggcgtggtggctcccacctgtaatcccagcactttgggaggctgaggtgggcggatcacctgagaccgcaagttcaagatgagcctgaccaacatggagaaaccccgtctctactaaaaatacaaaatttgctgggcgtggtggtgtatgcctgtaatcccagctactcgggaggctgtggcaggagaatcgcttgaacccaggaggcagaggttgcggtgagccaagatcatgccattgcgctccagcctgggcaacaagaacgaaactctgtctcaaaaacaacaacaacaaaaaaaactcctttgtgatagcccataaaacagtattgtattggctaagcatggtgactcatgcctgtaatcttagcactttgggaggccaaggcaggaagactgcttgaactggaagttcgagaccaccctgggtaacatcaagacctcatctctaaaaaaatttttaaacactagctgtgtgcggtggctcacgcctataatcctagcactttgggaggccaaggcaggcagatacggagaccatcctggctgacacggtgaaaccccgtctctactaaaaatacaaaaaaattagctgggcatggtggcgggcgcctgtagtcccagctactcaggaggctgaggcaggagaatggcgtgaacccaggaggcgaagcttgcagtgagccgagatcgtgccactgcattccagcctgggcgacagagctagactccgtctcaaaaaaaaaaaattttaaacattggccgtgtgcggtggctcacgcctgtaatcccagtcccttgggaggatgaggcaggtggatcacttgaagtcaggagttcgagaccagcctggccaacatagcgaaactccgtctcgactaaaaatacaaaagttagccaggcttgatagtgcgcgcctgtaatcccagctacctcggaggctgagacaggagaaacactttgaacccgggaggcagaggttgcagtgagcagagattgtgccactcccgcctgggcgatagcgagactcctcctcaaaacaaaaaaaaaagcctgagtggtggcgcaggcctgtagtcccaactactcaggaggctgaggtgggaagattgcttgagcctagcagttcaagactgcactgggttatgatcgtgccactgcactccagcctgggcaacagagtgagaccttgtctccatacaaacaaaatttaaaaaaaaatttttttaattattgttattattttttgagatggagtttcacttttgtcgccggttggagtgcaatggcgtgatcacagctcactgcagcctccgcctcctgggttcgagagattctcctgcctcagccttccaagtagctgggactagaggcatgtgccaccaagcctggctgattttcgtatttttagtagagatggggtttttccattttggccaggctggtctcaaactcctgatcccaggtgatccacctgcctcggcctcccacagtgttgggagtacaggcgtgagccactgcacctgataaaaaaaattttttttaattaatttaaaaactaataggccgggtgcggtagctcatgcctgtactcccagcactttgggaggctgaggaaggcggatcacgaggtcaagagatcgagaccaacctggccaacatggtgaaaccctgtctctactaaaaatacaaaaattagctgggcgtggtggcgtgtgcctgtaatcccaggtactcgggaggctgaggcaggagaattgcttaaacccaggaggcggaagttgtagtgagccgagatcgcgccactgcactccagcctggtgacagagcgagattccatctcaaaaaataaattaattaaaaaataatgaagaaataaataaaaaggtaccacaagctgcgaggcccagtgcatttccactgggcagtgctgcctgagatgctccataagagaagcagctagagcccaacagaaacatcttcctccatccgagccctcagcagccaccctgtcctctgctttcagccaatatgggaggtccttccagcctcgggacaacagtggacatattgcagaaaaagattggcagcctccagaaatctaggctcaaggttagtgtctccggcgaagggcttttgaggcagtgatggcttgaggtgagctggctgaagactccttgactctgcccccctcccaggtgcagctgtgttctgcagcaaaacaggctgggggaaagcgagctggctgcgaaggcagctgctgcctctcaaagctgattcactggtgcggtgggggggcccagcaggtgtggggctacacggttctgtgtctcaggtggctgttcagagggcaggtgaagccggtgcggtggctcatacctgtaatcccaacgctttacaaggctgaggcaggcagatcacttgagctcaggagttcaagaccagcctgggcaacatagtgagatcccttctctgcaaaaaaatacaaaaattatccaggtgtggtggtttgtccctacagtcccaactactcgggaggctgaggtgggaggatcacttgagcctgggaggtggaggctgcaatgagccaagatcacgccgctgcactctagcctgggtgacagagcaaggccctgtctcaaaaaaaaaaaaaaaaaaaaaaaaaaatggcaggtggaaggcaccctggtctgataccttatttttttttttttttgagacggaatcttgctctgtcatccaggctggagtgcagtggcgtgacctcagctcgctgcaacctctgcctcctgggttcaagcaattctcctgcctcagcctccctagtagctgggattacaggggcccgccaccacacctggctaatttttgtattttttgtagagactggtttcgccgtgttgggcaggctggtctcgagctcctgacctcagttgatctacccatcttggcctcccaaagtgctgggattacaggcatgagccaccacgcccagcctggtctggtacattcttcttggcctcaaccctccctcaggccccttcccggccatggtaacttcagaagcagaggcctggggtgtctgtgtctcccccttttaggaggaagaacttgagagaatttggggcaaccaaatagagatgatgaaggatcgctacatcactttggacaaggcggtggagaacctgcagattcgcatggatgagttcaaggttaggaggactgggtaggctggagaagggctggcaaagggagaattcctcacctagaccttctggcccttcccgaaggttctgcatgaggtggggatgcacttgaggctgggaaccagtggggctttactggcattttactgtgtgtaaattacacttcaatgaaaagcaaacgaatcccaccacccccccccacccatataaacagaagggccgggacaatgttcgtctttttgaccactgcgtcacctgcccctggaagggcaggggtagtgaaggctccatcacatttgctgaatgactcagtgaatgattaagagaacttcttgtgccaactgttacattcttaacatttccctgagccaagaggtagaaatatttactgacattttgggctgggtgataaaaataaaaaaataataataaaaagaaatatttaggctgggtgcggtggctcacatatgtaatcccagcgctttgggaatctgaggtgggaggatcacttaagacaaagagtttgagacaagccagggtaacacagggagaccccatctctacacaaataaaaaatttagctgggactgggcgcggtggttcacgcctataatcccagcactttgggaggccgaggtgtggtggatcacttgaggtcaggagtttgagaccagcctggccaacatggtgaaaccccgtctcttctagaaaaatacaaaattaggctgggtgcagaggctcacgcctgtaatcccagcactttaggaggctgaggtgggcggatcatctgagatcgggagttcgagaccagcctgaccaacatggagaaaccctgtctctactaaaaatacaaaattagctgggcgtggtggcgcatgcctgtaatcccagctactcaggaggctgaggcaggagaatcccttgaaccggggaggcagtggttgcggtgagccccgatcgtgccattgcactccagcttgggtaacaagagcaaaactctgtctaaaaatatatatgtatacatatatatatatatatatatatatatatatatatatatatataattagccaggcgtagtggcacacacctgtaatcccagctacctgggaggatgaggcaggagaatcgcttgaacccgggaggtggaggttgcactgagctgagattgcgccattgcattccagcctgggcaacaagagcgaaactctgtctcaaaaaaaaataaaaagggccaggcgcggtggctcacgcctgtaatcccagcactttgggaggctgaggcgagtggatcacgagttcaggagattgagaccatcctagctaacgtggtgaaaccccatctctactaaaaatacaaaaaattagccgggcgtggtggctggcgcctgtagtcccagctactcaggaggctgaggcaggagaatggcatgaacctgggaggcagagcttgcagtaagccgagatcccaccactgcactccagcctgggcgacagagcaagactccgtctcaaaaaacaaaaacaaaaacaaaaaaacctagctggatgtggtggctcatacctgtgatcctagtactttgggtgcagaggcttaaacctgtaatgagggaggattgcttgaggccaggagttcaagacttggccaacagaagaaaactgtctctacaaaaaaaaaattataaaattagccaagcgtggtagcacatgcctgtagtcccagctacctgggaggctgaggtgggaggattgcttcagcatgggaggttgaggctgcagtgagctgtgactgcatcactgactccagcctgggtgacacagaaagaccatctcaaaaaaagaaagcaaagaaacaagcaaaaagcaaaaaactcactaacggccaggcgcggtggttcacacctgtaatcccagcactttgggaggctgaggcaggcggatcacctgaggtcaggagttcgagaccagcctggccaacatagtgaaaccccgtctctactaaaaatacaaaaattagccgggcatggtggcggatgcctgtaatcccagctactcgggtggctgaggcaggagaatcacttaaacccgggaggcggaggttgcagtgagcgaagattgcgccattgcactccagcctgggcgacaagagcaagactcagtctcaaaaaataaataaataaataaataaataaataaataaataaataataacccaccaaggttgtttccgtgaaggcttccaagtcggggggctgttgctgggatgcactggggtgtgttgggggaaaagggaccaaggaaacccatggcgtatggctgaccccaaggctggcacactgtaatcaggctgggacccatttgaggcaactttgaatggaaaataactcattaaaggggaaccaattcacagcctatgaagtgggggtggacaggagggttggctgtctctggagatgctgggccgagtgtgggtggactgcatgcaggggtacgtgctcagactgtgcaccactggccaggaaccaggtctcctgccaacactcctcttcagagagacccaggccaccatgtcctggggtcatcttggtgccctttctccatggagctggagccagttccattcagcatgtccatcgtgcacccagcactacgccagaccctgcatgggggtgagcaggggctgcagtgtctgcctgcgtgtccgtagttgtcacttattagaaagactctgaagctgatgaagccctgccacgtgtgccaaaacagagcacatcccttgtcccaggaccgttgtcccagcttcctggctcttgtgctatgaagatttcattgctggccaggctcggtggctcacgcctgtaatcccagcactttgggaggctgaggcaggcggatcacctgaggtcaggagttcaagaccaacctgaccaacatgatgaaagccgatcgctactaaaaacacaaaaaaatcagctgggcgtggttgcgggtgcctgtaatcccagctactcgggaggctgaggcaggagaatcgcttgaacccgggaggcagaggttgcagtgagccgagattgtgtcattgcactccagcctgggcaacaagagcaaaactccatcttgggaaaaatctcagcactttgggaggccaaggcaggaggatcccttgaggccaggacttcaggacgagcctggacaatacggcaaggccccatcgctaaaaaaataaaaataaaaatattagccagatgtggcagcgtacgcctatagtcccagctaccagggaggctgaggcaggagaatcacttgaacccaggaggtggaggttgcagtgagctgaggtcatgccactgcactccagcctgggtgacagagtgagactctgtctcaaaaactaaagtaaactaaaatacagtcttaggattttgaaccacacaaatggtttgtattaccaatagttaaagaagaaaaataaaaaataatgtagaacaagtgtgggaataggcaaatcaataggccaagaagactgggcatggtggctcacacttgtaattccagcactttgggaggccgacatgggcggatcacttgaggtcaggagtttgaaaccagtctggccaacatggtgaaaccgtgtctctactaaaaatacaaaaaaattagccaggcgtggtggcgcatgcctgtaatcctagttacttgggaggctgaggcaggagaattgcttcagctcaggaggcggaggctgcagtgagccaagatcgcaccactgcactccagcctgggcgagagagcaagactgtatctcaaaaaaaaaaaaaaaaaaaaaaaataggccaagaagaccagatctaagatttacaagaatttagcatatgaccactacaggaaggatggattactccacaaccagtgttaggaaaaccatttcaaggaataacagtaagtcttaagtccgatagcaatcctctagatgacacaaggcagtagcacggtgacaaatgcaggatgggagcaagatctcatgactgtgtctctgtcttgctctccaccatgtgacttacatgtaagacttaggtttcccagtgtcgttttgggtcttgctctgtcccccaggctggagtgtagtggcctaatcatggctcagtgcagccttgaactcccaggctcaagtgatcctcccacctcggcctcctgagtagctgggactacaggcgtgtgccaccatgcctggctaatttttttttttgagatacagtctcgctctgtcgcccagcctggagtgcagtggcgcaatcttggctcattgtaacctccgcctcccgggttcaagcaattcttctgcctcagcctcctgagcagttgggactacaggcgtgtgccaccatgcctagttaatttttgtggtttttttggtttgttttttgtttttgttcgaggcagaatttcactctgttgcccaggctggagtgcaatggcgcaatcttggcttactgcaacatctgcctcccgggttcaagtgattctccttcctcagcctcccgagtagctggggtaacaggcgtttgccaccacactcggctaattttttattttgagtagagacagggtttcaccacattggccaggctggtcttgaactcctgacctcaggtgatttgcctgcctcggcctcccaaagtgctgggattacaggcgtgagccaccgtgcccagccaatttttttgtatttttagtagagatggggtttcaccatgttggctaggctggtctcgaactcctgaccccaagtgatccacccacctcagcctcccaaagtgctgggattacaggcattagccactgcgcccagccaaaataataagattataaaacatgaatatagcctggcatggtggcttgcacctatagtcccagctactggggaagcagaggtgggaggatcactggagtctgggaggtggaggttgcagtgagctgagctcgcaccactgcattccagcctgggtgacagactgagaccctgtctcaaaaaataaaaataaaaagcataaataaggccaggtttgatggctcttgtaatcccagcactttgggaggctgatgggggaggatcctttgagcctaggagttccagatcagcctgaggcaacatagtgagacccctgtctctacaaaaaaaaaaaaaaaaaaaaatccaggtaggtggtgtcacctgcagtcccagctcctctggaagctgaggcaggaggcttgcttgagcctggaaggctgagactgcagtgagctgtgatcaagccactttactccagcctgagtgacagagcaagagcctgcctcaaaaaattaaaataaaaaaattaaaattaaaataaagaggaggtaacagagactcagcaaagaaacgagcccaagcctgctgggctgggagggggcctggagtggctgtggttcagagcccaggctttggaacagacgtgcctaggtttgaatcctgattctgccacctgctggttggatcagttccctgcggttgctgcggcaaatcactcttggggttctggaggcgggaattctgaaatcaaggtgtcataggctgtgttccacctgaaagctcagaggggcctcctcgcctctcccagcttctggtggttcaaggtgtcccttggctttggagcaacttggatggaggccggggtcattattctaagtgaagcaactcaggagtggaaagcaaagactgcatgttctcacttgtaaatgagctaagccataggtgtgaaaagacagaccgagcaggataatggacacaggagactcaggataatagagagagggaaggatagaaaactacatattggagccaggcgcggtggctcacacctgtaatcccagcactttgggaggctgaggcaggcgaatcatttgaggtcaggagttcgagaccatcgtaaccaacatggtgaaaccccatatctactaaaaatacaaaacttagccaggcgtggtgttgggtgtcagtgaccccaactactcgggaggctgaggtgggagaatctcttgaacccgggaggcggaggttgcagtgagccgaaatggcgccactgcactccagcctgggcgacagagcagattctgtaaaaaacaaaacaaaacaaaacatgttaaagatacccattcacttctgttgacaccccagtggccacactaagctataagagaggctgtgaaatggagtcttgattctgggcagctgggttccagctaaaagtccagagttctgttcgtaagcgtgagcgggacacccgacaggaagagagaagtagaagcctgtttgcagctttgcaggaactatggcccgaccctctggggaaatggaggctcttcccaagctgaccagctgctgctcctattacaatggggatgtagtaattggagagagggtggaattcatgggggcagttggttctttgtggagttgtggggataggacgtgaggtttttccctaacgcttgagcacagtgtgtgtggctgtgataagtgctcagttcatagtagactggagttcctgctgggaccccaggacagatcagaagtagtaaacatgccttaaacatccagggagcgaaatcgtccacattggtttgtgctttccttccttgggtctaactccccgtggaggaaagttcctatgataccatctctgaggggacagcttgtcccaagtcgcacgttccttcccttttcatctgggcacctggagcccttgagcctgagtcttgtaacgcccatgcccacctgcctgctgtccacacggcctgctatccctccccagcatatggtaatggtagaggtgggaggttgacattttatcctcaaggctctccaggatggcagacatgcctgtgcttctgttcttagactctccaggctcaaatcaaaagactggaaatgaacaaggtgaataagagcacgatggaggaggagctgagagaggtgagtgagcagaggttcctctgccttccctgctcccctacccagggaaacggcaccatccaggcaaagcccaccaaagagtcttccagaatttccctccccctttgttcatattgaaaccaggagttggctgggcgcagtggctcatgcctgtaatcccagcactttgggaggccaaggcgggtggatcacctgaggtcaggaattcgagaccagcctgcctggcctacatgatgaaactccgtctctagtcaaaatacaaaaagtagccaggcgtggtggcaggtaactgtaatctcagctatttgagaggctgaggcaggagaatcacttgaacctgggaggcagaggttgcagtgaaccaagatcatgccattgcactccagcctgggcaacaagagcaaaaactctgtctcaaaaaaaaaaaaaaaaaaagaaagaaagaaaaagaaagaaaagaaaggaaaacaggaggcacatcaactcccattttcagcaattgaggattattaacactctacttgaaaatcacacatcagctgtgcacagggtggctcatacctgtaatcccagcactttgggaggccgagaagataggatcacttgaggccaagagtttgagaacagcctgggaaacataggaagatcacatctctacaaaaaaataaaaaaatgaactgggcatgatggaacatgcctgtagtcccagccactcaggaggctgaggtggaaggatcccttgagcccaagaggtggaggctgcagtgagctatgattgtgccactgcaatccagcctgggcaaccttgaacaagatcctgtctcaaaaaaacacataataataaaatacatcaacttccctgttataggaaaaccttggctttgatctcgagatcgtgtttgaatccacgtagaccccagggttgcatttaagccaaggctaaaagtccagagtcccaaactagaagcatcagacccaaggggtgtgatgtctcccagctttgccttcctccatcccagcagccatgcctccctgaactccctgtctccctagaaagctgacaggagtgccctggcaggcaaggcaagccgcgttgacctggagactgtggccttggagctgaacgagatgattcagggcatactcttcaaggtcacgatccatgaggacagctggaagaaggctatggaggagctcagcaaggacgtgaacaccaaggtgaatgcccccatgttgattttcactttattcctaacaaattaacccagaacttagcaactgcaaacaacaaacgttttcagtttaggaggagcaagaatttgggagtgacccagcaacttagctgggtggctcagggtttcctgtgaaattgcagtcaagatgtcatccagggctggtctcatctgaaggctcgaatgaggctggatgagccaattcaaagagattccctcacatggctgttggtaacactcttcagttcctcatcccatggactctgcctttgggccacttgagagtcctcatgacattgcagctgacatctcccagatcaaatgatccaagaggggaaggaagaagcagcaatgtcttttttttttttttttttttttttcatacagggcctcactctgggcacctgccccatacatagtcaataaatgaattgatccccatttcacagaggagaacactgagcctcagagaggttattatacttccctcaggaaacgctgctgctcatggtggagcttgagactcaaacccagagctgcctgattctaaacctaatttaacctctttgggccagtccagccacctcagttgcaagaaccatgtagcactgttgttggaccaactgttccagtctactatgaggaaggggctgtgactcctctagacacttccccggggtctgacacatcactggcagtcagtaaacgatgaatgaataaatgaatgactgtcacagtccctcagagactctcctcctccaccccacatccctgcacttacgcagccaggagagtggcatagttagcctccagggcggtcgccaaccatacctcttggtattcacacagttgtttagccccctcccacattgaatgggaccagcttgtgtaacctacaggatattagagagatgatggagggtgaccaccttccatcataaaagacattgcagccagttgtggtggctcacgcctgttatcccagtactttgggaggccaaagcaggcagatcacttgagcccaggagttcaagaccagcctgggcaacatggtgaaactctgtccccctaccaaaaaaaaaaaaaagccaggtgtggtggcacatacctgcatttccaactactcaggaggctgaggtgagagaatacctgagcctgggaggttgagactgcagtgaaccaaaatcgtgccactgcactccagcctgggcagcaggagcaccctggcaggcactcagagtgaaaccctatctcacaaaaaaaaaaaaaaatgggcgcagaacaaccaaaagcaacacatgaagagattttacttgtttcctggtttaattgaaccacatctacaaatgggctggagatgacatccaattcaggaatagttgctaattgtattaaacatgataatagtgttgtggttatataataaaatgttatcacactcaaatatttattagtgaaatgtcaccatttctgtaacttaaaaaaaatactccatcggctaggcacggtggctcacgcctgtaatcccagcacttcgggaggctgaggcgggcagatcacgaggtcagaagattgagaccatcctgaccaacacggtgaaaccccatctctactaaaaaatacaacaaaaattagccaggcctggtggcgggcgcctgtagtcccagctacttgggaggctgaggcaggagaatggcctgaacccgggaggcagagcttgtagtaagccgagatagcgccactgcactccagcctgggcgacagagcaagactccgtctcaaaaaaatactccctcgggtggcacagtggctcacacctataatcccagcactttgggaggttgagatgggaggatcacttgagcccaggggtttgagaccaatcctggcaacatagagagactccatctctactttaaaaaactatttttggccaggcgcggtggctcacacctgtaatcccagcactttgagaggcagagatgggtggatcacttgagatgaggagttcgagaccagcctgaccaacatggtgaaacactgtctctactaaaaatacaaaactagccggatgtggtagtgggggcctgtaatcccagctactcgggagactgaggcaaggagaatcgcttgaacccgggaggtggaggttgcagtgagccaagatcgcaccattgcactccagcctgggcaacagaagtgaaactctgtctcaaaaataaataaataaataaataaaataaaagtaaataaataaggccaggtgcggtggctcacacctgtaatcccagcactttgggaggctgaggcgggcagatcatgaagtcaggagtttgagaccagcctggccaatatggtgaaaccccgtctgtactaaaaatacaaagattaggctgggcgtggtggctcacgtctgtaatcccagcactttgggaggctgaggtgggcggatcacctgaggtcaggagtttgagaccagcctggctaacatggtgaaaccccatgtctactaaaagtaaaaaaaaaaaaaaaaaaaattagtcgggtttgggggcacacgcctgtaatcccagctacttgggaggctgaggcaggagaattgcttgaacctgggaggcggaggttgcagtgagctgagatcacaccactgtactccagccagggcaacaagagcgaaactccctctcaaaaaaaagccaggtgtggtaacacgcacctgtagtcccagctacttgggaggctgaggcagaagaattgcttgaacccgggaggcggaggttgcagtgagcagagattgcaccactgcgctccagcctgggcaacagagcgagactctgtctcaaaaataaataaataaaattaaaaataaataaataaatacgattgattatgatggtcacacaactctgtaaatatactaaacgccataaacctgcccactttacatacagaccgtcaataaacatgtgttgagtgtgtgaatgtcaggtgcagtgggaccattgccagaaaggtgtctcagaccgcccagcctgcagctgagcttggtttgatttggtcttttgcagacagtagctgatggtgttttttgcttctgctgctaggaagctcaccttgcagctcccctctaccaatagcatctagtaggggttgagcctcatcgaagctgtgtcattttccctttcctggactccctcactattttagttgaattttgttacaccgtgtaacttcccaggttgctgcaaccctcttctggaaggaggcagggtgtgaattcatagagtattctttcttatcttccccttggctgttggcagttagtccacagtgatctggatcccttgaagaaagaaatggaagaggtctggaaaatcgtccggaagctgctgattgagggcttaagactggatcctgacagtgctgctggctttaggaggtgagtgcccgcccgagcccctcctggtaggggtcctgctgcccaggctgtggggaacacaccctggaagctctgggaggaaagattccagacctttggatgaggggatgggggcttggctgtggctgaaagcactgaggaggagggaagctctggcctgagctggcagaggtgatccagccctattcctgccaatggggaaaccaaggctcagagagggaaggggactgggcagatccaggacccctgacccccacccagacagtgccccaggcagagggacccaatatttatggggctcctgtcctcagaccacccctcacacagctttaaaaaccatccgttgtgtttggggcggcagagaaaccacaagagtggttggagactgcagggcctgtggggctgagctgggccgggcactggcaggagggatgcagccctggggctctggctggctgcagcctcccacacatggcctgggcccagcaggggcagcggctgatgatcatgtgcctttcaggaagctgttcaagcgcgtgaagtgcatctcctgtgaccggcctgtggagatgatgactggcccgtgagtaccaccgcccagggtgccccggccctaagggcttgtggggcccatggaggtcatctccgtgcacctccatgtgcaccgttccatgcacgctgtgtgtctacacatccatatacagcattctctccagccatcaagtccatacacgcccacatgcaccattctctatgcaccaggtatctacacatccacatccactgttctgtaccgtcaagtccatacacatccatgtacactgttctgtatgtgccatgtgtatccacattcatatacagggttccccagccttcaagatacacatgtccacatacactgttctacagccatcaaaaatatacaaatatgcggccttgtatgatagcgcctgcctatagtcccagctactcaggaggctgagatgggaggatggcttgagcccaggagttcgaggctgtagtgagctaggattgtgccactgctctccagcctgggtgacagtgagacctcatatcaaaaaaaaaggccatgttggcaaggctggtctcaaactcctgacctcaggtgatccgcccacctcagcctcccaaagtgctgggatcataggtgtatgccaccgcgcctagcctggtttttacttttggaaatagaacaattgttttttgtgtcttactgtgatgatcagaggtcctgagatgcctttcgggggggccccttctacttctatgctgtggacgcttctggcattcgagggtggtgacctgagtctgcacctccttcctcctgctgggaaggcttcctggaggggtgggagacgagccctctgctggcctagcacgcctcccacagcccctgctgtgcccttgtcctccaacagacagctgatcaccatccgcaaagcccacctgctgtcccggctgcggccagccagcgccaacagctgcgagtacttgcagcggcaacagatgaggtgagcaggatgggcgccccgcagggaggccgccccgcatggaggccactctggagcctgggaaccctgttcctgcagagacacatcctccaggcccagggacctaagattgtcctggacatggccagcccttcgcaagacaggcactccgagaggtggctggggcggcagacaggcccacgagatgatggcggagggaggaactgacatatttactgcacatctattgtgggccaggaactgttagacggtttcttatttaaatctcacaaccccctgtgagctagggttcctatgcccatgtccctgtttcttggcggagggaatcggtgatgatggggaaccctcagggagccgctgctgtgcccggcaggcactgtgccaagcgctggggctcacctggccttgttgagtcctcacagctgccctctaagatgtatcctggtaccatcccatgtcacagttgaagaaactgaggctcagagaactgcagtgacctgcccaaggtcactgctagcaagtccagggctgatgtccaaaccctcaggtttccaccgcacccagctggctccctgggtgccagccccacccctcaacctcctgacatcccacagctctatggatctccccagcctccaaccctgctgtggggacgtctggccaggtgggggaagaaccggtgaatcgtcaccacagccgtgggaaggggagggacgtgggggcctgtgctgactctgccaccctccctccctggctccttgagatcaagagattagaaggacacgctcttcaggccaggggtccaaagggaaatggctgggtctggggaaatgcaggtctcaatttgattcctctgccccactgtgtgtgtctgtatccatccgccaggccccaggcctgcctggctgtgccagctaaacacaagctgaaagaaatgctggtcttccctcgatgctggccaggcccttggggcccgtcctgggctctggggtacagggtctccaggtcgctgctgacccactgccctgctgcagggaacagcagtggctgcagctccaggacctcggtatccaggaggattgtcagcaggactggggtgatggcccccaaaacgccaccagcctcaagtgcaagtcctgcaacctgttgacgctctatccctacggggatccccacgtgatcgactatgacagcgtgagtctggccggggcctccttctcagagggtggacgtcagcgcaccccagccccaggtgtgggaccaggcactgagcagtgggcaaccccagcagaggctgcactctgtctcctgggcttctgcgtgtaccaaagttcgggggcagatcgggtcgggggctccctaacccgggacctgggccatccaacaggccgaggtggacatcctgggcgtggatgggatcctgtacaaaggccgcgtgaacagccagcgtggggctcagcccttggccgtcgcaaaggagctggcaggtgaggggcgtagggctccctggggcacccttgcctggggccctggttctgctgggcagggtgagagggtgcaggtggggcccagagccagcactatccctgaccggggagtcctcacacagtcagtcacaaaaattgggtcacagcaggcccccaggagactcagtctttgcaatgggggagggagaccgcgggagcgaggatctgctgttcccgagatcaacagctgaccagagagagggccgtggccacaggaccatggcctgtgacgaaggacgatgagctaggaaaggtgctgggctggtgccaagggacgccagtccacggaggacggactggacagctgccctgaagcccttgaagagggactaggacttagctggatgaaggggtcgggtgagaggagagtggtcgtgtggcaggaacggtgggtgcaaaggccctgtggtgggtggaagccactcacaggcaggagctcaggacgccgagtctccctgaagggtggagactggggtggggcagtggggtgacaaggaggagacttgggccagaccccagaagctgtgtgttaatatcacaggcaagggttgggccagcgggagacccagaattgtgcacatctggaatcagtcaatgtggttgctgcagtgctgaggcccggctctggccggctcctgctgggaccccaagactctggagtccatcactgggttcgaaggacaaaaagaggagccttctctgcacaccccttgaaggctcttcccccttggggatggggagttctaaattttgcccctgggtgggagctacacgccgccccataaggagcagtcccggagccacaagatggccggggcctgaactccacctgcagaaattctggttttttgttgttgttgttgttgttgtttgtttgtttttgaggcggagtcttgctctgtcgcccaggctggagtgcagtggtgcgatctcggttcactgcaacctccaactcccgggttcaagcgattctcctgcctcagcctcccgagtagctgggataacaggcacgcaccaccacgcccggctaaatttttgtattttttagtagagacggggtttcaccatgtttggcctcaagtgatccacctgcctcagcctcccaaagtgcaaggattacaggcatgagcctctgcgcctggcccaccggcagaaattctttcttgccaacgctgtgcctccattgactcgaagaccagacatggaagaagggaagggggactgtttcatcaatgtgctgggcaaaggaggaggcaccctgattcgtctcctggggttgccgagacaaattaccacaagcagggtggcttaaagcagctgaagttccttcattccccggcccatgtagcacgccgtcccattggccgggcacggtggctcacgcctgtaatcccagcactttgggagaccgaggcgggcggatcacaaggtcaggagttcaagactagcctgaacaacatggtgaaacctcgtctgtactgaaaatacaaaaattagccagccatggtgacacacgccgttaatcccagctactcaggaggctggggcgggagaatcacttgaacccaggaggcagaggttgcagtgaaacaagatcacgccactgcactctagcctggacaacagagcgagacttcgtctcaaaaaaaaaaaaaaaaaacagctgaagttccagctgggcaacaacaaattagctgggcatggtggcgtgcgcctgtagtcccagcttctcaggaggctgaggcaggaggatcgcttgagcccgggaatttgaggctgtagtgagccatgatctcaccactgcactccagcctgggcgacagagccaggccctgtctcaaaaacaaacaaacaaacaaacaaaaacagaacagaacaaaaccaaacaacaacaacaacaaaaacaaaatacagccagagttgatcctcccgctgtcctggaggctggaaatcctaaatcaaggagtcagcagggctgcactccctccaaaggcttgaggagggtccctccctgtctcttcagcttctggggccgatggcactccctggcacttctctgtccccatgtgagcttctcttctgtgtgtcctctcctctgtcccccataaggacatttgtctttggatttgtgcccgacctaacccaggatgatctcatctcaagatccttaagctaattatacctgcaaagaccctttctccaaataaggtcacattcacagcttctaggagatgtatctttttggggagcacattcaacacaccctgtttccaggcgggccagacaccgtctcaaaccctgcattctcctgggcgggatgtggcttctcctcgagaggactggccgttccagcccctgccccctgcctggtatctgctgggagggctcaggctgggcgtcagggatcaccaggcaggatcacaacggtggctaatatttaatgaaccccgacttcgtgccaggccctgccccacctccttcaccctccaacaacctgccaaggagtttcacaaatgaccagctgagtgagggctgcttgccgggcggccagggcagatggagtccacatctgatgcacccagtcctgtccccactcattcactggcctccccaagggctgtcatctagagggaggggctttcccccttggctcattcattcccaagacccacacagcaagccaggacttgaatcatgatggcgtcaactgcttcatcttttttttttttttgagacggagtttcgctcttgttgccaaggctggagtgcagtggggcgatctcagctcactgccatctcaacctcctgggctcaagaaatcctccctcttcagccttccaagtgactggaactacaggcgtgcgccaccacgcctggataatttttgtatttttagtacagatggggttttgccatgttggccaggctggtctcaaacatctggcctcaagtgacccacctgtctcagcctcccaaagtgctgggattacaggtgtgagccactgcgcccggcctcatgtaacttattgactactatatattacattgaaattgtgacggatttatagcatcttaaagctgaaaagtggtaagtcaaaccatcataaatcagggaccttctgtattagaaatcaattggaaacctgtctgtggccagatcttgatcagtttgctgttgtcactcatttatttccccaaaagaactttctaactcaaaacagactcaaagccaggtatagtggcttacacctgtaatcccagcactttgggaagctgaagcctgaggatcacttgagcccagaagttcgagaccaacctgggcaacatcgtgaaaccccgcctttataaaaaatacaaaaattagcagggcatagtgaggctccctgcagtcccagctacttggggggctgaggcgggaggatcacttgagcccaggaggttccagctgcagtgagccatgattgcgccactgcactgcagcctgggcaaaagaatgagacttggtctcaaacaaaaaagaaagaaaaaagaaaagaaatgtccagaatagaaaaatctatagacagaaggaaaattggtgatttccaggggctggggtttggggcggggaaagggagagtgactgcttaatggggacagggccccttttggggtaatgggaaagtttcagaacaagatagtggtggtggtgtgcaacgctgtgtgcgtcctaaatgcctctgaattgtgcactttaaactggttaattttacgttatgtggattttacttcgaataatgaaaaaaaaacaaaggtgaaggacaggaagatgggggcatttaggtgctctggcccccagcgggacagctaaaccataaatagccctgccagcatttcacctgtgtcttactgtgctgaaatcacgtcacactcctctctggcctagagttactttcaaagagccttcttttctttcttagccttgagacactctccactcaagaaggcaaggaaggctgggcgtaatggttcacgcctgtaatttcaccactttgggaggtcaaggtgggaggatagcttgagcccaggagttcaagactagcctgagcaacatagcgagacctcctccctaggaaacatttaaacaattaaccgggagtagtggggcacacctgtagtcccagctactcgggaggctgagttaggaggattgcttgagcccaggagttcaaggctgcgtgcgctccagcctaggtgacagagcggagaccctgcctcaagaaaaaaaaaaaaaaagaagccaaggagggaagaacattgattatcccataaaggaatggaccggggagcctgggaaatggggttggtcccaccagagggagactgcccagtgctgggatcggcctgacacaggcccaggggtggatgccacccacacctgtctcttttcttttctgctaagctgtgaaggctccatctcccccgtcacaaagcctgtatgaccgtgtgcactccagtgccctatttggcgccatctgcccccgtgagtacctggttcccagccccagcccagctgtgattctggaagggtctccagtccctcctcgtctcatcccatcccccacaccccgcctgggctctcctgtccacctcctccacctcctgcctgctttgcctgcctatggcacttcagagatgattcctggccccggtgccatccccggtgcccaggccaagcatctgtccccagcgtccacccagctgcaggggcggcaacaagggaactgaggttggaaggaactgagcttctctggttcggatcaccacgtagcaggcacctgagggtactttacagtttacaaggcagtttctcccttatctcatcagaacctcatcccgactcctgtgaggcaggcactgtttgcccatttcacagaggagggagcagaggctcggtcactttgagctgtggcccaagatcacagagctagtgagctgggagctgagcccagatccgtggactccaagcttcatgttctctcccgggggctctgctccatttaagcaaacattcctggtgtcatttatcttgggtcacccacccaggacatttagggtgcccagggcccaggtgaggtatggtgcccagccggccatggcctgtacagcacttctagtcctgggcttctcttctctttagtggggatggccccatcaggctagtgtctcccaagaaggttcttggcacacatctagggtttctcctgcccctccccagccctgtgcccccgctccagtgcctgctcagctgcctcgggccctcacctgacgatgccagctcgaccaccttccctgccacctctgctgctgctgccaccgctgattccatccctaagggacccccagcaggccccagggtccaccaggctctcaagagctccacacattgagtcccgagtcggcaggaagccccccgaggagcccgccaacccgtga

SEQ ID NO: 832 - DNA, 6572 bp, Homo sapiens
actttaagcaagttccagtgtgtctatatttggtctggctgatcggctggactctggccttccccgctcacattagcagacagctctgccctagtgggcgtttagcctgcgacggcagcccgagaggaagagttgggcagagttgcaggggtctccacagctgaggcagtttggccggattatttgggttcctgctcggatggcggcgacgctgatcctggagcccgcgggccgctgctgctgggacgaaccggtgcgaatcgccgtgcgcggcctagccccggagcagccggtcacgctgcgcgcgtccctgcgcgacgagaagggcgcgcttttccaggcccacgcgcgctaccgcgccgacacccttggcgagctggacctggagcgcgcgcccgcgctgggcggcagcttcgcggggcttgagcccatggggctgctctgggccttggagcccgagaaacccttggtgcggctggtgaagcgcgacgtgcgaacgcccttggccgtggagctggaggtgctggatggccacgaccccgaccccgggcggctgctgtgccgggtgcggcacgagcgctacttcctcccgcccggggtgcggcgcgagccggtgcgcgcgggccgggtgcgaggcacgctcttcctgccgccaggtgactcacctccgctaattgttcccctctgcccatccctgttcctgcgctttccactgtgtgtgtgtgtgtgtccccttcgccccgccccgctcttttcgcttgtgtgtgtgtccctcctcccgccccaccaccaccaccccgggctatgttgcccaggtaggtcttgaactcctggacccaagctatcctcccgcctctgcctccccaagagctaggattgcagggtgagccactgcgcccggccctttgaggggagttacacttatttttttatttttattttttttcgtccctgcgcttttcatacggagaaaggatgtagcttccaacattccggaggttagtgtaaggagacaggaatggaatggaaagttggttggggaattgcccctgccgctccaaaactgagaggtccctcaaacctagtgctcagttaaaagacattgtaagggctgggcgcgctggctcacgcctgtaatcccagcactttgagaagccgaggcgggcggatcacgacgtcaggagatcaaggccatcctggctaacacggtgaaaactcgtctctactaaaaatacaaaaaattagccgggcgtggtagcgggcgcctgtcgtcccagctactcgggacgctgaggcagaagaatggcatgaacccaggaggcggagtttgcagtgagccaagatcgtgccacgcactccagcctgggcaatagagtgagactccgtctcaaaaaaaaaaaaaaaaaaaggcattgtaaggaaagagaaaagacacataatattaaaaacaaacaaaacaaaacaaaaaaaacaggccggacgcggtggctaacacctgtaatcctagcactttgggaggccgaggcaggcggatcaagagttcgagaccagcctggccaacatggtgaaaccccgtctctactaaaaatacaaaaattagccaggtgaggtggtgcacacctgtagtcccacctactcgggagtctgaggcaggagaatcgctggaaccctggaggcagaggttgcagtgagccgagatcacgccattgtactccagcctgggggacaagagtgaaactccatctaaaacaaaaacaaaaacaaaaaacaaacaacaacaacaaaaaattttcaagtagtttcaatgttcttatttatgtatggaccaggaagtcacttttttttttaataaaaagaattccaactggttttctcactgtatttccatggcagctaggaggtgccaggtggctgggcctgtgacagtgcagaggttttggtgcctgcccgcccaccattgctccagctgcagctgctgccccctgcagggcctgttcgttcctgctgcctagctccctgctggctggctatgatctccgtcctgttaccattccaggagagcagccacctccctgtgcatggcaggaccaggtactgattgtggcctctcctcttggcctcgaatggtatccttgtcatcagtgagcaagtccccaaagaccacggtcttgtccattgtcaggataattcactccacaagctgggactccaggtgctgctctacccagcggtgcttctcacccacacagtggtcatactttggcaggggctggtgcagtgtgaagacctcggtgttttgcatgtgcttcatctcttgcaaggccctctggggttgggcttcaagactagggaaaagcctagggcttcacacccatgggccactttatccaccaggtccggcagcagggtgaggtactgcttccagaccaggaagctgcggtgctgctgcagtgtcacatgcagctccctgagaagcggcggctgaagccccacaggatgccgtctggaagctgccagcacgcggtccctgtccatcagcacacgcgtgggctgtgctcatcgctgccggggcactggggtttctcgggatcctaggggtatggggcccagaaatgttctttaaaagtttctcatttttgcaacttttctttcaattcacacagtatgttaaggtttatgtaaattagcatttacaataggaaagcctcttcctgtcaaatggaaatttgaggttactggatacttttatattacataaagagcaatcagccagtgtagaaatgatgcttatccttattaataatcaaagaaatgcaaaataaaacaacagagtacatttcacaccctcagaagtggcccacttttagaagctagcattatcaattgctgaccagtatgtggaggaaatgaaactcactgctagaaggagtcaacatattcatctgctctgggcaacaatttgtcttaacttacaaagttaaatatgttattctacttgtacatgtgcaccaggaggcatattccttataagaggaaagccattgcagatgagcagtctggattaatttaaaaaaagagcaaagtcaactggaaacagtccaaatgtccatcaacaatagaacagattaataaattgaggtatatttccagcagtcaaagtgattgaactacagctagaagaatcaacatctatcaagatatacaaaagaaaagaaaaaaataaaaaagaatcaacatggatgaatctccaaaccactgttgagtgaaacagtcaaacactaggagaacacattcagtatcattccatttagatacagttcaaaaaataggcaaaataaaatattgtttaaggtacataatctaagtggtaatactatgaagaaaaccaagagtgatacacagaaagtccaggatactggaaagagaggaaagggcacaggggtctgtgggacgttgatggtttgcgggtatcagcactgaactatgtcttaaaagtgttgcctgtaaggtgtttgcattctttttttttttttttttttgagacagtgtctcgctctttcgcccaggctggagtagtggcacaatcttggctcactgcaacctccaactcccgggttcaagcgattctcctccctcagcctcccgagtagctgggattacaggtggccgccaccacacccagctaatttttgtatttttagtacagatggggtttcaccatgttggccaggctggtctcgaactcctgacctcaggtgatccacccgtctcagcctcccaaagtgctgggattacaggcgtgagccaccagacccagcctgcattattattctttaattttgtgtgaaacacaaaacctttaatgtaaatgataaaaatattcagtaagtggagtcattcagaatgagtagccttttgagtctgtctccattgaataagtgcattctgttgagtgcactggagaggaatttgtgctcttctatgtagcagtctttctttttgtttcttggtggtgcaccattaaatggattcattcaccagttaaaggacatttgggttgtttccagtctttggctacaatgaataaagtcactataaacacttgccagaagtttctggacgaacacaggttttcatttctcgtgggtagatacctaggagtgggattgctgggtcacatgtgtggtaagtatatgtttaacttggtaagaaaccatccaactgtttcaggaatagcttagttttgcattttgttttgtttcttcccaagaacctgggccctttcctggcattgtggacatgttcggaactggaggtggcctgctggagtatcgggctagtctgctggctgggaagggttttgctgtgatggctctggcttactataactatgaagacctccccaagaccatggagacgctccatctggagtactttgaagaagctgtgaactacttgctcagtcatcctgaggtgagttcttctctcagatttatgggctatgatgtatcaggtctcttcttaaatggtctgggttttcacagaagttagctcattcatgacagccattccctaccccaacacacactaccttttttagtcacttcttatagacagtttctttctttcttcttcttcttctttctttttttgagatggagtctcactctgttgccaggctggagtccagtggtgcgatcttggctcactgcaacctccacctcccaagttcaagtgattcttgtgccccagcctcccaagtagctgggattacaggcacctgccaacatgcctggataatttttgtattttcagtagagacggggtttcacaatatttgtcaggctggtcttgaattcctgacctcaaatgatccacctgccttggcctccccaggtgctggattacaggcatgagccactatgcctagcctaatttttgtattttttttttttagtagagatggggtttcgccatgttggccaggctggtctcaaactcctgacctcaagtgatctgcccacctcggcctcccagagtgctggaattacaggcatgagccaccacacctggcctcttatagacagtttctattcaattctatattactatatttcctgctagtaaagatatttgtagttggtattatgcaattttaaattccagtatgttttttctttctttttttttttttttttttaagacggagtcttgccgtgtcaacgaggctggagtgcagtggcatgatctcggcttactgcaacctccacctcccaggttcaagcgattctcctgcctcggcctcctgagtagctgggactacaggcgcatgccacttctgcctggctaatttttgtatttttagtagagacagggtttcaccatattggccaggctggtctcgaactcctgacctcaaatgatccacccgcctcagcctcccaaactgttgggattacaggcgtcagccaccacgcccggccatgagatgacgtacttgttgatgacgactcagtttagttatgacagtgggaatgggtggctcaggtgggagacagaaaaagatcatgggagataatgagattaaggaactgagaaaccagagtaattgatagatcttccacatggttatcaccaagagtggtgatggacaaattgtggaaaggaagagatagaggggaggtaaattcccaaagctgcaaatctgggtaaatggtagaacccagattcagactcaggttcaactaacttccagggtgggcacaactcaccatattccactgtttgtggagccattcttcttctttttcctttgtccctttctcaggtaaaaggtccaggagttgggctgcttggaatttccaaagggggtgagctctgcctttccatggcctctttcctgaagggcatcacggctgctgtcgtcatcaacggctctgtggccaatgttgggggaaccttacgctacaagggcgagaccctgccccctgtgggcgtcaacagaaatcgcatcaaggtgaccaaagatggctatgcagacattgtggatgtcctgaacagccctttggaaggacctgaccagaagagcttcattcctgtggaaagggcagagagcaccttcctgttcctggtaggtcaggatgaccacaactggaagagtgagttctatgctaatgaggcctgtaaacgcttgcaggcccatgggaggagaaagccccagatcatctgttacccagagacagggcactatattgagcctccttacttccccctgtgtcgggcttccctgcatgccttggtgggcagtcctattatctggggaggggagcccagggctcatgccatggctcaggtggatgcttggaaacaactccagactttcttccacaaacacttgggtggccacgaggggacaatcccatcaaaagtgtaaattttatttgatcatgtggcctctctgttgctaatctctcctggaaacatctgccacatttagtgtgtgtatgtgtattcattctttctcataacttcttaaagtttcttcccctcattattaaaatgaatttaccagt

SEQ ID NO: 833 - DNA, 40650 bp, Homo sapiens
tgaaagattcatttattcattcaacaaacagtggccgaaggcttgttatgtgctgtgcctggacttggcatgaaggcaccagatgtcagaagcgaggctgctgcccaggaggacacacctgatggggctctgggaccaggacgatggtggagacatcacatccggaataactttgttaggaaggtgaacttgacagttaggacttagttctccttgaagacgtccttcacatcccttgtgagttggattcctaggtattttattctctttgaagcaattgtgaatgggagttcactcatgatttggctctctgtcttttattggtgtacttgtgatttttgcacattgattttgtatcctgagactttgctgaatttgcttgtcagcttaacgagatttttgggctgggatgatggagtttcttttgtgggcatttagtgctataaatttccctctacacactgctttaaatgtgtcccagagattctggtctttgttctcattggtttcaaagaacatctttatttctgccttcatttcattatgtacccagtagtcattcaggagcaggttcagtttccatgtagctgagtggttttgagtgagtttcttaatcctgagttctagtttgactgcaatgtggtctgagagacagtttgttgtaatttctgttcttttacatttgctgaggagtgctttacttccacctatgtggtcaattttggaataagtgcgatgtggtgctgagaagaatgtatattctgttgatttggggtggagacttctgtagatgtctattaggtctgcttggtgcagagctgagttcaattcctggatagccttgttaactttctgtctcgttgatctgtctaaagttgacagtggggtgttaaagtctcccattattattgtggtgggagtttaagtctctttgtaggtctctaaggacttgctttatgaatctgggtgctcctgtattgggtgcatatgtatttaggatagtgagctcttcttgttgaattgatccctttacctttatgtaatggccttctttgtctcttttgatctttgttggtttaaagtctgttttatcagagactaggattgcaacccctgcctttttttgttttccatttgcttggtagatcttcctccatccctttgttttgagcctgtgtgtgtctctgcacgtgtaatgggtctcctgatggtcacactgatgggtcttgactctttatccaatttgccagtctgtgtcttttaattggagcattcagcccatttacatttaaggttaatattgttatgtgtgaatttgatcctgtcattatgatgttagctggttattttgctcattagttgatgaagtttcttcctagcatcgacggtctttacaatttggcatgtttttgcagtggctggtaccggttgttcccttccaggtttagtgcttccttcaggagctcttgtagggcaggcatggtggtgacaaaatctctcagcatttgcttgtctgtaaagaattttatttctccttcacttacgaagcttagtttggctggatatgaaattctgggttgaaaattcttttctttaagaatgttgaatactggcccccactctcttctggattggagtttctgccaagagatcagctgttagtctgatgggcttccctttgtgggtaacccgacctttctctctggctgcccttaacattttgtccttcatttcaactttggtgaatctgacaattatgtgtcttggagttgctcttctcgaggagtatctttgtggcgttctctgtatttcctgaatttgaatgttggcctgccttgctaggttggggaagttctcctggataatatcctgcagagtattttccaacttggttccattctcctcatcactttcaggtacacaaattagatgtagatttggtcttttcacatagtctcatatttcttggaggctttgtttgtttctttttactcttttttctctaaacttctcttctcgcttcatttcattcatttgatcttcaatcactgataccctttcttccagttgatcgaattggctactgaggcttgtgcatttatcacatagttctcatgccatggttttcagctccatcaggtcatttaaggacttctctaccctggttattctagttagccattcgtctaatcttttttcaaactttttagcttctttgcgatgggtttgaactttctgctttagcttcgaaaagtttgattgtctgaagccttcttgtctcaactcgtcaaagtcattctctgtccagctttgttccgttgctggcaaggaggtgtgttcctttggagcgggagaggcgctctgattgttagaatttttagcttttctgctctggtttctccccatctttgtggttttatctacatttggtctttgatgatggtgatgtacagatggggttttggtgtggaggtcctttctgtttgttagttttccttctaacagtcaggaccctcagctgcaggtctgttggagtttgctggagctccactccagaccctgtttgtctgggtatcagcagcggaggctgcagaacagggaatattgctgaacagcaaatgttgctgcctgatcattcctctggaagctttgtctccgaggggtacccagccgtgcgaggtgtcagtctgcccctcctgggggatgcctcccagttagggtactcgggggtcagggacccacttgaggaggcagtctgtccattctcagatctcaaactccatgctgggagaaccactactctcttcaaagctgtcagacagggacatttaagtctgcagaggtttctgctgccttttgttcagctatgccctgcccccagtggtggagtctacagaggcaggcaggcctccttgagctgcggtaggctccacccagttcgtgcttcctggctgctttgtttacctactcaagcctcagcaatgatgggcgcccctctcccagcctcgctgccaccttgcagttcgatctcagactgctgtgctagcaaaaagcgaggcactgtgggcgtgggaccctccaagccaggcgcgggatataatctcctggtgtagtgtttgctaagaccattggaaaagcgcagtattggggtggaagtgatctgattttccaggtgctgtctgttacagcttcccttggctaggaaagggaattccctgaccccttgcacttcctgggtgaggcgatgccttgccctgcttcggctcatgctcagtgggctgcacccactgtcctgcacccactgtctgacaagtcccagtgagatgaacctggtacctcagttggaaatgcagaaatcacccgtcttctgcgtcgcttatgctgggaactgtagactggagctgttcctattcgctcatcttggaactgcccaacactccatccttatctataacccagcattcttctataccccatagaaagcaccccttacactcggacatgcacaggaaggaagctgctaattggagggaagactcactcacactgtccccaggctccactccaaaggtggccagtgcagctctttcacctccattacctccaagtggtgctgtcactcacagtaagcccagaagagcagtctgacctccacatagagccccctcatttccactcctcactgctggctgctggctccacggaccctctaaaaccacccttggtaagatcaccaggggtttcctaactgccaagtaccagtaatgctttatagtcctcaaacatgctgaacgctaagggagttcctgcattcataaagctgcttgcggtacctgggtgctatggtctgaatatgtcccccctaaactcctatgctgaaacctcatccccaaggtgatggtattcagaggtgggatcttgggaggtgattaggtcgtgaggatgaagtcttcacctatgggatcagtgcccttacagaaagacccaaaggagcttgtttgccccttccgccatatgaggatacacaaaaaccgccatttatgaggaacaggtcctcaccagacataaatctactggcactttgatcttggattcccagccttcagagctatgagaaataaatttctgtttacaagctaaatgtaaagtgtttaccagtttatgataattgtgttataacagaccgtatgaactaaggcactggagtcagtccaagagcttagatgtaagggaaataagatcagagcagagatgtgcaagagactggctcctagcagagcaactaagagtcaggcaaataatgtcaactgaggaggcttctgggtccagcagccacccagctgctttaacacatggctcttcatttcctatccccttctctcctggtctgtctttccctctttgatggttctttttcaagctttcattttgagtgttcctcaaatggaagttttcctcaaaacagaaaagttcatatttccttcctaataattaataggaaaaaaatgccaaatggatagaatggactccggataagaatggagaattttttaaagaagaagcaaatatggtttatgaatatattttaaaactgtgcaaaaaagaatatacaaaaaaactcactagaaatcaaataaataaaaatcaaattaatatccaggttttacctatcattgtaaagaattaaaagaatggtatgagctaatataggacaagcacaaagaaatgtgcagacacacacacttttgacggaatactgaaatgggagatccatgctggagaatcattacacagcatgtcaaaatcctttttttaaatcaaaacagagtctcgctccattgctcaggccagagcgcagtggcagagtcataactcactgtaacctcaagcttacaggttcaagtgagcctcggcccttgtcctcctctcaagtagctgggcctacaggcacccaccaccacatctggctaattaaaaaaaaagttttttttagagacggggtcctgctatattgcccaggctggtccctaatccttgggctcaagcagtcttcccacctcagcctcccaaagcactgagatttcaggagtgagccaccctgctcgacctcaaagtcctttgaaaagacttgatcgaaattcaacttctagggttagagctcaagaaagtaactggtcaaatgtgcaaagatgtttgcataaggatgtttatcactgtaaagtttattgtcatagaagcaaccgaaagtgcaacaagaggggactggctgaataaatcctgctctatttctgtagcacagtacctcacagccatgaccaatgctgatgagggtttactgacatgaaaaacattgcccaactatagcaccaagcaagaaaagattataaaacaatatgtttggatttatttttggaaaaatggtattgaaaaatgatatccacaaacaagcatgcagagagaaaagtctgagtggttccaccaaatgttggtagcagttacctctgaaaagaggaattgtgggggattctctgcataaaagataaactctgaaggtctttgcacattctaggcacttggccctgctttcagacagtgaaactgaatcttgggagtctaaagggactcagttatgattgtgagctcctaaaggtaagacccgtgttcggttttattttattatttcaattaatcctattaatgtgcacaattcagtggcatttagtacattcacaatattgtgcaacgaccacccctttcttgttccaaatcatttttatcaccgcaaaaggaaattccttattcattaagtggttcccccttatttccctctctccccagtccctggcaacctaatctgctttctgtctctatggatttatttattgtggatacttcatataaatggaattgtacaatatctgaccttttatgtgtggcttctttcagctgatgttttcaaaattcattcgtattgcatcatgcatcagtacttcattcctttttagggctcaataatattccatgtatgtttatactgcactttgtttatccattcattcattgatggacattaaggttgtttctacgttttggttattgtgaatggtgctgctgtgaacattcaggtacaagcagttatttgaatacctattatcaattctttcgatgtatacctaggagcaaaattgctggttcatattttaatcctgtttaacattttgaggaaatgccaaactgtcttccaaagtgtcagctgtagtttactttcccaccagcagtgaaccttattttactccactgcctgcctcagcactactgcctagaacataaagggaagaagcaatagctgtttttttaccaagaagttattagatgcccagcactgtgagaaagagggcttcccatgttgtgcaatttcatgttaacagccttggagctaaggttggtattattaacatccccatttggcaaatgggaaactgaggtccagaaacctgaggtttcctctccacggccccatatgggaagtgaaagctcaaacctaaggtagctctgactccaaagcctgcactgttttactttttcagtacagcatgctgaccctgcaggcagggatttgacaagtgtttagtgagtctgaaattcacataaagcctcacaagcccagagaagcagctctgtgtggaggcgcataagattcaccagtaaggccccatcacccccatcctgttgccagtggtcaggacacccttgaccaaattcccatatgtgactaaggctctgttccttcttcaagatccagtttagtgctacctgctccgtccacttctgaccacccaaccagatgaatctggtcccagtccctccctccttggaagcctttgcatttctcattaagcacttgtattgctgccatttgttgcttacttaataattaacttatcatagttaattagactagaaattaacagttcaactaccctgataaactattttgtctttctattgcctctatgaacctgattataataaatcattgtattgttggagtcactgttattcccagagctgtcaggtttcagagcagcgtgtcagtgccaccccatgcctgcatccgggaagatcactcctccactggaccagcccagcctggaaaggggccagtgaggcggaaggtggacaatccagggccaatacattctgggagtctcagaggaagagaaaaatcgattcagactcatttaacataggctcctggaaaggatatcatctcccccaatctctcatcaataacccaacatcagatcagtgccctggacttatcatatgaagcagaatgaaagtagacagataggtcatccttggttagatgtccagaaatccgaggatggtggtcctagctcttcagagaggacacgttctttaacctaaccttttaacaaattctctacagaagatatcaggtcccaacatttcaagtagcttcgtagatataggtaatcaaaggactaattatgaaagtgtagatgggtagaggggagcaacaaggatggcacaggaacccatagccctgaggaggagggagagttgttggaacctgaaaggacctgggcagagcaggctgcccttagagcaggcctggggccaaggcacaatcaataccaagcctgcctcacgctctcttccctccactcctcaacttgctgctggctttcagaaaagttaagaacttgccatttctacccctttgccattgttgttgtcttaccataaggcggggagcaatatagtatccagttttctagatatggaagtggaaatcaggtgtatatacccagtatattagtacctattagtattcttattggtattactttctagatgttatgtaactgtagctttggattttctatttaattcaaaagacatataagagttttttttttgctaattccatgttggatttattgtcactacttattaagttataattttaatgtattgtgattagagattgtactgtgttctatttgtgttttaaggatacatagagattttctttgtggctaaatataagtaatccatgggtgttttaaagaaggtagagtttccaaatagagtatgacattccagtcactgtcagattccacacaacatttcagtcagccacagaacatataaatgatagcagtcccatgagattaaaatagtatatttttcctacaccttttctttatgtagatattttagatacacaaatacttaccactgtgttaaaattacctacaatagtcagtagagtaacatgctgtacaggtttgtagcctaggagcaataggctataccttatagcctagatgtgtagtaggctgtaccatctaggtttgagtaagcatacgctgtgatgttcacacaacaatgaaatcacctaacaatgcatttcttaatatacatctattaaatcattttattaattaaattatattcttcctgaatattgattttcttaatctgtcgagaacttcaaagagtatattttaagttaattgaatatagcttttgttaattgaatggttttatatatatatatatatatatattttttttttttttttttttttttttttttgagaaggaatctgcctctgtcacccaggttggagggcagtggcgtgatctcgacttactgcaacctctgcctcctggattcaaacgattctcctgccacagcctcctgagtatcttggactataggtgtgcaccaccacacccggctaagttttgtatttttagtagagatggggtttcaccatgttggccaggatggtctcaaactcctgacctcaagcgttccacccacctcggcttcccaaagtgctgagattacaggcatgagccacagcacccggcctggttatatatatttttattttcggcacataaatattaatgacatgaatattaatgacacttttttcactgtgaatcataccataaatcatataaagtaacttttattttacattttgaatatgttttgccttttattctacttcatccaatacagttttattaaatgtggatttgtaccattgctctttgtccatccttttacttttggcttttctgagtcacttcactcaagtggaagtagcacctacttgaatttaacttttttcccccacccaatttgaaggtctttttttgaagtgagttcaacttaagttcattgttgtaacaaatatgtttggtttaaattttatcatttccctttttgtttttttttccttttctggtaaacttattaagttaatgtttgttaaactaaattccatttcaaacggtgggaaggagtaaaaaacacctaacataaagtttaccatcttaagcattcttaagtgtacaggtcagtaatgttaaatatattcacattgttgtgagacagatctccagaacatttgaatattgcaaacctgaaactctatacccattgaataacaacttcccttgtcctcctcccccagcttctggtaaccaccattctactttctgtctctgtgaatttgtcgataccaagtttggaagataagaaatatcttttaattcctgattttgtgtgataagagaaataaaatatctaccctttagtgactgactcatttcacttagcataagatccttaagattcatccatgttgtagcatgtgacaggatttcctccctttttaagtcaggataattttccgtgggttgtgtgtgccacatttatgtatccattcctcagtggatgggcatctgtgttgcttccacatttgcctattgtgagttgtgctgctgtgagcatgggtatgctgttagctttttaagtccctgcttactgtgcttttggagacatactcagaagagggattactgaatcaaatggtagttctaagtttcacctttggaggaatctcaatactgatttccagagcagttgtgccattttacattgccaccaacagcacacatgagacccattttatctacatcctcaccaatacttgttattttcttttttttttataatgaccgtcctagtgggtgtgaggtgatatttcattgttgttttgatttgcattgctctgatgattggcgatatagagcatcttttcacatgcttgttggccatttgtatatcaactttggagaaatgtctattcaattcctttgcccatttttggtcaggttattgattttgttgtcattgttgaattctgagagttatttgtgtattctgtatatcagaatcatgagttgcaaatattttctcccaatccgtaggttgtcttttactctgttgaatgcatcccctgaggcacaacttaagcctggtggtcccatttgtctatttttgcttttgttgcctgtgcttttggtgtcatattcaagaaagcactgccatattcaatgtcacaaagcctttcctctatgttttcttccaagactttgatagttttaggccttacacataggtctttaatccattttgagttaatttttttacataagactagagtccaacttcattcttttgcatgtgaatgtccaggtttccaagcatcatttgtgaaaaatctgttcttttcccattgagtggtcttggcacccttgtcaaaaatcattttggccagggacagtggctcacacctgtaatcccagcaatttgggaggccgaggtgggtggatcacctgaggtaaggagttcaagaccagcctggccaacatggtgaaaccctgtctctactaaaaatacaaaaaattagctgggtgtggtggcgcacatctgtagtcctagctactcaggaggctgagacaggagaatcacttgaacccaggaggcagaggttgcagagagccaagatcgtgccactgcactccagcctgggcgacagagcaagaccttgcctcaaaaaaaaaaaaaaaatcatttgaccatatgtgagagtttatttgtaggcactttatcatatttcgttggtctattcgtctgtctttatgctactatcacactattttgattattgcacctttggtaatatgtttgggttttcggttgttgttgattattttggtttgtttgttttttgtagagatggggtctcactgtgtttcccagtctgatatcaaatttctgggctcaagtgatcccccagtcttggtctccagaagtcctgagattacaggtctgagacgccgtgcccagccagtaatatgttttaaaatcaggaaatgtgagtcctccaacattgttgttctctttcaaaattgttttggctgttcaggatgtcttatgatttttactgatttcttgccatttccaatcttttttgttcattactatgtaatatatgcttcttattttattttatttttggagattgagtctcgctctgttacccaggctggagtacaggggcatgatcttggctcactgcaacctccacctcccgggttcaagctattctcttgcctcagcctcctgagtagctgggattacaggcatgtgccaccatgcccggctaatttttgtatttttagtagagatggggtttcaccatggtggtcaggctggtcttgaactcctgacctcgtgatctgcctgcctcagcctcccaaagtgctgggattacaggcgtgagccaccatgcccggccataatatatgtttctttgagctgtttttctgataacttagcggccatgtaatctaattaactaatatccttcaaccactttctcaatctatcactctcagacacgaaacagtatctgttgactctatcatatgaaaaattaagaaagtgactgcacttctccccacctgtgcccccacatacagacattcccccaactaaccaataatggttatattttgtggattttgtgtcagctcattgtagtagtattactacattgactagctttacttattcgtggattcttgtaggtttttaagattttatactatgcagccataaaaaatgatgagttcatgtcctttttagggacatggatgaaattggaaatcatcattctcagtaaactatcgcaagaacaagaaaccaaacaccgcatattctcactcataggtgggaattgaacaatgagatcacatggacacaggaaggggaatatcacactctggggactgttgtggggtggggggaggggggaggggtagcattgggagatatacctaatgctagatgacgagttagtgggtgcagcgcaccagcatggcacatgtatacatatgtaactaacctgcacaatgtgcacatgtaccctaaaacttaaagtataattaaaaaaaaattgaacaaaataaaaaaaaaagattttaagtctagttacttttctagggtatgtctcaatgtaggtcaagctctgtttttttattaattgagataaaattcacattccatacaattcttttttagtatataattcagcatgtttttgtatattcagaaagttatacatccttcacccctaattcctgaacatttttgtctccccaaaaagaaaccgtgtgcccattagcagttacctcccattacccttgttcttgcacccccgcctcgccctggcaaccactaatctactttctgtctctatgggtttgcctatatgagacattccacataaatggaattgtaaaatatgtggctttttgtatctagcttctttgacttaacatgatatttttaaggttgtagcgtatatcagtacttcattttttggtttgcagaataaaatccgttacgtggatttacaacattttatttatatattcatgaatggatggatacttgggttgtttgtacttttttactttcacaaataatgctgttataaattgttatagattgtgtacacgtttttgtgtggacataattttttcagttctcttggatatatacgtaggagtagaacagctgggtcatatggtaactctctgtttaacctttgagtaactccccaactgttttccaaagtggctgtgccgcgttatatttccaccaggatcatattagggtttcagtatttccacgtcctcgtcaataattgttattttctgatttttgattataaccatcctaatgagtgtgaagtgtcatctcattgtggttttgatttgcatttctctaatgactaataatgagaagcacctttttaagtgcctattagccatttgaatatcttctttgcagaaatttctattcagatcctatgctcatgtttaaattggcttatttttgttcttttattattgggttcgacgtgttctccatatattctgaacagcagtcccttattcactatgtaatttgaaaacatgtctcccattctttgggatgcttttcactttcgatggtatcatttgcagtacaaaatttttagttttgacaaagtccaatttatctacttttgtcatttgtgtttttcatgttgtgtttaaaactattgcctaacccaacatcacacacaaaaaaagtttacttctttgcttttttctaagagtattataattttagctcttaaattagggtctatgatcattttttagctaatttttgtatgtaatgtgaggcaggggatacagtttcattttttgcatatggatatccagttgaccccgcaccatttgttgcagagactattctttcttccattaaattgtctggggtcctttgccaaaaattaattgaccataaatgtaagagtttatttctagactcttaattctatttcattgatccatatgtctctgcaaatgccaccaccacaccgtcttgttgtggtgttcttgtggtaaattttgatgtgtgagtcctccaactttgtttttcttttataaaattgctttagctatttatgggttctgtgaactttaagatcagcttgccagtctctgaaaaaaaataaaaggcagcatgaatcttggtagggatgtcattgaatctatagttggaattggggagtactgacatcttaaaaatattaagacttctaatctatgaacatgggatctattcccatttagttaagtcttctttcatttctttcaacaatgtttatagtttttacttctttgcagttcggcacatctgtcattaaatgtatttctatatattttcttctttctaatgccattgtaaatgaatttgttttcctaatttcatttctaggttgtttactgctagtgtatagaaatacaactgatttttcttacattgatcatagattgtacaagcttgctgaacttgtttatcagctctaataatttgtgtgtgtatatgtgtgccttaggattttctatatagaataccatgtcatcttcaaatagagatggtttttctttctaatcttatgctattttttctttttctttgctgattgcctttgtttgaacctccagaactatgttgaatagaagtggcaagaatggatgtccttgtcttgttcctaatcttaaaagggaaagcttgacagtcattaagcataatatgagggatgagttatttgtagatgccctttaacaggttgaggaagttcccttccattcctagtttgttgagtgtttttaccatgaaagggttttttattttgccagaagccttttctatttctattgagctgattatatgttttccctttattctattaatatggtgcattatattgatttattcatatgataaaccaaccttgcattcctgagataaatcccacttggttttgatgtgtaatcccgtttctgtcttcttggattcagtgagctagtatttttgtagtattttacatctgtagtcacaagggatattggtctgcagttctgtgatatcttcgtctgcctttgatatcaggataatactggcctacatagaaggaatcaagaagtgatccttctgattatgttttttgtatgagattgtgaataattggtgttacctcttctttaaatatttggcagaacttatcagtgaagcttggtccaagctttacttttggagaagttttctgattattaactcagtcttttctcattataagcctactgagattttttatttcttcttgaatcgattttgatcatttctttatctagaaatttgtctacttaatctaggttgtctaatatcttggtatatgattgttcatagtatcccctcatccattcttaattttagtgatttgagtcttcggtttttccttggtgaatctagctaaagatttcagtttttgttgatgttttcaaagaccaaacttggtttctttaattttctcttgcattttcctaatctctgttttatttatttccattctaacatttagcatttccctccttctacttatttttgttttagttacatagaactttagttacgtagagctcatctttttctaattcctttttaaaataatttcaatttttattatagattaaaggacacatgtgcacatttattacatgggtatattgcttgacactgaggtttggggtataaataatcccatcacccaggtggtgagcatagtacccaatcggtggtttttcagcccattccctcctcctttcctcccatctagaagtcctcactttgtattattctcatctttatgtatattcagtgttcagctcccgcttgtaagtgagaacatgcagtatttggttttctgttcttgcattaattggcttaggataatggcctccagctccatccatgctgctgcaaagggcatgattttattttatttttatgtctgcacggtatttcgtggtgtatatacactacattttctttatccatccactgttggtggccacctaggttgatttcatgtctttgctattatgaatagtgcgggaaagagcatgtgagtacatgagattttttgacagaatgaattcttttccttcgaatatatacccagtagtgggatcgctgggttgaacagtggttctttttcagttctttgagaaatctcccaactgctttatacaatggctgaaccagtttgcattcctaccaacagtgtataagcattcccttttctctgcagccttgactgcatctgttattttttgactttttaataatcagaattctgactggtgtgagatgttatctcattgtggttttgatttgtatttctctgatgaatggtgatgttgagcattttttcatgtttgtcagctgcttgtacatctgcttttgagaagtgtcttcctgttctttgctccccctacttttttttttttttttttttttttgagaaagggtctcactctgtcacctaggcggtagtgcagtggcacgatcttggctcactgcaacctccgcctcccaggttcaagcaattcttgtgcctcagcctcctgagtagctgggattacagctaatttttaaatttttagtagagatgggatttcgccatattggccagctaattttttaaatttttagtagagatggggtttcgccatattggccaggctggtcttgaactcctggcctcaattgatcttcccaccttggcctcccaaagtgctgagattacaggtgtgagccaccgtgcccagcccctttgcccatttttacaaatggaattatttgatttttgctttttaaatttttacatttccttacagattctggacattagagatttgttggatgcataatttcctaatattttctcccattctgtgagttgtctcttgattgatcatttattttactgtacagaagctctttggtttaattaggtaccaatcatcaatttttttattttgttacaattgctattcaggacttagccataaactattttccaaagccaatattgagaagggtatttcctaggttttctgctaggatttttgtagtttgaggtcctccatttaaatctttaatgtaccttgatttttttaaatatagtgagaggtaagggtccagtttcttctgcatatggctagccagttatcccagcaccatttattgaatacagagttctttcttcattgcttatttttgccaattttttgaaggtcagatggttgtaggtgtgcaggtttatttctgagttctctactctgttccattggtctatttgtctgtttttgtaccggtaccatgctgttttggttactgtagccttacagtggagttttaagttgggtaatgtgatgcctttggctttggtgtttttgcttgggattgctttgactatttgggttcttgtttggttccaaatgaattttagaatacatttttctaattctgtgaaaaatgatatgctattttgatagggatagcattgaatctgtaaattgctttgggaagtgtggccattttaacaataatattgattcttctcatccataagcatggaatttttttccatttatttgtcatctctgatttcattcagcaatgttttatagttctccttgtagagatctttcacctccttgattaggtatttcattttttgtggttattgtaaatgggattgtgttcttcatttggttctcagctagaacgttactgatgtagagaaatgctactgattttgtatcctgaaactttaataatttgttcatcaggtccaggaggcttttggtggagtctttagggtattctatgtaactcatatcatcagcaaagagagatagtttgacatcttgttttcctatttggatgcctttcacttctttctcttccataattgctctggctcagactttcagtactagaagtggtgagaatgggcatccttgtcttgttccagttctcaaggggaatacttccaacttctgcctattcagtatgatgttggctctatgttagtcatagaaagctcttattattttgaggtgtgttccttcaatgccttgtctgttaagggtttttatcatgaaggggtgttggatttcatggaagatgttttgtgcatctaccaggctgctctggggtccaaggcctatggaggtcccttgtggacttgagtgttgcctccttatacactctgggcaggcagctccctgtatcagtctatatgcctgggggtcaggaggaatctcccatcccaggattgcacaggtccccgcaggaagtgtagatcccccaggggctctcactcactatggaaaccatttagttgcccatagtaatgtggttgaattctctttaactgccttatacatgtttataagttgctgtttgaatccccttcccaggacatgactggtaattgtgtgtggtttgtattaattttgttccttggagcttggagaagccagagagggagtaggtgattctaggactctgtgcaacctcctgaagtgacatttttctctgcgattgttttaaaactcacaaactgatggctgctttagcaattgcagggtaagggaaatacctagttctatgggacgtgcccttgaggttttgcttttgtacttctttaaggtggctgttggctgctttggtggcttcctagtgtacagtaatattgctgggcctgattttttttctagcaaatcttcataatgcagctaagctattcagatctaagagataattttctagacatttttctgatttctttctggctagaaggagtatatgattaatcttcattcaagctggggcagaaatgctgttttcttttttaaacagggttgcatgtctctagttgagaagtttatctcttaccttagtcaccttttctgtcaaaagtgggctatccgtagggtattttgaatgtaatgactcacctttcaccctctgtatgtatgatcctttgtggagaaagaactgtgtattagctctaaatttgtgatatgagttgagccccttctctggattctgaagattcttttcatgttttgtttgtttgtatatttcagtcatggaagaggagattcattatacctgtctatttcctaaaatccatcacctgttttctcagtgtttctctctctcctatttactcagcttctctgtatctataggctgcttcctcttcactggaaccatgctttagtcattcctcacatggactggggaggacaagtgtgacaggatggcttctgttgatgtttctactgccttacatctttctctttattaccaaatatgtaatcttttattaagtataaagataaaaggatagttaaatataaagagttcaacaacatagaaaataaaaaggccttgtaattcatccgtaattctccccatcctgaaatagtcctgattaacattttatatataatcttccagttttatattttatgattcacataccttgttttattttaaaaaatggaattataccaggtgatttgaaagtcttattttcaacttttgtttgttttgaaactgttcatttaatatatcataatagacatctttctgtgtgaaatacagatttatgtagtcttttttattgctttatgagttccattgtatacttatactgtttaattagttccctaataacagatatttaaatcatttaaaatatttcttttttattattattatactttaagttctagggtacatgtgtacaacgtgcaggtttgttacatatgtatacatgtgccatgttggtgtgctgcatccattaactggtcatttacattaggtatatctccgaatgctatccttcccccctccccccaccccacaacaggccccactgtgtgatgttccccatcctgtgtccaagtgttctcattgttcaattcccacctatgagtgacataggtgtttgtttttctatccttgcgatagtttgctcagaatgatggtttccagcttcatccatgtctctacaaaggacgtgaactcatccttttttatcactgcatagtattccatggtctatatgtgccacattttcttaatccagtctgtcattgatggacatttgggttggttccaggtctttgctattgtgagtagtgccacaataaatatacgtgtgcatgtgtcttgatagtagcatgatttataatcctttgggtatatacccagtaatgggatggctgggtcaaatggtatttctagttctagatccttgaggaatcaccacactgtcttccacaatggttgaactaatttacagtcccaacaacagtgtaaaagtgttcctatttctccatatcctctccagcacctgttgtttcctgactttttaatgatcaccattctaactgttgcgagatggtatctcattgtggttttgatttgcatttctctgatgggcagtgatgatgagcattttttcatgtgtctgttggctgcataaatgtcttcttttgggaagtgtctgttcatatccattgcctagttttgatggggttgtttgatttatttcttgtaaatttgtttacgttcgttgtagattctggatattagccctttgtcagatgggtagattgtaaaaattttctcccattctgtaggttgcctgttcactctgatggtggtttcttttgctctgcagaagctctttggtttaattagatcccatttgtctattttgtcttttgttgttattgcttttggtgttttagtcatgaagtccttgcccatgcccatgtcctgaatggtattgcctaggttttcttctagagtttttatggtggtaagtctgacatttaagtctttaatccatcttgaattaatttttgtataagctgtaaggaagggatccagtttcagctttctatatatgtctagccagttttcccagtaccatttattaaatagggaatcctttccccatttcttgtttttatcaggtttgtcaaaggtcagatggttgtagatgtgtggcattatttctgagggctctgttctgttccattggtctatatctctgttttggttaccagtaccatgctattttggttactgtagccttgtagtatagtttgaagtcaggtagcgtgatgcctccagctttgttcttttggcttaggattgtcttggcaatgcgggctcttttttgattccatatgaactttaaagtaggtttttccaattctacgaagaaagtcgttggtagcttgatggggatggtattgaatctataaattaccttgggcagtatggccattttcacaatattgattcttcctatccatgagcatggaatgttcttccatttgtttgtgtcctcttctatttcattgagcagtggtttgtagttccccttgaagaggtccttcacatcccttgtaagttggattcctaggtattttattctctttgaagcaattgtgaatgggagttcgctcatgatttggctctctgtttgtctgttattggtgtataggaacgcttgtgatttttgcacattgattttgtatcctgagactttgctgaagttgcttatcagcttaaggagatttggggctgaggcaatggagttttctaaatttacaatcatgtcatctgcaaacagggacaatttgacttcctcttttcctaattgaataccctttatttctttctcctgcctgattgccctggccagaacttccaacactgtgttgaataggagtggtgagagggcatctctgtcttgtgccagttttcaaagggaatgcttccagtttttgcccattcagtatgatattggctgtgtgtttgccataaacagctcttattattttgagatatgtcccatcaatacctagtttattgggagtttttaacatgaagggctgttgaattttgttgaaggccttttctgcatatattgagataatcatgtggtttttgtctttggttctgtgtatatgatggattacatttattgatttgcatatgttgaaccagccttgcatcccagggatgaagccaatgtgatcatggtggataagctttttgatgtgctgctggattcagttttccagtattttattgaggatttttgcatcaatgttcatcagggatattggtctaaaattctctttttttgttgtgtctctgccaggcctaggtatcaggatgatgctggccttgtaaaatgagttagggaggattccctctttttctgttgattggaatagtttcagaaggaatggtaccagctcctctttgtacctctgatagaattcaactgtgaatctgtctggtcctggactttttttggttgataggctattaattattgcctcattttcagagcctgttattggtctattcaaggattcaacttcttcctggtttagtcttgggagggtgtatgtgtccaggaatttatccatctcttctagattttctagtttatttacatagaggtgtttatagtattctccgatggtagtttgtatttctgtgggatcggtggtgatatgccctttatcattttttattgcatctatttgattcttctctcttttcttctttattagtcttgctagcggtctatcaattttgctgatcttttcaaaaaaccagctcctggattcattgatttttggaagggttttttgtgtctctatctccttcagttctgctctgatcttagttatttcttgccttctgctagcttttgaatgtatttgctgttgcttctctagtttttttaactgtgacattaggatgtcaattttagatctttcctgctttctcttgtgggcatttagtgctataaatttccctctacacactactttaaatgtgtcccagagattctggtatgttgtgtctttgttctcattggtttcaaagaacatctttatttctgccttcatttcgttatgtacccagtagtctttcagaagcaggttgttcagtttccatgtagttgagcggttttgagtgagcttcttaatcctgagttctaattgggttgcactgtggtctgagagacagtttgttatcatttctgttcttttacatttgctaaggagtgctttacttccacctatgtggtcaattttggaataagtgcgatgtggtgctgagaagactgtatattctgttgatttggggtggagagttctatagatgtctattaggtctgcttggtgcagagctgagttcaattcctggatatccttgttaactttctgtctcgttgatctgtctaatgttgacagtggggtgttaaattctccaattattattgtgtggaagtctaagtctctttgtaggtctctaaggacttgctttatgaatctgggtgctcctgtattgggtgcatatgtatttaggatagttagctcttcttgtttaattgattcttttaccatcatgtaatggccttctttgtctcttttgatctttgttggtttaaagtttgttttatcagagactaggattgcaacccctgcctttttttgttttccatttgcttggtagctcttcctccatgcctttattttgagcctatatgtgtctgtgcacatgagatgggtctcctgaatacagcatactgatgggtcttgactctttatccaatttgccagtctgtgtctttcaattggagcatttaggccatttacatttaaggctaatattgttatgtgtgaatttgatcctgtcattatgatattagctggttattttgctcgctagttgatggagtttcttcctagcattgatgttctttacaatttggcatacgtttgcagtggctggtaccggttgttcctttccatatttagtgcttccttcaggagctcttgtgagacaggcctggtggtgagaaaatctctcagcatttgtttgtctgtaaaggattttatttctccttcacttatgaagcttagtttggctggatatgaaattctaggttgaaaattcttttctttaagaatgttgaatattggcccccactcctttctggcttgtagagtttctgctgagagatcagttgttagtctgatgggcttccctttgtgggtaacctgacctttctgtctggctgcccttaagattttttccttcatttcagctttggtgaatctgacaattatgtgtcttggagttgcttttctcgaggagtatctttgtggcattctctgtatttcctgaatttgaatgttggcctgccttgctaggctggggaagttctcctgggtaatatcctgcagagtgttttccaacttggttccattctcctcatcactttcaggtacaccaatcagacatagatttggtcttttcacatagtcccatatttcttggaggctttgttcatttctttttactcttttttctctaaacttctcacttcatttcattcatttgatcttcaatcactgattctctttcttccacttgattgaatcagctactgaagcttgggcatctctcacatagttcacgtgccatggtttttagctccatcaggtcatttaaggtcttctctatgctgtttattctagttagccattcatctaatcttttttcaaggtttttagcttctttgcaatgggttcgaacatcctccttttgctcagagaagtttgttattaccaatcatctgatgcttacttctgtcaactcgtcaaagtcattctccatccagctttgttccattgctggaaagcagctttgttgctttggaggggaagaggtgctctgatttttagaattttcagctgttctgctctggtttctccccatgtttgtggttttatctacctttggtctttgacgatggtgatgtacagatggggttttggtgcggaggtcctttctgtttgttagttttccttctaacagtcaggaccctcagctgcaggtctgttggagtttgctggagctccactcctgaccctgttcacctgcgtatcaccagcggaggctgcagtacagcaaatattgcagtacagcaaatgttgcagcctgatccttcctctggaagctttgtctcagaggggcacccagctgtatgaggtgtcaagttgtcccctaatgggagatgtctcccagttagggtactcgggtgtcagggacccacttgaagaggcagtctgtccgttctcagatggcaaactccatgctgggagaaccactactcccttcaaagctgtcagacagggatgtttaagactgcagaagtttctgctgccttttgttcagctatgccctgccctagaggtggagtctacagaggcaggcaggccttgttgagctgtggtgggctccacccaattcatgctttccggctgctttgtttacctactcaagcctcagcactggcggacacccctcccccagcctcgctgccaccttgcagtttgatctcagactactgtgctagcagtgagtgaggctctgtgggcatgggaccctccaagccaggcgtggggtataatctcctggtgtgccgtttgcttagactgttggaaaggtacagtgttagggtatgagtgtcctgattttccaagtaccatctgtcacggcttcccttggctagtaaagggaattcccctaccacttgcacttcccggatgaggtgatgccccaccctgcttcggctcacactccatgggctgcacccactgtccaacaagccccattgagatgaacctcgtacctcggttggaaatgcagaaatgacctatcttctgcatccctcatgctgtgagctgtagactggagctattcctattcagctatcttggaaccctccggtggttttgaagttcatcactttttttagctatctccaggcctccttatctcacatgaaaattatatgcaagtgtcacttcagaatttccttctgaagatgcatcagactaatgtttggctagcattctcttcagagtttttccaggcccagtgaaaatagccaggctttttttgtcttaccaccttacaacaaacagcttaagtcctatccaactactacattctcccaacacagatacaaggcagcatgttcacattatctcaagcttcctccaaatacatctcaacagttagaattggattagaaagaggacttgttggcttgcttatcctgtgggtaactgtgacattgactgcaggtaataataacaagatctcttttatttttctaggtggcaaaccatgtgatttcttctgactctatttcctcttctgccagtagtttcctgagctcgaactctactttttgcaacaagcagaatgtacacatgttaaacaagggcacacaagcaggtaattacttgaatctgaactttttcattgaaatacattgaaatggctcttaaacatataagatactcaacctcaatcatagtaaaggacatgaagttaaaactatatccaactgccaattttcatcttatcagattggcgtaaattcaagtgtgatggcaagtttgtgggcaagagtgtagggaagtgtgttcccttgtatattccagtgggagtagaagttggtttactgtgaaagacaatttgacaggtcctgtcaaaattactttcactcagcatttttacctttgaaatgtctgctatagatatactatgaatatgtggattttaacctatagatatacttgcatatgtgcaaaatagtgtacaaaattaaccactgaaacattgttttttatagcagaagattaaaatgaatttaggtattcctcaatagctgaatgattacataaattattgtatatctggataatgaatgaaattctacatagaatgaggaagctctctctttactaacgtggaaagatctccaaggcatataactgattttaagaaaaggtacagaacagtgtatggcatactacaatatgagtttttttaaataaaagaaataaaggagggaagagaattgcttaaatgtgcaaaatgaattctctggaaccatatggggttgtgaacagagtaaatggagaccagaagtgggaaggaggatttttagctattgcctttctatacttttggtttcataaaataaaaataaataaactttcttgatttgtttcttcccctcaaatcctgtctttacttctgtcaacctcttccatacctgggtgactaccaaaaggactctaagtatttattgtctttctgccttgggatccaggtggaaattctttaccctttgaacccatattcattcttctttccctctcatacctaaaatgacttacaaataaaaccctttcttttttcttctccctctttttccctcctactctcccctgtccttccttcttttcctctctcttcccatcactccatcccacacaaagggattgtatttttgaaacattaaaaaggttcacatactcacttgaataaacctgtcaactcagcctcaaggttactcccagagacacctgtgatccttcccctcaggtaacttggagattgtgaacggtgccgaaaaacacactcgagccaactccaagttccagcgaggctaaattggaagaggacagtgatgtgacttcttggtcagaagaaaaacatgaagagaaaatgctctttaccagttatcctgaggacagaaagttaaaaaagaacaagaagaattcccatgaaggtcagtttctcattccagatcttgtagtagagaaactagtgaatttcaagtcccctgcaatgctgactctgtgtttccaagtgattctatgtgacccccacctacccccagtcaccaccttgtcagattttcgaagtccagcatggcagttacacagtcatccctgcagtgaaaccaaactcaagggcaccctgtggccgctgacagctgagacccctgagagcctgtattatatgcatctccttgatgaaagccaggtggggctgtaaaaagtgaaaattctgttttacttctaaaaactatttcctgtaggagtttcctggtttgttcctgtggaaaatgtggagtctagataaaaagaaggaaaacatgctcaagactcatgaccctggcatctcccggttggaaccagtaaccaagaccaagccgtggagggagccactgtgggagcggaactggcaggggcagcacctggacagtcggggctacctggcaggcccaggcagagaggatggcagaaacccactgaagctgtttgtgagagcaaccctgcaggtgcagtgacgtttacttaactttagccctacatgtagggagaagaagggtaaggcgcagagaagctggctctgtgacttggcgagctgaggtgtaggcctgagacgctcttttccagcacctccgcagttcacctgttttcacacgtgaggactgagtttctcatcatctgtcaaaggctgccttactcttagccatagatggtgcatcactgtcaggatctggagacaagggcacaggagggaggatttgtggctctgctcattgggtttgtgggtccctgtgtgtggagggcccagaggcctgatgcttgtgcagcctcatgcatgttcctccatgtccgcagctcctgtttctgctccatgtcggatttaaaggaaaccaagtctcttctgatgtgtccctctggggataaaggaaaagttattaatgatgtatttgtttgaatagatctttaaaatagcagcatgggcagagctgtattgcgttgatgtttcagagagttgtaatcgccatagtcttagttcctggcctatgctgaaggcatgtctttgatccctgtgggttccaagctgcagctctccgccatagagaggtgtcagaggtttcttcaactctaggtattttctcggcatttgaatcaggcttccccagacctcttgggtacgtggtgtgtttccagccatatggagagtagattgcatcattaatctgaggctgggtattttctctctctctctcttttttttttttttttttaaggaatcgcttcagtttcacagacctgacttcatctcccacattggggagcggataaagcgtctgaagttaatagtccaggagagaaagctgcagagcatgttaaagagcgagcgggatgcgctattcgacattgacagggaacggcagggccaccagaatcgcatgcgcccactacccaagagaggtacgccctgcccgttcactttcctgtgagtggaatagagaaggcaaggtctgctgctgtgctgcagagccctgctaaaggccagcccaggccagttacctgggcagacagcaaccttttgcttgccaagactcaaaccttcttagctaacagaacctccccaccttagccgtcagcacattcatgatccaagtaagcccagttactctagccctgtcactgcatcttaaaccagctctgtctgtgagcaagttagttccaaaagtatattgatttttcctgaaaagatggggctgattccaggcttgcctacctcttaggatggtaataatgataataataaacacatagtccttacatcttgcccaggcactgttcacattagcgcttacagcactctcagtaggtactattaatatatctactttatagtgagaaaactgaatcaaagggagattaactacctctcccaaggtgacatactcaggtgtgctgctctggagtctgcattcttaacaattatggtaagcagatcttgataaaataatgaaagctgtgaaaactacaaagtactatctaattctttcatcaagccttacctggaaactggccagttttttaattcaaagcctagtctttgctacagagtgttaggtccttagggccttaggctgctgtcctgttaccctagtctaaccctggcttgccttggtcattgctccccactcagtcttgccagctcagggtaggggcaccaagtcctagcagctccctctcccagctcttgcaccacaccctctgggttaagtcactgtccactgaaaaccctttcttctcttccttagtcttcctggctgtccagaagaacaagcctatcagcaagaaggaaatgattcagaggtccaaacggtaagaccaagaaaacaagagtttgtgtacaagtgttaaccaggccaccaagtggtcaggagctctggcttgcacccagaataaaggcattatgctcaaatttaaacattatgagaaagttgtgagagtcatttctcacttatggcactgaaaaaaaaagtagcacatcatggtatgaatgactcatatgcaaaagatgaaaaacttctcattaatttgcatatcttaggctcctctttattaacctaaatgtaaataaagaatattttaggccaggtgcggtggctcacgcctgtaatcccagcactttgggaggtcaaggtggataaatcacttgaggtcaggagttcgagaccagcctggccaacatggtgaaaccccgtctctactaaaaatacaaaaagtagccgggcgtggtggtgcacgcctgtaatcccaaccactcagaaagctgagccgggaggatcctttgaacctgggaggcagaggttgcagtgagcttagatggcactactacactccagtctgggtgacagagcgagactccatctcaaaaaaaaaagattattttaaaataaaattaaatatgtatttgggttattataccttttatcttagcaatcccatttcttggaattgatcccatagggtgagaaagaacagtgttctccagaacatattaagttaaacttttttaaaaaattaaattttcgaagtatgtcaacactgtttccatttgtggtctttaaaagtaagtatttgtgcctatgtagacgtgtatacttttatatgcatagaatatttctggaagacagaaaaacctgataatactgattgcctttggaaaggagaactgatgtaggatgtagtagattttttgactttttgaatgttgtgtcatgaggaacgaacattagttactcataaattaattcatttgagtgttggatgtggtggtacatttctgtaatcctacctactcaggagtcttaggtgagagaatctcttaagcccaggaatttgagactgcagtgagctatgatcacaccattacgctctggcctgggtaacagactgagactctgtatctaaaaaataataaataatattttaaaaaattaattcatttcagatattgatatattgatcatgggaatgccagagaataagttaaggttgacttttttaggtgttcattagagacttgctttaatgagaatagtttcttagttggcataatgcttctgaagtaaaggtactttaaaacagtttatcttacggactttaagcattcctcttgaaatcttgtttttactctttctagtcagtctttataggcaatccaaagggatgctttggatgctttagtccagtggttctcagagagtggtctgtggagtcctggaagtcgctgagaccctttcaggcaatttgcaaggtcaaaactaatttcagaatgacaccaggatgttctgtgccttttttgctgtgttggctatttgcactgatgatgcaagagtactgggagaggagtaaaaccattggtgtcttaccactattcaagacggtggcaccaaaccgtactagtctaataggcattgtatcctgcacagcctcccgccaggagtgtgatggaagaacaaggaagcagtgtaaatggaggtaaacgggaagcacttcctttgcaccgtgaaagatgatgactgtttcaaggaaaagcacttatgccatggtttgtgtcgtgagctgaaccagctgcctttgtcatggaacatgacttttaattgaaagagtaactgacagaaaaccaattattctgacttgtgtttagcagacattttcttgaaaatgaagaagtgactctctgacttcaggaaaatgtctgacagtatctgttgccaaagaaaatgtgagttttcaagccaacaatagaattctagaaaacttgtattcaccaccatgggcttgatgacatcttagtacttagacctttctgacgagatagcagtgacattaacaaatgtgacgtttttcatgttatctaaatacatttgtcaacatttggaagatctgcacaactccctggaccaggattttccaaatgattgttgctttttgttacaaaatcagggaatagatagaagattcaaatagtacaagatagactgatggatttttatgtaacagaataggaaaagtttgctgacatgctttcagattccaccttgcaactaatttttaagaaactaccacttgtcagccaggcacagtggctcacgcctcataaaatgagttggaatgaagtttttctttcttattctctagaagaatgtaatgtaatttattgcttaaataattaggagaattcaccagtgaaacccatctgggcctggattttcttttgtgggattcatttttttcaataactattcagatttcagtttttcttttatgccaaggtttagtaagttgtgttttttacgtaatttgttcatttcctagaaatttacaaattgatgatccaatgttataatatccttttgttatctttttttttttttttttttgagacggagtctcgctctgtcgccctcaggctggagtgcagtggcacgacctcggatcactgaaagctccacctcccaggttcacaccatcctcctgcctcagcctcccgagtaggtgggactacagacatccgccaccacgtctgactaattttttgtatgtttagtggagacagggtttcactgtgttagtcaggatgttctcgatctcctgacctcgtgatcagccctcttcggcctcccaaagtgctgggtttacaggcatgagcccccgcacctggccctttgttatctttttaatgtctggacgttctaggatctgtagtgatgttccgtttttattcctgatattatttttgcctcctgtcatttttacctgatcactctttccaaggggtatataaatttcactagtattgtcaaataacccactttgggttttattgatttttctctatcgtatattggtcttatattgattttttgttgtttattttggggccgtagcaggagccacagccagctccacatagttcagagggcctggcaagtatggaggaagacccttgctttcccctggaggtgctgagagtttaattcccgaggaagtaaggggattatttccctgtattggcaaaggttctagtttttgagtagaactagaggacctcacttctcttgaaggagaagtagagaggctcctcctcattcccttccctacaagtccccacgtgactgattcttcctctccaggggcttctagaattagcaacattgttccctttgatcctttggctgattacatatcctgcatttcttctgtagggctgggtgttgatagagggccataagacattatacataaggtattttatcccatttaccttgtttcttacaaaataagtcccagttggagaattgtagtattaatgtatgtaagtaactcatgttcagaccatctctcttgattccgtagggaacactggggccatatggtattacagtaatatatcatttgctttttggtcatggatatgggtatccaaatagtttccagtgctggaggaggcactgtaacgggctctcctccagtattgagacctggttccccatattctagggtctttgcccagaaggctgattccaccctccaagaagcttccactggggattagtgatgacacaaatcctgtaactcttagcctgtaggatatttctggtcctttcagcttgctgctacacgcaggccactatggagtggaggtgctgggaagctaggagaggacaataggggttgcctctccctggatcatgttcagtctgggtagcttccctggaaatctcatggagattccacagtagttccggatccagcttgagtggtgggaggtatgtaaatcaatcaagtaagcaaggtgttctttctggagagggtgcacactctgctcatgtaaagtctacatcactgtattttggttccaggaattcccacccaaactgccccattctaaattaggcctcttcaaatcaataacagttcttctgtgactgctggaatatggaagcccaatattttagggattaccacagactaaggagaagggaatccagacttcacatgcattcaggccacaaagaaacacaagtattggcaaaagtgacaagcattcagcctacagatataccagacagggacaaagtcttaaagatgagagtcctcgtctttatattagggcttcccctgttaaaatggatggagacatctctcaactcctagacctgaaggggagtcctgcccattcccaacagtcctggatcccttgagctaggtcctaaacctgacaacccagagtcctaataatcaaaaccaaaaccactcttttagtcagttcacagaaccaccaccacttactgcctcaaaattgcaccaaatgaaaggtccaagcagccacttctgctttcctggtgggctggggggatggggttggcatgcctgaggcccttcaccaatctccctcttggcaacttaacccactcatgcttcctcagactgctgcttcgcctgtaagcagcctataagggaggtcgagtcagggctcagtccatagtcccatctggatcaaccagatttgtttcccaggccctcccaccccactgcctccaaaaaaaaagcggggtttgtttgcctggtgagtaacaaaagtcgctgagaacacagactttgatcaataggagttttattacttgtcacaagtaggaagagctctgggaatattcgtcaaagcagtgtctcctaagagaaaatgacaggaaggctttatagagtgatcgagaggggagaaggtgcatcatcacatgaagaggaggggtcccagtgacacagatggagggagtcatcgtgccaccacataggacgcatgctatggtaatgaaactatagctctcccagggtgcaggatttagcattgtaatgaggaaagttcactgtaagtgagttcatctataagttgctggggtctgtcaggagcaggttccaactgactaggtgaccacatttcacacagggtttgagacaaaaccgtctgcaaggcagaaggctgtaaaacgggctaattgctcaaattcattaaattccttcactccctgggggcccgccctgtcttgtctatatagccagtccttaggaagtgaggccaagctgaactgttgacacagtctatgtctttacgagtctgggagctgggtgattttacctctgatgctagacttatttttactggttttgaagccttgcttacagccctttcccagtttctcacgaaatactcatgaaaggggatggtggggagtgggcatggggaaaagggaatgatattaaaattaaagctaacatcattggcctctagggggcactcatggctcatctccatagcccttggctcttgcagctgcccaagatgagagtcctgatctaaggaaactccaccaccaccaaggctggggtggtggcaatgggggcattattttccaaacctgactaggctacattttaaggggatcatagtcacagagaacatagatgtggactattaattttctttgcctgagcagccgtagccctatgtgctcctctccagcctttcagggagctatgatgggccaaaaaatgctcagtagcccaagccatctcctccatagacactggagtaaaatctctgcctatgggtgtgtgtgtcttgtcttactctatcctggatttgtttcctccaatgctggtggctttactttagatagtctgattgttgcagagatgagacccaaggctccactctggagaaaatagagccctcttgagaggtcagcccaacttgctagacttctgcatggggcttggggttcaatgttccagcctgtccccaaaaagtcatggccaaattcacatattcctttgatccctgatggtgtctcatcacacagttcgtctggcctcaccattgctccactaagtccaggaacctcaaggaactatgagacaggtagggctagacttaacaaaatggctatcacagtcttcatttcatgagacagaggtgaactgagaaaaggtggaaggtgcttcagagacttctctgtattcatccctaacttaggcagagagccttggccacacaggaaactggggaagacccctctcttactcaggagtcccccacactggtgccatcttatgacaggcaggcatcagcttcagagccagtcaaacagttaggaatagcaaacattgctccagaatttgttggggttttttttcccctgaatttgatagtaagctccacataggcaagaatgacaaccatcttgttctccttgtttctctggagtctaacacaacatgtagcacgtggttggcccaataagaatttgtcgaatgggggccagatgtggtggctcatgcctgtaatcccagcactttgggaggctgaggtgggagagtcgtttgaggcctggagttcaagatcaacctgttcaacatagtgagacccctatcttcttttttttttttttttttttaaagtggagtttgttgaatggcacacagaaaataaacaatccaaatgacagatcagaggtgctggaaaagaccagggagatctaatcgttaaatcacgtcatctaaatattaagaggagacatttggacatctgatagaatttggcattgaataagtgataaatacacagaaaactgaacaacggcaaaaagaaaagtatcagttctaagggaaaagatacaaatcaaaagccttcaggaaaggataagtcatcatggcttactgtatagcttagcttaaaataacacagaatagtgaagtagcccaaagggccatctaaccacactgggaagctgagcaggggaggagtgcgtatatgcatggaggagacttgtcttcaccctcctcagcagctgacagcaggcaggctagacctggacaatggagcaggagtcacacagcctgtgaaagaagtgctggggaatgtaggggctgctgtttcacatgacagagccattgaaccctggctgtttataatagttacatacataattttaatagaaataaaaaccaaaaagaaaaaagacttaaacatgaaaggcaaaaccattacaatttttagaggaaaatataagagagtaagaacagaaaaatgtcttaaggcacaaagtgctaaccataaagaaaaagattgataaattcatcttgataaattttttgtttatcaaaaggcaccataaagacagtgaaaagacaaggcacaaaatgggagaagataattgcagcacatctgaccagcaaagaatttgtatccagaatatataaagaacttctatgagtcggttttttaaaaacacaatttatatttaagtctctttaaaacaaatagacaattcatagaaatatggtgatatggtttggctgtgtccccacccaaatctcatcttgaattgtagcttccataatttccacatgttgtgggagggacccagtgggaggtaattgaatcatgggggcagatttttcccatgttcttgtgttagtgaataagtctcatgagagctgatggttttataaagagcagtgcccctgcacaccctctcttgcctaccaccacataagatgtgcctttgctcctccttcacgttctgctgtgattggtccgcatccaaatgtcatcttgaattgtagctcccataatcctcatgtgttgtgggagggacctggtgggaggtaattgaatcatgggggcagatttttcccattttcttgtgatagtgaataagtctcatgagagctgagggttttataaaaggcagttcccttgcacaagctttcttgcctaccatcatgtaagatatgcctttttcattataagttacccagtcttggatatttcttcacagtggtatgaaaatggactaatacacatgggctaaactcatgagcaggcaactttatagaaaaacacaaatagcccataaacataaaatgtagattgagttcattattaattagggtaatgcatgttatggatagaataaaatacctttttacattcactggattggcacaaagttttgtctttgtgccactctaaatgttgacagggatgttgatcaactggaattcacacactgcttgaggaagcttgcattcactctataattcagcattctgaaaagtgctcaccaataatcagcccaggaaggttcacaaggacatcttcaccaaatatgtcctttcaccctagcaaagaactagaaacaactcaagtgtcttttgacaagagaatgagtaaatggcaagtggtatgtcacgcaaaagaattctagacagaagagaaaattaaggaacatcaaacttagtgaatctttgagacgatgttgagtaggaaaaaaaattcagaagaatatattgtatgatacttttatcataaggtttaaaagcaagccaaggtaaacatgtgcagggacacctagggacccatgtcattttaggatcaaacagatagatggacagatgatagatagacagacagatggatttttttaactcaaaatagtggttacatccttagggagctgggattggagaagagacacttagctttgaaagtattgtcaaatatagtgacctttctagttcatttgggtgctgggttcaggggtattcattttattatgcaccataatttatgtgagacattttattatatcaaatattttctaatcttacagtaagcagtttggtaaacagattcataactgcatataatgtgtaggtcttgtgaacaatgctgctgtgaatatcaggacccaactgcacttgtctctcactgccttttgtaagcctgctcaattggggagttcttccccttatactggagatgagaactcaggtaatgcctcgactgttcggatcactgtcaggggattacatgttctaccgtgctgacttttcactgaaagcccagtctccactcaataagtaaaagtgtaataatcgaaactcccaatttgagttccacttaaaatcttctctcttcccctgccagacctctctgcaccatctaggggagcatagtcccctctgtccctgcctgacagggctctcctcctcagcagcacagggaggtgtctgacccatctgtgtgtgtgtgtctatgtggtggggatggggaccatagcttggcatcctgccctctcaccctggcagttcattgtctcaagctgactttcttgggtgttttcatggcttcttctgaggcctccctctggaatattggatcgtaactccagcaatgcaagcaataggttttcctccagcttctggtcctcctcctcctcctcctcctccccaaacctggtttctagcagtcactccactgagactcagagtcttcttggcccagtgccagcctcttgcatgtcccaaaccttgtcctcaggaaacacttatgcatcctatgctggggtgaactcttaagagtgcaggatcacctcatggccacagcctagctaggccctgaaacccacactctgggtttgtcagacgtgagtcagccccaggccactgaacctctcccactgcagggaatccctgtcaagtggtgaaagccagcatctagacctggagtcacaggcacctgtagcataactcctcctgaaatggaggtttttctttagagattggtccatatcccttatccctggacttctgagaagggtggacaacctgtggactggacttgagtctggaatttagagaagtgtccatagtagggctgccagatgaggcaaacacaaatacaggatgcccaattaaatttgaatttcagataaatgatttttaatgtttgattctgtcccatgctaaaaattgcccactgtttatgataagtttaaatttattggtccattctgtactttatcaaggacacacgcaggaggaacagtagcacaaaggcttcccggtgccttgtgggtgaaagaaaggcttccagggaaaggagagaaacacccagggatcccggtgacgtcgggaagcagcacccagaccatgtaaggacaccgcctgcagggggagactcaaggcctgggaaggttttctaatctgtgccttgagtcgggtggggggattttctgggaaaggaaaaccagacacagtaggacaaatattgtatagtttcacttatatgaaattgtcagaataggcaagttcgtagagacagaatgtagaacagggctttccgggggctggaggagaagacaaggagttcttgcctagtgggtacagagtttctgtttgaaatgatgaaaaacttctggaaatagattgtggtgacagttacacaccattgtgaacataattagtaccactgaactgtacacgttaaaatggttagttgtatgttttatgtattttgccataataaaaactagggggaaaaaaaggaaggggagattgtctcaggctggctgactttccctgcatgtacgcacatcttcacatgtgcacacatgtaaaacaaaaatgaagcaa

SEQ ID NO: 834 - DNA, 833 bp, Homo sapiens
gttaatggacaataagcttttattgcacagaaaggtcattgcagtcagaggttggggattgcttgctgctacagccgaatggattctattctgaccaatacagaaggaaagaaatcatagacgccctgcctgagcagaagggaggtgatagatgaaatgaactgtatgaagatccaccagcctggcccacacgtggaagaaggactggcccgtcttcttgaagcccaagctctggtagaggcccatggcagagagctggatgttgctggtgtccaggacaacttcactgtagccctagtcccgggcaaactggaggacagtcctgaccagggcttttgctatcccctgaccacggtgctcattgtccacagagagatgaaacagctgcaaccgcttctccctcaaggtgggatcatcaacgggcagagctcctactgtgcccaccaccttctcttcagattcacccacccagaagcaggagccacactcactcaggtaggatttggtgatgtcagacatgtctgtgcgcaatgctatgtctacataccgcgtccagggttttttggcaaggaaccacagggcaggaaggaggctgaggctgaacacgagggccagaatccaggagccagagaccaggagtagggcaagggcccccccaagtaagagtatgagggttcgaggcagcttcagtaatcgccggaaggtggctggggcgtgttcggccatcccccgggagagcaagcccacgacctacttgcggtcgctctcctggtatttgcggatgtgataaggagccatggacagacttctgtgtctgaagtcactgagtccag

SEQ ID NO: 835 - DNA, 6602 bp, Homo sapiens
aaaagcaaacctaggaagtagctttccaacataaagtggaggtttcaacacaggagactttaagcaagttccagtgtgtctatatttggtctggctgatcggctggactctggccttccccgctcacgttagcagacagctctgccctagtgggcgcttagcctgcgacggcagcccgagaggatgtctaacaagcttctttctccccacccccattcagttgttctcaggtctgaattcaaaatggcctcatctcctgctgtccttcgagcgtcccggctgtaccaatggagcctgaagagttcggcgcagttcctggggtctccacagctgaggcaggttggtcagatcattagggttcctgctcggatggcggcgacgctgatcctggagcctgcgggccgctgctgctgggacgaaccggtgcgaatcgccgtgcgcggcctagccccggagcagccggtcacgctgcgcgcgtccctgcgcgacgagaagggcgcgcttttccaggcccacgcgcgctaccgcgccgacactcttggcgagctggacctggagcgcgcgcccgcgctgggcggcagcttcgcggggcttgagcccatggggctgctctgggccttggagcccgagaaacctttggtgcggctggtgaagcgcgacgtgcgaacgcccttggccgtggagctggaggtgctggatggccacgaccccgaccccgggcggctgctgtgccagacgcggcacgagcgctacttcctcccgcccggggtgcggcgcgagccggtgcgcgtgggccgggtgcgaggcacgctcttcctgccgccaggtgactcacctccgctaattgttccgtgttcgttcgcctttcactttgtgtgtctcccccgccccacgcttttcgcttatgtgtatgcccccccgccgcgcccccgggctatattgcccaggcaggtttcgaattcctggtctccagctatcttcccgcctctgcctccctaagagctgggattacagggtgagccaccgcgcccggcactttgaggggagttacactttttttttttttccgtccctgcccttttcacacgaagaagggatgtagcttccaaccttccggaggttagtgtaaagaaacaggaatggaatggaaagctgattggggaagtgtccctgccgctccaaaactgagaggtccctcaaacctagtgctcagttaaaagacattgtaagggccaggcgcagtggctcacgcttgtaatcccagcactttgggaagtctcggcgggcagatcacgagatcaaaagattgaggccatcctgactaacacggtgaaaccccgtctctactaaaaatacaaaacagtagctgggcgtagtagcgggcgcctgtagtcccagctactcgggaggctgaggcaggagaatggtgtgaacccgggaggcagagtttgtagtgagctgagatcgcgccactgcactccagcctgggcgacagagcgagactccgtctcaaaaaaaagacattgtaaggaaaggaaaaagacacttatattaaaaacaaaacaggccgggcgcggtggctaacgcctgtaatcctagcgctttgggaggccgaggccggcggatcacctgaggtcaggagttcgagaccagcctggccaacatggtgaaaccccatctctactaaaaatagaaaaattagccaggcgtggtggtgcatgcctgtagtcccaactacttaggaggttgaggcaggagaatcgctggaacccgggaggcagaggttgcagtgagctgagatcatgccattgcactccagcctgggggacaagagtgactctatcttaaaaaaaaaaaaaaaaaattcaggtagtttcaattttttaatgttcttatttatgtattgactaggaagccacttttttttttttttaaataagaattccgactggttttctcactgtatttccatggcagctaggaggtgccaggtggctgggcctgtgacagtgcagaggttttggtgcctgcccgcccaccattgctccagctgcagctgctgccccctgcagggcctgttcgttcctgctgcctagctccccgctggctggctatgatctccctgttaccattccaggagagcagccgcgtccctatgcatggcaggaccaggtactattgtggcctctcctcttggcctcgaatggtatctttgtcatcagtgagcaagtccccaaagaccacggtcttgtccattgtcaggataattcactccacaagctggggctccaggtgctgccctacccagcggtgcttctcacccacacagtggtcatactttggcaggggctggtgcagtgtgaagacctcggtgttttgcatgtgcttcatctcttgcaaggtcctccggggttgggcttcaagactagggaaaagcctgggcttcacacccgtgggccactttatccaccaggtccggcagcagggtgaggtactgcttccagaccaggaagctgcggtgctgctgcagtgtcacatgcagctccctgagaaggggcggctgaagccccgcaggaggccgtctggaagctgccagcacgcggtccctgtccatcagcacacgcgtgggctgtgctcatcgctgccggggcactggggtttctcgggatcctaggggtatggggcccagaaatgttctttaaaagtttctcatttttgcaacttttctttgaattcgcacagtatgttaagatttatgtaaattagcatttacaataggaaaacctcttcctgtcaaatggaaatttgaggttactggatacttttatattacataaagagcaatcagccagtgtaaaaatgaaatgatgcttatccttattaataatcaaagaaatgcaaaataaaacaacagagtacatttcacaccctcagaagtggcccacttttagaagctagcattatcaattgctgaccagtatgtggaggaaatgaaactcactgctagaaggagcaacatattcatctgctctgggcaacaatttgtcttaacttacaaagttaaatatgttattctacttgtacatgtgcaccaggaggcatattccttataagaggccagatgagcagtctggattaatttaaaaaaagagcaaagtcaactggaaacagtccaaatgtccatcaacaatagaacagattaataaattgaggtatatttccagcagtcaaagtgattgaactacagctacaagaatcaacatctatcaagatatacaaaagaaaagaaaaaaaaagaatcaacatggatgaatctccaaaccactgttgagtgaaacagtcaaaccctaggagaacacattcagtatcattccatttagatacaattcaaaaactaggcaaaataaaatattaaggtacataatctaagtggtaatactatgaagaaaaccaagagtgatacacagaaagtccaggatactggaaagagaggaaagggcacaggggtctgtgggacgttgatggtttgcgggtatcagcactgaactatgtcttaaaagtgttgcctgtaaggtgtttgcattttttttttttttttttttttttttgagacagtgtctcgctctttcgcccaggctggagtagtggcacaatcttggctcactgcaacctccacctcccgggttcaagcgattctcctccctcagcctcccgagtagctgggattacaggtggccgccaccacacccagctaatttttgtatttttagtacagatggggtttcaccatgttggccaggctggtctcgaactcctgacctcaggtgatccacccgtctcagcctcccaaagtgctggggttacaggcgtgagccaccggacccagcctgcattattactatttaattttgtgtgaaacacaaaacctttaatgtaaatgataaaaatatcagtaagtggagtcattcagaatgagtagccttttgagtctgtctccgttgagtaagtgcattctgttgagtgcactggagaggaatttgtgctcttctatgtagcagtctttctttttgtttcttggtggtgcaccattaaatggattcattcaccagttaaaggacatttgggttgtttccagtctttggctacaacgagtaaagtcactataaacacttgccagaggtttctggacgaacaggttttcatttctcgtgggtagatacctaggagtgggattgctgggtcacatgtgtggtaagtatatgtttaacttaaaccatccaactgtttcaggaatagcttagttttgcattttgttttgtttcttcccaagaacctgggccctttcctgggattgtggacatgttcggaactggaggtggcctgctggagtatcgggctagtctgctggctgggaagggttttgctgtgatggctctggcttattataactatgaagacctccccaagaccatggagacgctccatctggagtactttgaagaagccatgaactacttgctcagtcatcccgaggttagttcttctttcagatttatgggctatgatgtatcaggtctcttcttaaatggtctgggttttcacagaagttagctcattcatgacagccattccctaccccaacacacactaccttttttagtcacttcttatagacagtttctttttttgagatggagtctcactctgttgccaggctggagtccagtggtgcgatcttggctcactgcaacctccacctcccaagttcaagtgattcttgtgccccaccctcccgagtagttgggattacaggcacctgccaccatgcttggctaatttttgtatttttagtggaggcggggtttcacaatattggtcaggctggtcttgaactcctgacctcaaatgatccacctgctttgacctacccaagtgctggattacaggcatgagccactatgcccagcctaatatttgtatttttttttttttaagtagagatggggtttcgccatgttggccaggctggtctcaaactcctgacctcaagtgatctgcccaccttggcctcccagagtgctggaattacaggcatgagccaccacacctggcctcttatagacagtttctattcaattctatattactatatttcctgctagtaaagagattcgtagttgttattatgcaattttaaattccagtatttttttttttttttttttgagatggagtcttgctgtgtcacccaggctggagtgcaatggcatgatctcggctcactgcaaactccacctcccaggttcaattgattcttctgcctcagcctcccacgtagctgtgactacaggcacgtgccactactgcccggctaattcttgtatttttagtagagatgtttcaccatgttggccagactgatctcaaactcctgacctcaaatgatccacccgcctcagcctcccaaactgttgggattacaggcgtcagccaccactcccggccatgagatgatgtacttgttgatgatgactcagtttagttatgacagtgggaatgggtggctcaggtgggagacagaaaaagatcatgggagatacgagattaaggaactgagaaaccagagaataattgatagatcttccacatggttatcaccaagagtggtgatggacaaattgtggaaaggaagagatagaggggaggtaaattctcaaagttgcaaatctgggtaaatggtagaacctagattcagactcaggttcaactaacttccagggtggacacaactcaccatattccactgtttgtggaatcattcttcttctttttcctttgtccctttctcaggtaaaaggtccaggagttgggctgcttggaatttccaaagggggtgagctctgcctttccatggcctctttcctgaagggcatcacggctgctgtcgtcatcaacggctctgtggccaatgttgggggaaccttacactacaagggcgagaccctgccccctgtgggcgtcaacagaaatcgcatcaaggtgaccaaagatggctatgcagacattgtggatgtcctgaacagccctttggaaggacctgaccagaagagcttcattcctgtggaaagggcagagagcaccttcctgttcctggtaggtcaggatgaccacaactggaagagtgagttctatgctaatgaggcctgtaaacgcttgcaggcccatgggaggagaaagccccagatcatctgttacccagagacagggcactatattgagcctccttacttccccctgtgtcgggcttccctgcatgccttggtgggcagtcctattatctggggaggggagcccagggctcatgccatggctcaggtggatgcttggaaacaactccagactttcttccacaaacacttgggtggccacgaggggacaatcccatcaaaagtgtaaattttatttgatcatgtggcctctctgttgctaatctctcctggaaacatctgccacatttagtgtgtgtatgtgtattcattcttttgtttttaataactaaagttttttcccctcattattaaaatgaatttaccagtaagaat

SEQ ID NO: 836 - DNA, 8041 bp, Homo sapiens
taacctgcgtgagttccgctccaggctgatggaagctttgttcttttgtacttcacaataaaccttgctactgctccttctttgggtccatactgcatttcagagctgtaacaccgtgaaggtatacagcttcactcctgaagccaagaccatgaacccactgagaggaacaagaaaaacaactctggacctgctgcctttatgagctgtaacactcaccttgaaggtctgtggctttactcttgaagtcggtgagaagcgagaccatgaacccaccagaaggaacacattccggacgcatctgaacatcagaggaaacaaactccagacacactacttttcagaactgtattaagaactgtaacagtcactgcgagggtctgcggcttcattcttgatgtcagcgagaccaagaatccaccagaaggaaccaattccagacacagaattatttgccttcttacttcctgagagttctaggcacagaacatacttgaggtgttatacaaaggtaattagaactgacagggaattgtatgattaatgacgtgggacatgagagatttggaacgagataaaaaggcttaccttgaggacagccttattaggagcagaggcaaacacaggttttgtgggtttgaagcctacacatttatagctttctctaattacacaggtaggaaattataaaatcaggtacaagggcttggcaggggcctaaagcttaagtgatgaaaaaaaaaaacaccacacctctggtgaaaccaatagcttacgaaaaagtagaaaaaagcgcgatgcatggggagctccggtagtcctttgaggtatttgagaggctgagtcaggaagatggcttgagcaccaggagttggaggtttgtaagtgcagtgatggtaaactgccgctgtactccagtctggcaatgtagtgagaccctgtctctcaaaaaaaaaaagtaacccttgcctgactgggacaataattgagaaaccagtaaaacaaaataataactattagccgggcgcggtggctcatgcctgtaaatcctagcattttgggaggctgaggcgggcggattacaaagtcaggagtttgagaaattactacctattaccccatttggctatttttacacttgtaaggaatgaagctcagaggtcacacagctagtaagaagccagcacccttcgatgtgggattgatgtggaggataggcatatacagagaacacaaaagcaaaacaccatggtgcagattttgaaagaaaagccctaagattagtaatgagtgtgaattattcaacaaagtgatcaaaactaactccagctctgcattcctcttcgccatcaggagtttggagcctggagactgctagctgcctggttctttaagaaccagccctggtccagcccattccgcaggccagcaagcttctgaaaagcaaacctaggaagtagctttccaacataaagtggaggtttcaacacaggagactttaagcaagttccagtgtgtctatatttggtctggctgatcggctggactctggccttccccgctcacgttagcagacagctctgccctagtgggcgcttagcctgcgacggcagcccgagaggatgtctaacaagcttctttctccccacccccattcagttgttctcaggtctgaattcaaaatggcctcatctcctgctgtccttcgagcgtcccggctgtaccaatggagcctgaagagttcggcgcagttcctggggtctccacagctgaggcaggttggtcagatcattagggttcctgctcggatggcggcgacgctgatcctggagcctgcgggccgctgctgctgggacgaaccggtgcgaatcgccgtgcgcggcctagccccggagcagccggtcacgctgcgcgcgtccctgcgcgacgagaagggcgcgcttttccaggcccacgcgcgctaccgcgccgacactcttggcgagctggacctggagcgcgcgcccgcgctgggcggcagcttcgcggggcttgagcccatggggctgctctgggccttggagcccgagaaacctttggtgcggctggtgaagcgcgacgtgcgaacgcccttggccgtggagctggaggtgctggatggccacgaccccgaccccgggcggctgctgtgccagacgcggcacgagcgctacttcctcccgcccggggtgcggcgcgagccggtgcgcgtgggccgggtgcgaggcacgctcttcctgccgccaggtgactcacctccgctaattgttccgtgttcgttcgcctttcactttgtgtgtctcccccgccccacgcttttcgcttatgtgtatgcccccccgccgcgcccccgggctatattgcccaggcaggtttcgaattcctggtctccagctatcttcccgcctctgcctccctaagagctgggattacagggtgagccaccgcgcccggcactttgaggggagttacactttttttttttttccgtccctgcccttttcacacgaagaagggatgtagcttccaaccttccggaggttagtgtaaagaaacaggaatggaatggaaagctgattggggaagtgtccctgccgctccaaaactgagaggtccctcaaacctagtgctcagttaaaagacattgtaagggccaggcgcagtggctcacgcttgtaatcccagcactttgggaagtctcggcgggcagatcacgagatcaaaagattgaggccatcctgactaacacggtgaaaccccgtctctactaaaaatacaaaacagtagctgggcgtagtagcgggcgcctgtagtcccagctactcgggaggctgaggcaggagaatggtgtgaacccgggaggcagagtttgtagtgagctgagatcgcgccactgcactccagcctgggcgacagagcgagactccgtctcaaaaaaaagacattgtaaggaaaggaaaaagacacttatattaaaaacaaaacaggccgggcgcggtggctaacgcctgtaatcctagcgctttgggaggccgaggccggcggatcacctgaggtcaggagttcgagaccagcctggccaacatggtgaaaccccatctctactaaaaatagaaaaattagccaggcgtggtggtgcatgcctgtagtcccaactacttaggaggttgaggcaggagaatcgctggaacccgggaggcagaggttgcagtgagctgagatcatgccattgcactccagcctgggggacaagagtgactctatcttaaaaaaaaaaaaaaaaaattcaggtagtttcaattttttaatgttcttatttatgtattgactaggaagccacttttttttttttttaaataagaattccgactggttttctcactgtatttccatggcagctaggaggtgccaggtggctgggcctgtgacagtgcagaggttttggtgcctgcccgcccaccattgctccagctgcagctgctgccccctgcagggcctgttcgttcctgctgcctagctccccgctggctggctatgatctccctgttaccattccaggagagcagccgcgtccctatgcatggcaggaccaggtactattgtggcctctcctcttggcctcgaatggtatctttgtcatcagtgagcaagtccccaaagaccacggtcttgtccattgtcaggataattcactccacaagctggggctccaggtgctgccctacccagcggtgcttctcacccacacagtggtcatactttggcaggggctggtgcagtgtgaagacctcggtgttttgcatgtgcttcatctcttgcaaggtcctccggggttgggcttcaagactagggaaaagcctgggcttcacacccgtgggccactttatccaccaggtccggcagcagggtgaggtactgcttccagaccaggaagctgcggtgctgctgcagtgtcacatgcagctccctgagaaggggcggctgaagccccgcaggaggccgtctggaagctgccagcacgcggtccctgtccatcagcacacgcgtgggctgtgctcatcgctgccggggcactggggtttctcgggatcctaggggtatggggcccagaaatgttctttaaaagtttctcatttttgcaacttttctttgaattcgcacagtatgttaagatttatgtaaattagcatttacaataggaaaacctcttcctgtcaaatggaaatttgaggttactggatacttttatattacataaagagcaatcagccagtgtaaaaatgaaatgatgcttatccttattaataatcaaagaaatgcaaaataaaacaacagagtacatttcacaccctcagaagtggcccacttttagaagctagcattatcaattgctgaccagtatgtggaggaaatgaaactcactgctagaaggagcaacatattcatctgctctgggcaacaatttgtcttaacttacaaagttaaatatgttattctacttgtacatgtgcaccaggaggcatattccttataagaggccagatgagcagtctggattaatttaaaaaaagagcaaagtcaactggaaacagtccaaatgtccatcaacaatagaacagattaataaattgaggtatatttccagcagtcaaagtgattgaactacagctacaagaatcaacatctatcaagatatacaaaagaaaagaaaaaaaaagaatcaacatggatgaatctccaaaccactgttgagtgaaacagtcaaaccctaggagaacacattcagtatcattccatttagatacaattcaaaaactaggcaaaataaaatattaaggtacataatctaagtggtaatactatgaagaaaaccaagagtgatacacagaaagtccaggatactggaaagagaggaaagggcacaggggtctgtgggacgttgatggtttgcgggtatcagcactgaactatgtcttaaaagtgttgcctgtaaggtgtttgcattttttttttttttttttttttttttgagacagtgtctcgctctttcgcccaggctggagtagtggcacaatcttggctcactgcaacctccacctcccgggttcaagcgattctcctccctcagcctcccgagtagctgggattacaggtggccgccaccacacccagctaatttttgtatttttagtacagatggggtttcaccatgttggccaggctggtctcgaactcctgacctcaggtgatccacccgtctcagcctcccaaagtgctggggttacaggcgtgagccaccggacccagcctgcattattactatttaattttgtgtgaaacacaaaacctttaatgtaaatgataaaaatatcagtaagtggagtcattcagaatgagtagccttttgagtctgtctccgttgagtaagtgcattctgttgagtgcactggagaggaatttgtgctcttctatgtagcagtctttctttttgtttcttggtggtgcaccattaaatggattcattcaccagttaaaggacatttgggttgtttccagtctttggctacaacgagtaaagtcactataaacacttgccagaggtttctggacgaacaggttttcatttctcgtgggtagatacctaggagtgggattgctgggtcacatgtgtggtaagtatatgtttaacttaaaccatccaactgtttcaggaatagcttagttttgcattttgttttgtttcttcccaagaacctgggccctttcctgggattgtggacatgttcggaactggaggtggcctgctggagtatcgggctagtctgctggctgggaagggttttgctgtgatggctctggcttattataactatgaagacctccccaagaccatggagacgctccatctggagtactttgaagaagccatgaactacttgctcagtcatcccgaggttagttcttctttcagatttatgggctatgatgtatcaggtctcttcttaaatggtctgggttttcacagaagttagctcattcatgacagccattccctaccccaacacacactaccttttttagtcacttcttatagacagtttctttttttgagatggagtctcactctgttgccaggctggagtccagtggtgcgatcttggctcactgcaacctccacctcccaagttcaagtgattcttgtgccccaccctcccgagtagttgggattacaggcacctgccaccatgcttggctaatttttgtatttttagtggaggcggggtttcacaatattggtcaggctggtcttgaactcctgacctcaaatgatccacctgctttgacctacccaagtgctggattacaggcatgagccactatgcccagcctaatatttgtatttttttttttttaagtagagatggggtttcgccatgttggccaggctggtctcaaactcctgacctcaagtgatctgcccaccttggcctcccagagtgctggaattacaggcatgagccaccacacctggcctcttatagacagtttctattcaattctatattactatatttcctgctagtaaagagattcgtagttgttattatgcaattttaaattccagtatttttttttttttttttttgagatggagtcttgctgtgtcacccaggctggagtgcaatggcatgatctcggctcactgcaaactccacctcccaggttcaattgattcttctgcctcagcctcccacgtagctgtgactacaggcacgtgccactactgcccggctaattcttgtatttttagtagagatgtttcaccatgttggccagactgatctcaaactcctgacctcaaatgatccacccgcctcagcctcccaaactgttgggattacaggcgtcagccaccactcccggccatgagatgatgtacttgttgatgatgactcagtttagttatgacagtgggaatgggtggctcaggtgggagacagaaaaagatcatgggagatacgagattaaggaactgagaaaccagagaataattgatagatcttccacatggttatcaccaagagtggtgatggacaaattgtggaaaggaagagatagaggggaggtaaattctcaaagttgcaaatctgggtaaatggtagaacctagattcagactcaggttcaactaacttccagggtggacacaactcaccatattccactgtttgtggaatcattcttcttctttttcctttgtccctttctcaggtaaaaggtccaggagttgggctgcttggaatttccaaagggggtgagctctgcctttccatggcctctttcctgaagggcatcacggctgctgtcgtcatcaacggctctgtggccaatgttgggggaaccttacactacaagggcgagaccctgccccctgtgggcgtcaacagaaatcgcatcaaggtgaccaaagatggctatgcagacattgtggatgtcctgaacagccctttggaaggacctgaccagaagagcttcattcctgtggaaagggcagagagcaccttcctgttcctggtaggtcaggatgaccacaactggaagagtgagttctatgctaatgaggcctgtaaacgcttgcaggcccatgggaggagaaagccccagatcatctgttacccagagacagggcactatattgagcctccttacttccccctgtgtcgggcttccctgcatgccttggtgggcagtcctattatctggggaggggagcccagggctcatgccatggctcaggtggatgcttggaaacaactccagactttcttccacaaacacttgggtggccacgaggggacaatcccatcaaaagtgtaaattttatttgatcatgtggcctctctgttgctaatctctcctggaaacatctgccacatttagtgtgtgtatgtgtattcattcttttgtttttaataactaaagttttttcccctcattattaaaatgaatttaccagtaagaat

SEQ ID NO: 837 - DNA, 1689 bp, Homo sapiens
tatgcaacattatgctggcactagaaaaatgaaacagatgggaatcaaaaagactgaatgaagcagaaacccagaagctaccccacaagcaatcacatgggactcagatgtgaatggacaataagcttttattgcattgaaaggtcattgcagtgaaaggttggggattgcttgctgctacagctgaatggattctattctgaccaatacacacagaaagagatcacagactccctaccttagaagaagggaggtggtagatgaaatgaactgtatgaagagccactagcctggcccacacacagaagaaggactggcccgtcttcttgaagcccatgctctggtagagggccatagcagagagctggatggtgccggtgtccaggataacttcactgtagccctggtcccgggcaaactggaggacagtcctgaccagggcttttgctatcccctgacgacggtgctcactgtccacaaagagatgaaacagctgcaaccgcttctccctcaaggtgggatcatcaacaggcagagctcctaccatgcccaccaccttctcttcagactcagccacccagaagcaggagccacgctcactcaggtaggatttggtaatgtcagacatgtctgtgcacaatgtcatgtccacatactccgtccagggttttttggcaaggaaccacagggcagggaagaggctgatgctgaacacgagggctagaagccaggatccagagaccaggagtagggcgaggggccccccaagtaagagtatgagggttcgaggcagcttcagcaattgccggaaggtggctggggcatgctcggccatcccccgggagagcaagcccacaacccactggcggtcgctctcctggtatttgcggatgtgacaaggagccatggacagacttctgtgtctgaaatctctaagtccaggagacagagctaggcctccctgcacgcctttacgtcagactggggaagagagagaaaatcatgtgagtgcctgcatggctcccagccttgcaggaacagggagacctgctcaagggtgtgtctttccgcgtttgcccatgaggaagcaggcctctgccactgggagaaggtagggtcagaaagacctgcattggaatctggttccatccctttctagctgtgtgaccttaggcatgtcacttaacctctctgagcctccatttcttcaactatagaacaggggagaagaaaacctgccttctagagttgttttgaagattgaataagatgccttctataaagccctggtagatgaactacccaccgctcttcctttttctgtttcctttttctggctctctcagcttctccgtgcattgagggggcacctacctcaggcaggccacacgtgcaacccttttgtccttctccagggaccatacatcgcaaaaattctctgtccaacacaagtttcaggaaaggctccctccagctttattgtaagtttttaggttgctgaagtggcataagagccaagcataaaaaacagcccagcctccagatcccaaggaaggtgcatgctcagagcactgtccttccacccagtcccctcacctgtcaccacaagagccttgagtgtccagggagcttcagctctcagccgctcactggcatccaggagataccgtctggggcttgctcacccct

SEQ ID NO: 838 - DNA, 2463 bp, Homo sapiens
gcaccgcagccgctgcattcaggaaccgctttagcttcgcccccggccggccgggcggggaagactggtgtggtctggccatggatgggctccaggccagtgcagggccgttgaggcgcgggcggccgaagcgccggcgcaagccccagccacacagcgggtcggtcctggccctgcccttgaggtccaggaagatacgaaagcagctgcgaagtgttgtatcccgcatggcagcgctgaggacgcagacgctgcctagcgagaactcggaggaatcgagggtggagtcgacggccgacgacctgggggacgcgctacccggtggggcggcggtggcggcgtcccggacgcagcccggcgagagccatacggccacctggggcccgcagagctgctggaggcctcgcccgccgcgcgctccctgcagaccccgtcggcgcgcctggtgcccgcttccgcgccgcccgcgcgcctggtggaggtgcccgccgcgccggtccgggtggtggagacctcggccctgctgtgcaccgcgcaacacttagcggccgtccagtcgtccggggcccctgcgacggcgtcggggccgcaggtggataacacgggtggggagccggcctgggactccccgctgcggcgcgtcttggccgagctgaaccgcatccccagcagccggcggcgagcggcccgcctctttgagtggctcatcgcgcccatgccgccagatcacttttaccggcgcctatgggagcgcgaggcggtgctggtgcggcggcaggaccacacctactaccagggacttttctctaccgctgacctggattcgatgctgcgcaacgaggaggtgcagttcggccagcatttggacgccgctcgctacatcaacggacgacgcgagaccctgaacccacccggccgcgcgctgcccgccgccgcgtggtccctgtaccaggccggctgctccctgcgtctcctctgtccgcaggctttctctactactgtgtggcagtttttggctgtgcttcaagagcagtttggaagcatggcaggctccaacgtttacctcacgccccctaactcgcagggctttgccccccactacgacgacatcgaggccttcgtgctgcagctggaaggtaggaaactctggcgtgtataccgaccccgagtcccaaccgaggaactggctctgacatccagccccaacttcagtcaggacgacctcggtgagccggtgctgcagaccgtgctggaacctggagatttgctgtattttcctcggggcttcattcaccaagctgaatgccaggatggagtccactctctgcacctcaccttgtccacgtaccagcgcaatacctggggtgacttcttagaggccatactgcctctggcagtgcaggctgcaatggaagaaaatgtggagtttcggaggggtctgccccgagacttcatggattacatgggggcccagcattcagattctaaggatccgcgaagaaccgctttcatggagaaggtgcgggtcttggttgcccgcctgggacactttgctcctgttgatgctgtggccgaccagcgagccaaagacttcattcacgattctctgccccctgttttgactgatagggagagggcactaagtgtttacgggcttccaattcgctgggaggctggagaacctgtaaacgtgggggcccagttgacaacagaaacagaagtccatatgcttcaggatgggatagctcggctggtgggtgaggggggccatttgtttctctattacacagtggaaaactcccgtgtgtatcatctggaagaacccaagtgcttggaaatatacccccagcaagctgatgccatggaactgttgcttggttcttatccagagtttgtgagagtgggggacctgccctgtgacagtgtggaggaccagctgtccttggcaaccacgttgtatgataaggggctgctgctcactaagatgcctctagccctaaattagtttcttgttgattgctggaaacaaggcagtagtgattctccgctgccactgctaccttttttttttttttttccttaaactcacgttcttaccttgataagcatcagtgtgctcacatttacctttatcactgcttcagtgtcacaaacctcggaaggtcttctaggaagaaccatctcatctaggtacaaaaggaaaaggagaagttggaggtggaaaaaaaacccttgatccgtgatcatttcagagcaccaacttcatcaccttcaggcttcagtgtactgggtaacactgaccatgtcgttctgcttgagacagatattagattttttttggaatttggatctttcatctgagttctttttcatgggcgggtcggggtcagtatcctgtttgttattgttaaatttgtatgaaccttagaaaagttattaaagtgccaaagaatgtttcccttt

SEQ ID NO: 839 - DNA, 64450 bp, Homo sapiens
tgtgcctacactggtcccacaggttttcagctgtggagtttgggatctgagcttggagcccatttgtttctggcagttccgctcatattttccacttgaagacatcgcctcccttccttccaagctgggagaccagaagtcaacaacaggagggtggagaggccgggtctcacaatccgcttggctggggagtccactgaggttcttgcatcctgaagcaaaccatggagagctggtggggacttccctgtcttgcgttcctgtgttttctaatgcacgcccgaggtaagaggcattttgctttgagggagatctgcctgggcatggatttttctattcttgctttaagaaactctttccaaaggagttgctatgaagtgaatggggataatttgcccaatgggattagaaaggagactaagagcgatgggtggctgagaggggagggagaagacgggctgctcccatttggaatctgggaattagatccagaagggcaggatgttagctgataccatctagatattcgccatattttcctgttttgatccatgtgtcccaagcgtttaaaaaatgacctatttaactccatgattcaagcatgactgggtgtgtgtggaatgtcagtcatttctttctgattttaaaaattagttctgaccatttccatacagtaaaagtagagttgaaactacttcatcccgtggggcagattaccagagattcgtttgccggaagggttgcatttattcagatttttaaatcttttcctaaacactgtcattcattcttgcaaattaaaaccacctgaattgttcacatcaaaaacttcgatataaacttgcaggctggctgtcccagatccaagattagatttttcagttccgtacgaggacctctttaagaaactccaatgaactcataaagtacaggatttgaacaacggttgagtaagtttctttggtcattttcatgtggcgatttcagagaagggaacacctgggcgcatcttaagagagagaagtatttctgttaggagttaaaacacatcattcagatgtccctgtggcagcatttcctgtttatcctatttaaagacatggacgtcattaagattggagttggttgtttatgggcggaggcggtgtcgggatggatagatcctggtggacatagtctaggatctgcagtgagaattttttattattctgtgctgtcttcagatctcacctagtaagtggacaatgtggccatgcattcattagcttctgtttacagggagatgttcaacagtaaacccacctccccagaaaagtacttccaggagtttgtatcattcacagtaagagccaaaggttaaccatatccccttgggcaaatcaacttctacaaagtgcggatacagacagttcccaacttaccatggtttgacatgatggttcaatttaagatttttcaactttacaacggtgtaaaattggtatgcattcagtacaaacgaaaactgtactttgagtacccatacaacttttcttttttttttttgagatgtcgtgtcgtttcattctgttgcccaggctggagtgcagtgacacaatctgagctcactgcaacctccacctcctacgttcaagcaattctcctgcctcagcatctcaagtagctgggattataggtgcccaccaccacacccagctaatttttctatttttagtagagactgggtttcaccatgttggccaggctggtcttgaatcttgacctctggtgatccaccggcctcccaaagtgctgggattataaatgtgagccaccatgcccggccccatacagccattctgtttttcactttcagtacaatgttcaataaattatgtgaggtatgcaacacctcattataaagttgactgtgtgctagatgatttgtccatccgttggctgatgaaaagtgttctgagcactctgaaggcaggtaaggctaagctatggcgtttggtagggtagttgtattaaatgcacttacaacataaaatattttcttttttttaatgtgttttaatttttttgagggaggggcccactgtgtcacctagactggagtgcggtggttccatcatagctcactgcagtcttcaccccaggggttcgaacaaacctcccacctcagcctccagagtagctgggactacaggcatttgccgctgtgcctgactagtttttaaaactttttgtagagacgggatctcactatgttgtccaggctggacttgaacatctcagctcaaacgatcctcctgccttggcctccccaaatcttgagattacaggcatcagccaccataccctgtcctgcgctaaattctttgactgacggcagcacttcctatgcactaggcatggattaacttagttgattgtccctcagccctatgacgggagtgtcgtgcctgatgtcattttacagatggtgtattagtcagggttctctagagggacagaactaatgcaatagaaatatatatagagagaggagtttattaagtattaactcatatgatcacaaggtcccacaacaggccgtctgcaggctgaggagcaaggagagccagtccaggttccaaaactgaagaacttggagtctgatgttccagcatccaccatgggagaaagatgtaggccagaagactaggccagtgtctcttttcacatttttctgcctgcttatattctagccacagcggcagctgattagatggtgcccacccaaattgagggtgggtccgccccttccagtccactgactcaaatgttaatctcctttggcaacaccctcacagacacacccaggatcaatactttgtatccttcaatccaatcaagttgacattcagtattaaccgtcacagatatgggtaaactgaggcactgaggatttggacgggggcagccggcagcggaatctgagctgtcctgtagctctgtctgggaagactccagtgagcatcccgctctatcccaagccttgtcttctgaaaatcagaatcatccctcctccaagtgttacaggaaaggggtccggatccagacgccaagacggggttcttggatctcgctccataaagaattcagggctagtctgtaaactgaaaacaagtttattaggaaagtaaaggaataaaagaatggctattccgcagagcagctcttagagctactgcttgcccatttttatggttatttcttagtgatatgctaagcaaggcttggattattcatgcctcccctttttagaccatgcagagttcctgacattgccgtggtatttgtaattgtcatggtgctggtgggagggtaacactgaggacaaccagaggccactctcatcaccatctgggttttggtgggttctggccggcttctttactaccacctgttttatcagctaggtctttatgacctgtatcttgtgcagaccttcagtctcatcctgtgactcagaatgccttaatcatctgggaatgcagcccagtaggtttcagccttctattgcccagcccctattcaagatggagtcgctctggttccagtgcctctgacacaagtagcgccccttagggaggttacaggagggactggaaggaaagtgaggtctggatcagggcccttctgtgtaaataagatgatgtacatgcagcagctgggtatgtcctgggtaaaaattagttaaatgcacagacgaccctgtttcatccccagccatcaccagctggaaatggggcacattcccaagatcccaaaaacattctgcaaggctggtgcgatgattgctatgaagtacttaagaaaacagattattgttcaggatcaatagctaatgcatgtggggcttaatgcctctgtgacgggttgatgggtgcagcaaaccaccatggcacatgtttacctatgtaacaaacctgcacgtcctgcacacgtatcccggaacttaaaataaaataaagaagacagaatattgttaatggttaatatgctgtaaatcattatgatgattactaaattatcaatacaaaagaagataatagcaagacggccatattcctaatagaggttgacattttagcagccctacatttccactgtatttaattagtatttgccgtccaatccagaggggcatgaaggagcacgagacaaaatcaggtcttctaacagctgagaagaagctgagaaccagaagtggaaaccccaaagggcagtgtatgaaatgtcatttattgaggggaaaaaaaagaaaatgacagagttcgatagaagaaataagcactagtgtttacataatcagtagggtgactttagtttacaataatctattgtagacttcaaaatagaagagtcggaatggttctaatatgaaggaaagacaaatatttaaggtggatggatatcccaagtaggctgatttgatctttacaaattatataaatgtattaaattattacatgtaccctgaagctatgtacatctgttatgcatcaattaaaaataaattaaaagaaaaggatatatgtccaggatatacaccagctaagacagtctcttccaagtctattgtacattattcccttatcagatttgaaacctgagagttccctgacgccccctcacaggatgtgcaacaggggtgtgtttgatctgtttgaccgccacacactgaaacctcttatgggaggcagaacttgcagacgggcaggtgcagcagctagtgtgagtgtttttgagctctgggccccacggtagcatctagggatgggtgcctgcgacccccgaagccctagtgggcgttttacggtgctcttttagctctgccatccgcacgtggcttaagtgttagccagctcagtgccgtcttggtacccgggttcttgtccagcatccaggaagaatcaggtcacacgaaccagctgaaggatggtaaatgcagaagagtttgttgccagatggagatgactcttagcgggatggttggggagttggaaaggggatggagtgggcagatgatcttcccctggagtttggttgtcctgcggctaatctcttctccaaccatccccagctgaacacctctcagtgttcagatgttccttctcttctctccttctctgctgtgctgctctttggttcctcaccttttctgctcatctgtctgtctgcacatggggtctggggtttggggttatatgggtacaggacaggcaggcatggtgggtcaaaaggcaacatttgggcacaaaaataggaatgcctgtttccatttaggactacaggtttccaggcttgagggcggggcctttgctggggaactgccctcttgtatctagtatcttcaggcctcctgtccgtatcaacatgacttaaaatgtgtgtgcatttgtatagagctgtgtttctatgtaaagactaaaaaagacttatgaaaaagatcactcagagctctgaacagtagcaaatcatatttctgagtacttcctgttgagtaaaggtaagtgaggattgtgccaagtatttttcattacttgctgcattaggttgtcacaggctgtttagtttacttctaaaaattgggatatggggaagttgtgggccgggcacagtggctcatgtttgtaatcccagcagtttgggaggccgagttgggcagatcacttgaggtcaggagtttgagaccagcctggccaacatggcagaacgctgtttctactaaaaatacaaaaattagccaggcatggtggggggtgtctgtaatcccagctattcaggaggctgagacaggagaatcgcttgaacccaggaggcggaggttgcaatcagctgagatcataccactgcactccagcctgggtgacagagtaagactccatctcaaaaaaaaaaaaaaaaaaaaaaaaaggaaaaaaaagttatgatgatcgcctaaggtgagaagccataccacgccagcgtacagaaccccaaaccacgccagcctcatcctacgtctcagttatatttttcttgacttgcttccattctggtgccccctctctccctgccccctccttccctgcaaaggatctagcaaatttgtaggtgtggaaagggaaccacaaatgggtcatttccctgccattgtcacctggagcgtgtagccatttcgtgcagtgattctctgtctttgatgtgcaggtcatcaccttgaagggaggaggtattaaaagcgccacccagtccccacccactgaggtctttattcagcaggtgtgggtcaggcatttgggagctgggagacctgcattttaagaagcaccccaggtgatgcccaagcggagctatgtgcttcttttaagagatgatgactccgtgtgcaaccgtgtggttacctttgcgtggagtctcatggatcactgccacagtggggaggcagctctgtgctctccaattcggtgatgtgtcattcactctatgcaggcccaaggtgacacccccagatacaggtgctgccatccagccattctcaaccagggatcatgtttatccacagggacacttgtcgatatcttgaggctttgcgttgccacactgatagcagggatgctgctggcatctagtgggtggagcccagggatgctggtcaacaccctgcagtgcacaggacgccccacagaaaagaatgatccaacctcatatgtcagtaggactgaggctgaggaatcttgccttagcatgagagatcctgtctgtctgtctgcctatctctagatctatctatcgtctaccattatccatccacctatctgtctctattatatacacctatcatctacctaatctatctgtcaatgattttctgtcatctattatctatctatttatctatctttctacctacttctctatccaactctcatctctattacctatctatgtatctatgtatctatctatgtatctatctatccatccgtctatcaatctatctatttatctagcagtccatcatctatctgtgacattcttctgctacccagggataattgtgttcctcgagtaacacttggcaatgtctggaaacaattttggtagttgcactgggatgggtgttctcgcattcggtgggtggagacaaggcatgttgttcaacaccttacagtgcacaggacagcacccatgacagagagttacgcagccccaagtgtcattagtgctgtagtggagaacctgctgttagttataacttctaaccctgcgaaaggggacaggttggaaatgtcatgctcctgtacgctgtaggaggtatagttgtctggaggtatagttgtctggaggtatagttgtcctgtacagtataggaggtacggtatagttgtctgggcatttctaaatggatcttactgtcagaatgcacttgtaggatcttttccccatagggcatagagccatggcacatataacccagaagctgagcattccatagtttccttcttggagtaggaaggggctgtgcagaaaaagtctatggctgtttggcacctgagtgtgaagacatctggcaaatattggagccaattagcagacaagcacggagtccaagaaatgtctcccctttcttggataacaactgacccttcctgtgagggcccccctcattccagccattttcctctttctcattggcacacagggggtagaaaagtggggttctgcctgcaggtggggctctgccagacacggcaaagctcctggggattcccccgatggatcaggggccagaggcacctaaacctgtgagcgatgtgtgcagccacggtgctgaggctgggaaactctgctgtagtctgtgaatcccaacctctgggaatgcttcagaatcagattctgggctgatctggaatctgcatgtggctggattctggtctgatccaggcatggaggcgtgtgcctgtaatcccagctactcgggaggctgaggtgagagaactgcttgaacctgggaggcagaggttgcagtgagctgagattgtgccattgcactgcagtgagctgagattgcaccactgcactccagcctgggcaacagagcgagactctgtctcagaaaaaaaaaattaaggaagagtattattgagagcgtaggccaggcgcgtgatgttgctgagatgaaactgtctctctagattcccaaaccctggttatctccactgaaccaggctgtccaatggcatccccattgtaattgaccatgttccatggtttaaatctgttgtgagccaaattgtaccctcctcaattttacaaatggaagtcctaacctgcaggacctccaattgtgactgtgtttggagatggggtctttaaagaggtgattcaggctgggtgcggtggctcatgcctgtaatcccagcactttgggaggctgaggctggcagatcatgaggtcaggagatggagatcatcctggctaacacggtgaaaccccatctctactaaaaatacaaaaaaaaaaaaaaaattagctgggcgtgcctgtagtcccagctacttgggaggctgaggcaggagaatcgcttgaacctgggaggtggaggttgcagtgagccgagatcgcactactgcactccagcctgggcgacagagcgaggctctgtctcaaaaaaaaaaaaaaaaaaaaaagaggtgattcaggcaaaatgaggtcactaggttgggccctgatccaacaggactgcagaccttataaaaagacgagatgaagacacagacatgcacacagggacgatcctgtgaggacttagggaaaagatggcatccacaagccaaggagagaggtctcagtaggaaccagccctgcccacaccttgatctcagacttccagcttccaggcctgtgggagaatcaatgtccactgtttaaacagcctggtctgtgggactttgctatggcagcagccacagtggacaaacacatttgtattccaatgaatgagttacctctgtaagggttgaattgtgcgtctccaaaatttatatattgaaggcctaatccctaggacctcagaacatgactgtgtttggtgatggggtctttaaagaggtgagaagggtacaatgagctcaggaggttgtgccctgatccaataggactggggtccttataaaaagagtagataaggacacagacacacacagagggatgaccctgtaaagacacagggagaagagggtgtctacaagtcaagaagagaggcctcaggaggaaccagctctgcccatgccttgatctcagaattccagcctccaggactgtgggagaataaaagtctgtggtttgtaagccacccagcctatggtattctgtgatagcagcctgcaatggactaagacatctcataagaagagcagatgaggacacagacatgcacatagagggatgaccacgtggggacacagggagaagatggtgtctacaagcccaggacagaggcctcaggaggaaacagccttgcccatatcctgatctcaagacgtccagcctccagggctgtgggagaatcaatgtctgttgcttataagccacccagtctatggtatgctgtgacagcagcctgaaatggactaagacacctcataagaagaggagatgaggacacagacgcacacagagggatgaccacgtggggactcagggagaagacggcatctacaagcccaggagagaggactcaggaggaaccggccctgcccacaccttgatctcagacttccagcttccaggactgtgggagaatcaaggttgttgtttaagctgcccagtctttgggattgcattgtaacaactctgggaagccattaccaagtctctgtcctgcaaagtgagatccatggatctgcagccttgacatcccctgggagctgatgagaaacactgtgtcttgggcccagacagacctgctgaagcatagtctgtgtgtcacccatgtcctgagggatccgtgtgcatgccactctgggaagacgggtttataacacaccgtcaaccagtgcctcattgcatggtctgcggtattttcctcgagttttccttgcaccaaagatgtcttgctttttgtgatgaatgatcattccttcctcttcgacgacaaaatacttcgatctctgcagacaccgtctgttgtgttacagacagacactgaggcctgaattctcattaccaatgtctgctctaatagagcttcaatctgcaactgcataatatggtcactgggaagtcaagaacggggccagttggttgaccttctggggagaggctgggctgcttggatgctgagaccgtggagggttcatgggttccgaggagcagatcatgcaccagggcggcctgctcagctctggtgtctgcagccccggtgagcttgagcattagggagtccctggatattcatgttgaggtgtggaggaggagactccagctgtgtttgatttcctgtcctgctggaaatataaacttcttaaccaattagagaacagaatggatttcatcttatccatggggctaaagtagaattcagcccttggcaaacaagccccccgggaataagattccccattggggcagcagccttccttgtcactttctgttgcaacctacggtcctaacctagtcatatgatttaattttttttactctgtgaatcatgccgtcctgggagagagtgagatggagcaaggacaaccctcttaggggcctgccaggcactctccctagcatggaaataaaggaaaaccttgagttccttcaagggaaattccaggcacctcgctggccttgagaagtacatggagcagcttgataagcaagaaggtgattgtagtgtagaacaatagccaaggaagttagagcctcaatatgtttagtttcctgtaaagactaaagataacatccttttttgagatggagtcttgctctgtcacccaggttgcagtgtagtggtgcaatcttggctcagtgcaacctccagcacctcctgggttcaagtgattctcatgcatcagcctcccaagtagctgggactacaggtgcacaccaccacgcccacatttttgtatttttagtagacacagggcttccccatgttggccagtctggtctggaactcctgacctcaggtaatctgcctgccctggcctcccaaagtgctgggattgcgggtgtgagccaccatgcccagccaagataacatcttactatatggccctgagttgattttcaggaacccagacccccaccaaataaaaaatgccatctgctggctcatagacgttgggtaagagaaactgaggcctgaattctcattacaaatgtttgttctaaattccttccctggggcatgtggcggtgggaggggggtggaaggggggtgaggggacgtgctggaggaagtcacaccaatggccacaactaacattgatttctgctgaccccaaatgctcagacaaacttggcctccttaaccaatgacaaatcagagaaactttgaatccacattaagcccctgcttccaggtatcccgcctttttagatcaaagcaatgtatagcctgcatgtattatggctttgcctgtaacctctgcctccttgccattgaaaaccctcagctactggccacccaggaggttgggtcttgaggcatcaaggaggttgcttgatgccctctaaatagctcggaataaacgcctcacttcctcacgctgcaatcccaatggcggtgttcggctttactgcacagggccggtggacctaagttgagttagtgggaggtgttcgaaccagggcaactccaggttgagtaggggctgtgtaaaatgaggccgagagctgccgggctgcattcccggatggtcaaggcattctaaggcacaggatgagataggaggttgacacaagaaacaagtcataaagaccttgctgatgaaacagcttgccgtaaagaagtcggccaaattttaccaaatccaagatggcgatgagagtgacctcgggtggtcctcacttgtgtcttcccaccagcaccatgacagtttacaaatgccacggcaatgtcaggaagttaccctatatggtctaaaaagaggaggcatgaatgggccactccttgtttagcatatcctcaagaaagaaccatacaaatgggcaaccagtggccctcggggctgctccgtctatggaggagccattctttattcctctgcttttctaataaacttgctttcattttatggactcgccgcaaattctttcttgtgcaaggtccaagaaccctgtcctggggtctgattccagacctctttccggtcacaagttcagtcacaagaaccattatcatatgctttctatatatacacataggtattttttaattgctgaactggagtcaaagagaaaccttaggatttgcctgaaggaagtcaagatttgtccttctcggggtccctgtgccagctttgtaaaacctcggaactttcccctctgtgggcttcctcaagctgaggagggctctatgggcttagtacccactaagtggcttcatctgcagcagctgacccaagaaagttgatttaaatgaacccacacttcagaggaaaccagtacaatccgatgtaaagaaataaaaaataggccgggggcggtggctcatgcctgtaattacagcactttgggaggccgaggcgggtgaatcacttcatgccaggagttcaagaccatcctggccaacatggtgaaaccccgtcattactaaaaacacaaaaattacctgggcgtagtggcatgcacctgtagtcccagctactcaggagactgaggcactagaagcgctcgaaccagggaggcaggggttgtagtgagccgagagtgcgccattgcactgcagcctgggcaacatagtgagattctttatccaaaaaaaaaaaaaaaaaaaaaaaaggctaggcacggcggctcatgcctgtaatctccgcactttgggaggccaaggtgggtggatcacgaggtcaggagtttgagaccagcctggccaacatggtgaaaccccatctctactaaaaataaaaaaaattagttgggcatagtagggggcgcctgtaatcccagctactcaggaggctgaggcaggcgggagaatcaattgaacctggggggcagaggttgcagtgaacagagattgcgccattgcactgcagcctgggcaacatagtgaggttctgtatgagagaaagagagaaagagggagggagggaaggaaggaaggaaggaaggaaggaaggaaggaaggaaacaattgcttgaaagggctttgtttcaccagggcacgcagatcaaaggacattggattgaataatgaaacagaagagcctgtctgaatttactaatgtggttgcacgtcccgtaatgattgcagttggctctaattcagttccgtggtgtataaattctgctggcaatagctgtaattggggtcagggatttagatagtctctgtgtgttccttttcattttctgctcagagcctgctgggagctgattttcttctttaaagcgaggtaaataattcagtggggagcagaggttttgctgtgggtccattgctctcctgtgctgcgtggcagctgtgctggtggcagctaatattcagtgggcagtggcctcgacattgcattattattcgagcaatggtactgttctttgctttgcaaaattgctgtttgttatattgactttctggggtcgtggcccctgaagcattactgaaaatcatggacatgaagcagatttattaactggagaaaagacatacaaatgtatttaatgtgtatacacgggagcattcagaatgaagaccccaagttacaaggggagattgtctatatttatgctttggttcatccaagtctggacagctgtgtagaaatagggttggacaaaaagggcctgatccaatgctaatggcctgagtggggaaacccagccaggcctgtgtgtctagattcttcttggcctctctctctctctttttttttgagacggagtctcactctgttgccaggctggagtgcagtggcacagtcttggctcactgcaatctccacctcccaggttcaagcaattctcctgcctcagcctcctgagtagctgggattacaggcacgcaccaccacgctcagctaagttttgtatttttagtagagacggggtttcaccatgttggccaggatggtctcgatctcttgaccttgtgatctgccctcctcggcctcccaaagtgctgggattacaggcgtgagccaccgcacccggcctcttcttggcctctctgaacagtgctccttccttccgggtatggggctgggagcttctctgggatggggggtcttaggacgcccaaacaaggcaggtcagggaatttccttatggccacttttttttttttttttttttttttcaagacagattcttgctctgtcacccaggctggagtgtactggtgtgaactcggctcactgcaagctccgcctcccgggttcacgccattctcctgcctcagcctcccgagtagctgggactacaggcgcccgccaccacacccggctaatttttttgtatttttactagagacggggtttcaccgtgttagccaggatggtctcgatctcctgacctcgtgatccgcctgcctcggcctcccaaagtgctgggattacaggtgtgagccaccgcgcccagcctgtgccactctttatacagataggatagagggaaagttagattcctgtttttaggttttatggctggcttcggggggaaaggcgttcttgtttctgggacccgtcttggggaagagggattctagttccttcggtgccttaggggagaatgggactcagagacatgggggctggagaagttccgagagaaacttctgcttctgaggctgctgctgaggcctgcacttggcggtattgtttcgtaagcctgaaccacgtgcaggtctgaatcaacataaagaatttgggtgggaggcaggggaactccaataagaagcatctttgaatccggcaggggtggaatttgggtcccagaggggtttggtgactgcaggctacagaagaatgcttcaaagtgctgtatcacatggctttgctccgaagggtcccgagcacagctttaccgggggctcatgtgtaacgctcggcccacccatccaccaacaggagccacttaatcgacatctccaggatgccagcaaccgaggaccgttgtcatagtcccagcacaaaatgaggctgctttcttcttgggggtttagggatcccagaccacaaggatttgattaaaagccgctcagttcactaactataagcaaagcaaatcagaaatagatctcctgttcctgccccgtcttatgttcccagtggaaaataaaccccgtgaaagcaatggcgtcatgtgcaacccgaccttggagacagagaccccagagttagcgttgtctacctgggacatctcccagcccaggggtcttactccagacccgtgaggaccccaggcgtggctttgctgcaacttccctggagaggagagaggacagggggccctgcctgggagatagatttgctgcctggcatgcgggactggagactgtctcagtgcccaggccgtctgatgctggccggagtccgcctggtttatgtaacgaggtctggatgtgaccaacaacggcctcgtgtgtgtgagtcacgcgtgcagcaacttctggctgtagtgcaacccctgaaaccaagcaaagcctaaagcccccaggctccacttcctctgtgaccctccccacccccaattcctgtcatctctcagggtcatccggagcatctcaaagctgaaggagcctccgctgcaacctggcctcctgctgcaggatgagacgagctgtctgcagccctcccgtgccacctgcctgttttatgcaacagcatttcagagaggagggactgggaggggagagacaacaccgaggcctttggttatttagggcaacagcagggagtggccgggtgcacagattggaggagattaagtggttgctgaggggatgcctgggattgctgggatgggcggagacataacacagtgaaagatattggtcaacggcgaacacagattggaatgtaaattctcagggtgtgtgcatagccgggacgcttaactttggcgtcctggacaggtgtctcgactggaactgctggcagccttggaggggagatgttgcacagatccaagaggctgacacggttcctgtcccccagcccagtctgagcagcttggaccatgatgatcaagagcgctggaggaggccaggtgcggtggctcacgcctgtaatcccagcactttgggaggccaaggcaggtgggtcacttgaggtcaggagttcgagaccagcctggccaacatggtgaaaccctgtctctactgaaaatacaaaagttagctgggcgtgatggcatgcacctgtaatcccagttactcagacggctgaggcacaagaatcgtttgaacccaggaggtgggagttgcagtgggctgagattgtgccactgcactccagcctaggcgacagagagagacgccatctaaaaacaaaacaaacaaaaagaaaacaacaataaagaaaaaataagaagagagctggatggagcaaagatttgctgggttgttcttaaaggcgagcctgtagtgatcgctggtaacagagaacgtcatctgagagggacgtgggggctcccagagtttgagagaaacggccgtgtgggatttgacctgtgatggcaccgccagctcccagcctccagtctgggcccaggggcagctgctgtgtgcaccctgggctcagagttccccttccctccaaggtttgtgactttgtcctgacttagggattcctgtctggggatgcgtcttctgctccggagaggccctaattgcctccacaaggagcggcaaagcctgcccgggtggcatctgactggagccatgccacagcctatacgaatctatgttggagcccttgaaccttcccccagagcaagcgtcaccgaggcagaccgatttttgggagggagacagacatcagagcgggggagacccagtacctagggctcacctggttcccccaggcttagcctcctccagggcttagtgtttgagtgagagattgtcccccctggacaattctgtagattctgactctgctcctgccttgccctgaacttcccagaacctcagtttcttcctttgggaaatatgcatgctggtcataccaacatccttgggtgggcagatgagactcttgggtgcctggcattactgcaacagaactcaatgcatagtaagtgctgactcaatgtgctcctggctgcatcctctacttcctgataaattctctggtggtgttttctctacaaggctagtactggcaggggcaagtgaggaacaagatcaaggtgtgcatatatgtcagcaagagggacccttcaccctcacaaattctgcagtgtgtttttaatgatgtgtcccaaagatgtgaatgttctcttctctctgctgcagacacattcattagattaactgcttttggatcaggtaggaacctcagcttgtccacacaggttgcttcctgaccctgtatttgtcagtgtaggctagctgctataacaaacagcccccaaagaattaaaagtttatctcttgtttgtgttgcagccaggtgaggtggcaaaggtgtcctatgctccatatagtctctcaggcatccaggaccctcacattgttgtgcttcaccttcttctagggcagcccctctcaacctagactctgtgcgtgtgtggaggggtggggggggcgttggggggcggggatatgcctgtcctaagctgtgagtgggacagtccaggagagaagtctatgtgcttggagagaggcttccttcaaagtttcctggccatgagcaggaatgaagctctgacacaggttgcaacgtgaacgcaactcaagagcatcatgctcaatgaaagaagccaggcacaaaataccacatattgtagaattctatttataagaaatttgcagaacagacaattcatggagacagaaagtggatagtggttgtcaggggctggggaggcgggaggggaactaactgctgaatggggacaggggtcttcttttgggtgatgagtatgctctgggactaggtggaggtggtggttgcatctcccatgtagctcatggtcaggttagttttagtgctctgggcgaccctaggcttgcaggaggaggggagcagcatgaggtgaggaacaagggggattctggcctttccatcatggggtgacttatgccctgtttgctcccaataggtcaaagagactttgatttggcagatgcccttgatgaccctggtaagtgccgatatttcaaggggagccttcccttttcagcttggatctaacagcatcagctgtatagttactttggggttggattgggccagtgttgggaatttcttggtcttgagatctctgttctttgcaggagattgcagacaccttgagacaaacctttacacactctctaaaagtctcagactcatttcttggtaggtctgtgcttctaaacctgtggtttaggaatatgctagtattttattattttattttactttattttgttgagatgggagtctcgttctgatgcccagactggagtgcagtggtgcaatcatagcttaccacatagcctcgacttcctggctcaagtgatcctcccacctcagcctcccaagtagctggaacaacaggtgtgtgcccccatgccaagctaatttttttcttttttcttttttgtagaaacggattctcactatgttgcccaggctggtcttgaacccctgggctcaagaaatccttctaccttggtttctcaaaacactgggattacagacgtgcctcaacatgcctggcccagtttctgcttttcttacacttcagttcatatccctcattgtcccacaccccgatcccaatccatggcctccaatctccccagtttctgcttttcttacacttcagttcatatccctcattgtcccataccccgatcccaatccatggcctccaatctcccctcccagagcacacttcattccgttctcccctcaacttctctggttaccttcactgacggggctgtgagtttttcttctccagggcactgaggacctggaatcttcccattctgtgttttcatcagtccaagttcagctagaacctttctggctgaccagaatgctgaaaatatgtgtcctgggccctgcagaaagtcctgcttgaggcagatagtctgattgagattcaggtgtattcagaccgcggtgggtgggagaaagggaaagatttggtttctgatgcaggcacaatggaaccaaacatttattttgaaagaaaaataaacttttgtgtacacagaggaagaatccattgggctttagcattgggaacaactggttgaccagtgcagttacataatggtgtttgttggaggaagagagaatgataaccagatctgatcctaaaaagccaacaacaagatgataggaactcatctctctcccagttttctgcacacagtgatgtttttgctaataattatcctaaaaggcagatacaaaattgttgtcagtgcaacaggaaaatgtaatgactcaccccaacatggagatgccatttctcccatgaagttagaaaaggtgaaggttgaatcctaccctgtcaaggcagattgaggggtgggggttagaggcaggtgtgtggttgcaaccactttggaagcattgggggattatctccaaaattcagactgagtgtgttgcaccagcgtttggtctggataaagaatgaggcatatctgcaagagaaccctgtgcaatagtgaaggaggggctggctggtaggctcagatacagaacaagacatgttattgatctgaaagatcactgacatgtgacccaggagttccacttctagacagatacccaagagaattgggagcagggactcaaacagttatttgtgtacccatgtttgcagcagcaatattcacaataagccaaaggtggaaacaacccaactgtccatcaggggatgaatgaatgaacagaatgtggtccctccaggcaacagaatatgatttggctgtaaaaaggaagggggttctgatgcgtgctacatgagccttgaaactgtgctcagtgaaacaagccaggcacaaaaggccacagggtgtaggatcccattaatatgaaatgtccagaataggcaaattcagagagacagaaagtggattagcgattgttgggctggaagaggggacaaaagggagggactgctcgtggctatggggtctccttttggggggatgaaactgttctggaactagatacaggtggtgattgtacaatattgtgaatatatgaaacaccattgaattgcacactttaaaatgtcaaattttatatgtgagtttcacattaattttttaaaaatcacataaataaacttattttccactcacctgctactaccttttcattgctcacctagaaggctgccagtgcctgcaaacacatctttgaatgcatcgttttgctaccaagagccccccatgaatgggcaggcatgtgcctgttcatccacagcccttcctcatgggaaggaagccccagtgcagaggaaccacagtcacctgcatggcgactgtggggaattcacttttcactgtctatactgcctgggctttaagaaactctgtgagtgtatcactattttaaaaaatagttataattttacattttaaaaaggagacagagaaaggaaggatgggagagagggagggagggtgggaggaggaaggaagggaaaaggaagagaagaaagaaaagaaggaaacaatgaaaggacagaggaaaacagggagggagggaggaaaaaggatggaaacaaggagggaagaaaaggaagaagagagggaacgatggagggaaggaaggaagaagaaaggagaggagataagaaaagactgaggggaggaaggaagaaggagaggaatgaaggaggaagggaagaaaggaggggggaaggaaagaaagaaaaataggagaagaaaggaagaaagaaaaagaataagggaaggacggagggaaggaaggagagagggagaggagaaaggttggaggggaggaaggaagaaaggagggtggggaggaaggaaagaagaagggggaaaaggagagagggaaggaaggaaggaaggagagaaggaaggaaggagagaaggaaggaaggagagaaggaaggaaggagagaaggaaggaaggagagaaggaaggaaggagagaaggaaggaaggagagaaggaaggaaggagagaaggaaggaaggagagaaggaaggaaggagcgaaggaaggaaggagagaaggaaggaaggagagaaggaaggaaggagagaaggaaggaaggagagaaggaaggaaggagagaaggaaggaaggagagaaggaaggaaggagcgaaggaaggaaggagcgaaggaaggaaggagagaaggaaggaaggagagaaggaaggaaggagagaaggaaggaaggagagaaggaaggaaggaagaagggagggcaggaagggagagggaggtggcaggaaggagaaaaggtgatgagaaaccttctattaaaatacaggacatgcgaaaccatatgccccgtttggaggttcaagctctccttcttgcagtctctgcatccccagtgaatgtccgcaccacacacaaacccgtgttccagccgcctcctaccaaggcaatgctaggctgttatgtaaaccatgctttcaaatacggtgtttcctctgtttggaagaagtctggccattgcacagccctgaagctccaattttcccagccatggccgactccacctcctttgagccatcttcctcaaacctcctcctgccctcgtctgcccatccacactgcacacccaggttcactaagcagggcagtcacaggctgcaccctgagcactcctgacctgatatccacatccatgcaatacatatttgctgaatgaataaatgaatgaatgaaagaaagtgagataagccatcattctggaagctgcaagtctttctccttcttttcttttgcctccccctgcctcaccctccaccgtccagccctgtggtggctctacgggcaggtggctcacttacttgtcttggatgttctcagctactttggccatcctgtgggcatcctcacagcctcaagggtggattgtttttgaatggattttaagggtgttttcttgtcttttttctcaattcaacatggaatttgtgtctatatcatttactttgtatggctttgtcactcccttttcacctttcatcagggcgttcatggcctttcttcatgcttccaatgaatcttcaatgcatattgcatttattttctctctttgttcacagaacccaccaagaagccaaactcaggtgagtgtctcttcagctgggaaaaactgaggcaacgtccttgaactgatgcttacggaggggatggttgaggatgttttacagaactgtggggtatatgaaagagatgcaacaactgtaccagatagcagatattgaaagcaaaatgtggtgattagggaaatgcaaatcacaaccacagtgaagcaccacttcgtccccactgagatggctaaaatctaaaatggaaaataacaagtgttggcaaggatgtgatgaaactggaatgtttgtacagtgctggtgggagtctaaaatggtacagccactgtgaacaaatgctttggtggatcctccaaaagttaaatacaggattactctatgaaccagcaattccactcctaggtatgtactcaaaataattgaaaacacgggttccaagaaaaatgtgtacacaaatgttcagagcagcactattcattatagctaaaagatagaaataactcacatgttaatcagtggaaggaatggataaacaaaatgtggtccattcacacaatggaatattatttagccttgaagaggaatgaagcactgaaaattgctacaaagtggttgagcctcaaaaacattttgcaaagagaaagaagccagacacaaatgatcacataatgtatatttttatgaagatgaaatttcaagaataggtgaatccctagaaccagaagcaatgtcgtgactgccaggggctggaggggaaagagagagtgactgcttgataaattccaggtttctttttgggggaacgaaagcattctggaagtacacagaggtgatggctgcacaacactgtgaatattctaagtgcccctgaattattcacttttaaatggttaattatatgtaaatttgacttcaatttatttatttattttcaattaaaaaggtaacctttggctgggggcggtggctcacacctgtaatcccagcgctttgaaaggccgaggtgggcagatcatctgaggtcaggggttcgagaccaacctggccaacatggtgaaacctggtctctactaaatataaaaaaattagctgggcatgatggcacatgtctgtaatcccagctactcgggaggctgaggcaagagaatcacttgaacccgggaggtggaggttgcagtgagccgagatcatgccactgcactccaacctgggtgacagagtgagattccgtctcaaaaaaaaaaaaaaaaagaaaagaaaagaaaagaaaaagaaataattcccggggccgggcgcagtggctcacgcctgtaatcccagcactttgggaggccaaggcgggtggatcacaaggtcaggagatcgagaccatcctggctaacacggtatgttgtacctgagcgagttagaaaaacgctttgagacaaattaagagtcctttataagccagcgaccgagagacggctaatgcttaatagtctctcggtcctgaggaaggggcttgattaacttttagatcttggtttaggaaggggagggctgggggtctagtgaaaaccattttacagaagtaaagtaggcaaaaagttaaaaggataaatggttgcaggaaagtaaacagttccaggtgcaggggctttaagactattacaaggtgatagacgcggggctttgggcgttactaatcagacgaattcccgggaactgcggatgtagctcgccacagtatcttatcagttaactgcattcttggatgtgctgggagtcagcctgcacgagttcagtccttgaggaaggggctgccagtgaaagagccaaggtggagtctggctggctctcttagctaagggagagtccattcaggtggaaagaaggctaggtgagtaaaggaaaagggagagtctaaaaacaggttagtaaaaaccaggttgggcattacaggtgaaaccccgtctctactaaaaaatacaaaaaaaatttgccaggcatggtggcgggcgcctgtagtctcagctacttgggaggctgaggcaggagaatggcgtgaacccgggaggcggagcttgcagtgagccgagatctcccactgcactccagcctgggcgacagagcgagactccgtctcaacaacaacaacaacaaaaagaaataactcccagacttccagcagactccttgactgccatgagagatgtcaggaagtcaatggacgggtgtttataggttgttcaggaaatgttcactatcaagcaagaattgaaaatgcagctaaattgctgttggagagtgatgatagcataaagatttccaacaagaagctctgcaaattttgctgaaaaatcttccaaatgatgctctgccataagaagaaattcacaccctgaatagcacagcaggatgcgaatagcaatgccagccaaagacattgcaaacaagccggtaaaactaagtgattgttagctgtttaaaaaaataataataactggtgttaacaacaaagtgaaacttaacttctgaagatgaggctaccttcacagagaggataagaaaggaagaactgagtaaaagtagttagatattgctggattttgacattttaaggttaagtgttcctgctaaaaataaaaattgaacatataactcctgaactagtggatgaaaatgaagaatgaagaataaaattaaatacaaaaaaaatgaagagtaaaattaaataccaaaattagccaagtgttgtggtgaatgcctgtagtcccagctactcaggaggctgaggtgggaggatcacttgagccccagaggtggaggttgcagtgagctgagattgcgccactgcacttccgcctgggtggcagagccaggctttgtctcaaaaataaaaaaaaataataaattaaaaacctgaatactaaatggaagttaagaaggaaggaattaaaaaagaagaaaagtaaaataaaatagtaggaatagtgaatccttagttatgttagatgttcagtgatttaataaatctgtaaaaagacggagatgagatgatgcaatttaaaatgtttcggctgggcgcagtggctcacgcctgtaatcccagcactgtaggaagccgaggcgggtggatcacgaggtcaggagatcgagaccatcctggctaacacggtgaaaccccatctctactaaaaatacaaataaaatgtttcatgctatttacgagagaagcatttgcaacaaaatgccaaagagaaggtgaaaatagctggaaaaaaaatgcgcaaagcaaataaccaatagaaagaaagccaagttgggctagcaaaatcagacaaaataaccttcgaggtgcaaacaactttgaggcccaaatagaggttcttcccactaaaagaatgattccctgaatgataatggaatcttgacccagcctgcacctcaggttaagttaaaagtggaaatttaaagatctaagtgtgagattttaaaaagcatttccccagaaataccaggatctgtagatggaaatgttattaagaataaagatgtggagctgggcgtggtggctcacgcctgtaatcccagaactttgggaggctgagactggctgatttcttgagcccaggagtttgagactagcctggacaacatagtgagaccccatctttacaaaaaaattaaaaaaaattagtggacatggtggcatgcacctctagtcccagttactcaggaggctgaggtgggaggatcacctgtgcccaggctgaggctgcagtgagccatgatcacgccactgcactccagcctgcgtgacagagcaagaccctgtctcaaaagaaaagaaaaaaaaagaagaaagaaatgaaaaccgtagctcagagacagagaaactgagcaatgcataggttcagaagggtttgaaacagactgaattgtgtcttggcatatgagagaggtcgcagctataaaacaatgagagaagaaaccaaattccacataggcaggactgagacaattggctgttcttgtggatgatacgtgatcaaatctcaacctcatgcgatacttttttttttttttttgagatggagtctcgctctgtcacccaggctgcagtgcagtggtgtgatctcacctccccgcaaacttctcctcccgggttcaagtaattctcgtgcctcagctgggactacaggcatgtgccaccacgcctggctaatttttgcatttttttagtagagacggggtttcaccaagttggccaggctggtctcgaactcctgacctcaggtgatctgtccacctcggtgtcccaaagtgctgggattacaggtgtgaaccaccacacccagcctcatgtaatacttaaaaatgaactacaggtggattacaaacctgaatataaaagaaaacttttttttttgaaaaatagagggaaatgtcttataacctcagagttaggaggtttttcttagatacaatacaaaaagcataaccacgcccatagtcccagctactcaggaggctgaggcataagaatcacttgagctcgagaggtggaggttgcagtgagccgagatcctgccattgcactccagctgaggctacagagtgagagtataaaaaaaaaaaaaaaaaagcataacctttaaaaatgggttagcctatgtctacatttaaataataataataataataatgttccaacttcaggctctgaaaaaagtcaaaagatgagctgtcaactagaagaggctccttactgctcataccaccagggaaagtttaatatgcaaaatgcagtcatccttcagaattcatgggggattagttttaagacgccttcttccccgcagacaccaaaatccacagctgctgaagtctctgatataaaacgtgcagtacttgcatataatgcaagtatatgttcctgtatatttttatttatttatttggagacagaatctcactctgttgcccaggctggagtgcagtggcgtgatcttggctcactgtaacctccacctcccgggttcaagagattctcctgactcaacctcccaagtagctgggattacaggtatgcgccaccacccccagctaatttttgtatttttggtagagacgggttttaaccatgttgtccaggctggtttcgaactcctgacctcacataatctgcccaccttggcctcccaaagtgctgggattacagggatgagccaccgtgtccagcctctggtatactttaaattatctctaggttactcataactcctgatacgctgtaaatgctatgcaaatagttgttatactatattattttttatttgtattactttttattggattgctatattttattttttgaaatattttcaatacaagactggttggatctatagatgcagaaattctggttatagagcacaaactgtgtatagatagctcctaccaaaacagacggatggtgaaaaaaagaaaagaaaagaaaagaaaaagaaaatggaggagagagactatgaggcgactaaaagaagagggatatgatcattccattcgctgacaagaaaaattcaaagaagagggaattatgcaattgaccagctgatgtgtgttagaaatgctcagggtcacacatattcattgaaagccaatttaagccactatttaaatttaaaccgatttaaacaattgggcttttttttttttttctaaaaaaaaaaaaaagtcaattaggccaggcgaggtggctcacacctgtcatcccggcactttgggaggccgaggtgggtggatcacaaggtcaggagtttgagaccagcctggccaacatggtgaaaccctgtttctactaaaaatacaaaagttagctgggcatggtggtgtgtgcctgaggctgtgagactgaggcaggagaatcacttgaacccaggaggcggaggttgcagggagcggagatcatgccactgcactccagcttgggcgacagaccaagactctgtctcaaaaaaaaaaaagaagaagtatattggttccgtctggaaaggtggagcacttgaagcaaaggcaggaagactggaagcagggagagggttttcaggtcacaaacaggtgagagacaaaacagttgccttcttttgagtttctgattagcctttccaaaggaggcgatcagatacgaatctgcctcagggagcagaggggggactttgaatagaatgggaggcaggttggccctaagcagttcccagctggacttttccctttagcttagtgacttgggggtcccgagatttatgttcccttcacagtgtatgagtgagagcacttggaaactgagagtggaagtgtcgcaggccaggtctcactaacacaggcccccacaacacctgtttcagtattgactgagtggttaaatattaaaagccagtgctgttatacaaaggctggaatgtaacaaaagcccaccgagagtttttcccaggactttcccgggccttaaagcatgacaaaataatgaatgaattcttaacaggacccatttaggattaaacaagttttactgggggtctgcagaaactccccaggcctccacaaacaagtttattggggctttgaaggaactctgcaaacctcctggatttagcaggagacaacatgagggtaatcaccccggcacctggacccattagattaagtcaatttactgaggctcctgaggaagatcctcaggactcagaccttagttatagattaaaagaagttaatcacttatgtctttagataaatgcacacacatatctccacatagcttggaaggtatataagctctggaaaactataattttgagttagtctggtgataatttccaggccttctccctgtaacaggttgcagaaataaaaactctcttcctccccagttcatcggtgtttcattattgggctgtgagaaatagcaacccagttgggtccgggaacagaaggtttggtgttatcttcatcacaggcactggactgtcggtaaatttattccatgacaattcttcctaggtttcttttttatattacttgcttccatcatggcagacagctacactggcttcttgccatgaaaacgaacttctagtaacaaaacggaaacctttttttttaagtttcaggtttcaaggttttacttctatctgcaaagtgatttttaaccagacaatggcaatctataaacacaccgtgggcagcaaatcagaacaaactgcaaggtcgatagtcacgctgatgagcttgtttctgcagcctgctcctaagggaaggacaattttcttttctaacagtgcaatgttgtttcctccacagatatctacccaaagccaaaaccaccttactacccacagcccgagaatcccgacagcggtggaagtaagaatccgcaggcctgaaactctttctcaatctggtttgatgatgtttgcctttttatttactagcaggtttagcctggttgcatttgaaatatgtgtgtaatagctcccttactgggaatgtagtttctttcctcactggggggagcaagaaagtccaacggacagaaacaatcttattttccctttgctttgacatctagaaaccactaaggtgtacttgtaaccacccaactggttcactttgttggctgcctagacagagctgatttatcaagataggggaactgcaatggagaaagagtaattcacgcagagccggctctaagggaggctagagttttattattaatcattcagtctctggaacatctggggatcagggttgttaaggataagttggcaggtaggggcttgggaagtggggagtgctgaccggtcaggttggaaagggaaccatagggggttgaagtgaggttttcttgctgttttctgttcctgggtggatggcggacctggttgagccagattaccgggctgagtggtgtcagctgatccatccagtgcagaggctgcaaaatatctcaagcaccgatcttaggttttacaatagtgatgttacccccaggagaaacttggggaggttcagactcttgcagccagaggctgcacgagccctaaagtgtaatttctaatcttgtagctaattttttggtcctgcaaaggcagactggttcccaggcaagaagggggtctttttgggaaaggggcattcttaattttgtttcagagtgaaaccacgaactgaattcgttcccaaggctagtttggctcacacccaggaaagaacaaggacagcttaaaggttagaagcaagatggagttggttaggtctgacctctttcactgtcatcatttcctcagtcataatttttgcaaaggccgtttgatactcaaaggacactttgcattatcatcacagaaagctaatcaggctgagagacaagtcctttctctcacttgttttcagtgctccaaatacctttggcttaaccattcccaaacccccacgtgtgctgtgcactttatgtgttttagagttggtttctccattttttctaacatttggcagacagtttttttccacagatttattacactcatcattgaaaaatatgcaattcaaaaaagaaagagagtgaacgagagagagaagagtggggaggggggtgggcatggagagagaaagagaaagagaaaagaaaggggaaagaagaaaggaaaagatagattctggccattaaagttatcagcagttcaacaaccttaaaaacttaaatgtttgccaggcagagcagcgtgaagctggctaaatcaagaggggttctggaagcttcctggtagtttgctctggctttaaactttcacagcttaacagcgtgtccattcattgcagacacgcacatccagatggacagaaattatctcctcttacaaggaatcattaaaaacagagaccaagacccaagggaggtgacacccacttgaaaaactacacctcaggccgggcgtgggggctcacgcctggaatcccagcactttgggaggccgaggcgggcagatcacctgaagtcaggagctcgagaccagcctggccaacatggcgaaaccctgtctctaccaaaaatacaaaaattagctgggcatggtggcatgcgcctataatcccagctacttgggaggctaagacacgagaattacttgaatccaggagaggaaggttacagtgagccaagattgtgccactgcactccagccggggaacagaatgagattctgtctcgaaaaaccaaaccaaaccaaaccaaaccaaacaaaacaaaaccccaaaacaccacctcacccttaactgcattagttaagccagctagtctttcttttttccccctctttcatgatgaaaatcccaaataccacccacctttttctcctgctatttcctcctagtcttttaaaaaccattgtcctgcggatcatggctatgttgcaaggcactcatgggaattccacagggaacgtgtttcttgctgaaacatacttgggaaacgcccagttaaacagactgccgtgggcttccctcccagagaattcatcaggacttaaaatgtgtggctgggcatggtgggtcacgtctgtaatcccagtactttggtagaccgaggctggtggatcacctgaggtcaggagttcaaggccagcctggccaacatggtgaaaccccatctctactaaaaatacaaaaattagtcgtggcctgtagtcccagcaactcgagaggctgaggcataagaatcgcttgaacctgggaggcagaggttgtagcaagctgagatggcgccactgcactccaggctgggcaacagagcgagactccgtctcaaaaaaaaaaaaaaaaagaataagaaaaaaaaaacttaaaatgcgagatcctttaagatgggccatcttcagagtgtgaacactcagcccctcccacagcaaagtgattcatgaaccccaataggaggaggagtgggggaagagaggctcaggctggggaggtgaccccccatgactcaagcctcaatctcctgatgcttgtcccaacaaagaggaggcttcctttccgactttggtttttcatgttgtgcttaaatccagccacactgatgcctttaacatggcagtcctgaattattaatcaatactgtgtgaatccaaaatatctgagacaggtctcaatcagtttacaaagtttattttgccaaggttaaggacgtgcccgtgacacagcctcaggaggtcctgatgacaagtgctcaaagttgtcaggacacagcttggttttacacattttagggagacaggagatatcaatcaatatgtataagaagtacattggtttgatctggaaatgcgggacaactggaagcaggggcttccaggtcacaggaagatacgagacaactagttgcattcttctaagtccttgatcggccttttactgaaaactcaatttacatgtgagacagggcaaaggaatagtacttatgcctcagtctggcccagtgaatctgcatttttcatcaacaatagggcagaggaagcaatcagacatgcatttgtctcaggggagcagaggggatgactttctgtcccacacctgtgaagatgagctgttggtgtacattgccagggtgaaattccacagaactgttttagggtaaacaaaacagtttactttcctcagattgtgaggacagtatgtagcttttaaaaaacttaaaaaaatttttttgtagctatcttatttagaaagaaaatgggaggcagatctgactaactttttttttccagcttgacttttcccttggcttaatgattttggggtcccaagatttattttcctttcacaattgaacatcagaacatggagtatttaacacaggaaatgagcaaatttaacgtacacacccaaggaaaaggaaaaatgaagctggttggaagttaattatggatagtgtggtatatgagcagaaattccccttaaccagtgttcttgcccaggctagcccaaatgagcccaggctagcctagattcccaagtgtgtatcttgagaacgaggaagagccctagaaaacaatgtgtaacgtccctccaagatggggtgttctggaacaatccctcagacaacgaaggcaattgttgatgggcaacattgggaagaccccagagatggaatgtcctaggcctttccatgttctctttctcattctccctccattgacttgataggtggctgggggatttataagtatttaccacacaccagccagctttctccggatggctccaggcatgcttggagcccagtggtctctttcccttagaatttgatctggaggaacccaaaattctctctgtgtcctttgaaattcagcacatttttcttggcttccatgagctcctgtggcatttctcaggccaactgttgactctgcttcctatgtctgtgcttgtccctttgagagatgtcagcgttgctcaccgattcttttctctgaccccagcagctcctatccatgttgtctttttttttttttttttcagacagagtctcactgtattgctcaggctggagtgcaatggcacgatggcatgatcttggctcactgcaacctccgcctcctgggttcaagcaattctcctgccttagcctcccgagtaactgggattacaggcgtgcaacaccacacctggctaatttttgtacttttagcagagacagggtttcaccatgttggccaggctggtctcaaactcctgacctcaggtgatctgcccaccttggcctcccaaaatgctgggattacaggtgtgagccactgtgcctgtcctcatgttgtcttgaaagtaacaagacaggcacggattctttttgatgcaagctgttatgggatgaattatgtctccccgcaaattcataggatgaagtcctaacccccagtttcctcagaatgtgactgtctttggagatggggcctttaagaaggagattaatgtaaaatgaggtcactagggtgggtccggatccaataggactagtatcctaataagaagagatgaggacttagacacacacagaggaaagattatatgaagacacagggagaagacggcatctacaagcccaggagagaggccttaggaggaaccagcccagaccatatcttgatctcacactcccagcctccaggactgtgggagaatcaatgtctgttgtttataagccacccagtctatggtgttctgtgacagcaacctgaaatggactaagacacctcataagaaggggagatgaggacgcagacacacacagagggacaatcctgtgaggacacagggagaagatggcatctgcaagcccaggagagaggcctcaggaggaatcagcccagcccacacctggatctcagacttccagcctccaggactgtgggagaatcaatgtctgttgtttataagccacccagtctttggtattctgtgatagcagcctgaaatggactaagacatctcataagaagaggagatgaggacacagacacacacagagggacgaccctgtgaggacacagggagaagatggtgtctacaagccaaggagagaggcctcaggagtaagcccaggaatcaatgcagttggaggttctgtgtgtgaatggaggagggaagctcacagatgaaggcgttttgagggaggactgaccttacagtgaggtacccagagacttcctgaaccaagccacgaatatgcagctcgtgctccgggcagtgccttctggcctggaaaccaaagctcccttgtgtccagtccccactcctctgtttggcccccaagtttccataatcccccacagttgtatcattttagagacctcaaaagagagtctaggctgggcgtggtggctcatgcctgtaatcccagccctttcagaggccgacgtgggtggatcacctgaagtcaggatttcaagaccagcctggccaacatggtgaaaccctgtctctactaaaaatacaaaaattagctgggcatggtggtgtatacctgtaatcccagctacttgggaggctggggccagagaatcgcttgaacccaggaggcggaggttgcagggagccgagattgtgccactgcactccagcctgggcaacaacagcaaaactccttctcaaaaaaaaaaaaaaaaaaagagagtctaggcagggcatggtggtccatgcctgtagtcctagctatactcaggaggctgaggtaggaggatcacttgagcccaggaggtggaggctgcagtgagctatgattcaccactgcactccagcctgggcaacagagcaacaccctgtctcaagagagagagaaagggaaagagagagagactattttgagaagtgaaaaaccagtcattctcagcccagatttccagtgttctgagacgtctgtcctgaggaaggactttgagaacagcatccttgccttttttgtgaattaaagtaatttcactcttgagccaatgtggataagcacttgacaggtactggcagtgccaggtaccaggaatatagaatgggtacagaaaataaagtttctagtccagcgacaaaaaggtgctgaagatacagactcatgtcgtgcaaagagcttgcactgattatttcatttcggcttcttgaatagggtcaaaggacatttaagctgagacaggagggacgagctaattaatgcttttccagatgacaaatggattcttcaaatatttagggagagtgtaaagtgatggacagggaacaggaggggtcatgacagaaggaatgccacctgcaaaagtcctggggcagggctgggcacggtggctcatgcgtgtaatcccaacactttgggaggccaaggtgggcagatcacctgaggtcagaagttcgagaccagcctgggcaacatagtgaaatcccatctctactaaaaatacaaaaattggccaggcgtggtggcacacacctgtaatctcagctactcgggaggctgaggcaggagaattgtttgaacccaggaggcagaggttgccgtgagctgagatcacaccactgcactccagcctgggcgacaaaagcgaaactccgtcttaaaaaaaaaagtcctagggcagaaagctcatggtaaacttgaggaacatgcaaaagtcattgcaaaaagttttaagaaattcaaatgaagccaggctcagtgtggctaatgcctatgatgattccagctctttgggaaggcaagacaggacgattgcttaagaacaggaatttgagaccaacctgggcaacatagcaagaccttgtctctacacaaattttaaaaattagccaactatggtggtatgcacctgtagactgagctacatgggtggctgaggtgggaggattgtttgagcctaggaactcgaggctgcggggagctatgattgcaccactgcactgcagcctgggcaacagagcaagactctgtctcaaaacaacaacaacacaaattcaaatgaaacggtgtaactcaagcaagatggaaatacaacacactatcaaaaggtcagatgtttcatcctaacatttatagaagtgactgacttctgtaaatggtgctggcatctgtagtagccctaaacagggaaaggtcaacaacgcactttctgccctgttaatttcagagagccctggacttcttgcgaaagcaccagtggtgtaagtttttgttttttcattgtaagctctgaggtggtattatgaatattgtctacatgattaataagctccgtaaaagcaatgggcagtaacatcttttctgtactttggcattcttatttatagatggtatctacctgaaagatgtcattatttttctgaaatcatactgttgttttccaacagatatctacccaaggccaaagccacgccctcaaccccagcctggcaattccggcaacagtggaggtaatgagtatttatttatttatttttattttattttattttattttattttactattttatttgattctatgttattttactttattttaccattttatttgattctatgttattttactttattttatttgattctatgttattttactattttattttattatttattttggagacagggtctcgctctgttgccctggccagagtgaagtgatgtaattgcagccttgaactcctgggctcaagcaatcttcctccctcagcctttcaagtagttaggactacagatgtgtaccacctacattgcaccacctatatttcaccacctatattggctatatttcaaattttttgcagagacaggatcttgctgtgttgttcaggctattcttgaactcccggcctcaagcaatcctctgcctcagcctcccaaaatgctgggattacaggcaccagctattgtggcccagcctgataatcagtattaaagtccattttagaagtgtttggggccaggcacagtggctcatgcctgtaatcccagcactttgggaagccgaggtgggcggatcacttgaggtcaggagtttgacaccagcctgagcaatatgatgaaaccctgtctctactaaaaatacaaaaattcgccgggcgtggtggtacatgcctgtaatccagctactcaggaggatgaagcaggagaatcgcttgaacccgcaaagcggaggctgctgtgagttgagatcacgccacagcactccagcctgggagacagagcgagcccctgtctcaaaaggaaaaaaaaaaaaaaaaagaagtgcttcacgcctgtaatcccagcactttgggaggccgaggtctcctcaggcagatcacctgaggtcaggagtttgaaaccagcggccaacatggtgaacccctgtttctactaaaaatacaaaattagctgggcagagtgacgcgtgcctgtaatcccagctactggggaggctgaggcaggagaatcgcttgaacccaggaggcggaggttgccttgagccaagattgtgccaatgcacaatctatctaggtgatagagtgagactctgtctcaaaaaaaggcgggggggtggttggatacaagtattatttaatgacttaaaaattctcatctccatggtgaaagaccaattgcttttgaaatgcacagacattgttttgcgaggagttcagttctactatccaccagcacctggggattacatttagttgatagtaaataaatttaaatgtttttgatgacattgactgaaaaataccatgcacactaagacatttcaagttatgatggaggaaggcaattttttcttgtttttttttttgttggtctgtgttctactcacttattcttccctctgcaagagttatctgcggccactttgcctgtgttcctacagcacttcccatctccgccttggcaattgtgtctcacgaacgtgagacactcaggaaagagatgctggtctgtaaagttggaagagtctcagcgattccattggtggggcaaatgtgtgcagattgaggaagctaagatacactgggtgtcttcctctctccacctgctttaaccattgggagttcccctgattgtgattgtttcaggacgttgcttggatgttgtcatattcctagggttcaaggcactccgtgaaatccaaggaaacaagctttgggtatgtcccagtgccttttcccttgggtcttgcaactgaagaattgtgtttcttccctagaaaaacgaacacacttttgcccactcacccacctcctgcaagtctccaaaaccacagcgttgtatcctagactatgttcccccaggaggtggttcctccctctgcattcccgtactccatactgcttgatatgttcttacatgcaacaccgtgcaattgtgtttagttgattcctgtgaattagaatgagaactctacatgggcatggatttttgcctttcattcactgctgcattccctagtctggaaagctgtgcctggcacacaatgagtcctaggtgaaggtcagtgaagtcattaatgcttgagtcccaacaggcaaacagctggattcatgaatgaaagacttaccgctacatcccttcatcagggtgtatagcttcaactccatttcctggaaagctctacaatagttcttcctcctcaaaaggctctggtcttgtgattcatagcattcgtccaccaagacatgaacaagggatctttatgtcagaggttccctgttcaaagctgttttagaggccaggcgtggtggctcattcaggtaatcccagcactttgggaggccgaagtgggaagaccacttgaggtcaggagttcgagaccagcctggccaacatggtgaaaccccatctccattaaaatacaaaaattagccaggcatggtggcatgtacctgtaatcacaactacttgagaggctgaggcaggagaatcacttgaacctgggaggcggagttcagttggagttgcagtgagccgagatcatgccattgcactccagcctgggtgacagaacgagactccatctcaaaaacagtaaaaataaaaaagctgttttaggaaacatcccttttttattattttttctttgagtcagggacttgcttggttgcctaggctgaaatgcagtggcgggatcacagctcactgcagcctccacctcctgggctcaagcaatcctccgactttagcctcctgaatagctgggactacagacacacagcactccacctggctaattttttcttttttctttttctttttctttctttttctttttctttgtgtgtgtgtgtgtgtgtgtgtgtatgtgtgtgtgttgggacagggtttccctctgttgcccaggctggtcacaaactcctggccttaagtgaccctcctgccttgacctctcaaagtgctgggattacagatgtgagccactgagcccagccctaggaaacagcctcttaagccaagtgcaatgactcttgaactccccagagcctctgtgcatgctacctcgacttcagcttcacagatgtatgcaactgcgggatcaggttaggggcactcacttaccggcagtcccaaagctctggagagtctgtgctgagggaatggtccatgttaaagcaaagcagaacaaccactctgccttttgtattttatacttgttttttttttgaaacagggtctctctgtgtcactcaggctggaatgcagtggtgtgatcatagctaactgcagcctccagttcctgggctcaagtgatcctcctggcagatgggactacaggcgcacaccaccaagcccagataattttttgtatttttttgtagagacagggggtctcactatgttgcccagactggtctccaactcctggcctcaagcaatcctcccgcctccacctcccaaagtgctgggttgcacccggcttgcatttcacacgtttaataaactcaatcagcatgtttcctaccccctagagtgacaatggtgcacattagcatggatttcttatagatcgagaccaaagacctaattacttatctatagaccaatcttggagaggaaaggcagactccaagggttaattcggggtccaggaaccacagaaggaaggtctccttggatctcgtttgagcctgaagtagctcagtctatgacagacaccatcagagggcagaggcacaggtgaacgcagcagtcggaactttgtcagagcagcaaaggacatcttaggaaatgaggcttgcaaagcagccttgggttattgagaaagctctctcagcgtggattctcagggctctgggatcttctctgccttgcaggtgcctctttgttttttgggaggaagcaggtgggtctcatgtgtcagggcagtaaggagcaggaatgaatggatgaaacaaatctgttggggtgggtagcggctgtgctctggggagccaagagagagacagggggatggtgctggtttcagacaagatagttgagcaggaacttgaaagagaaaaggagagtggatcgtggggacctgagaagctggaattctccctggggaatcggccactgccaacgtgagggctggggttaggagcatgcctatggtgatggagaagcctgggggaggtgcctggttgatggggcaagaggagccatctggagagaaggaaaagcctggagtctccttccgggcttgcttaaggactagggaggggcaggacatgagatgatgttggaggattctgagcaggggatgggcctaggtgggaggtggggcagaaggagagctggacgaggacatggtgagaggtgatgttggctcatccaggaaggacggccaggaggaagcagagggaaaggggcatgcaaaggtccagaggcaggagcaacggggaacatccagggaaggagggaagggcaggggatttggagatggggcaccctgagagagggatccaggcagcaggcagacacgacagcctgagcttcaccccagctcacggttggccctgggagggctttgagcagaagaggggcaaacatcagcaatatgaggccacactgcagacgttctgggccctgcacacgcctccttgcaggcaaggcggccagcccacaaggtaatttaattcctggtgcctgtgggcgtcctgcaaagagccagttggcgtcggaacgctcttctccaaaacctgtgccagtgcccccagcgcagacctggtgtgaaggggacctttggagaggtctcatgagcaatgccgcgtgctctgccccacaggttacttcaatgatgtggaccgtgatgacggacgctacccgcccaggcccaggccacggccgcctgcaggtaggtgccgagcctccccagatgcgacacattgaatttgcacagagagggtgggatgagaggcctgaagttggggatgagagagctgaggttggggcagagttggtgacgagcagacgataagctggtgcaggggatgacagagaaggccccatggccgcatcagtggggtttgcggtctgggcatctgtccgcctctccaggctgggggactggatggaaacaaaatgaacaggcagaactggagggtccactgaaacacttgcggtcatttctgtttagacttgtatatgtgtaagtgtgggtgtacatgtccagacacacctttatatatctgcatgcttatcaatcttcatttgtgtgtatatagatgtttatgtatctttatatttgtgtgtatatatgcttttaaatatatataaatgcatctacatatgtaggtatatggtttttttcatgtgtgtatatacatgcttttgtatatatacagtacgtggatacctttctctgtttttatatatgtatatcctgactttatatatatccttatatatatctttacataggtacatgttttatatgtgtatatatatctttatatttatatgcagatatatgctttttatatatatttatgtatatgtatatcgtttaatatatctttttaaaaatatatcttcatgtatatctttaaatacatatacattttatatacattttaatattttatgtgtatgttatataaatatatatctttacatatataattaaatatatgcctttatttatatacatctttatatatgtacatatatacctttacatgtatgtgcctttatttatatatgtatatatttatatatacacttttatatatacatatgtgtatatctttatatgtgtgtataaatgcctttatatacgtacacatatacctttatgtgtatatacttttatatgtgttatgtatgtacacacaactttatatatacatgtgtatatatctttatataggtatataaatgtctttaaatatgtatatacatatcttttgtatttatttatttttttttgagacggagtctcgctctgtcgcccaggctggagagcagtggcacaattttggctcactgcaacctctgcctcccgggttcaagtgatgttctgcctcagcctcctgagtagctgggattacaggcgcctgccagcacgcctggctaacttttgtatttttagtagagacggggtttcaccattttggccaggctggtcctgaactcctgacctcgtgatccacctgcctcagcctctcaaagcgttgggattacaggcgtgagccactgtacctggtctatatgtatatcttctaatgtatctttatatatatctttaatatatctttatatacatgtacattttatatacatttttatattttatgtatgttatataaatatatacatttatacatatataattatatacctttatttatatatctttatatgtacatatatacctatatatgcttttatatatgtatgtgtacatttatatatacacttttatatatgcatatgtatatgtctttatgtgtataaatatcttcataaatatatttatatatctatacataacctttatatatgtataaatatcttatataaatatatattttatgtgtatatatgcattatttgtataaacacatatttgtaaatgtctttccatatatatgcatatatagcttacatatgtttctatactgttatatataggtgtatacctttacatatgtatgcatactgttttatatatgtgtatataggtcccttcatgtatatatgtatatacatttaggtatatgtgtgtgtgtgtgtgtgtgtatatatatatacacctttatatatgtacatttatctttatacacacagacatatataaacacttctaatataaagttttctctgtaattggaggtgaatgtctatcaataatctttcatatagaaatacaagtacagactataggagacagagatgcatacaacattgggctgaagagtgtgatgtttgaggctttattttcaagcatgtgaggtttctggcctgtttagttctgcaattttattttagaagacataaaggacttgtcccagatattttgcaaagctggacctgcatctttcggacaaccagattgcatccagtcatcttttctgccgtgtttacttgcaataaataaagagcgctgtcttaggatttattacaataacaatcaggaataaactaaaaattactagttatttttgaaaggagaagctgagaacatttacgattgagaccatctgctggaaggtcctcctaatccggcgtcggcgtggctgatctcatatcagtttctcggcaggaagcgggtgcgcctgcgtgaatttggagtccccagggtaaatgttagtcccgtgacggcaaagtgtttttgatagctagagctcagtgttggcatgagttttcccacggggaagaggaagctttggtggggccacccttgactctcccctgctggtcactctttggagctctcttggcagtgacacgttcacacgacttgttgccattcccaatgagctggacagaccaacacctgcaggaaaccccacgctcagacacctgaacatccctcaactctaccttctctgtctaacaggaggtggcggcggtggctactccagttatggcaactccgacaacacgcacggtacccctacatctgggcatgcgatggtgggtggagggtgggaggggtcatctttctagggctcccgcttgcactctgccctgggccttctacctggagtctttggtgagtagggtgctgtgtgctggtgcctggtcttctgagaacctgtctgtgctgggctgttctgcttctgttccccaggagggtgggtgcagccacacatacacacacgcatacacacatgcacacacacacacacacacacacccctttaggtaaaagtaaacagagcaaagaactatacaactaattagagaaagagagcatccaacaaactggagagcatccaacaaattctttaggggcgcagctcgcttacttcaagcagaatagaaaacactttcaatggctgggcgcggtggctcatgcctgtaatcccagcactttgggaggctgaggtgggaggattgcttgagcccaggagtttgagaccagcctggacaacatggaaaaaccctgtctctacaaaaaatacatatatgcaaaaattagccaggcgtggtggcatgtgcctgtagttccagctactcaggaggcagaggtaggaggatcacttgagcccaggaggtcgaggcttcagtgagcagacagagataagatcgtgccactgcactccagcttgggtgacagactgagatcctgtctcaaagaaaaagaaaagaaaagaaaagaaaaaaagcaagagaactcttttggtcggtgcttatgcccagagtgaaagccgtgttctacagaagccataaacaggctcttggcttggttgagtttttctcatggagaccaggggaccttgaaaccctcagatcctctccggtttggaaaacgactgaagcaaaatgtcatcactgagaaagaaaacaataacaaaacactctgtaggttgattttaaaccatcatctccgttttaacattttccctttgttaagagttttgtacaccttcaatgaattgagtaaccatcttttcttttttttttttttttttttgagacagagtttcacttgttgcccaggctggagtgcagtggtgtgatctctgctcactgcaaccttggcctcccgggttcaagtgattctcctgcctcagcctcccaagtagctgggattacaagcatgtgccactacacagggctaatttttgtttttttagtagagacagggtttcaccatgttggtcagattggtcttgaactcttgacctcaggtgatccatctgcctcagcctcccaaagtgctgggattacaggcatgagccactacacctggctaatttttgtatttttagtacagatggggtttcaccttgttggtcaggctggtcttgaactcctgacctcaggtgatccgccctcttcagcctcccatagtgctgggattacagacgtgagccaccatgcccggccttgagtaaccatctttttggttaaaactaatatgtgccaagagctctggtaatgtgggaagtacttttttttctttttctttctttttttttttttaagatatggtctcattaggctttgtgagagccaaggctgttggccccctaagttttctctgaatcactgacatgaggcagcttaattaacaggagaaaaagcgtataaatttattgagtggatatacacgcaaaccttcagaaccaagactcaaccaccaatgggatgcaaaagcttatagaccatcttttttaactttgatgttaggttcaggggtccttgtgtagggttgttacataggtaaattgtttgtcaccggggtttggtgtacacattatgtcatcacccaggcaataagcatagtacctgataggtagtttttccatcctcactctactcccaccctctgccctcaagtaggccctggtgtctggtgttcccttctttgtgtccatgttgtcaatcgagaaaaatgacgagacgagcgtaaaagatttatttgccaaagttaaggttaagggcgcgccccaggagacaggtctgtggccttctccgaagatgattttgaaggctgcaaatttaaaggggaaagggtgggggtagggaaaaagagttattcatgcttttgtctggctcagtgaatctgtgtttttttacataagatggcatagacaaatggggcagagggaaaatgcagggaatctgcatgttgcataagataatctggacaaaatggggcaggggagcaatcacatatgatttgtgtctgctgggcgggggtgactgcaaagctgtcgatttgcatattgtcatggtgaaatcttcacagctcactaggattttccttgtgggcaaaatatgggggagacgtgtagcttttcatcttgtagccattttatttaggaaccaaaagggggaggcaggtttgtgtgacccagttcccagcttgacttttccctttgactaaatgagttcaggatcacaaaatttaatttcctttcacaatgcgtactccgtgtttagctcccacttgtaaatgagaacacatggtatttggttttctgttcctgcattagtttgctcaggagaatggccaccagctcgatccatgttgctgcaaaggacatgatcttgttcttttttatggctgtgtatatgggccacattgtatatgggccacatttcccttatccagtctaccattgatgggaacctaggctgattccatgtctttactatttgagtttgctatttgttgttctttgcaggaagaatgtgggctcagagcatggccccaaataggtgacgttggtaaagcaggtttaacgggtggcaagccaggtgatgagagggagacaggaagaggcctgcttagcaagggggtccttgttatgcagatgaaggttcccaggtagcagcgctcagagacgaccatggtaaatgtttcttttcagacctgtaaaggtgtcagagtctccgtttctctctcctacatccaggaaaagcttagaaagggaaggcctggctgcaacagcaaagatcctctacagatgccaatttccccacctcagtctgctggccctggagcggcaatttcaaaataaggcaaagcaatatattttggagtaaaatattttgatgtccgtcatcttcgttacctcggaagcgagtgttgtcatcagatccatttaacaaaatgaaagcaatgcatgacgctcgactgtccacttcaaaggagcaatagctgtggccctataggtagcccatcctcagaactcactccctatgacacagacaagcttcaggatgggagggggctcatgacaaagtgctcattacctggggtcaagaactgtctacttttggccgggcatggtggcccacgcctgtaatcccagcactttaggaggccaaggtgggtggatcccttgagttcaggagttcaagaccagcctgggcaaaatagtgaaaccctgtctctacaagaaaatacaaaaattagctgggcatggaagtgtgcgcctgtggtcccagctactcgggaggtgtaagtgaccctggaagtttgaggctgcagtgaaccgtgatagcaccactaccttccagcctgggccatggagtgagaccctgtctcaaaaaaaaaaaaaaaaaaaaaaaggacactaaaaaagaattgaccaccttcaactcaacgtactatgagatgagttccttccaccatctttctggaactagctaaggggttccccttacctactacctaggtagacctgatttattaagacgggaatcgcaatagagaaagagtttaattcacacagagctgactgaacgggagcatgtgaagcagctatgctgtctggggtacatacctggggttcattgttgcacgctgagaaagaattcaggacacagacacatgtggttgggttaaggagttgaaagtttaatagaagaaaggagagaggagagcagctccttgcaagagagagagggagagagagaaagagagagagagaaagagaagcatctgaaaaagttgggaggttgtggaccgcagcagcttttgtaggcaggctggaggaggtggtgtctgatttacatagggcttacagactggttcgatcaggtatgacttctacatagtgcgtggggaaggctggtggccccaccctaattttgttatgtaaatgggctttccagttggtcagtgccatcttgtctgctacttactgtacatggggctgacaaagaggagggaagatgaagctgccatcttgaacgtgtctaggccctagttcctgccggcattcacccatgtaagctcctagctggcttgtctatgtctgcagctcaactttattttttattttttatttttttttgagacggagtctcgctctgtcgcccaggctggagtgcagtggcgtcatctcggctcactgcaagctccgcctcccgggttcacgccattctcctgcctcagcctcccgagtagctgggactacaggcgcccgccaccacgcctggcaattttttctatttttagtagagacggggtttcaccgtgttagccaggatgatctcgatctcctgacctcgtgatccgcccgcctcggcctcccaaagtgctgggattacaggcgtgagccaccgcgcccggccacagctcaactttacaggctgctctttgttagaaaatgatttggggctgcttttcattaaaaagaaaagccttaccaaggactcccatacccttgctatgtgcctaagtaattaactaattccttcttaactcctatatcaactggaggttttgcttttttttctttaaacagggtttcattttgttacccaggctggactgcagtggtgaaatcatagctcactgcagcctcaacctcttgggctcaagcgatcctcccgcctcagcctcctgtgtagctaggaccacaggtgtatgccaccacacctgcctaatttttaaaaaatttttgtagagatggggtctcactatattgctcaggctggtcttcaactcctggcctcaagtgtttctccgacctcagcctcccaaagagctgggattacgggcatgagccactgcacctagccaagactggagttttatgactcaaatcagcttcccccaaaatttggacactgggctttttaacgtgtaatttggctggtaggagacccgggcgtggggagtgctgagtggttggttggaggtggaatgacagaggacggacatgggttctttttgttgtcttctgttcttgtgtgggacggcagagctcgctgagccgcattaccagtctgggtggcgccggctggtgcatctcaatgaagggtttaaaaaatgtctcaacttcaaccttaggttttacaatagtgatgccatccctaggagcaactgaagaggtttggaatcttgtggcctccggctgcatggctcctaacctattaatataatttctaatcttgtgactaatttgttagtctttcaaaggcagtctgatccccggggaagaagggagtttgtttcagaaaagggctgttatctttgtttgaatgttaagctggaacttcctcctatggttatctgagtctgtgttcaggaatgaactagggctgttcgagggctacaggcacgatgcagtcggttaggtcagatctctttcactgtcgtaattttctcactgttataatttttgcaaaggcggtttcaatttaactgaaaatgtcaggcaaagaccaaatttaatatttttacagaaagccactgggagtagttttttattgttttattatttatttatttagagacagagtctcactctgttgcccaggctggagtgcagtggtgcaatcatagctcactgcagcctcaaactcctgggctcaagcgatcctcccacctcagcctcccgaggagctggggctacaggcacacaccatcatacccagctaaatttttaagaaattttttgtagagatggggtctcaccgttgtaactgcccaatgggtttaccttgccccctgcctaaacagggccgatttatcaagacagaggaattgtaatggagaaagagtaattcatgcagagccagctgtgcccgagaccagagttttattattactcaaatcagtctccccaggcattcagggtccagagtttttaaagataatttggcgggtaggggcttgggaagtggggagggctgattggtcaggttgcagagggaaccataggggggtgaagtgaggttttcttgctgttttctgttcctgggtggatggcggaactggttgagccagattaccgggctggctggtgtcagctgatccatccagtgcagaggctgcaaaatgtctcaaacaccgcgcttacgttttacaatagtgatgttacccccaggagcaatttgcagaggttcagactcttgagccagaggctgcacgacccctaaaccataatttttcttttcttttcttctttttttgtttttttcgagacagagtatcactctgttgcccaggcttgagtgcagtggtgtgatctcggctcactgcatcctctgcctccctggttcaagcaattctcctgcctcagcctccccagtaactgggactacgggcacatgtcaccatgcccggctaattttcatatttttaccagagacggggtttcaccatattgttccggccggtctcgaactcctgacctgaggcgatccaccctcatcggcctcccaaagtgctgggattataggcttgagccactgcgcccagccctaaactataatttttaatcttgtagctaatttgttagtcctacaaagtccaactggtccccaggcaagaaggaggtgttttcaggaaaaggctgtgatcagttttgtttcagagtgaaaccatgaactgaattccttcccaaagttagttgggcctatgcccaggaatgaacaaggacagcttaagggttagaagcaagatagagtcggttaggtctggcctctttcactgtcatcatttcctcagttacaatttttgcaaaggtggtttcgccacgttgcccaggctggtcttgaactgggctcaagcgatcctcctaccttggcctccataagtgctgggattacaggcctgcaccaccacatccggcccaccttggagcgtgttatataaagcgagccgtccccacacccctacagcctacgaatgagccttttcaccccatgcacgattctctgaaactgctctctgtaaggagctattcgggacacgttcttttgttctctggcatactcatcaggtagaaagaagtgattcagcaagcggctcccctgagagccctgatcgtttcctgttttcctgtgaagttagtctcgggaggtctgcgctgtgccatttttgggggaccattatctggctcccgaatggatcaaagcttactggtcagggggctgctgtatccctggggcaaaactgccagaaaatagcaggtagccctgtggtccttggcagggccagggcccggtggaagcagcagctgggccaagaacatcaggcgtgcatgaggcacagcccagttttgggagcatgacgcttgttttcgaggatgcctgtgctccccttcctgcctggacccctgctctccagccccggcagagcgaggctgtgagtcagcgctcggattagcatcagcatggaggtgccggctgggatgcaagccgccgccatgggatgagtcacgcggcttctccccgaatccccaaaggaggcagagcgtgttaggcttgttctggcttcatgcagagcactgaggggtgagggctgaccgtggctggccgcggagggaagcccaaagtctggcctccctgcggagactggggagaaaatgttgcgctcgtcgtttttaaatactgggggacaagtttcccttgtctgctaaggctgccattgtaaattacaagagtcaggagggctgaagcaaaagggatttcttctcccacagtcctggaggctggaagtctgagatcaaggtgtgagcagggctggttcctcctgaagcctctctccttggctcgtcgacatcatcatctccctgtgtcctcacagggtcgtccctctgtgtgtgtctgtgttccaatctcctctccttatgaggtgtcttagtccatttcaggctgctatcacagaatactatagactgggtggcttagaaacagcagacattgattctctcaccgtcctagaggctggaggtccaagatcaaggtgtgagcagggctggttcctcctgaggcctccctccttggcttgtagacaccatcttctccctgtgtcctcacagggtcgtccctctgtgtgtgtctgtgtcctcatctcctcttcttataaggtctgtagtcctattggattagggcccaccctagtgatctcgttttattttaatcacctctctaaggacgttgtgttcaaatacagtcacagtctgatgccctgggggttaggactgcgacctgtgaatttggagggggatatagttcagcccatagaacccactatccacataagtcattccacttcaaaatcagcacaaagcattagttttaaaaatctcaaatctgtatttttaaaaattgctcttaacacattagaaaaatatagaaaaactttttttgctgtttttctgagacaaaatctcactctgtagcccagcctggagtgcagggacgtgatcatagatcattgcagcctccacctcctgggctcaagcaatcttttgcctcagtcgtctcccaagtagtagctgagactacaggtgcacatcaccacacccagctattttttttttttaagtagaaacggggtctcactatgtttctcaggctgggctccaaatgagctcaagtggtcttaccgccttagcctcccaaagtggtaggattacaggtgggagccaccacacccaacctggaggaactctttttttttaaaattttaaataaattactatttgtggcctgcgttttcatcctattctctttttttttaaccaacatttgctggcatttttttttatgccgaagaaaacacctttgcccatctatgtcaggcctccagaccctcagggatgtacatctaatgcaccttcagccaccggtgtaaacagtaaacaggggccagatggcgcctgtgcaccttccctggccttgggagagcattggaatctctgcagcttttaagagcatcttgcttcaggtttgctgacctgcttgcttctgtaagatcatgcagacttcctgagcaatatctagcatttcatggtctcttttctatcctgcaggaagagggggctatagactcaactctcgttatggaaatacttatggtaaaggaattatgtcttacagaatatgtgaggcaaaactgtccatttgcaaataactaacacactgtctgcactgatgggaagctgatgctttcatccagtgcacaaccaactggccgttcgagtctctcatttgcattttccttggtcatccatgctggggggagatgttgtgcatgccctgaggacttcatttcttcaaaggaactatggcccacttacaggtgttactgggtgcatgtgtgtgcacgtgtgtgtgtatacatatgtgttcacacacaggtatgcttgtgtgtattgtgtgtgcatgcatgtgtacatgtgcatgtggattttgtaatcatgtgcataagtgcatgtggatttcatgtgcatgtgtgcaagtgtctgtgcacacatgtggattgagcacatgcatgtttgtgtatgtgcacagatgtgttggcatgtacttgtggattttgcatgtgtgcatgcttgtgcttgggttgcatgtgcattgcatgtttcccatgtgtgtccattcacatgcatacatttaggggtgtgcaagcacatgtgtgcatgtggatagatgcaggagtgtgcatctgggtgtgctcgtgtggtatgtgcatactgcacgaatatatcatgtgcatctgtgcatgtggattgtgtgtatacatgcgtgtgtacaggcatgcacacacacacatgaatgtgtttgtgtgtgcatatttgtgtgtacatgcatgtgtttatgcatacaggtgtaaacatgtgcacacatcggtgtgtgcatgtgcacacatgtgtacatgtgtatgtttaggcgaattgtgctttatatgtgcttttgttgcctgtgtgtgtggtatgtgcatgtgtgtgtatgtggggatgtgtgggatgtgcatgtgtgtggatgtgcacattgcattgtgcttctgtgttgcatttgtatttacatgttgcacatgtgtgtaaatgcatgtgtgtgtgcacgtgtgtatgcgtgcttgtctgcctgtgtgttgcacgtttgttgcatgctgcatgtgtgtatgcatgtgcacacacatttgtgcatgtcagtgtgtgttgcatgtgcttgtgtatgaatggcgtgcgtgtgtgcatgtgtgtccatggggttgtcagcctgtgtgtgttttgcatgcgcatgtatgtagactctccaatcctgaaattaaagctgcatctccctctccctggtattatccccattctgctaatgaccattagacatggcatacacattcacattcctcctccttatgctgcttggctgtccccctccccccacaagaatgtaaattccctgaaaacagggatctgtgtgctgtgttcacagtcgcatcctcaacagtgcccggcaatataaggccctccataagctctgctgaataaacacgaacatccttttccgcttacaggtggagatcaccattcaacgtatggcaatccagaaggtaactgattgactcacccggtcccaacctttaataagagcacactctcctagatcagtgctgggaggagctgtgtgggcttctgtttcccaacctcatgactttcacggagcactcatactttgtatgtatataaagtagctcctgaataaaaatatctgaccttcagcacaggaccaatcagagttcagagaaaggagaggcaagcattggttttcactgcagaagatgccccttagctctcaaagcaaggctgtgaatgagtgctgagactattacatttctcccagtaccaccattactcccctttctttgaccagcactaacttgaaacccaagaaggacaggagaaaggaaggtatgaacactctgcccaaagaagccatcagagtgcactgtcaatcccgtctcaggtcaaaggagggagaacttgaagcccagaaggctgactttgtgtcctgtattgttgggagaacaggttccccattccctaagggtcatattcttagagatttgggctgacacctgcttgagtttaagttgagagtaaacgcactcaaccccaaggctcttgtgagttttcaattatgggggaggagaaagtgattgaaggtgacctctacctttcaatgatcatgcagagtactagtatcaatatttttggggtatgttggcatccttagaaaaatttatggtttcacctttttccctctgtggtgtaaagtgaggtccagagatggaaagggcaaggcaaataaacaagtaattgcagtcaaatctgatgaataatttcctggaacatatgggatcctgtagcaaggcagaagggatactcctagactaggttaggtgagggaggtagggtttcctggagagaacaatatccaagccaatcccccaaaatatgggtgggaggtgcccaggagaagagtgaggtgtcagggaagatggtgcactaggtagagctggatacacacgtggggacaccggaaattgtgtagccaggatgtggaatgcaacgggaaccagggaaggatgcaatggtgaccaggaaagacctccaggttagcagaggtggagtctgcacttcatagaaccttcatgggaaggagcctgcccctgttgatatgtaggtgaagaatggacctgagggggctcactaagacccagggagacaccctttcagaccagttcagtactccctggaaatgatgacaggctgaattaaagcctgggcaaaggaggcaaagagaagcagtcagcttggatgaccacttggtaatgacaattgattgtacttgattgatttgtaagagatgagagagaggaaaaggtatgtatcagtcagctatgctgtgtcacaaaaaaccccaaaacttagtagctggaaataacaaccatttattatgttcgtgattatgtgagtcagcaatttgggctgacaccattctagtggtcctcctggtctcttctgaactccctctcttgtgtgcagtcaactgtaggtgtggccagcgctttgaccatgtttcctgggtcttcttatgtatctgggactttaggtggaatggctcatctcagcttcatgtgggctctcacatccctccaggaagccaggccaggcttcatcacatggtgaccagacagggtaccaagagcatgaagagaagcgtgcctgggcttagagccaccatgccttcacttgtgtgacattctgttggctaaagcctggattttcagaatgaagatgcagctccacctctggatggggaacactgtgaaatcatactgtggagcgtgttcatgtagggaggggaagaatagagggctgtctctcccaggaggcagggtgtggcgggcggcagcatcagccgtagagcaggttcttgcgttcagtgacaacactcttccccccagcatggcagcctcattcgtggagcagtcttgtgtccctcacctatgccatgccatgtattggcccaggtgttcaaccctgtctgaagaaagccatgcatggaaagggtggctatttcaaatggaaacggtgatttcttccttttttccctttggaagtgttgatttttgtcacatcaagctccttcttgttctttgtgcaggagtgccaaagctctggagcaatttgccatcgaggcattgaggatgcttgtgtctagtgtgtgcttgggtctagagttccagcatgcctttgaaagcaagcctatctggcagtttttagtggaacaatatttttgcatgagtgggcattctacatctaaaaaggcacaaaatagttttgacatgtgcctgtcatcccaactactcaggaggcggaggcaggaggatcacttgagcccaggagttcaggacgagcttaggcggcatagtgagaccccatctctaaaaaaataaatcaggccaggcgcggtggctcccctctgtaatcccaacactttgggaggctgaggcgagtggatcacctgaggtcaagagttcgagaccagcctggccaacatggtgaaaccccatctctactaaaaatgcaaaaattagttgggcatggtggcatacacctgtagtcccagctattcgggaggctgaggcaggagaatcgcttgaacccgggagaaggaggttgcagtgaactgagatcacgccactgtattccagactgggcgacagagcaacattccgtctcaaaaaataataagaaataaataaataaataaataaataaaattaattaaaaggcatacatgaattgacttcaacaaacaaacaaaaatgccaagtgcctcgtctgtgcaaatcctggccttggatgtcttcagtggtaaaatgtggttgacaagcttggctctttgtgaaaacagaattacttcctaaggtttttttttctttttttttaaattaagtttctcttttttttctgtgaatacaagggtgggaagggacgtgatggagaagttactagatagatgcaaaagttattgcagtttttgtcattactttcaatggcaaaaaccgcaataacttttggaccaacctaatatttaagcagttttcctgcagccatgtttttttctcggatgagcttgctttttctccactcctgcaggcaatatggtagcaaaaatcgtgtctcccatcgtatccgtggtggtggtgacactgctgggagcagcagccagttatttcaaactaaacaataggagaaattgtttcaggacccatggtaagtttggctctaaacattgttttgcttgttactaagcctgatttaaaaaaaaaaattactttcagatgtctgtcactagcaaggttatttctggttaagttcaatatacataacttgcctaataatgtgattttttaaaatttatttttattctttttgagacagagttacactgtgttgcccaggctggactgcagtggcaggacctcggctcactgcaacctctacctcctgggttcaagagattctcttgcctcagcctcccgaacagctgggactacaggcatgcaccaccacgcctggctaatttttgtatttttagtagagatggggtttcaccatgttggccaggctggtcttgaactcctgacctcaagtgagctgcccgccttggcctcccaaagttctgagattacaggcgtgagccaccgtgcctggccaacaattgggttttcatggtcaggtgtgagctgtaccttcctctaaaccttgttacaatgaggctggcacattatctgtctaatgtaaaagaggaggagaaaaaaaggaaagaaaaagaaacaaacaaacaaaaattaccaacctacattgcaagactataagcatgacggttggtttaactacctgttctgttttgtattcagtgaaattttcgtcacaggcgagtcaggaaaaatacctgggttgaatgtgaatgttttgcccagaaccccacccgcaaagaaaactaccgaaacactgaattataagcctctctgaaattccgaaggtgcgctcagaccataggggagaggaaagatctgctgtggcttcctggttcaatgccggctccacactcctgggtttgaagaatcacttgggatttgagagcagaggatgccctaaagaaatctctgaaacaacagtcagggattgttttatagcctaaagagtgactcagatctttaactgggtgtctctggaggcttggtttaaacctcaggccacccacgtcagaatctgtctggagtttgcccagggccctctaactcataccttctttgtgtccccgaaggaaaccagaaaggggtgcccattcctacggtgtttgctttaggatttgcatttggcctcaaaaatcctaaaaccttcccatgcgctccctctgctggtgaatgggcagtatcaaccgttagctaatgaacctccgtttggggtgagcctccgtctacattacgccccgtcctgaaattttaggaggaaactgagtttctgaaaaactgccttattttcctggcaacctgagagcagattcttgggttcagtgacaacactctttcacccaacatggcagccatcattaacgaacaccacgtgttaacttcagtagcttttgtggcagtgatttgtaagcctttgttaaccaagggctgaaactgagtaagcagagagaggcacccatctccacaagcacaaaatgtaagggcggggtacaggggtcccccacaaactcaataatcaaggcaaatatattttagtgcaatattttagaaggaaaatcattggaatgggggccagttgagtttctgaaataggtgtagttttaaaaacgtggatgatgcctgccccatttatctgaggtggaaggaagcacgtttttgctaaagaggtataatgtcttgaagctctttcatgccttttggctgcctggtaagtatttttgtctactttctccattgtacttcgatgataccctcaccaggtattcccaagcaccaagtttatcttcccctcccttaaagttcctgagatcagaaaggaggatgtagacagagtgagctgatgttagggagatctcttcaagggtgagcagtgacatttatgtggatcctgggcctatatcacctcgctggctgtaaagcctttatactatctaggaaatatgtgcatgacagcaaatacgtatgggtttggtatcaaatggggctcagagctctgcgaacttgactctaaagttccaggctgctgctaatggtacccagctgtccacctctccttagttaggtcattaattttctctgtctcctaaaggatgacgtacatggtatactaaccatatccatggtgatgtggtgcagtgcacaacctgtggaactgtgtacctgctgaggccatacactgaagcttgcacactttgtagagaaagagttgtagtaacagagctacacagatagaagcagatgtctgtcacttgatgtggacttttaagaatcatactttgcttttattttataaagtggagcaaatgacaacatcacttcagaagttataaagaccaacaaggccatattcgaaaaaagaagttcctacaaatattagttttaaccaaaaaggaagttactcaattcatttaagatcatcaaaatccttaacaaatggcaaaatgtcaaaaacaatgttttcaaaacgaatatttgtttccagatatgattttaacagtttttaaatattttctatttttaatttttcctgctttattgaggtatagttgacaaataaacattgtatatatttaagatgtacaacttcatttctgcatcatttatttgttctaatctatctccttctgccgaatgtaaagcaggtgtcatgtagacagcacatagtctgatcttggttttcttttttttaaaatagatttttcattcttctagctttattaaagtatgatagacaaacattgtatatatttaagatgtgcaacttcatttctgcttcatttttttctgttctaatcttccttctcctaaatctagagcaagagtctcttgtaacagcatagaattggatcttggttttctttttctctgtttaataagacttttttttttgcccccacaatgacatttgtttctaatcttcctttcagaaccagaaaatgtctgaagatgttaagatcccctgattactttgagaaaaacaactaaaacaagaaccgtgtttatcactgttgtggagatttccttttattcttgacacaatttgatgacctaaagtgtgttttcttctgtgtaaagtacatgagctgcctcactaagcattcccaactcattgaatgtgatgtggttataaagataagttaggcagctagaccctgcgttctaaaaaaggattgcttgcaatgttggtttggctattcatttgcacaaagagactgtggctctctgttgtgagatcttcagctacctcatggtgcaataacacacacacgcttaaccatgttgatggcacaaagcggtgagcagtagggaggtagaatatcttggtggggaggggatgttatcagcttctgggagatgaagaatattgttgaggttccaaagatgctggacctgtgctaaattcttcagtgatatgaaaaaatcattgagcattcattattgcgaatgaagtggggatgcattatttctgacacccacaagcagggtttgatcatcctttcagctttgagatatctgcacataaaattattattacctgaagaaaataaggctgcattttgaaatgttaagtgcaaaatgactgatgttaaaaccatctgggggaaatcttgggatgctttttcctaggaaatcatatggttgtgatatgttttggcgcataggagacagaaatagtgattatcaggcgttgagcctttttgtagtatttttagtctttgatactctgtaagtgctagttcctaaggcaccaacattgcattccttggtttatactttttctattcatcagggtaggaagtcttaaatccttaggcatccaagaagtatactagctttttgcttctcttttagaaatacttgtggggagagaaaaaaggatggtttgggcatattggtatagtttgagtaaactaaggttaatgttcatataacatttagactttgccataaatatcagaaccaaagatcaagacattcatgtacagtctggaatgtatatatggggcccataaaaattcccagtatgcatgttttatgctcaccattatgaattggggtcttcaaagagagaaggttgaaagtggaaagcacttgaaagggctccccggtttgtaaaatatctttaatcattcacattaggtacctcggagttgcgggtctcaaatgtggattcatgcatcatttgtgcagtttgaagatagtccatatttcctatttcagtattaggtcctgcaacacttttcaattcttgtagaaggtttttttcaggagtggtgatgtctgatgctcaattactattttccctataagagtttcagcatgagcttaattaaattcttgtgaaaaaacctgtgtttttagttacacacacacacacacacacacctacttaaatggaatctaaacatttttagcctttaatccattccattttctaaaactgtcataaactatttttaatcattttaaataaatgtaaaagaaaaataactggatttgattattgaatagtttttttctatatttcacaaataaattgtatgaaatgactgtagaagtggccccaaaattatgaaccttcgtagctgtgaatatgatgccataaatctcttttaaagctcaagatagactatgaacatatgaaatacatagttacctaatcatgagactaaattcacctgggtgacaaggctaacgttcaagctacttaagatgaaaatatttgaatcatgattgcttgggggaacctctctttgaggggtcatgaggaccacctgctgggcattctgttttcatgctgagaaggtgagaattgaacagatgagaaaagccttgataaaacgtcatctccatgtaatttagagaaggataaccttgactgtacagctgacccttgaacaacacagggctgaactgcacatgtccacctgtatgtgagtttgcttctggctctgccattactgagacagcaggaccaaccctccatctactcaatgggaagatgataaggatgaagacctttatggtgatccgcttccacttaataaatagtaaattcattaa

SEQ ID NO: 840 - DNA, 64450 bp, Homo sapiens; identical to SEQ ID NO: 839

SEQ ID NO: 841 - DNA, 64450 bp, Homo sapiens; identical to SEQ ID NO: 839

SEQ ID NO: 842 - DNA, 52453 bp, Homo sapiens
tgaatgtaaagagatccagggctcttggagagggacaagtgagagccagccaaaaaggaaaaagcaaaggcagaaacggcatcaggagagacagagatgtgaaggagggaaggagcaggagagcaggaaggaaacgcaggaggagggagcagcatctcctgtgaacacagaggagcacctgtttgctgttaaaatcgatctccctcggcaccctgagcaatggatataatatttggcaggaataggaaagaacagctggagcctgtgagggccaaagtgacaggtgagcattctgataaacactgggctctttcttctatttattttattattttttttttttttgaggcggagtctcgctctgtcgcccgggctggagtccagtggcttgatctcggcccactgcaacctctgcctcctgggttcaaacgatcctcccaccacagcctcccgagtagctgagattacaggcacccaccaccaagcccggctaatctgtgtgtttttagtagagacggggtttcagcatgttggccaggctggtctcgaactcctagcctcaagtgatccacccacctcggcctccgaaagtgctaggattacaggggtgagccactgcacctggcttcttccttgtgtttagatggacactattttttcctgatgatataagtaatactaattgtaaattacttttggaaagtctggaaaacagtacagagaggggacacattttctgtgaaaatctaggtattcttttacacattataactccgtttgcaaagggaggagagtcagtctcactgttcccaggaaaaaagcattggaatgccccagtgggtacatagacaatgggattaatctgcaaactgctgcctgtctcagatgcatgatgtatttgtgcaaatgtatgcattctaaattagtttcaaaatgcttagaggggcgtgcatgagctcccacgcatgcacatccaccacgcacacttgcaggggattgcagagtctgatgtgattttctctcaggaactcacaggtgtgagctcctgcagagcctataggagtaggaccttctatcctttagaggctctgtgtttcgcttaatcttttatatctctttttcctcctcttttgagttgccactttcctggtaccatttcgactctaaagggcagttcctggttctggactcccgggtccccagagtggtgctcgctcagttttaagaacagctgagtcagctcaggcctgcaggcattttcatctgctagatggactggaattgttcataaggagaggacaactgtgagtgattttcgtgagaacatcagattgaagcttttcaactgagcaattgccttgggagtcttttgaaacaaaaaaaaaatagcttttatgtatatattttcctggttacaaaggtaaggcacaatctatagctatcaatctgtatatatatatagctgtatgtatattaaattatatataaattaattaggagtgcaaatgagaacatggaaggaaataaaatcagctgtattttgaaatctcttaaccactattaatatttgggtctatttcctttaactttttaaaacataggtagatcaattgatagattactatatttgtaaacagtttttcaaaaagcaaatgtatactattacatttttattttttttctcaatttgactgttcatctgtacatattttattttttaaaaagacaccccacggccaggtgcggtggctcacgcctgtggtcccagcactttcggaggccaaagagggtggatcacttgaagccaggagtttgagaccagcctggctaacatggcgaaatccctctctactaaaaatacacaaattagccaggggtggtggcatgcacctgtagtcccagctactcaggaggatgaggtagtagaattgcttgaaccccggaggcagaggttgcagtgagctgagatcgtgccactgcactctggccttggcaagagtgagaccctgtctcaaaaataaataaataaaaaaaaaccaggcaccccagcctggccaacctggtatggtgaaacactgtctttattatttggttggtgcaaaaataatcgcggtttttgccattactttcaatgcatttaattttaatttttttttttttttgagaaggagtttcactcttgttgcccaggctggagtgtaatggcgcgatctcggctcaccacaacctctgcctcctgggttcaagcgattcttctgcctcagcctcccaaatagctggaatgacaggcatgcaccaccacacccggctaattttgtatttttagctgaaacagggtatctccatgttggtcaggctggtcgcaaactcccaacctcagttgatccgcccgtgttggcctcccagagtgctgggattataggcgtgaaccaccatgcccggcctgaaattttattttaaataaaaatacaaaaattagccaggcatggtggtgcatatctataagcccagctcctcaggagactgggcatgagaatcacttgaacccaggaggcagaggttgtagtgagccaagatcgcaccactgtactccagcctgggcaacagagtgagactctgtctccaaaagaaaacaaaaaggcacctatgatacctaccttttcgtgccctggaatattttgtaccctttacacctcatgtttaatgactgcatgaaatccttggaaatgttagaaaacatgaattctagaacacgagaggctgagtgagccccaaagatcagcagcggttctcaaaggggtggccccggacctgcagcataagcatcacctgggtgctgggtagaaataaacatccttgggccctacccagacccacggggtcagacacttggggggtggagctcagcaagctgtgtgttcacaagccctcaggcgattccaaaggtaagaaccattcctctacatcaagcctccctattgacagatgggaaactgaggcagaggggcagtgacttgccaaggccaggcagcctgcagagaacaggcctcctgactctccgtccaggcctgggttgagcctaatcagttggtgacatccatgggcaaacagctaactaaaaactgtgcctgggttgacacgtccatgcagggagcacatgcaaaggttttggctttgtaactggctgtgccgacacacgtgtgttctgagacctctttggcaacttaagcatttcctgcctcagtgttcttttctgtttgatgaatgtagcctggcacctcccacatagggttgctgcaacgattaagtggtttaatccacctagaacacagtggctggtgtatgaatgcatgtaagtgttcttgtcctatctagggctttaattatattctcagatgcctctctccctgctctttctcaagcctgccccctctcctgtgccctgggtgcctgtgcctggcgccacgattatgtaggtgcccaaggcaagagacttggctgtctttttttttttttttttttttttttgaggcggagtttcactctgtcgcccaggcaagagtgcaatggcgcaatcttcggctcactgcaatctcctcctcctaggttcaatcgattctcctgcctcagcctccccagtagctgggattacaggcacccaccaccacacccagctaatttttgtattttcagtagtgacggggtttcaccatattggccaggctagtctcaaacttctgacctcgagtgatccatccgccttggcctcccctagtgctaggataacaggcctgagccaccgcgctggcctcggctgtcatttttcagtgctccactgcacatccccctgtatttagtcaaatagaggcccatcagttctgtgtgttccatctatctttgttcatccatttctctccatccctgtggaatccccgggtcctctctctggtcttcctgcctctctcagggaatttcccagtccacaatccacaccatgggtggagacaaccttcgaagctccaagttcctattccatttataacaggggtccccgaccctcgagccgtggaccagtaccagtctgtagcctgttaggaaccgggccgcacagcattacggcccgagttctgcctcctctcagatcggtggcattagattctcatatgagtgcaaaccctactgtgagcgtgaaccctgtcgtgaactgcacataggagggatctaggttgtgcgctccttataagaatcgacccctcaaccccaccatccatggaaaaattatcttccacaaaaccagtccctggtgccaaaaagtttggggaccactgatctatatggaatccagaacaggcaaatccataggaaagaagatgggtgcctgccaggggctggggtaaggggagaagggggagtgacagctaatgcataagggagatggctttttggagtgatgaaatgttctggaattaggtgatggttgcgcaacattgtgaatacactagaaccccctgaactgtacattttaaaatgatgagttttatctcaaatttttttaaattgcagaaaatatctggtcctgtccttccctattataaccatcaaaggtgccccattcttctgaggattagatcaggacccttagtgtgatcctgttgacctttgtcccctggcccccgttatttctgcagtttcattgcttacagttttcttgcttgaaaatgacggtccagtcttactaaacagcttgcccgtctcctggtcttgatcattcattcattcattcattcattcatttatgagacggagtcttgctctgtcacccaggctggagtgcagtggcgtgatctcagctcactgcaacctcccccttccgggtttaagcaattctcctgtctcagcctccagagtggttgggattacaggcacccgtcatcacacctggctaatttttgtatttttggtggaggcggggtttcaccatgttggccaggcttgtctccagctcctgacctcaagcgatctgcctgcctcacctcccaaagtgctgggattcaggtatgcctcggcatgcccagcctcctggttttggtcttcttgttttgggttcctccagaggcaagaattcaaggctaagtggtttatttggcacgtgatcccaagaaacatcaggaggaactcagggaaacagagagaaggaaaccaataaatggggcattgtcgagccattggctgctgaggccattggagctaaatcctctgggtatgacgtaaaacatgcctctcgtgatcccaactgagggcaaggcaacggcgggatttgtcccccaattctgcatccatcactgggtgagagcagcttccaggggcattacctatccgaggtgcttcctgctcttcctgcatgtaggcaaagcctgccccacccgcagtcagaaccaagcactcaggcagggagctgcaggcatttgcagaaagcagcctgtaggaagggacgaacgctgagaggacttgggtggaggcaccaacagcattttctgcagcaccctgcctctagagcagggctgtcccctagaaagagaacctatgccacacgtgcacttttaaattttctggtagaaacattgaaaaaagtcaaaagaagcaggtgaaattatttcagtggtatattttaacacaacaaatccaagatattatcagttcaacatgaaatcaatatttaaaaaattgctaatgagatggttcacttttgttcatactaagtctttgaaatctggtgtatatttcattcttatagcacatgtcatttcagaccaaccacatttcaagtgctgatagctaccatattggacagtacagctctagaatgttctttccttttgcctttgtgaggcgaatacctactctccctcaagacttagccaggttgcctcctctaggaagctgaccacaccctcctgctctcagcccacccgagggctgttctgtttcacaaagaacctttttctacgtctgtagcgttgcccctatctttttttttttttttttttaattttttgagacaaggtcttgctctgttgcccaggctggagtggagtggtgtgatcactgcagcctggagctcccaggctcaagcgatcctcccacctcaacctcccaagcagctgggactacaggcatatgccaccacaatgagctatgtttttttggggggtttttttgacacagagtttcgctcttgttgcccagactttagtgcagtggtacaatctcggctcgctgcaacctctgcctcctgggttcaagtgattctcctgcctcagcctcccgagtagctgggattacaggcgctcactatgacgcccagctaatgttttgtatttttagtagaggtgggatttcatcatgttggccaggctggtcttgaactcctgacctcaggtgatccacccacctaggcttcccaaagtgctgggattacaggcgtgagccaacacacaaccagcattgccttgaccacagtggatcttgggtgtctgtttattcatctgtctcttaatggtcagtaggcagtttgaggacagggacagtgtctccatcttggtatcctcagtgctagccaactgcccaacacattatacactttctggaaatgactgtagaataaacgaacagatgcaaggagtggtactgggaccacaactctcaaattcctttccatgaccatttcttccagcattttggtttgcaggtggaaacgggaaactaaacattctctcttttctcaggcaagattccagcatggctgcagggaaccctgctccgcaatgggcctgggatgcacacagttggggagtccagatacaaccattggttcgacggccttgccctgctccacagcttcaccatcagagacggtgagaacacccacgagtgtgctgccactgctgcagcaaaggaccccaaatgcagtgccttaaaacagcacaaatttattcttttagggattggaggtcagaagtctaaatcgggtctcactgaactgaaatcaaggtgttcatagggccacattcagttctggaggctctaggaaaaatatccacgttcttccgttttctatcttctagaagccgctttccttgacttgtggctccatctctgtcttttttttttttttttttttttttttctctgagacggagttttgctcttgttgcccaagctggagtgcaatggtgcaatcttgactcacggcaacctgcatctcccaggttccagtgattctcctgcctcagcctcctgagtagctgggattacaggcatgtgacaccatgcccagctaatttttgtacttttggtctcaaactcctgacctcagatgatccgcccacctcgtgctcccaaagtgctgggattacaggcatgagccactgcgcccggcctccatctctatctttaaagcagcagcagagcatcttgtcttgcaatctctctctctctccttccatcctcacacctcctcctctgactgactttcctgcctccctcttataaggacccttgtgattacattgaatccactcagataatccctagataatctcccatctcaaaatccttattcacatctacaaagtccattttgatatgtcaggtcacacattcaacaggttctagggatttggatgtggagatatttgtcaggggtgcattattcagccaaccgcaagcacagactttcctaaaaaggaggccaaggttctttttcaaatagttaatcttgcaaaataatatacatcctcaatcaggtaggcaagagcaggtggaagagtacaggaatcagacatgcctaaagttgaaacaggaaatggacagagctggtagctgggcgcagtggctcatgcctgtaattccatcactttgggaggccaaggcaggcagatcattcagggtcgggagtttgagaccaacctggccaacatagcgaaaccccatctccaccaaaaatacaaaaattagctggtcatagtggcacacacctgtaatcccagctactagggaggctgaggcacgagaattgcttgaacccaggaagcagaggttgcagtgagctgaaattgtgccactgcactccagcctgggagacagagccagactttgtctcaaaaaaaaaaaaaaaaaagaagagtacagagctggaaagagcaaagctgcatatattgcccattaagcaagacagagccagaccacttacacaataagccgagggatctccctgagtggaaagggaaatggataaatatagggcatcacaaataaggcgaattctgagttcaggtgtctggctcatgaggtgggatgtaaattctttgctgttggccattgagccagtttatgctacaaaatcaagagccgagttcttaaagaggtccaggatggatttagcgggcttcgggtcacacagtggacagatttgtgtccaaatgctccaggctttccaaaatttttctttaattcctgtgttctaatgtggtcaaactgggattacgttaagtctctcagcctcagtttcctcatcagtaaaatgagcttgttcatcctcccctggagagctgttgggatcattggaagtattggacgttctagcaagggcctgacacctggtagatgcttaagagattaaaaatcaccattgaccaggcacagtggctcatgcctgtaatcccaacaccttgagaggcggaggcaggagtgttgcttgatcccaggagttccagaccaatctgtgcaacatagtgagaccccatttctattttattttattttattttttatttttatttttatttatgtttttgagacagagtttcgctcttgttgcccaggctggtgtgcaatggtgcaatctcagctcaccacagcctccacttcctgggttcaagtaattctcctgcctcagcctcccgagtagctgggattacagggatgcgccaccatactcagctaattttgtatttttagtacagatggggtttctccatgttggtcaggctgttctcgaacttccaacctcaggtgatctgcccacctcggcctcccaaagtgctggggttacaggcatgagccaccacgcccggcccatcccatttctattttaatttattttaaaaaaataattaaacataaaaataaaaccactatctgtggctttgaatcccagctccaccatcctagctaacatgcacctaaactgtgtaactttggccaaggtactgaccctgtctgtctcagtctcttctgtaaaatggacatatcaatagcgtatctcatggagctgctattagatctaaacgaatgtgtaaacagctctgtattatgtctcgtgcacaacacctgctcaataagcatttgttcttaatttcatataactactggccagtcgcgatggctcacacctgtattcccagcactttgggaggccgaggcgggtggatcacctgagatcaggagttcgagaccagcctggccaacatggtgaaaccccgtctctactaaaaatacaaaaaattagctgagcgttgtggtgagcacctgtaatcccagctacttgggaggctgagacaggagaatcgcttgaactcgggaggcagcggttgcagtgagctgagattgcaccattgcactccagcctgggcaacaagagcgaggctccctctcacaaaaaaaaaaaaaaaaaaaaattatataactattaatttcttttgagctagtcagcaattattttttgaatgtgtactctatgccagtgccttgctctaacatttacacatgaatagagacacgatgggtgaaaagcgcgagctctgagtctgcaataccttgcagattttactgtgactcagctacagaatgggtggttccatattttgctgacagcactaaatcttaatgattcctttcttttctaaacagaagttcccaatgattcttggaaataaatactgttctggatgaggaacatagaaggtaaatgcaccagtggtggccgggcgcggtggctcacgcctgtaatcccagcactttggggagccaaggtgggcagatcacctgaagtcgggagttcaagaccagcctggccaacatgggaaaatcctatctctactaaaaatacaaaaattagccggatgtggtggcaggcaactgtaatcccagctacttgggaggctgagataggataattgcttgaactcaagaggcagaggctgtggtgagttgagatcatgccactgcactccagcctgggtgacacagtgagactccgtctcaagaaaaaaagcaccagtggttttccttccatgaggccttgcttccccaggctgccagctcctccatggtctctttctttcttttttttttttttttgagatggagtctcactccgttacccaggttggagtgtggtggcgcaatctcggctcactgcaaccttcgccttccaggttcaagtgattctcatgtctcagcctccggcgtagctaggattacaggcacatgccaccacatctggctagtttttttttctttttttgagacagagtctggctctgtcacccaggctggagtgcagtggcacgatctcggctcattgcaaactccacctcccgggttcacgccattctcctgtgtcagcctcccgagtagctgggactacaggctcccaccaccacgcctggctaattttttgtatttttagtagagacggggtttcaccgtgttagccaggatggtcttgatctcctgacctcgtgatctgaccgcctcggcctcccaaaatgctgggattacaggtgtgagccactgtgcccggccccggctaggtttttttgtatttttagtagagatgggggtttcatcatgttggccaggccggtctcgaactcctgacctcaggtgattcaccagcatgggcctcccaaagtgctgggattacaggcgtgagccaccgcgcccggccgagtcagttttattcacaatctggcattggctgggaaaataggaaacccaggaattacacccaatgatttgttttccctccatctttctcttagacctaggccagcgtctgagggttcatgccccattctgcttggcaggcatcattttgccaatctgtggcatagggtgggaaggcccagagtgcggggagcctgcctgaattgtggtgtcttcatcatctagcatggggcctggcccagaggggcgcttggaaactgtatatggagctgagatggtacagtgaggcagtcattgttttggtagacagaggcaatactttcccagtcaaactcttcaatatttactacaaagagggtttgctgggccctgccccaagtgtttcatgtccatccacaactcagccctccccgtcactcctgaggaggatagcctggggactaccacagttttagagataaggaatgaagtcccagagaggccaagtcacttacccagaagcacacagctaagagttggtaaagctcagacatagacgcaatactctctaacttcagaatcccaagtcctaaccattgtgcaattcagccctgtttccccttcccaccagctcctgcctccccatctctccatcccaatcctctcagtgctgccagcttgccaatgctggtgtggcatagcctggcttcatctctcctctcctctaggactctccgtggcaccccattgtctaatggtgggaagatacaccagaaatgttcagttccactctagcgggttcagaagagaacacgtggggaagttggggtccctgataagctgaaaacaaagccaataactctcaaaaagtggtttgtgtgcctcctttctcaataaagcttttttttttttttttttttgagatggagtctcactgtgttgcccaggctggagtacagtggcacgatctcagctcactgcaggctctgcctcccaggttcaagcgattctcgtgcctcggcctctggagtagctaggattacaggcatgagccaccatgcccagctaatttttgtatttttagtagagatagggtctcgccatgttggccaggttggtctcgacctcctgacctcaggtgatccacttgcctgggccttccaaagtgctgggatgacaagtgtgagccaccgcgtctggccattcagtaaagctttgaatcctgaaagctgcacagggcttgagtgcatcatagtcctcaaagatagcgtttgtgtttctaacacacttcccaggtgaccccgagccctctgaggtttgacaatccctccacaatgggcctctagcctggctgcccaggcctaaccaaaaccatgttattaatactaataatcagaagaaccatgggctagtgaatagccttctgtacctttttaaagcacccaggtgattccagtgtagatgcaggttaggtgcttaagaccaaacatctaacttagagaaaagactttggagcaagaaacaaaaaggcagaaaatagcttgtggccttcagcagaggccagtagaaattaatgctctaaaaaaaaaacaaagagggaccagaggttgtggttcatgcctataatcccagcacttttagaggctgaggtgggaggatcccttgagcccaggagttcaagacaagcctgggtaacatagtgagacctggtacctaccagaaaatcaaaaagttatccaggcgtggtggtatgcacctatagtcccagcatcttaggagactgaggcaggaggatcacttgagccttggaggcagaggctgcagtgagccgagatcacacctctgcactccatcctgggtgacagagtgagacttcatctaaaaaaaattaaaaaagaaaaacatgtaaaaaataacaaagatatgaacaaaaaaagcagagtacagagggagaagctgggtgaagggtacaagaacactcctttctgtacatctaaaattatttcaaagcaaaaagtttttacaaagcacgcatagaaatgagtgattccaagtctccctcattaatgatatctgttaattttccgataaaattaacaggcaaagtcattgtcccaccaggatttgaacattggaaagtttcttttatatatacccacacacacacacacacgcacacacacacacacacatatatgtgtgtgtgtgtgtgtatatatatctatatcttcccttcttccccaaaatatcaaacttgacctagttctagaagatcccaggcaggagcacgtctgttggcgtatgtcccttcagaaggaatgtggctaattgggctctcctgaaagcagactgctggggaatgcatggaggctccttctgtaatctcaacctcaaagtccagggtcagccttgagtaattccagacacctactttcctgtggtcaccaggcactccatgctctggggctggatgtttataggaaatgggcagcctgttcactacccagcctgggtgtttatatttctttctttctttttttttcttttcttgtgtgtgtgggtgtgtgtttttgttttgttttgttttgttttgttttttgagatggagacttgctctgtcacccaggctggattgcggtggcatgatctcagctcactgcaacctctacctcccaggctcaattctcctgcctcagcctcccgagtggctgggattacagacacccggcaccatgcccagctaatttttatattttcagtagagacggggtttcaccatgttggtcaggctggtcttgaactcctgacctcaggtgatccacctgcctcggcctcccaaagtgctgggattataggcgtgagccacagcacccagccaatatttcaagtgaacataattcaacatttcaggtcaagcaccttagccaatgccttgtgggtggtgactcccagcaacagtaaccagtgaaagacaggctggctcaaaggggagatcagggtggccttaagtgggcctctgtctccatgtagcatgtagctgaggaccagtgagtatgtgtggccttgctcacccacagatgagtccgcctgccacccggattttcttggacaatgcagtttcaacagcctttgtttacgaagtgcatgctgggagtcaatgcgcaggaccccttacattaccacatctcatttaaaactgcccacctcaccacttgaggtcaggagttcaagaccatcctggccaacatggtgaaaccccctctctagtaaaaatacaaatattagccaggcatggtggcaggcacctgtcatgccacctactcaggatgctgaggcaggagaactgcttgaacccaggaggtggaagttgcagtgagccgagatcgcactactgcactccagcctgggtgacggagcaagatgttgtctcaaatataaaaaataaagataataaaactgcccacctagaaggggaggactatgtgattcccagcttccagtcaaggagactgaggctcgatgagattaagagacctgcccaaggtcacccaacctggatgagatgaaacctagagccgaagccttgatcactctgtctactgcatctcaatactctacgcagcttttcttgagcacctactatgtgcacagtgctttgcaagcctcaaatgtcacgtgactctgcaaggactgtgtcacgatcctcatgtcatagtggaggggacagattcttgactgttaccaaggtcaagtgcatggttggtacatgatgaagccaggattcatatccatgtggagattgagcctccttagcaacaggaatcctggccattctgctcattgttatattttcactcctggcccatcagggcagttaataaataatggttgaaagcatgaactcagggcctggtcagccccaaagctcaggctcctaaccgttcctccatatttctttctgctgcccaggaataaatctccccctacagaaatatctcagtgaggctgggcaccgtgcctcacacttgtaatcccagcacttcaggatgccaaggcgggaggatcgcttgagtccaggagttcaagaccagcctaggcaatatagcaagatcccatctctacaaaaaataaaaaattagccaggcatggtagcacgcacctatagtcccagttacttgggaaactgaggtgggaggatcactcgagcctgggagattgaggctgcagtgagctgtaattgcgccactgcccttagcctggtgacagcaagaccctgtctcacaaagaaaggagaaagaaatatctcagtgacacttattcacacagtaaccacccctgaaaagatgtttgcataaaggctagatgattgtctcttaggaacacaaataacctcctgaagactggaggaggaactagcaggtctttcatgatctccctcaattttattttattgtatatttttttctttgagatagagtctccctctgtcacccaggcaggagttcaatggcacagtctcagctcactgcaacctctgcctcctgggttcaagcaattctcctgcctcagcctcctgagtagctgggactatgggtgcgtgccaccacgcccggctaatttttttttttttttttttttttttttgtatttttagtagagacagggtttcaccatgttgaccaggctggtctcgaactcctgacctcagacgatccgcccatcttggcctcccaaagtgctgggattacaggcataagccaccacaccaagcatttttttttttttaatagataagggcttcctacattgcccaggctgatctcgaacacctagcctcacctttttatgtgccaggacaacaagcctgagccaccacgcctcccctcaattttcttataattagtgttactattattgtcattatgtccatccaagtgcacaggtgggagtcattgccactggaatgtacattcaaatcctttggcaatggacatggaaacacaaccccaagggcaaaacaagttgaaactcttcaaagtcaagatagcggttaccctggagggggaagaggttagtgacaaggtggatatatgaggctagcgttcagggggctgctctggtcctgtttctctttttgaggcagggtcttgctctgttgcccaggctgaagtgcagtagtgcgatcttggctcactgtagccttgacctcccaggctcaagtgatcctcccgcctcagcctcctgaacagctgggactaccatacccatctgatttttgtattatttgtagagatggggtctcgccatgctgcccaagtagtcttgaactcctgggctcaagcgatcctcccctctgggcctctcaaactgctgggattacaggcatgagccattgcacctggccccaggtcctgtttcttgatcaggatgtagtttgcgtgggtagctcccctttgtgaaacctcagcaggctggatgtcatcaagctgcacatctctgtaggagtgattttaattggaaggtgcagacagaacactcaaactgattgttcttgctgtgttaggatcttggttaagagggccagctttagatgcccattgctggccttcgactccagattaccactcgctagctgtgtggcttaacacaagctgcttaacctctctgtgcctcaattttattagctgggaaataagtctgcagggctgtgagtacccaagccctttgtacttcatttggtaaaaaagttggaacctttaagcactgtttagatcttgctttattttgctattaattaacaaatgacattatgttatttttttttattttttatttttttgagatggagtctcgctctgttgcccaggctggagtgcagtggcgtgatctcagctcactgcaacctctgcctcctgggttcgagcgattctcctgcctcagcctcccaagtagctggtagctgggactacaggtgcctcccaccacacccagctaatttttgtatttttagtagagacagggtttcaccgtataggccaggctggtctcaaactcctgaccttgtgatccgcctgcctcagcctcccaaagtgctgggattataggagtgagccaccatgcccagcctttctttctttctttttatttatttatttatttatctttgacattgagtctcgctctgttgcccaggctggacttcagtggcacgatttcggctcactgcaagctccgcctcccaggttcaagcaattgaacctcccgagtagctgggaccacaggtgcccagtaccccggctaattttttttgtatttttagtagagatggagtttccccatgttggccaggctggtcttgaactcctgacctcaaatgatccacctgcctctacctcccaaattgctaggattacaggcatgaggcactgcgcatggccgatttttttttttttccagcgaatgcatttctggttggagtattctacttgcttccagtgttgtgagtatgaaaccagataacacacatcaagtgcccagcacagtgtttagcatgctggtgctcaatcgatgctggctgttagtactagtttccttttcctaagatatcaaaaggcactgggcgagaatttcttggaaacatgttttctcctctaagcccatcctgtggcagtcaacatatgatgggcgtttctgaggtcaactttttgcttattggaatgcaatgtcactgtgtcccaggcttggcttttccgtgtgttgtaattgtagcaacactggaagcacatactataccacgaaaatgaaatgcgttctgtaaaaggaaaaaatcttaatgtcatttgcgaattaacagcaaaataaaataaaacactgcctctttcaggcccctccccgaggtttcaaactgcccaggaaataaagttctcagggctggtgcggtggttcatgcctgtaatcccagcactttgggaggccgaggcaggcagttcacccgagcttaggagtttgagaccagcccggccaacagagtaaaacctcgtctctactaaaaatacaaaaattagtcggacatggtggcacatgcctgtagtcccagctatttgggaagctgaggcaggagaatcgttcgaacctgagacgtggaggttacagtgagccaagatcgtaccactggactccagcctgggcgacagagtgactccatctcaaaaaaagaaaaaaaaaaagttatcaggcctgcaaacctagtaggacccctcaacccatttcccaatttcatttcactcctgtcctccaaatccctctctaatgttccagcccagccgaactcaacgcctgcaagaagggttctgcattttcccaactccaggcctttgcttacagacctcttagcgggtgaacaggacagctctgccctctctccccagcatattgcagtcaaattctactcatcctttaagagctgtttcatgcaccacctcctccctgaagcttctcctgacttattcccagctgggaaggacctcctctcacccctgccccaggaggaatccatggatgtgggttttttgttgttgttgcgtttttttgtttatttgttttttgagacggggtctcgctctgtcgtccaggctatagggcagtggcgcgatctcggctcactgcagcctctgcctcttgggttcaggcaattctgtctcctcagcctcctgagtagctgggattacaagggtgtgccaccacacccagctaatttttgcatttttagtagagatggggtttcaccatgttggccaggctggtctcaaactcctgacctcaggtgatccacccactttggcctcccaaagtgctgggattacaggcgtgagccaccgcacctggcctagatgtgttattttacatagcaaaagaaacttcgcaggctaggcaaacgcctgtaatcccagcactttgggaggccgaggcaggtgggtctcctgtggtcaggagttcgagaccagtctgaccaacatggcaaaaccctgtctctactaaaaatattttaaaaattagctgggcatggtggcacatgcctgtaataccagctactcggggaggctgaggcaggagaatcttttgaaccagagaggctgagcttgcagtgagccaagattccaccattgcactccagcctgggtgacagagtgagactccatctcaaaaaaaaaaaaaaaaagagagagactttgtagatgtgattagatgaaggatcttgagatgggggaggtgatctgacattagggatgggcccagtgtaatctcaagagagaagcaggagcgtcagcctcagaggagatgtgataccgggacaggagacaggggtcacagtgacgcagccatgaccagggaaggcagcagcttctcaaagctagaaaaatcaaggaacagacctcccctggagcctccaaaaggaactagccctgtggacaccttgattttagctctgtaatccccatttcagactttcttccaaactctgagataatgactgtatgttgtgtgaagccactaagtgaggggtaagtcgttacagcagccgtagaaaactaacacgggtctagaaccatctggtatattttgaggttggtctcaatggactggtcaagagatttatgccatgagttagactctctgcagaatttggatgaattagacattgaacacaggtctgaccctctattgctatgcaggattgggcatcaggtcacctcctggttgtgttcaatatcaaacgttactccagggagactgaagtgatcaactgggcttctggaggcagcgctcccaggactgaacggggccctggggaaaaccaccccacatatgcagccttctagattagtcctccagctctgctccttccctggagggacacaaacagggtggaagggatgactgattctggtcagcactctcagatgggtgaccctgggcaaggtgaaagaatgtttctgagcctgagttccttcctatggaaaatggagctaagaacagacatattttgcattgacatattttgcattatcacattttgcattgctataaaggaatacccaagaccgggtaatttataaagaaaagaggtttatttggctcacggttctgcaggctgtacaggaagcaagccaccagcatctgtttggtttctggcgagggcctcaaaaagctttggctcatggcagaaggcaaagggggagcaggcatgtcacatggtgaaagagagagagagagaggagggagggatcttttaaacaaccagatgttgcatgaactaatagagtgagaactcactcatcaccagaacaacactaagccattcatgagggacccacccccatcacccagacacctcctcctaggcccacctgcaacatcacaggcttcaacatgagatttgcaaggaacaaaacattcaaaccgtaacacatacttatccagccatactgttgtgagtcaggagtgagaaaatgtgtgtctaaaattatattccaggccgggcatggtggctcacgcttgtaatttcagcactttgggaggctgaggcgggtggatcacctgaggtcaggagttcaagactagcctggccaacgtggtgaaaccccatctctactaaaaatacaaaaatttgctggtcgtggtggcgcatgcctataatcctagccactcaggaggctgagtcaggagaatcacttgaacccaggaggcggaggttgcagtgagccgagatcgcaccattatattccagcctgggcaacaagagcaaaactcaaaaaaataataataataaataaaattatatttaaaatgcgaattgtatcggccctgtgtactaaaggagcttgtcctagtgaaataaccaccttcttctcccagtaaaacccatacaaggactgacattgattttaaagccctgtgaaggcgtcagcctgagattatgctggttcttctcttgcaggtgaagtctattacaggagcaaatacctgagaagcgatacctacaacaccaatattgaggcaaacaggattgtggtgtctgagtttggaacaatggcctatccggacccctgcaaaaacatattttccaagtaactgcctattttaaatctgagcaaatttcatgctttttgctatccttgatggctgaaataaccagcatttgctcctctgacaattctctttagggtagatgaaaactccacatgactgccctttaaccagaggtgctacacagttcttgatcactgattgccagagagactaagagcatttgacaaattattagaagccctcccacatggctggtgggaaagcgatttggaatcatctgtcaaaattataaatgcgtattcccttcagcctagagatctgcttacttgcatagaaaatgacacatgcaccaggtatttgtcatttatggctgcatcatttgttataacaagtagctgaaaacaacccaaatgttcattaaaagaggactggttaaatccgtaacagtaaaactgtacgagaaaatgccatgtagaagtaaaaaggaatgaggatgttctctttgcactctacagaagcttttccaagatagactaagtggaaaaaaaaaaaaaaaggaaggtgtagaaagagcatgttataagctgtactttgtgtgaaaaagcagtaagaaatctaaattaaattttgcttgtacatgcataaagaaactaggaaaggatgcacaggggcagatggatgttgaggagagggagagattttttgctgtatatattttatttcatttcatttcattttattcatttatttatttatttaagatggagtttcactcttcttgtccaagctggagtgcaatggcgcaatctcagttcaccgcaacctctgccccccaggttcaagtgattctcctgcctcagcctcccaagtagctgggattacaggcacccaccaccacgcccggctaatttttatattttcagtagagacggggtttcaccatgttgatcaggctggtcttgaactcctgatcttaggtgatccacccaccttggcatcccaaagtgctaggattacaggcatgagccactgcgcctggccactgtatacattttaaatcatctggattagtatccatatgaatgtgttacatatctgacagttaaattcttggccagggaatcaggcctgccatcagtatcttctttctgaaactctctagatgtagaagagttatgaaagagttgaagggtggactggcccagagatggaagattgcttctgcttttttgagaactgaagtcatctctcccattccagtatccagctctagggctagctcagagcaagcactgaattcacatttgcaaataggaggtgtggagtaggagccagtgagaaaggaggaggaaagagcaaaggaatttaaaaccaccatacttacctggtaggggagatagcaggatcacgaatttgaaaccacgacctggaggtcctggaaccaagcctcctttttgttccagtgtttgccagtaggaggagcactccccaatacaccgatacaggatttgccaatttcatcacccataaacccctctggtttttctttcttcttgctttgagtataccttctgatcaaatgagctatgtgttcttaactcataattagtttgttttcctttttaaattaaaaactaatttcctggataaattcgagataaccagtgtggactcacattcctggcaaagcagatatcagctacgttgttaggctttgggagccgttacgggttcatatacgatttccgtagagcttcttgacatactttggaacagtatgtcttgctggctctgatgttagagacctttgggttttggggagcccaggaggatcagctggtgaccatggcattccggccgactcatttcttagctaactcaacgtggaggtgtctttggggtgtctgagttcttaggattcctcaggtgacccattgggacccagttgctttttcttccttagttgaagtaaagcattttttttttttctttgagacagagtctcgctctttcgcccaggctggagtgtagtggcgccatctcggttcactgcaagctccgcctcccgggttcacgccattctcctgcctcagcctcccgagtagctgggactacaggcgcctgccaccacgcccggctgattttttgtattttttagtacagacggggtttcaccgtgttggccaggatggtctcaatctcctgacctcgtgatccacctgcctcggcctcccacagtgctgggattacaggcacccggccgaagtaaagcatttttaagtggtaggaaaactaaagccatcaaggatagacttctctggctgggtggacatagccactgactctgttgatttgcttttctccccagagctttctcctacttgtctcacaccatccccgatttcaccgacaactgcctgatcaacatcatgaagtgcggagaagacttctacgcgacctcagagaccaattacatcaggaaaatcaacccacagactctggaaaccctggagaaggtatcaacacatatgtaaccagcatcacttcctgactcaagaaagggagagtcggcgacggccggggtgaggttgctcagcctgcaagcagcttaccaggggagcccctcctctaacaccgttggatcccgtgccctagcgccacacttactgctagatgctaggcagggactgtgttgtttttatcttcgtgtctgtatcagtttcctggggctgatgtaaccaagtcctacaaaaaagattgctttaaacaacagaaattggctgggtgtggtgacctacacctgtaattccagcactttgggaggtcaaggtgggcagatcacctgaggtcaggagtttgagaccagcctggccaacatggtgaaaccccatctctaccaaaaatacaaaaattagccaggcgtggtggcatgtgcctgtaatcccagctactctgaggctgaggcaggagaatcgcttgaactcaggagggggaggttgcagtgagcccagattgcaccactgcactccagcctgcatgacagagtgagactctgtctcaaacaaaaacaaaaaaaaaaaaaaaaaaaacaagacaaacaaataaaaaaacagaaatttactctctcacagttctggaggttaaaagtctgaaaccaaggtgtcagcccggccatgctctctctgaagactctagaggagggtcctccctggccccttcctggcttctagcggttgccggcaacccctggtgttcctcagcttgtagatgcatccctccagcctctgcctcagtcttcacactgcctctccttatggggctatgtgtccaaatgttctgccttttttttttttttttttttgaaaaagtgtcttgctctgtcgcccagactggagtgcagtggtgcgatctcagctcactgcaacctccgcctcctgggttcaagcgattcttctgcctcagcctcctgagtagctgggactacaggcacgtgccaccacacttcactaattttttgtatttttggtacagatggggtttcaccgtgttagccaggctggtcttgatctcctgacctcatgattggccctcatgattacaggcgtgagccattgcacccaaccatgttctgccttttatagagacacaagtcattgcattagggcccaccccagtgcagtatgacctcatcttaacttaatgacatctataaagaccttatttccaagtaaggtcacattcacaggtacccaaggtgaggacttcaacctatcttttttgcaagacacaattcaacccataactctgttcataattcttggcactgagggagttcactgagaatttgaatgaatgactgttgaaatgcctgcgattctcagcaatcctaccttctattgacctgaagagggaggcattaggcaaaaagctagggcacaaaaatcagtgcccaagcacatacctttcctgggaagaatcaagtcaacattttggtgggaatcaatagacccactttcaattttctccagctggctgttcaaaattccgatgtctctgcaatacgttttaacgatctgttaaagagatgaggcttttcttagctgtgaaattatgtccagctccttttaagctagacggcatcggtccaactgatgatgctttccacagggctacagagaggaaatgctggaagagaaaggagttatctgactctgggctggaggttgtgtttttctaggggaggaagcgcagacggttggtctgcggccactccatcattctgcagctgtggactgcagagtgagggtcattattcagctcgttgatcaaacttcactttgaccaaatgtttttgtaacctctccattcccagaataatcgtctaagagaggcctagagatttatgcttctgtgcaatgcaaaagggcagaatttaagccagaatgacagaactgtggccaagattagctcgaaggctacctctctgcccaggtcattgctcagagctttctgcagtgaggaatcttgtttccatgttgaggattccagcaaggtcaggcaacaggattggaacgatagccacagaagcacaccagctccctaactcccctgcaacctattagctgtctgagtccctcaaatccccatgtgaggttgtataaggtcacaagagtgaaagtcttctttaaaagcaaattctgtatcgttttcagatcaacagagtgcaaaaatatccctcatctctctgaacctagaatcagtcacgttttcataggacttcaacctttctcctttgaaaaaccagatgatgtcatatcttgcaggttgattatcgtaaatactttaaaaaacaggaggtgtcatatcttgcaggttgattatcgtaaatacgtggcggtaaatctggcaacgtcacatccccattatgatgaggctggaaatgttctaaacatgggcacatccattgtggaaaaggggaagacaaagtatgtgatttttaagatccctgccacagtaccaggtaggccactctggggaattgaataaaacacaaacaaccaagtgtggcttcttctgaagagttctgtttttcgttgatgacacaagatccagtgtggtactttctcccgtagattattgaggtggaccatgaagtcagtactttcctttagaagagaagaggagatgctgggattcctcttggaagaaagaaatccctttactattctaatttccttttatttaggctccagtttattattttattaatttatctacccatctaccatccatccatccatcatctatttaccatccaaccattccttcatctaccatccatccattcatgcatctactcaccgtccatctatccaccattcattcagctactcactatccatccacccacctacccaccattcatccacctatccatcacccatccaccatccgtccacccatccacctatccaccccttatctagccagccactcaccatccatccattcatccattcacccacctacccatccacccacacaccatccctccatccatccatctacccactatccatctacccacccatccacccatccacccaccatgaatccattcaaccatctacccattctcccatccatccacccatccaccatccatccattcatccatccacccaccacccatccaccatctatctacccacccacccgcccacccatcatgaatccatttatccatctacccattctcccatccatcaacccattcacttacccaccatccatccatccattgagcttcccacccacccatccatccatcattcatccatccatccacccacccatccaccatccatccattcatccatccacccacacaccatctacccatccatccgtccacccaccatccatccaccatccatctacctacccatccacccacccaccatgaatccattcatccatctacatgttctgccatccatccactcatccacttatccaccatccatccattgagccacccacctgcccatccatccatcattcatccatctacccaccatctatacacccaccattcatccatctatccatctaccatccatccatccacccacccaacatccatctaccatgtgcatctaccacccatctattcactcaccatccttccatccaccatctatccatccacccaccatccatctgtctactatccaccgattcatgcatgcacccacccacccacctatcgattcatccttccatccattcagtttttcagtctcctgacaaaactttctatgacaaggttatgccacctactttcattcctagcccctgcagccaagtttccagggctgtttagggagctcagtcctgctgggatccactccagatccctgccctgttctccaggccttctggaccttctccatgtggggctgggatcttggagcaaagcccaggctgactgtgattgcatgatcctgagggggaggaggcggaggctcttagcccatgtttgtccaggaccctcctgggaaccacacccaggagacctaggcctgtgaggacagctgacaggactcaggagacagtgcagaactacaacggtgcttcctctgaccttctagtttaaaaaaaactagtttctgcctgtgatccttgctgctcccccatcccccactgtcttgtagagccccctgagcaaactaccaggcactgcctggagatatgagccttcgaggtcagaaggtacacggagtgtacttgctaaatagaactctcattaattaagccagtaaagggatataggggtcaagctcagaatcctagaatgccatacctggggattgtctaggcatttgagtttgccaccttgtattacagaggaggactgtgaggctcaggggatcagatgacacaccccagtcacacagctcccaggagccactgacatcctgcaagcagagatcctctgagcacctgctccatgctggcggtggcactgcgactcatgccccatcctgctcctcccaggccacagtgcttttcgtttcagtttgcattgtgttccatttgttttataaagacgataactatcccacaaccccacagcatccctcccaccagccagctgtttacagggtgcacaggtggccacaagagaggtggggaagtttgcagataactcattataagccagccgtaggcctgggtggggaggccttttgaccagcgagtgactcatgcttgcagaggaataagaaaactgaacacgtattgagcaccttccatgtttgggtgcagggcgaggcacatggatgactgctttatttcattctgttctctaccttcactgtatgagagtcgtaatccctgataaaagaggaggaaggcgaagggggctgtgttttcttggcttaaccctatgactctgaccataatgatagcccattccactaagcctcagtttcccatctataaaatggccattctacagccccgcttgactatctgcatttatataaaacccctaattatggccgggcgcagtggctcacacctgtaatcccagcactttgggaggccgaggcgggcagatcacctgaggtcaggagttcgagaacagcctggccaacatggcaaaaccccatctctactaaaaatgcaaaaattagccaagcatggtggcgtgagcctattgtaccagctactcgggaggctgaggcaggagaattgcttgaacctgggaggcggagattgaagtgggctgagatcgtgcccctacattccagtctgggcagcagagggagactctatctcagacaaaccggtggaggcaggatttagcccccaggctataggtgaagaccccttacctggagggctccctcttggttcagtggttttcagattgtatatggggtgggtgctgagtggaaggtctcagcctggccccctgcagcagctgcagcaaccttgttgtctgtctacacgttgctgtttaatgtaaaggtttttttcagcaatcaagtcagtttgtaggtgatggtggtgtggtcttgggggggcagccagatcctgcacaattcctgaggcttgctttttgtcttgctagagggcaagaagcaggggaagagcccctggaagcacacagaggtgttctgctccatcccatcccgctccctgctctccccaagctactaccacagctttggagtcaccgagaactatgtcatcttccttgagcagcctttcaggttggatattctcaagatggcaaccgcatacatccggagaatgagctgggcctcctgcctggctttccacagggaggagaaggtgaggtctggctggactctagcccagtgggtgctggctgaccatggagggaggctggtgtgcaggagggtgaagtttaaggcaaggaagtggcatggaagagggaggaggctaccagaggcatctacccaccttccagcaagttctgaagctggatggtccttcagaatggcccccaggcctttgtacccccacggtgatgagttattggatgaggctgtccaggcaagggggtgccatcttgggcaaacatggaagccctggcagtccccatatgcccagcagcaaaaggagtgagtcctcagtccttatggagagctgggctcctccccacctccgccctgttgacaagaccccttaaccatgtctgctaccagtgtgtagcgttggggcggtagcggccagaggtttagacattgtaatgacagtatgttccaccagacagttcaatagaaacctctccttccattcaggtacacctgagtgctcaaagtatgtatgcacgtattgcatgcttgtatatgcacatatgcatgtatatgtgtacatgtatatgtgcatgtatgtgcatatgtgtatgaatacatgtacgtgtgcatgggtgtatgtatgtattactagtgtttatttacttgttgggtttttattgtgggggggttgtttttgagacagagtgttgctctgtcacccaggctggagtgcactggtacaatcacagctcagtgcaccctcaacctcccaggctcaagtgatcctcccaagtagctggaaccagaggcacatgtctctatgcctggctaattttttgttgttttgtagagattggggtcttgctatgttgcccaggctagcctcaaactctggactcaagtgatcctcctcccttcccctcccaaagtactgggattacatgtgtgagccattgcacctggtctttttttttttttttttttttttgcgttgtcacttcacttttgtaaaatatccagtagttctcagtgttacctattcaaagaatatacaagtatagaaagccatgtataaaatcctccccaactcacttcccccctcctgcctcccatccacccccacgtctgaagggagccactgctacccactgacactgtgttactccaccatctctgccttcacgtgcacttttagtttttcttttttttttttttcagatagagtctcactctgtcacccaggctggagcgcagtggtgcgatatcagttcactgtaacctccgcctacgtatcaagctattctcctctctcagcctcctgagtagttgggattataggcacacgccacaatgcctagtgaatttatttatttatttattttttgagatggagttccatgcttgtcgcctaggctggaatgcaatggcacattcttggctcactgcaccctccacctcctgggttcaagcgattctcctgcctccacctcctgagtagttgggattacaggcaagtgccaccatgcctggctaattttttgtatttttagtagagatggggttttgccatgttggccaggctagtcttgaactcctgacctcaagtgatccacctgcccggcctcccaaagtgctgggattacagcatgagccactgtgccctgccaaggctccagtcttagatggagcctggcacctggcagattctccccaacttggtcattgccagggagctgggatgtcaggacaatggaacaaggggaccgtgcacactggagcgtctctccaaacactgtcctcctagtgactgcaaagactctggcagcaaagcatccctcctctccatctgaaagatatacttatggaagtacaataaacagctctcattttggggggcacttttgcctgtctggtgttgtggagcacacacagaatgcagaatggggacatagtcctgagcctagctcctggcggggctgggttttgttcagcccccagatgccacagtgccaggctgagagagggtgagctgagcccttgatatgtgtcctttttcagacttatatccacatcatcgaccaaaggaccaggcagcctgtgcagaccaagttttacacagacgccatggtggtcttccatcacgtcaacgcctacgaagaggacggctgcatcgtgtttgacgtcattgcctacgaggacaacagcctctaccagctcttctacctggccaacctgaaccaggacttcaaggagaactccaggctcacctcggtccccaccctcaggaggtttgccgtgcccctccacgtggacaaggtaatggcttccaaggaggtcccttttctttctagagagatatcggcccaggtgggaagttactttggcccttatttgattgacattgaaatccaaatgaactgttcttgaaaaaaaaaaaagttttcattgtttttcccaaagtagtaccgattcataataaaaactttagaaaatatagataagtaaaaaggagaaaaaaatccctataaacctaccaccgaagatgatcactgtggatatatatgtttgtctcccagtctctctctctgtgtctgtgtgtgtgtgtgtgtgtgtgtgtgtgaatcttcattttaatcatattgtacataatttttttttttttgagacgtagtctcgctctgtcacccaggctggagtgcagtgttgcgatctctgctcgctgcaagctccacctcccaggctcacgccattctcctgcctcagcctctggagtagctgggactacaggtgcccgccaccatgcccagagaattttttgtatttttagtagagacggggtttcaccgtgttagccaggatggtctggatctcccgacctcgtgatccacccgcctcggcctcccaaagtgctgggattacaggcgtgagccactgcacctggctgtcttacataatttttaacagctttattgagatgtaattgacacagcatacaatttgcccttttatttatttttttttttattttttttgagacagagtcttgctctgtcacccaggctggagtgcagtgccatgatctaagctcactgcaacctctgcctcctggattcaagcggttctcctgcctcggcctctcaagtacctgggattacaggcgcctgccaccacgcccagctaatttttgtatttttagaaaagacggggtttcaccatgttgctcaggctgttctcgaactcctgacctcaggtgatccacccaccttggcctcccaaagagctgagattacaggcgtgagccaccatgcctggcctaatttgcccatttaaagtgtttgacagcctttggtatgttttcacagttgtgcatccaccaccacgataaattttagaacattttcatcacctccaaaacacaccccacaccccttagccatcacctcctagtcttcccctccctgccccaggcaacctgtcatctgctctctgtctctgcagacttgccctttctagacatcacgtataaatggagtcttacaatacgtgatcttttgtgtccggctcctttcacacagcacagtgttgtcaaggctcatctgtgttgtagtccgtataagtgcttcatttctttttgttgttgttgttggtttttgcttgtttgtttgttttgagacagtctcgctctgccgcccaggctggagtgcagtggtgtaatctcggctcattgcaacctctgcctctgaggttcaagcaattcttgtgcctcagcctcctgagtagctgggattacaggtgcccaccaccatgcctaagtttttgtatttttagtagaggtgaagtttcgccatgttgcccaggccggtcttgaactcctgaactcaggcaatctgcccccctacgtctcccaaagtgctggggtttcaggtgtgagccacagtgcccggccagtacttcatttctttttatggattaataggtacatactatcttacagactgcttttcttttctttcttttttttttttttttttgagaaggagtctcgctctgtggcccaggctggagtgcagtggcgcagtctcagctcactgcaagctccgcctcccaggttcaagccattctccttcctcagcctcccaagtagctgggactacagacacctgccaccacgcctggctaattttttttttgtattttttagtagagacagggtttcaccgtgttagccaggatggtctcaacctcctgacctcatgatccgcccgccttggcctcccaaagtgctgggattacaggcgtgagccaccgcgcccggcccagactgcttttctacctatttatgtatcgaaacatctctccatgacattaaatattctttgaaacatcactttaaacatttgcctaatcgttcatggcagggattcatcaccatttgcttacacaattctctgatgttggaagttccgttcttgcactaagaatgaccaccaggccagacattatccccaattagggtgatgtggcccaggctctgggctttacttacagagacttacaaaggcttctggctccagaactcactgacttcatgacttaattaatttaagtgaaaccaaattcaattcaattaaatgttgatggcttacattgactaaatgcaagttatgtgccaggtactttgctaagcattttgtttttcttacctcacttaatgatcaaaacaacctgtgggaaacgtccctgtagaagcctcattttacagatgaacaaactgaggctcagagaagttaagaaatgtgggcaaggtcacagcccagagtggcagagccaagactggaacctgccccagtctgtctctaaacccccattttttttttctttttgtgggggatggagtcttgttgtgtcacccaggctggagtgcagtggtttaatctcggctcactgcaatctccgcctcctgggttctagcgattctcctgtctcagtttcccaagaagctgggattacaggcatgtgccagcacacacagctcattttttgtttgtttgtttgtatttttagtagagatggggtttcaccatgttggccaggctggtcttgaactcctgacctcaagttatccacccacctcggccttccaaagtgctgagattacaggcatgagccaccgtggccggccctaaacccctgtttgtaactacgaaggaggaggaactctgctattctccccagtagccctaagtcctaggaaagagcctcagatgggccacacttggcactctgcaggcctggcagacggtcctacagtgtccagggagccttttcccacccttaccgcccagtttctcagtgcaggaattcagccaccctcccagccagcgggcaggggagctggcgtttgaactgaggtttgtctgactccagagctggggtcctctcccatctctccagcattttcccacccatggccatttgtgtgtctctgccatggtttttgtcatattttatatcacctctacttaacatttaaaaatccttttttttttttcatttcaatcaattcactctctacttagctcatttgaaaggaaacacatcactacccagtagaaagctggcaatgcttgctgcacagagaagacaagcatgagaataaaatagtggaaataaagcagaggtcttgagctccagccagagggctgtggcttaccaagacctgatctctctgtgaaaaagccaagttttaaaagtattaggcattaaagacatcgtggcaccgcactgagactctccttgacctagtcagaacaactggaagagaaaaaggcattgattttctcccctatgtgactcagggctattggatgaacagccacgtcccatgaaatcagcacatgagccctgggcgcctgcaccccttgctccagaagcaccgcagtgcagcccctcagactttctcctggttccaggaagtactgaggagtaacaaggcacaaaggtagtaagtctcaaggctgacctcagcctagggatagtacacagagaggaacatactccctcccactgccacaccttacaagattttataaccttttgtcatgctcgagaatgctttgctgccttggaaccaagctaagaatgttagcttgtgtatctttttttttttttttttttttttgagacagagtctcgctctgtcgcccaggctggagtgcagtggcgtgatctcggctcactgcaagctccgcctcccgggttcacgccattctgctgcctcagcctccctagtggctgggactacaggcgcccgccactacacctggcttattgttttgtatttttggtagagacggggtttcaccgtattagccaggatggtctcgatcttctgacctcgtgatccgcctgcctcagccttccaaagtgctgggattacaggcgtgagccactgcgcccagccccctagcttgtgtatctttaaaagccatcaggtgttcaggcacagtggctcacgcctgtaatcccaacactttaggaggcccaggcaggtgatcacctgaggtcaggagttcaacaccagcctggccaacaaggtgaaaccctgtctctgctaaaaatgtaaaaattagcttggcgtggtggcccctgcctgtaatcttagctactcaggaggctgaggcaggagaattgcttgaacccaggaggtggaggctgcagtgagctgagatcccaccactgcactccagcctgatcccgccactgcactccagcatgggcaacagagtgagactccatctcaaaaaaaaaaaaaaagaaagctgtcatatgaaccatctgctgctttgaaactagcaaaggaaagcaagccctgggatgggtagctccagccacgctttttaattgctacttattgtcccttaaatatgtcttcttactgcactttcaatggctccgcctgcatagtgaaatcagaaagtcaggcaggtggacagagccttacatgccctgatccagcagctttggctccaccccatccagaggtttactggagaagcgacttcaggaagatgctgcccttactcagatgccctctgggcctgaggcctttgcaggacattgctttcccctctgtctgaaaccctgtcctcctgggctgacactcctgctccccctggctggctgcacattgggatcccctggagagccctgagacccccatgtccgggccttggcttccgcccagaccggggaagcccaggcccgggtgtggtctcagaaacccccagtgattctgcagtgcagccgtggcagagaacctccaaggtcagggatcagcagcatgaccccgcagctgagtccgtatcctctaatggcgccttgtaactctttgtcaacatttatctcaagtgtaagtaacttgttcatttccctcttcctgttcaagcctaagttctgggaggacagggactctgtctcatcagcagttcatctgctgcactcagagggtgctcttaaatatttgaaatgaatgaatgaatgatgaatacatgaaaaatgggaagcaagttctctaaaagggcgcagcatcttccttcagcctttggaacccgtcccaagtgaaaagtgcttcccacatagaacaggcaatagcaaattctatttaaaaggccaggaggtcctgaatgtcccagattctcttgctttgggaccagctggggtcaaaggaaggcagggctggcagggcctctgggcaccgtgggcctgtttacgcagggcggtgtgggggtgcctgaggcagggcttagcagtggcggggtgtggctgggaggggtgtgggcaggggtgggtcatctggaccttggccctgccctggtgctgcagggcgctgtgtgaggcccgaggttcgtgtgcacccacgcctaaggggcattcacaggaggaagcactgtggacctggaagggatggctttgatgactggatcagtgggtttggtttctgtctccaaatgcacaaatgcagacactccagtaagagaagcaccattcatggaggacccgctaggtgccaggctctgtgttcaatgccttttctgctcttagaccctggcaagaggggcccctgctctgggtttggcactttggaggactgtggtccaggctttctttctctagcaggacccgtactccacagggtgagttcacagggccaaggcattctgactacccagaggggtgcttccacccccaccccaaccatgtgctggacacctgggatcccagaagctcctgaagggcccagccttgcttccaatacccgtcttcctaagggcagactgccactctgctgttcctgccacaggcccatgaggtggccagggctggctgttgccttggttgtgctggctagggcatccacgcagtgagggatggagcctgggatgaggcaggaaggagccaagggccagagactgccttattccagctcagaactctaaggagtcctggggttctcaattcacagtcatcctttcagaccagcacagtgcattgctggaacattctgtctgtccaacacagtagctactaactacgagttgttattgtacacttgaaatgtggctggtgcagctaaggaattgaatttttaattttacttaagcttattttaaaattaaatttaaggccaggcatggtggctcacgcgtgtaaacccagcactttgggaggccaagccaggcagatcacttgaggtcaggagttcaagaccagcttggccaacatgatgaaaccccatctctactaaaaatacaaaacttagccaggcatggtggctcatgcctgtaacctcagctactcaggaagctgaggcaggggaactgctcgaacccgggaggcggaggttgcagtgagctgagatcgtgccaccgtattccgcctggatgacagagtgagactcggtctcaaaaaaaaaaaaaaaaaaagtaaaataaaataaaattaaatttaaatcgcaacatatggctagcgattgccgtttgggacagcctgttccacgccatcatgaagggctgcgtgtcaaggcagggagagagatggtgttggacttaatttgcttggtgtatttagacagaaggttggtgggcctccacttgtactctcctcctggctcctgtgaattttaggggctgtgaagtgctttgctaatcttcatcacaatgttctaagttatttatgatcccccacgtctacagatgagaaagtaacttgcccaactttttagaatcatccccaggacttgagctggaactggaatgtacgcctgtctgcctgcacgatgtgtgtggccctggaccagcctatttttctcaaccattatttaatttaatcctaacataatgctcagatgcaggtggaaaccgcctcacttatacccagcaccacactaaaagttatgaatcaccaccccgattttacacagtggaggaaactagctctgagaaaaagaggtctgctcgaatctgcatggaaaaccacagcgttgaatttcatatggcaggcagcattctaggggatgacagtgatgactgcttcttatgagagttcccttaagtgtcgggatttcaatgtaagcttgcaagatggtgctggattctggctggaaagtgatgtcttcctaaaactgagcatgctggccactgaaagcagccaagtcatgtttgttattgctgtgtgtggaaaaattcacagtttattcctcaaccagtccgaccagtttggggctggagttataagatgtctgtgcagaccaactccctaagaatcaaggctggaatgtgcccagaggtctcttgctgtcacatgcttagcaaggtaccaggaagggcctcccaccagcttgcagagccatggaggtggaggcattgaaagtttctgtttattttattttatttttttttgagacagagtctcgctctgtcgcccaggctggagtgcagtgacgcgatctcggctcattgcaacctccgcctcccaggttcaagcgattctcctgcctcagtctcctgagcagctgggactacaggcatgtgctaccacgcagggctaatttttacattttgagtagagatggggtttcaccatgttagccaggctggtctcgaactcctgacctcagatgatccacccacctcggcctcccaaagtgctgggattacaggcatgagcccccgcactcagctaaatgtttctaagaagccaccgatgtgccaggtgctgggctcctttgtctctgcatttcctctcatttgattcttacagccaccgtgcaaaacaagtcttgccccttgacagcccaaagaaaagcttattgagttgtgcattcactcattaattcagcgattacttcctgggcactaggtgccaggcactgagcaaaatctggtccctggcttcatgcggcagacaagctaaaataaggaaaagagcttcataaaggagataattacagctcagggccagtgccttggagacactgcagattccaatggagttgttagggaaggggtgtttcttctgagacctcagggtttggggaagaaccagcctcagggcctttgcactgccttcaccctctaccagcaatgctcttgcttctgggccaaagaatcaatgcaaaggccccaggcacagggtctgcttctctccatgtgactttggaccagtccctttccttctctaggcctcagttacttctacaaatcgagactgaattaaacaaatttccgaggacccttgcggttcagctgctaagttgcagtaaacttttcatgctctccaacaaaaatgctgctatccctaaaataggttggttttaattataaaagccattttgagccaggtgtactggctcatgcttgtaatcccagcactttgggaggtcaagagaggaggatcacttgagcccaggagttcgagaccaagctgggcaacatagtgagaccctgtctctacaaaaaatacaaaaattaaccaaggatggtgacgcatgcccgtagtcccccagctactcaggaggctgaggtggaaggatcacttgagcctgggagtttaaggctacagtgagctgtcatcacactactgtactccagcctgggcgacagagcaagaccctgtcccaaaataaaatagaagctatcttagaaaatgtagaaagtagagaaaagtttaaatgagaagtcagccataacaataatgttccatcctcttgttcctcaatatcttccagagcctaacccgtagtcacctccagtagtggtggcagcaatataataataataagtgatagtagtagtagtatggtaataatagtaataataatataacaacgtcatcaatagaagcagctgacattcatctagcacttattgtgaagcaggcattcttgtgaatcatttgtgcagatgatgtcattcagtctgcacaataactcaaagatgcatatgctattaatatacacataaggaaacggaactatagagaggccaactgacttgctcaaggccccacggttagtacatgagggaaacagggagtagtagatgctcaataaatatttaatcatgctaaatccctccccttgcttatactgatgacagtaagatactgaacacagcaaaatctgactgtaaattgagaccaagaaatgtccttgaaggctgttttgccaccaaataatttttattgcatgtttgttttcatttctgcagtgataacttttcctagaagaaaatactgaaaatacagagaggcatacaaaaaagaaattaaagtccccccaatcccatcatctgttgtatttttaatatttagtatatttctggctgggcgtggtggctcacgcctgtaatcccagcactttgggaggccgaggcgggtggatcacttgaggtcaggagttcaagaccaccctggccaacatgatgaaaccccatctccactaaaaatataaaaattagccaggcatggtggaatgaacctgtaatcccagctactctggaggctgaggcaggagaatcgattgaacctgggaggcagaggttgcggtaagccaagatcacaccactgcactccggactccagtctgggcaacagagtgagactccatctcaaaaaaaaaaaaaaaaaaaaaaaaaaaaaaaaaaaaaaattacacacacacacagacacacacacacacacacacacacacatttagtatatttctctgtctcttctccgtgtaacttttttaatgtggttgagctcagactgcatacgcaatttgtcctgttgctgcttttactcagtgttatgtgataagcatttcccatgttgttgtaaactctttagaagcatccttttaacgactgatgcagctttttataggtgaatcatctagtactttaaaagtgagaacttactctcagaagcacattaattttccctgtgagggataaggcaggctcagagtaagagaaaagagtcctatcacctaccaggtatgtgaccttggaggagtcaccttaaatggccaatcctcattttttaaactgagactaaggataacaacaggaaacgagctgcttcctatgattaatgtgaggctaagccaagatgacatgtattcaagcattttaaaaaatatatacactaaagcaaatgtttgctctggattacacgtttttattttactttttgaaaactgaattttttcagaatgcagaagtgggcacaaatttaatcaaagtggcatctacaacagccacggccctgaaggaagaagatggccaagtctactgccagccggaatttctttatgaaggtaaaatgcatcctcttgtcctgagtttaggaaaggggcagattttcacagggagcccagaggcctctttacataataattccctcctgtgcatggacaagggccaaaaaggaaagggtcttgggatgccctggtgaaaagcatctggggacatttctcttttctctatcttcaaatgcttcctaggaaggcaatgggtgaggccaggcacggtggctcccacctgtagtctcagcactttgggaagctgagggaggcagatcacttgaggccaggagttcaagaccagcctgagcaacatggcgaaaccccatctctactaaaaatacaaaaattagccgggtgtggtggcgcatgcctgtggtcccagctactcaggaggctgaggcatgagaatcacttgagcccaggaggtggagattgcagtgagttgagattgtgctattgtactccagcctgggcaacagagcaagacactgtctcacaaaaataaaaataaaaataggaaggcagtgggtggttgttgggccagatgacttctgcaaatgctgtcccttactgaacatgggcttactgaacaggcacaatacatttccatttcttcctctcaacatccacaatatcctgcaaaaataggtgttatcggccccgtaatatagcgaagaaaactaggcctgggagtccttgaggtacacacagaaagcagaccctctagaacaggagtcacacccgtggagcagggctcctcaatctgggcaccatcgccatctggggctgggtcattctttgcagtgggtgctgtccagggaattgtaagatgtttagccacatccctggcctctacccactggaagccaggaagacccccatcctgaattggagcagccaaatatgtctccagacattgccagcatctcatgggagcaccattgccatgatggagaacttctgccccagaatataagcccgtgaggcgagaattgtgttgctgtgctcacagcgtatcagcagcacatgacacaaaggctggcatagagaggtctgtgttccatacgccaaagtgcagaatgaatggacttgtccaaggagactcagctagagagtgggacagagtgcatttcaactgagcgcattggctgggcacggtggctcacgcctgtaatcccagcactttgggatgctgaggtgggcagatcacttgaggccaggagtttgagaccagcctggccaacatggcgaaaacacatctctaccgaaaatacaaaaattagccggcatggtggtgcacgcttgtaatccataatcccagctactcaggaggttgtggcaggagaattgcttgaaccccgaaggcagagcagagagctgagattgcgccactgcactccagcctgggcaacagagactttgcctcaaaacaaaaaacaaaaaacaaaaacaaaaacaaaaaaccctgagagccttgttccatcagctgccccatgccaggaggtttgggcatctggaagagcacatagacttggggactcttttaggatgacccttggatttgacctaagaatccacttctgtaaaaggcatcccatgcatcccataaccggttctgtgatgcaactcattcccctggagtctttagaaatgaatcaatagatgatgccaggtctgaaggcatcaacccccaacccccatccctgctcacccaccacatcccttttttttttttcctgagaagaccacgcttgtttattgttgcaatattgtccacactaaaaagtgtaacaataaagaaaccacccgtaatccctgcccccgtgacagcgctttgggctacccatccaatcctcccatcatgcatggattgtgtgacataggccgggtcccttctggcgagttctcagactctctcatttcatcccggcagtgtcattcttttattgttgacattagatttgttcacgtacatcaagggcttagtgtggggtctggcctatagggagagtccagccattggcagcaatattagaacagtcctaagaagcaggctcagacaatctcaaaacttgccaaaaggcaggcagcagagccaggttctgaccccagcagtctcttatcccagagcccattgcctctgcatttgtacttttgcaaaatgcattccatatcatctagaatgttccgaagctgcctcttgcacttaatgtatgtaacctgagtattttcccacatcctgaagattcttcaagaacatggctgttaaggaccgggcatggtgattcacacctataatcccagcactttgggaggccaagccttaatttcatgtaactactggccaggcgcaatggcaattacaggcattactcatgcctgtaatcccagcactttgggaagctgagacaggtggggcatctgaggtcaagagtttgagaccagcctggacaacatggcaaaaccccatctctatttaaaaaaaaaaatacaaaaattagccgggggtagtggtgcacacctgtagtcccagctacttgggaggcttaggcaggagaatcgctggtctgagaggggcccaggaacatcttggaagtctcaggcctactttgaggtcaagggcaggcaccttcttcttatctaagtatgggagtgttccctctgcctcaccttcatctgggcctgtcccttggaagtttcatgctttctcatttgtgggattggacatctgcttcccatctcaatacttcattccccttcccgccccactgagcctaatcagcatttatccatggatgtatctctgcttcctcttttcttggacattatatcttcaccagcagttggcggcaaccacctagaatatttcctaagagttgaacatccatttcagtattcagacttagaaattcaatttgatgcaataggcatatatacatatatacacatttacggccaagcacggtggctcacacctgtaatcccagcactttgggaagctgagacgggcggatcatgaggtcaggagatcgagaccatcctggctaacatggtgaaaccctgtctctactgaaaatacaaaaaaaaaaaaaagtagccggatgtggtggcacgcacctgtagtcctagctacttgggaggctgaagcaggagaattgcttgaacctgggaggcggtggttgcagtgagttgagattgagccactgcactccagcccaggcgacagagctagactccatctcaaaacaacaacaacaaacaaactatatatatatatatttttatatatttatatatttatatataaatatatatttatatatttatatataaatatatatttatatatacacacacatttacagagaaaaaataatatttttgattatgtaaaaataataagcatgatgaaaatttcacataatgagaaacttagattctatcatagaaaatgtaaactgtaaggcagttagaaccccagcaatgcttccaaattttttctcttcatttgtaacctagcggagatacaataattctataaccagcattttacacttaaccttatggtatggacacttgcccatgttattaaaatcatttgtaaatgttgtttttccataatgttattatagaattcaccagatttaattaactgttctccattgacacccttttccacagcttcccattctgttttattttttagtttttattttagagatggggttcttgccatgttgagcaggttggtctcaaactcctggcctcaagcgatcctcccatctcagcttcccaaagtgctgggattacaggcatgagccaccatgcctagcacagcttcctatttcttttctttttgttttgttttgttttcttttcttttcttttcttttttttttttttcgagacagagtctcactctgtggcccaggctggagtgaagtggcacgatctcggctcactgcaacctctgcctcctgggttcaagtgattctcctgcctcagcctcctgagtagctggaattacaggcatgcggcaccatgcctggctaattttctttgtatttttagtagagggagggttttgccatgttggccaggctggtctcaaactcccgaactcaagtgatctgcccgcctcggcctcccaaagtgctgagattacaggcatgagccactgcgcccagccagcttcccatttctcatcacatatgtgcacatgcacgcacacatatatacacatcagcacttttttgaaaaaaagctttaagaaattgcagtagcctctgattttaatcatgcaattctctttgatttctatgttggataattaaagatgtttatacacttaaaacctaggtctggagtaccttgctcctggactctctaatagagctggggtaattaaattaccagaggctccctcccctgcctttgaccacctttgatccaatgcaggctctaaatcaagctcaaggatcttggtgtggaaacggattctgaggaaaggctacccaatctgacaggaagggtggatgctcccagcccccaatgataggggcttcatccacctcctcatttccttgtaggcttagagcttccacgggtcaattatgctcacaatggaaagcaataccgatatgtctttgctacaggagttcagtggagtccaatcccaaccaaggtactggtctctgtgtattcacaagcctttcctacagtgattgtgtctatatgcaaagctgaattctaaggttctgagacgttgattagaaaagaggaggtcagaaggagtaagcctaggataaaataaatttgaagtaaggatgttcagctgggagagggagtggtacctaatgggctaaggttcaggtaagaggttgtggctggagtttattcactgatttctttattcaatacatatttaatgagcaccaattatgggctacaatgtggtaggcactgagggtaaggaagtcagcagggagattcccaatccctgacctaaggaactcaccctctccagcagagagggtgtagctgaaacttagaggatttattttgcttctttttttgttttgttttgttttttcctttttatttaaaaaaaaaatacagaaagagacagagtctcattgtgttgtccatgcctgtcttgaattcctaggttcaggggatcctcctgcctcagccaccaaaagtgctggattacagcctcgagccaccatgcctggcccattttgcttcttaagctaccatttgtcaaacacttactgtgttctgggcactgtgctaagtgctgtgcaggtgtcacttctttttaatgtcttcatttttcataataaaatggaaaatcttttttttaaaatgcaaacagagcaggaatgtacacagccaaaaattaagcctccacccctccataccccaagccactctccactaatcccaaaccccagagggaaataggcctattgggagattaagagagattcagggaattgcacccttaaagcaacaaaggggttgtattgtactttaaatgtttgcattgaatatattcatttatttaactcatataaaattgcagtgcaatttcaaatacaagatatgttcgatatttttaggcagggtgtggtggctcacgcctgtaatcctagcactttgggaggctgaggattgcttgagaccaggagttcgagaccagcttggtcaacaatagcaagaccctgtctctatattaaaaaataataataaattttaaaagattttaatttttaaaagaattccttctacagtatcagctacgtggtggccagaggacccatgtttaaaactgggggaggaggccgggcgcggtggctcacacctgtaatcccagcattctgggaggctgaggtgggcggatcacctgaggtcaggagttcaagaccaacctggctatggtgaaaccccgtctctactaaaaatacaaaaaatcagccaggtgtggtggcacacgcctgtaattccagctactcaggaggctgaggcaggagaatcacttgaacccgggaggccgaggttgcagtgagccaagatcacgccattgcactccagcctgggcaacagcctggaaactccgtctcaaaaaacaaacaaacaaacaaaaaactgggggaggagagttagctcctgtcctttcttggctgtgctcaccagaggtagctgtcattgggagactacgtcaaaagtctacatccgatgggcttcatctcctctgtgtggatcttcatgcactcctatttgcagagaatagtattctctcaaacaagtcatttatgtgtttttcctcgttggatgtacagataataaaatatgacattctcacaaagtcatccttaaaatggagagaggacgactgctggccagcggaacccctgtttgtgcccgcgccaggtgccaaggatgaggatgacggtaagactctaagaagccacgcctagttgctgcacgttactgcagatcgccctccaacagagacaccatctgggggcagctgacccccccaggtcataaagggggtggattggtgctttgaagtgtacatctgtctgggtcaaagctaaagggtgagggagtccccaagaccacctttacttctgataccaattgcaaagtttgagggtccccaagatagccttcagcttcaataattcattaaatcaccaacctcactgcaagtgcttatgttcacagttctggtttgtggcaatgaaaagatacagactaaaattagcacagggaagagatgcacaagacagagcccagcagggaccaggcaggagcttccaggtgcctctccaagtagagtcacagatagcactgacttctcccgacaatgacgtatgacaatactcaccgagtattactgccagccaggaagctcccctgagactcagtatggagagtttttattgggactcagtcatgtaaacatggttgactgcctgtgtgtctgacctttatttagtcttcagtcctcctggagatcaagttcataccacacggcacaaggccccaccataaatcccactgtaagggtagactgcctgatgtggcccaaggcccccaggtatacaaagatacttgtatcaagcaggacattcgacgggtatagaggtgacctcccagaagctgaggacaaaagccagccccctctttagacaagtttaagttttttaccgcacaaagtccatctcctttccactcagtgacattaaactctctcagaatgcagaatcttggttttaaaattgattgcagtggctggatcccaaacaaatgtttttaagaaatggagtcttgctctgttgcccaggctggagtgtagtggcatgatcatagctcactgcagcctcaaactcctgggctcaagtgatcctcctgcctcagcccaccaagtagctggagctacaggggcacaccaccatgcctagctcattctttttatttttttgtaaagaaagggtctcactatgtttcccaggctggtctcaaactcttgggctcaagcgatcctcccatcttggcctcccaaagtgctgggattacaggtgtgagccagtgcacctggcctggatcccggatccaaatttttaacaatgtataagcatgtaaatgtttcacagagccgctggaaatgtgtatttgtggcccacctctattttctaggtttccacttgactgaatgatgctttccctcttccattctcagaaatgcttcagaaatgccctgcccacagccctgaggaggctaaggagggtaactagaaccataggtggggatgccacctggccacaccagcaatggggctgccacacctgcaaggagggcaggctgccccacttgagcctgccagcttcttccctcaggtcacaagggagtggttttccacctgggccttgtcttcctactgatcatggcatggcacgccaggccagcaaccctgtgtcactgtcatctccaaggcgggggaccacaggccttgcctcctgttcaggtcgttctcccactcagtgggacacttcctttacattctctgtgaggagggagtatcgttgtcttcattttaccaatgggatgctcagagagtgacctttttgcccaaggtcacacaccccttacattcagaggtaagatttaaatccaggccaatctgacctcaacgatgctcaactgctcttccacctgggaccctctggaggcattgagagtatttgcaggaagttgatatgcattatttcatttaactctctatcccttcagagtgagtattgagagtatttccattttacagaggggaaggatgagtttagtagcactgctacatgtgcaagagatgaattgggcccattgaaatgccattcttcaagccaggtgcggtggttcatgcctgtaatcccagcacttgggaggtcaaggtaggcagatcgcttgagcccaggagtccaagaccagcatgggcgatatagggagaccccatctgacaaaaaatacaaaaattagccagacgtggtgtcatgtgcctgtagtcccagctacttggagggctgaagtgggaggatagcttgagcccaagagatcgagattgcagtgagctgtgatcacaccactgcactctagcctgggcaacagagtaagaccctgtctcaaaaaagcaaaacaaacaaacaaaaaaccgaataccactcttcgatgcctgcaataatttacagagtgctttcaaaatccatcattcaggagatactctcggcaaccctgtggagtgtaggtgagattatcgcatctctacagatgaagagactgaggctccgagaggtcaagggactggcccagccaagggtagaaccaggttttctggtttgttcattcgtttgtttgttcgtttgttttgaggccgtgtttcactccgtcacccaggctggaatgcaatggcacgatctcggctcaccgcaacctccactcccaggttcaagtaattctctggcttcagtctactgagtagctgagattacaagcacccaccaccacacccagctaatttttgtatttttagtagagatggggtttcaccacgttggccagactggtctcaaactcctgatctgaagtgatccgcccacctctgctcccaaagtggcgggattacaggcgtgagccaccgcgcccggcctagaaccaggttttctgatgcctagttgccaggcctttcccttctgttacagtgtctcaaattcactccctcctgttttggttagatacatatgtttaaagagggcagagagacatgctgagaaattcatccctccgactgaagcctgcacttttacgaagtgttttttttctgtttccctaaaggagtaatcttatcagccattgtctctactgatccccaaaagctgccttttctgctcattctggatgccaaaagctttacggaattggcccgtgcctctgttgatgtcgatatgcacatggatctccatggattattcattacagacatggactgggacacaaaaaagcaggccgcttctgaggaacagcgggacagggcttccgactgccacggggctcctctgacctgatggtgttggggtttgggtaggggaggggagctcggctgtcagaactccatggatatgtttctttggatggaggggagggcctttgttaccttttgcacttattctttctgtgggtgctttgacaagggcatggcaagagagcttgtcagtatcatttctttcattttattttggctgtaaaaattttgtttgaaagtcaaacatttgaacatcaaatatgtattgattagatccagtccttctaagaaacctcctttcctttaacaaaaagaccttgaccatgaatcagagattgtattcaatgacattatcatcatttttagaacgagccactaacctattagagaagaggcagataattatttatcattgtgccttcctctgtctctttctctttcctttgctccctcccatgtttctggtggactaaattgtgtatctgggagttctcactttctagccaggcctgatgagttaagttacatgaccaggaaggttatgccactttgtggtcattccatgcaagtcatggcgtaatataaaataataaaaactttaaagtctg

SEQ ID NO: 843 - DNA, 50124 bp, Homo sapiens
tggaggccggggcggggcgggcgcagccggcgctgagcttgcagggccgctcccctcacccgcccccttcgagtccccgggcttcgccccacccggcccgtgggggagtatctgtcctgccgccttcgcccacgccctgcactccgggaccgtccctgcgcgctctgggcgcaccatggcccgcggggctgcgctggcgctgctgctcttcggcctgctgggtgttctggtcgccgccccgggtgagcgagcggagggatccgggttgggggacgcggagggcgcgggccgggactggggatccgcttgagatgcggcgttgggggcgccccgcggggacacccggagcctcctccctgcccggcaggacgcgctgtgcccacgggggcccaggcccggaggaggcgcccactttctccccaacgcttttcctggagccgttccagagagaaaagtcagcgtttgttgtcggagttgcaaactcttacatgtggggcggccttgggagaggtgcgtccgatttttcccaatctaggggaccttcttacagatctctctccctttgcatgagcccctcaccccaccccgttatctacccccagggtttggggacctgcgtcttcaggccgcgcgcggaggccgccctggagttgcctgtcacagccacgccctgcgtcccgggcctaaatttggaatcgctaggagcctgagacccgggtggtggggggaagggaaggaaaagttagaaaaaaactttgagccctgaaaatgttcaaaaatactctgtggatgcgggctccgggaatttcagcgcgtgctgtgcgccaagcaacacggggcgcagaaagaaacgtgtgcttaccaaattgtccatctgcggcggtggagaattcggaaaacagaaaaagtgggcagggaagaaagagccacggtcaccctcccacgccctaaaccgggcctatttctaattattactttaatcatgtttttctgtttccctccctttgaaacggaaacggagaccctgccggatgtggtatgttataaattcttttttcatgttataaattcttttttcaatggtcagtgcattttttgctcttcgtatgggcaggcttttaagtagaccggcttgcgggcagtgtggacttcaggacgggccttatcagggctggacgtatttaggaaggagacgcgggaacgcccggccctggggaggacggaggaggcccgatttgtgttgataggatctagctcagcctagagctgcggtgactaggccgggtctctatttttagggaggagttgctaatggatttacaccctctttaaaggggtcccgggtatcctagaaattgtgctttcacttggtagagattagagataatgaagcctgctccgtagaggaaaacttggaggactttccagcctgcaggggaggttccaagcagagcttcctgtttctcccttttcttcctaaatgtccttcttgcgggcaacctgtcaccacggacgggatggctctgtagggttttatcagctgcatttgttccccaggcacctgcagatgaacgggtttttcacttgtctctctgcgaatgcattccttcatccttcatgcctgccttccttcttttgcacctactgtgggcttggggtcagggaaatatatccaagggagtgctggtggcctaagaattcagtttcctggagaacagaggcatctgaacaggcagacgggagacagggccacagggacctttatagttccatcacgaaataactcaggggttcccagtggtaaatcttggtgaggggcttggctggattttgaagccctagggacagatttgccggctggtctggcgttccaggtcattggagcagagtgagtggaaagccttatattctctaagccccaaacaagtcgttgcacagtttttttgtttttgttggtggtggtggttttttttttttggacggagtttcactctgtcaccagtctggagtgtagtggcacgatgtcggctcattggcgttgcacagtttttaaacccacagcagtgttcatctggaactcctgattttggaagcagactgggcttaggaactccagctgctgatgctttgagtaaagggaagagtacctgtctatggggtgggtgggtagggaagagcagtgggataggggcataacaggggccaacctatccttccaattgcagaggagggcctggccgtcagcactgatggatctccttgagggacgcttctcaccccttctttgcagtctgaccctgctagagatggagacagaaacagcctgtcccaataatattaatacacgtttcatcgggaaagttgacttttgagttggtgatgctcagaacacactttcttatagcaacgtgcatcaggctgcaaaaccccgttgagcctgaagtaggttctcagactggtgctgatagctctggcctgatctcagagtgttggggaccctgtgttccttggttccttcataaattctcaggggtacaggtgggatgtggtgagggatggatggacagagggaggtgtatagaggaaaagaggaggcttcagctttgtagagagcaggatgtccccacagggcgacgttggccccgaggagacactttgtgatggttgcagacatttttggttgccaccctggggtgggacatcccaccatcctgcaatgggtggggcagcttagggaagctgctcagaatctttcaagggccaggacggcctccagcacaaagaattcatctggtcccaaatgccagtggtgttgagggtggaaaaccctgaggagggcttgggagttgcatgtatgcgctgattcagggctgcccctgcagttaggagcctgccgtcccgacagtagagtcgcacacatccgatgcatccctgctctctggcaaaggctgatttgccccaccccccggggcaacggcacagcggcctgtgcggtttgaaaaactccaaacatctacggaaccgacatctcttgaacaataccaggcctcttcaggattccctcgccccagtagagcaagtgtgggcttcgttgtttttttttttttttaactctctccagagctcttgtctcctgcccctgtgggtgtgtgtggaagttattaggagaatgtttctgggcagaggaagtgggttttatcatccagcgagtttgccttgattttccatcagcgcgtttggctctggtaaaagttgattgctttgcatttaactccctactttaggccgagcacggtgactcaggcctgtaaatcccagcactttgagaggccgagggccggtgggtcacatgaggccaagagttcgagaccagcctggccaacatggcaaaaccccgactctactaaaaatacaaaaattagccgggcgtggtggtgagcgcctataatcccagctactcaggaggctgaggcaggaaaatcacttcagcccgggaagcagaggttgcagtgagctgagatcgtgtcaccgcattatggcctgggtaacagagagagactcagtctcaaagaaaaaaaaaaacttcctgctttagctctttctcctttctctgtgtatgagacagagttttcatgtaaagacaaatacatgtctttacactttggagatactcaagtaaatgattgtttgtctggaaatcatttttcttcctgaaggtcctatggtgggtacatgctgtcatttagaaagaaatgcagctcatacaatacttttcccaattcagcatttaggaatcatggcgggatttcatggatactgtctggaatgttttcggactcagatatcttcccccggggaaatagacttctcagtagccacgtggaccttgtgctggttttcagtcctgctgaaaatgttctgagcactcttgttactttaggggaaaagaattacgtgtcctttgtgatttatagacacagtaagaaataagacctgtgtgtctctcggggtgcgaaggaggaaaagtcttttttttttgagatggaattttcctctgttgtccaggctggagtgaagtggcacgatctcagctcatggcaatctctccatctcaggttcaagcagttctcctgcctcagcctcccaattagctgggactacaggcatgcactgcatatctggctaatttttgtatgtttagtagagaaggggtttcactatgttgaccaggctgaaaaatatttttttgaggtggggtctctgttgcccagactggagtgcaggggtgcaatcagggctcactacagcctccacctcctgggctcaagcaatccttccacctcagcctctgtagtagctgggactacaagcacacaccactgtgcctggccacttttaaatttttttgtagagacagggtcttgctatgttgcccagactgaaaaaaaagtcttttttttttttttgagacagtgtctcactgtgtcacccaggctggagtgcaatggcaggatcttggctcactgcgacctgtgtctcccgggctcaggcaattctcctgcctcagacacctgaatagctgggaatacaggcacatgtcaccacacctggctattttttgtatttttagtagagacggtgtttcaccctgttggacaggctggcctcaaactcctggcctcaagtgatctgcccaccttggcctcccaaagtgctgggattacaggtgtgagccacctgaaaaatcattgtaaaaatcaactgtcctacattcttatttggaagtgactcctctaaccaaagacagggaaaaacaaaccaaactttattaacatgcgtttttcattgatacatgagagatacctagaaatgggtagttttcaaggaagtggcttggattctagctgctctagtaccctcaacaaagaacagtccatttttagagaattggcagagaaagacaaaggactttgagtcttcaggggcagcaacaaaatggcagagaaaggctggttattgaagcttgttcattctgagtcctgtgttccatgtcccaggcccatgtggattttctgctgtcttccgtgcttcacctctgttctcccagttggggaggtggggttcggattgcttgtgaatgtgggctcatcgttgctggtgtagctgcaggctgcaggctgtccagggcttgaggatttgctgatattctttcttttcttttctttttattttgagatgaagtctcgctctttttccccaggctggagtgcgatggtgcgatctcggctcactgcaacctctgcctcccaggttcaagcaattctcctgtctcagcctcctgagtacctgggattacaggtgcccgccaccacacctggctaatttttgtatttttttagtagaggtggagtttcaccatcttggccaggctggtttcgaactcctgacctcaggtgatccgcccgcctcggcctcctaaagtgtattcttttttgatttattcccagtctcttggctgaaacatggtagctcaccagcatttctactcccatttgtccaactgacggtatcttttcacatctctagagaccagaaggacttcctcttcttgaatttcctgttcagtattctttcttggcttggttccttggtgagttttgaggagatggtgcatgggtgtgtttttcggctttgttttagtatgactcagggttgccaccatgccttgtacggtctcctagtcatagtattaaagtttccgcttagcaggaaaccagaaacttcctttcttctcccccagagtcagattcaaaccagtgtttctcaagtgggctgtgaaagtagcttgcagccacccaccttgcaaagaagaaaattcaacagaggagaggagaaaatgcccacagggtacatggaaagccttgctaaagaagccgcatgggcaaagcttttgttccgctccctctgtcccggtgggctgggctgagatataatatatgtttgtcattgtggacggcagctggatgagtctgaaagcggttgcaaacccctttaattcactttgctttctcaactttgaatggtgtcgtgggctggggtgggtcccctgtttttgagaatcacctgaaagagtctgattttctgcatcttttcggggagtaaagctgttgctccaaagcgctgtttaaaagctgataatagtgtatctggttgagctaacagcccttcttgaggaggcagcagactggccagagggttctgcaggcattactcatcagcgacacctgagtttgcccaggtagcctgactcttgtttgtttctgctttgcctgaccctgcaaaattattgtccaaatgcaccctggcaagcattgatccacgaggggatgctgaccagaaggagctttcgtttctgcacgatggactggaacacgatggactggaatgatgacaagaataaacacactgcattgtcttttagggccaatggacttggaggcatagagattttataactactgccagaacccaaatattgccagtcggcctcttctgctgctgttgctagctgtcttcttctgggggaaatgggttgggttctaaatatgaattaacacagggctgtcttcgatgaattcagcacaaaatgttctcagcaattgaacactcggagagaagtgttaggcatttagtgcagactcatagaatagcaggacagggagggatttggatctgggcaagcaggagatggatatgaacatctgtcttttgagaccgtgccgaggtggcaatgaaggtagaggccccctgtgttgaggtctttactcaagaggctgtggtcctttgggactaacatagcatccgatagacagacaagatggacagctacagccacctatgggaagcggtttctactcttaaaccacaagcccctagacactcatcatatcataaacatatcaccgggcagtggcttgcaatctttttttttctttgtttctttttttttttttttttagacttgcccaggccggagtgcagtggcacgattgtagctcactgcagtcttgacctcctgggtgcaggtgaatctctcacctcagccttccaaggagctgggaccacaggcatgtgccaccctcagctaatttttaaaatctttttgtagaatcggagtctgactacattgcccaggctggtcttgaactcctgggctcaagcaaacctctcgcctcagcttcccaaagtgctggggttacaggcgtgagccaccatgctcagcctgcaatcattttttttgagacaggatctcactctgtcgcccaggctgaagtgcagtggtgtgatctcagctcactgcagcctcgaacccccaggctcaggtgacctgcccaccttagccttctgtgtagttgggactatgggcacatgccaccacactcaattaatttttaccttttttgtagatacagagttttgttctgtcgcccaggctggtggacatattttaatcctacagagtccaggctaaaaacacaccagtaactgtgatgcccatccctcctgcattcctgatttctgagtgatggtttcagacacaaacctgcttgaccaccctccagtagctcttgctgacctagatccgaggttctcagctttggccccattgcgggaagcttggaaacgtcactcttgcccagggttacctgggtagtctggtttatagacgtgttaggtgttttaatttttttttttttttgagacaagattttgctctgtcacccaggctggagtgcagtggtacagtcatagctcactgcagcctcaacctcctgggttcaagcagcccacctacctcagcctcgaaagaagctgggaccacaggtgcacctcaccatacccagctaatcttttctttctttttgtttttttcttttctttcctcttcttttcttttcttttgttttctcttctctcttttctttcttcttcttcttttttttagacagagtcttgctgtgttgcccaggctggagtgccttggtgcaatcttggctcactgcaacttccgcctccctggttcaagtgcctctcttgcctcagcctcctgagtagctggaactacaggcacgcaccaccacgcctggctaatttttgtatttttagtagagacgggatttcactatgttggccaggatggtctcgaactcctgacgtcgtgatctgcccacctcggcttcccaaagtgctgggattacaggtgtgagccaccgcgcccagccttttttttttttttttttttaaattacagagtctcactctgtcaccaggctggagtgcagcgatgcaatcttggctcgctgcaacctctgccacccaggttcaagtgattcttctgcctcagcctccctcaggcgtgagctggcacgcccagccaaatttttcattttttgtagagacagggtctccctatgttgcccagtttagtcctgaactcctgagttcaagccatccacctgccttggcctggcaaagtcttgggtttataggcgggagccactgcatcccgctattaggaatttttaaaaagcccctcggagggtcttcatgtgtggctgagttgtcaagaatcattgttattttactagatattctgtttcttccctcctacatgagatttcccatgaccgcctctcggatgtgaatgtctatgccatggattacatttttcaaagagcattcagtttgttatttcatcttcagcgagcccttaagatatttctcatgggccttttgtagataaagacactggggtcagagagttcaggagcttgctggtgatcacatggtcagcatggggaaaaatgcatgtggacatgagttctgttggtggtgagacgtgggcacaggggttgctgggcttgggagttggtggctgcgtgtgtgggctgaacagagctccccaggcacggccttgtggaccttgagggatgcctgccttcaccactagtgtgacttgaaggggaggagaatgtcctgaatcagtgatgggcattttgatatggaagagaactcccttgaatcctggtggtgaacttagaccagtcactgaggcctctccagctcctcagggtctccgtgttctaggtatccatgtgtccttccatccatttatccatccatttatgcatccatgcatccatccagccatgcatcctccttttatccatccatccatcaacccatcctcccattcatttacccatccatccgttcgtccatccatccatccatcaacccatcctcccattcatttacccatccatccattcatccatgcatccatccatccatgcgtgcatccatccatccatttatccatccatccatccatccatccgtcgtcccattcctttatccatccgttaatgcacctgtccatccatccatccattctccattcatctttccatccatgcatcatccatgcatccatccttttagttcatccagccactcatcaattgatacatccatctgtccaccatccactcatctatccatccattcacccatcctttcatcaatttacccatctaccatccatccatttatccgttcacccattcatctatccatctgtccatccatccacctatctgttcatccatccatccattcatctatccatccatccacctactcacccacccacccatccatccacccacccaaccatccatccacccaaccatccatccatacctccatccgtctacccacccactcatccacttaactacccatccatccacttatccatgcattcatccatccatccacctacctactcacccacctaaactcatctatccactcaaccatccatccacctatccacccttacctccatccatccccttactgcccatctttccactcatcccatccaactacccatccatccacccagctgtccacccaaccatccacccactcactaatttatccactcacccacgcatgcatccatccatccatccatccacccacccatttacccacccacccatccatccacttacctgcctgtccatccaccctcccagtccatggctctttcatgtattccttcagccagcataggttgaagttaaatgtactattggtgctatttgctgtggtccctgttttttgttctctgctttggaggtaacaaccagggcatcaatttgggcataaaagcaccattgtggatggaaggcctggatgtctggaggcacagagcagggactacacttgttcagggggtcagagagagttctcccaggaggggccctccctggacactgagcttccaagaatgagcagaggaaaccaggtgtaaggaagaggaagggcctcttctcagcctggtagacaagcagtaagagtgatgatggggcagctgcagttcatctcagactagaggagctgcaggggccagatggtgggcaacctctgttgccactgctgaggagtgcagatttaagctcccctgaagggtttgacgcagacagctgtgcggggacgcttaacctgcctaaggcccgtctttgggtaacagcatgcagaacaggtgggaggggctggggctatttttggcagagcgtggataagtcagtggagatagaagagaaggcacaagctattttaggagatattgaggaagttaaaatctgtaacaggtccctgcctgcagagttgaccacacgtttgcatcacatgggtaggctttaaaatatagatgcctgcatctcaccttggaaagtttctgatttaattagcctgggcatcaggacttaggaaaaccccacagatgtgtgtaatttgctgctggagttgagaactggggtgcggagctgtgctccttaaactgtaatgtgcttacagatcacctctggtaatacttgtgagaaagcgcttcaggtgggctagggagaggatcacggagggcttcctggagaaggtgacattctcccagggccttgaggggtgaatagacattttccaggttcagaaagaaggaatgggctttcatggccaggtagaggatccaatgaggcagacgaggggcccaaattctgtgaccccctacccctaccccacccccaggatgcccctgtatcagtcccatggtgtaacaaccaaattcacaagatgctgcagaggggaagagattttaaattttctgagaaagacaatgatatattttggacaccatgagaaatactgttattaacttgttttaacctaggtacacgcaatcttcatcattcagtgattctgtatttgtgacttgcctgcttactaaaatgtatttgtcatccccacatcaatattcctggcatttaatttttttattttaaactttcattttaggttcggggatacatgtgaaagtttgtgacttaggtaaacatgtgtcatgaggttttgttgtacagattatttcatcactgtggtattaaacccaggacccaatagttaccctttatgttcttctccttaccctcggctattttgttcatgcacagaacggcaaaaaaattgaactttttttttttattttttttggatggagtctccctctttcgccaaggctggagtgcagtggcgtgatcttggctcactgtaacctccgcctcctgtgttcaagtgattctcctgcctcagcctcccgagtagctgggattacaggcatgggattacagccaccacgcctggctaatttttgtatttttagtagagacggggtttcaccgtgttggccaggctgctctcaaactcctggcctcaagtgattcacccgcctgggcttcccaaaatgctgggattacaggcgtgagccaccacacctggccagaattgagcttctcaatagcacatgttctcagctgaggttcaacaaagccagaccctgccttctcgggccagcgcgtactgtcaacagggttctttgcaaggtctatttggtgtcccgtgttttgtgttttcgtgctttttgtcagtgattttgcgctttcaaatatccccaagtcggtgctgacatgctacctagcgtccctaagtacaggaaagctggcatggtctcacggggaaaatacacatttgatgagcgtcatttaggcacgagttatagtgctgttggcttcgagatcaatgtgagtgactccacaatgtctattcactgcggtgtctttaaacagaaacccacataaaacgcgcttaggtagtgattggttcatgacctctgggaacgtagtcctgtatttacgtgggagcaatagttcactattcgctaattcagtgttcgctgagactttataaaacgtaactgctttgaataacaaagctgtaattaacaaaccgagctgttaagtgtgtgtgtgtgtgtgtgtgtgtgtgtgtgtgtgtgtgtgtgtgttggcctcacatcattttacagagacacacagggctctgtgaactgctaatagttgggaccggcggaggggttatttcaagctagtccaaaactgcagggcagagaccactttgaaaggagatcagcagtcggggagtggctgggatgaagttggaaaaagtgctgaggcccctaagtcagtttccggtgtttccacgttagccttggggggtgatcactcagtttcctgtagggatgggatctgggctggcatctgcctgtggaaggggtgacagggacggagagcagggaaccccgagcagccctgccttgctgttgtctgagcctcagaactcctgaaggcggggtccttcagcatcaccctggagtttgttaaaaatgcaggctcatgagcctcaccccagaccacagaacgaaaatgtctgggggtgagacccaggattccacgtctccccaggtccctcgcagggcgattctgagaactgccggtgtgaggcgtgctcagcccagcccaaacattcacaccattctttggcctcttgtaaaacttggcgtagctcaggggacgttcccagagttatggcacacgaacaaaagaaagtttcccacttcttaccaaacatattgtaaaattacaggaaagagcttgttctttcacgtctatacccttgtgccgtcgtcctagttaggatgaagccgagatgttaccttgtaccttaggccaccgcagacaaggaagtatatgcagtttaaccacctgcatataatctttttcttttttcttttctttctttttttttgagacaaagtctcattctatcacccaggctagtgtgcagtggcacagtctcggctcactgcaacctccatctgccaagttcaagagattcttgtgcctcagcctcccaagtagctggaactacaggtacacgccaccatgcccagctaatttagcagagatggggttttgccttgttggccaggctggtctcgaacccctgacctcagtgatctgcctgcctcaacctcccaaagtgttgggattacaggagtgagccaccatgccctgcctattttttggaggcagggtctctctctgttgcccaggctggagtgccgtggtgcagtgtcagctccctgcaatctcaacctccacaagcgcaggccatcctcccgcctcagcctcccaagtagctgggaccatgggagtgcgtcacaacacctgtctaatttttgcattttttgtagagacggggtttcatcatgttgcccaggctgctgttgaactcctgggctcaagcaatcctcccaccttggcctcccaaagtgttgggattataggcgtgagccactgtacccggccacctatgtataattttcaagctaagaagacagagagacgagtttaactattgctacagacatgaagcccttccctttccatagtttgctagcagagagtgtttccagggcccggcggccactatcacccactgcgttcatagctttccatggggtgaacagattgcgctggactcagcggttaaatctaaagtgtaggatgtttggtgaactcggagttccttgcacttgtctgtgatctggcacattgtgttttctgtactcagatatgcagtcactggcacacatcctgttactgacgggaagctggacccagcactggagtatttctgagactatgacactctggtgtattcctgaaactatttatgacactattaagctcttttctgtaattttacaatatgtttggtaagatctcagcgccagatttttttaaatgatgtgtttatttcttttaattgacaaatacacattgtatgtgtttatgcggttgcacatggtgtcttgatgtatgtatccatggtgagatggatttaaatatgcatgacctcacagactttgcagcacttttttgtgtgtggtgagaacacttattcagaatgggctcctttagtcgttttcaaatattcaagccattgttactaattgcagtcgccatggtgtctctgagctttcctgaagttatttgtcctgtctcatggacgctttgtgccctgtgaccgatcgtctgcccggtgttaaatgacacatcttgaaaaagaggacaatacttccagagcgattcggttttatagcaacagaaaagtaagggtgttttgaccatttgaataaaatagtaaaatgaaatgtatcagctgcctcctgctattcccacacaggaggacttccggtgcttgctccaatgtggaggcattttctcttgcagcattctgagctacaattatctctaggctggggacccttcccgaggccccccaaacctggaatgaaagtttttagggtcagaccatgtgactggttccactcgacctccaaaacgttaaaaagaaaaaaaaaaaaagagccgggcgcggtggctcacgcctgtcatcccagcactttgggaggccgaggcgggcggatcacgagttcaggagatcgagaccatcctggctaccacggtgaaacccagtctctactaaaaatacaaaaaaatcagccgggcgtggtggtgggcacctgtagtcccagctactcgggaggctgaggcagcagaatggtgtgaacccgggaggcatagcttgcagtgagccaaaatcgggccaccgcactccagcctgggtgacacagagacactctgtctcaaaaaaaggaaaaaacaaaaaacaaaaaacgctttgcctttgcttggcatcagaggactcagcagcaagtaaagagcacacacgtgccctctgcaccacctcctcctccttttctacaatgtcctgaaagtttcgtgtttagtgggctttggaaaagggtgtggaaaaccagcaggagcagatgagtactggagtggccagcagcaggtgtgaacaccctggggtgatgctggggctgagtgaattggacatttttcagcagggacacccaggccagtggcgggtcttcatcctcccacccttaatggagatgaacggcattattgagaaagctgcaggcacacacagagcactgcttaaatgatgtccctggctgctgctgttactatgtaatgattgtgttattcttatgaaaatctgaaagttacaggaatcttggaactgcctaattttttttaattaattaattaatttatttcgagacagagtctcactctgtcgcccaggctggagtgcagtggtgcgatctcggctcactgcaacctccacctcccgggttcaagcgattctcctgcctcagcctcccaagtaactgggactacgggcgtgcaccaccacgcctggctcatttttaattttatgtgaaacacctgaatgatgtgatgatggggtttaagataacccaagtgttcgggcgcggcggctcacatctgtaatccctgcactttgggaggccaaggcaggcagatcacttgatgcccggagtttgagaccagcctggccaacatggcgaaactccatctctactaaaaacacaagaattagctggatgtggtggcacatgcccatagtcccagctactggggaagctgaggaaggagaatcacttgaacccaggaggtggaggttgcagtgagttgagatcatgctactgtactctagcctgggcaacagagcaaaactctgcctcaaaagaaaagaaaagaaaagaaaaaaacagcaaaaagagaacccaggtactggctctcctcctgcgtttgccccggttgagtgcattcctgcattagtgcaagccttagtcacgttgcagaggaactcacacaccccatgtggcctcggggacttcactctgggttcgtcctgttttttgagttgcctggctgatgagaaaaagtaaacatggtttgaatcagtagaaagtgtcttgtcagactgactcatgccatctgtcgtccgttccgccttgccctgatgagccattaccctgtcccggaaacatctggagctttgagagggccgggtggaaacagcagtggcagttgggggttctgctgagggtctggtctctttgcaaatttgcagagaggctgaatgccgtaaacgtgcaacacaggcacctgagttctccaccaggctccttctctgagggcatggttgcagctcttgctgggtgggttttgttggtgttttcttcacatttgtagccccggaggtcgttttcaggagcaaaaaggcaagtgggggtgtctgctgtgagcccgcaatttcctgcctaccacctgaaagctcagggaatgtgatgaattgggagatgaatcctaggcaataaagagagcagtggactgagttaggagacgatagcttcatttacagagattcctttactgactgatgatcattgattgggtttgcttccccatgaggcttcaagccaatagcacgtgcatttgcatccatttatatacacctgggggactgccttcctcacacacacctgggggactgcctccctcacacacacctggggaactgcatcccttcacatacatagggaactgtgtccctcacacacctggaagattagcctcagaggtgtctgcagtaccagattccaccagggagtgaacgtctgattatgggtgattcagggtgcccacgtctatatgaaatcgagagcgggtcacctccctttcctccctactctctgtggggtggtgtttggggagctgtcttaagtgttagtcacccgaggagaaaatggtgagggtgggactctgtatctgggagaaaggagaccttggaggcaggggacagactgacagagccttgagcgatggaagctgaggtcgagggcccaaggtcgatgatagaatgcttggggttgtctctcctctggtgtccttgtccttcaggcatcctggagtgacattgaaattgtttcaattaaaaactgtagaaacagcacagagataagaatggaagacaagctccaagtgcggggctgaggcgagttctccaaggactagggctaagggcagagggtgggagaaggggagaagggcgtgaggggcatactgtgtcctttgccacccactctcagacttgttgtcttggacctccgtcggctgagcttggggtccggggagcagtgggtttggacactcagtggtgacgtcagccgtagtcctgaagcagaggggaagttggcaatccaggcttgcctgggggtgacactggtggcgggagggcctgtgccctcccctgtaactgggtttgtgtggggtccatgggggcattggggtcagtggaaggaacatgaagtgagccagagcatcgtcactgtggcctctgagggcaggtggagcaagaaaaggaggaagcttctaagtgacacctggtcccagctcagtggctatgaccagggaagtcatgtggaggaaaaggctggtggactctgagggtgatggaggaggatgggaggggcaagctaggctggggaggtggcaggccatggacacacaccagacagacacacatgtgcatgcacacatacacaggcacatacatgcatgcacactcatgccatgcatatatgcatgcatgcacacgtgtgcacccacacagcaagtcacatgtgcacgtgagcacacatgaaaacacacaagcacatgcacatactcctgcagtgcacatgcacacccatatatgcatgcacacaggtgtgtgctcagatagcaccctcacacatatgcacacaagcacacaggcaaacacgcagacacatgaacaaatgcacatatatattcatgcagtgcacttgtgcacatatacacatgcaaacaggtgtgcattcagcacactcacaatgcacatgaaaacacgtgtgcacacacatgcagtgcaatacatatatgcatgcacatgtgtgcccacaccatacacccacacatacgtgcaggagcacacacgtgcacacacagaaaccacatgaatgcatgagcacgcgtatatgaaatacacatgtacacatgagcacatccacacgcgcacatgcatgaacatagacacacacatgcatgtacatagacacgcacatgcatgtacatagacatgcacacgtatacccaggccctgcattggaaaaaatccaaaatgtggcttggttgcaaagagcacatgaagagctgttgaatgcagaggtgcccagcaagaagcatggacctaaacccgaaggtggttgggggaagcttggggacacctgggtgggcaaatggcccccctgaggcccagggacagatgcaaaaacccagcaagccaggagggtctttgaaaaaaaaaatgtgtaccacatgtgacatttcccatgtgagggaagcatcgagatcatactgtgttttccctgtgccctgcgattttgcagctgacatgccctttctgtggaaatatatagcagtcctcatgctaggattgcgtgttctgtgtcaggcagctgggcatgggagtgcagggtgtggggtggaacctgggaggagagttctagttttaccactgtgttccggccgtggggtgtcctggggaatggaggccacctcctgacactggagtttcctgggttctgctgtgagcgaggagtgggagaagacaagactctggtcttagaaaccttccgagtctcgtacgcccttgactgccgtttctgagtatttcctgaagcttgggaaggatgagtcactttaaggggattgtcctatgttgctttgttttgtttctttagtgacggtgtctatgatcatcttctgtttatgagggtgaaattacagaaataagaagggttacacttaaaataatatctgtactttactttcacgtgtggggtttttttttgtcattgctgctgcttttttttctttaacattctgacagttctgtctgcttattattaagtcttcctacctttctaaagagaatgtctttcttgctaaagaatacattatggactcttggaatctctttgttggggtggagggggtggggacttgccctgacttgctgggaatgcccatagggtttagaagtcacgtctaccgctgaggcactaacaaaggtaagccttcaaggaagcactgtcatttccggggaagagagttttgaggaaattgaaacagttacgaattgatctagcagtccctctactaatgtatctacatatgaagatatgtagagatgactttttttttttttttttttttgagatggagtctccctctgtcacccaggctggagtgcagtggcatgatctctgctcactgcaacctctacttcccggattcaagcgattttcctgcctcagcctcctgagtagctgggattacatgcgcatatcaccacgcctggccaatttttttgtatttatagtagagacggggtttcaccatgttggttgggctggtctcgaactcctgacctcgtgatcctctcaccttggcctcccaaagtgctgagattacaggtgtgagccaccgcacccggccccagagatgacttctaaaccttcagggtattcccagcaagtcagggcaagtctatatatatataatatatatatgtgtatatatatatttgtataaatatataattcgtatatatagtatgtatatatagtatatatagtatgtatgtatatggtgtgtatatatgtagtgtgtgtatacatagtatgtgtatatacagtatgtatgtatatagtatgtgtatatatagtatgtgtgtgtattatatatatatatagtatgtgtatgtgtgtatatatatatatgtttatttgggataaggaaaggaaatcagtatgtcaaagagacactcccctcccatgtttattgcagcaccattcggagtagccaagacatgcagtcaatggaagagcccatcaagggatgaatgcagaaagaaaatgtgctatatcaactctgtacattcactaaaagccattcatttgcacagtgagaataagtgcctttcatgctatgtaaactatgcctcaataaagctattaaatgaacaaagaaaatagggtatattcacaatggaatggtattcagctttaaaaaagaaggaggttggctgggtgcggtggctcatgcctgtcatcctagcactttgggaggctgaggcaggtggatcacctgaggtcaggagttcaagaccagcctggccaacatggtgaaaccccgtctctagtaaaaatacaaaaaattagctgggcatgatgggcgggcgcctatagtcccagctactcaggaggctgaggcaggagaattgcttgaacccaggaggcggaggttgtagtgagccaagatcatcgcactccagcttgggcaacagagtgagactctgtctcaaaaagaaaaaagaaggaagtcctgccatttgcaacaacatggatggaactggaggacatgatgttaagtgcagtaagccgagcacagaaagacaaataccgtctgacccaaacacgcttacgtggaatctaaaaccactgaactcacagaagcagagtggaatggcggtgaccaaggggttgggagtgaggggtgggggaaatggggaaatgatgggtaaagggtacaacatttccatcagataggaagggataagttcaggggtctactgtactcagggtgactgtggttagtaagaatgcgttgcatacttgaaaatgcctaagacagtagctttgaactgtttgcaccacaaataaataggcgaggtaagatgtaaataaagaaaaaaaatacttcaaaaaatacaattacagatttctatggaaacatatgaacatgagtgcatatatatatttatatgtgcgtgtgtctgtacctgccttatggtttattctggatcagtaggatcctcccttgctaccgtctaaagatctgccgcatgctgcaggaggagctgtaattgcatttatgatgtctggcaagtgtcctgttgtggaaacagccatttcagggctctgaggttgtggaaacgactccactctggttgccggcatggggcccacagagctgttccgagcgttttgtctactttctacttattgttgacacacacagaaacacacacgcagccatgagtacacacacacacagacatacaagcagacgtggacacacctacctgtatgtacatactcaaaacacaccttcacactatactcacctacccatacacacacgtgcacacaactacatgtgtgcacacaaacacatgcatacatgcacctatgcatatgcacacgtggaaacacacctgcacactacacacacctacacatacacacacaaacccacaaatgcacacacccacacaggcacaaacacacaaatgcacacacccacacatgcacaaacacacctacacacataaacatattgacacatgcacacatgcacatgaaaaacacatatacacactacatccgcctacacatacacacacaaacccacatatacatgcacctacacacatgcacacataacacctacacacatgcatacagaacccacacatacatgcatccataggcacacagaaacacacctacacactgtgcacacctacatatgcacacacaaacccacatgaacatgcactgacacatatgcacacaaaaaacacactacacacacagaaacccacaaaatacacctccacacttacacaaaacacgcctacacatatgcacatacacaaacccacacatacatgcacctgcctatatgcacccacaacacatacacatatgcacacacagaactcacctacacaccccatacatgcacacaaaacccacaaatacatacatgtgcactgcaaatgcccaaatatacatgcacactcacacacacatacccctgtgacatatgcatgcacgcttcatttatacatgcaggagcatagcctggtcgtttgcacctgttgtggaactggacacacttccggtgttcacagggctcctgcgggttgttcttggacccctcgccacccaccgccaggtgcttcctgacggttgagagatgttgtatgcctttggtgctgaggagtggggacgctggatgttgacgattatcctaactcttcctccagttgaccaaacagtccaagtcgacttttccaaattttcctgaatttggcttttcttcagtgcgccagagatggccagccacgttgaagtagcattgaaattgttgtaattaaagactgtagaaacagggtagcctatcaataattcagcatgccagtttcctcattccgtgggattccatgagatttttttttaatgcataatgcacgtgtctttctgggttgtctagtgtttctactatattttggtttgtaattacaggaaagttgccaataaaaaagggagaattttgttccccatgttgttttcagtacatattcaaaattgttattcatctgtttgaaaggaacgacctgttaagaataatacacaaaatgatcgtgtttttacactattttaatttctactaagcttgaaggtcatcatttatttaaaacctaggctaacatattcttacttttaggcatggaagtgaatatttagaatgagaagagaaatcacgcaccttgtaaatttttttaagttgctgttttaaatatcacaaaaagaaaaatcgcatatcttttttatctctataatattcaaatttatttttatttttcttgtttctaagttgactctttttttctctcttagatggtggtttcgatttatccgatgcccttcctggtgagtatcaacatcattttttaaaatcccgtcaatattttatgttaacatagtatatacaggcatatcccagccatttccagctaggttctagaccaccgcaataacaggagtcatagcaatttttggcttcccagtacatataaatgttatgtttactctcaactgtagtctattaagtatgcaatagcattacctctaaaaacagtatactccaattgaaaataccttattgctaaaaaatgcagatacagagacaggaagtggggcacgtgctgttggaaaaaatgatgccgagagtctggcttgccacagggttgctgcaggccttccgtttgtaaaacacacagtatttgcaaagcaccttaagacaaagtgcagtgaaggaggtccgcctgtatgtgtccacctgccttattataaaaactagactcatagatgacgaggaaaagcaagatgcccttgttaagataaatgaaccaccctggtggaataattcacagtcctgtgatggtcagaggccgagcaaaaacttgccaggtccttggggaggggtctagaggaggtgagcaaatggaggtccccaggagagaggggcatccagtgctggcatcctccctctcgaaatcggcacccgctgtctccatggggccactccttccttcttctgcagctcttcctgtctcccgctcctcacccagagccctcggtgaagggcatgggaaaaggaattgaaggaattccgtcttatcactctatcagcttctgggtcttgtcatccctttgtatttgttttccggggctgccataaaaaggtgccaccaactgggggcttaaaccacagggatttatcatcttccagacctggacaacagaagtctgagatcaaggtgtagacagacccatgctccctctaggggctctaggggagggtccttcctgcctcttgcggcttccgggagctccaggtgtccctggacttgtggccgcatcactccagtctctgcctccttctccgtggggcctcctcctctgtgtctgtgtctccttttctttgtcttacaaggatacttgtcattgggtttagggccactctactccaggattatctaatctcaagatccttctcttaagcacatctgcaaagaccctatttccaaataaagtctcattaccaggttttaggctttaggatgtagatatatcttttgcggggaccactgctcaatccactgcagttatatccagttctttttggtggctctaggggaggatccttcctgcttctcccagcttttgagggcttcacgtgtccctgtgcttgtggctgcatcactgtaggctctgcctttgtgaacgctggtctcttccctgtgtctccatgtatctaaatttccttcctataagggcaccagtcattaggacctatcctaatctattataacctcatcttaactgattacaactgcaaagaccctgtttccaagtaagatcacctattgaggtttggggtgggtgtggatcttggaggaatgcttttcaacccaggacagccctcttcattttttttttttttttttccgagatggagtctctctctgtcacccaggctggagtgcagtggcacgatctcggctcactgcaacctctgcctcccgggttcaagtgattctcctgcctctgcctcccgagtaactgggattacaggcatgcaccaccatgcctagctagtttttgtattttcagtacagacggggtttcataatgttggtcaggctggtttcgaactcctgaccttgtgatctgcccgccttggcctcccaaagtgctgggatgacaggcatgagccactgagcccagccaccctcttcacttttttatgttttacttttttttttctgagacactgtctcgctgtgttgctcaggttggagtgcagtgttgggatcttggctcactgcagccttgaccgtctgggctcaagcagtcctcccacctcagcctgctgagtagctgggactacaggcatgtgccacctcacctggtacagtgagcaacacggggtctcactgtgttgctcagattggagtgccacggtgggatcttgtctcactacagccttgaccatgtgggttcgagcaatcctcccacctcagcctcccaaagtgctgaggcgtgagaggattgcagacacgagccactgcacctcgccagcttttaattttatgtcctgtggtgcagtgcagatggtttgagcggaaacagtgctgatggggatcatctctttcctgaccacctaccccttcttggcccttgggaacaaccattccctgcagtgggaggtgcccttagtcttacagcctccacctgatttgcctgattggcttccattctcagagggggcagcctaggcagaggcctgacggggccaaaagtgtgtttcatatgagaaatgtgaacagcctttcagccatcaatccggtgtctctccttctcatgcatagatctcgggctctgaaaagggcagtttttctcctaactttgccattctcctgccttcctggcttatgtctcagtcatagtcccattcaacgtcaagaagtggagaagggctgggcacggtggctcaagcctgtcatcccagcactttgggaggacgaggtgggtggatcacctgaggtcaggagttcgagaccaacctggccaacgtggtgaaaccccatctctgctaaaaatacaaaaaattagccgggagtgatggcatgcacctgtaagcccagctactcgggaggctgaggcaggagaatcgcttgaacccaggaggcagaggttgtggtgaacggagaccacaccattgcactccagcttgggtaacagagcaagacttggtctcaaaaaaaaaaaaaaaagaagtggagaaggggctcctggtctctgtggaaaccatggccggtagcagcctctgtgtctgtcttctgggctcaagagtcgttgtataaacctcagctcggtgtgggcaggtgagaaaaaacaatgctaaaaacattctccgactgtttccaagaaaatgaaacatccttaaccacaaaagagttgacacttgttttcccagctgcaacttttactaactgaaatatcttatctctttagacaatgaaaacaagaaacccactgcaatccccaagaaacccagtgctggtgagaagggcttcttcctagtatgcaaagaaaaagagcaaatcattttctcggacagcaggacgggacttaggcaactagaaagaagacagaagtgatttgagtgctccggctggagtctggttaatagttaatactggaattgtgttatgatgttacatttcatgtagtgattccagtaaaagaatggttgctgatgtgaaatgtttcggggccatttggacaacatctctgtgtgcttttattctaagggtctgagttactctgtctttagattttcttccctttttttttttttttttttttgagatggcgtttcattcttgtctcccaggctggagtgcagtggtgtgatcttggctcactgcaacctccacctcccgggttcagtgattctcctgcctcagatgcctcagtagctgggactgcaggcaccagccaccacacctggttaattgttgtatttttagtcgagacgaggtttcactatgtcggccaggctggtcttgaactcctgacttcaggcaatctgcctcccaaagtgctgggattacagcggtgagccaccatgcacggcctgtgtctttagatttcaacttcctaggagagagagcatttggtgctgagatctcccccatgatgaccaacaagtgaactcatctctcaacctgtgggcacacacctcatttgttctcagtgcttgctgttctttctttctttttttttttttttttgagacggagtctcgctctgtcgcccaggctggagtgcagtggcgcaatctcggctcactgcaagctccgcttcctgggttcacaccattcttctgcctcagcctcccaagtagctgggactacaggcagcggccaccacgcccagctaatttttttgtatttttagtagagacggggtttcaccatgttagccaggatggtctcgatctcctgaccttgtgatccacgcgccttggcctcccaaagtgctgggattacgggcatgagccaccacacccagccctcaatgctgttctttcaaacaaaagtcagaaacgaggtccacgtgatggaattgcccaagggtcaaccccactggcggataaacagagtaaaaatgatgctaaaacttatggcatcagtgtcttacagctaagacactgtcttgtcttagcacttctgagttttctaatataaaacattaatagctccacttcattattgggcttcctgtctagagtgtcagctcatgagcaaagggaccctgtgtccccagatccttgaactaagcaatcatgcagatagcaccaatgagtaggtgttgagcgtctgaatttatactatcatagtctccttgaggaagggactggaaattcccatatgtcactcaggatggctcagtacatgctgttgggtggatgccagcaaccattcctccatcttagttgggttttcaaaatcattcttcatactagaagacaagatctgaggccatggtgaactgtcacatcagttgcggagcacatatgggttgctagagccatgttttagacaccctctagcctaaatctgatcacagtcatctgtccccttctcttagggtctacctttccaaagttgttagggacctgggaggagaggatgatgggatggggagtcaacaggagaaaatcatgtgcaggcagaattggaatttcaacttggtccaggcaacacaattcatttataaattactttatttctctctctctctccccactgcctctcctctgagagcttctctcctagctttttatctgtctctgtctctctgttttttcctctttttatctgagagaatagtgatgtaaaaatggtcaggaattcactttttctaatgagatcctggtcaagctgatattcagaaaagtatttaggaatgtggggccgtggtgtgtttttgatctgttcacgaggtcattccttcctcgtttctctctggaatttggtattaactgctctttcccctcttttaggggatgactttgacttaggagatgctgttgttgatggagaaaatggtgagtattttcctttaatctcttctgctgctgatctgcttattatcacccaattatgatcatttcagagagaattctcccatttaaattataaagggaaccagttttcacagtggaaacctagggaataggtgtgtcggtttgttcttgctgttgtcgttgggtttttctttacaaccagtacgtgtgcttttattttaaaactcttacagtctttggaaggacatgagacaaatgtgcctaccctggccagggctggcttcaccagcatgtgacctgtgcagtggcacaggaccccatggcatgttggtttggcatgggaaccatactggtttactgctctgttgccgccatcttggaatacttaagaaaatttgaaaaatgggtcccacctttttattttggccctagaaattctgtagctggtgtggacacccgctttaatttttattaaacatagttgacattaagaactgtggctgaaagttgatgggaggaaactggcaggagactgtgtgtgtacaggtatccccaccaggacaaaggccaaggtccaatttctgttcagggaaccatctgtgtgtaaactgatgtttcattttctttactgcaaggcacttaaaattgcaactctcatctttcacaaacagacgacccacgaccaccgaacccacccaaaccgatgccaaatccaaaccccaaccaccctagttcctccggtaagagtctctgaccctgtgggatgtcttcatgttgttcagaattcagcgatatttatgtcagctgagaggaggtgatttcagatgagtgtgtgcttactgttgactgcctgtgcagtgtaatgcccatgttcatgtaatggaaaatgtacatttcaaaaatatatatttagcttggattttatttttagtttgcttttttttttttttttttttttgagacagagtcttgttctgtcacccaggctggagtgcagtggtgccatcttggctcactgcaacctccacctactgggttcaagtgattctcctgcatcagcctcctgagtagctggaattacaggcacacactgccatgcccggctaatttttgtatttttagtagagacagggttttgccatgttggccaggctggtcttgaactcctgacctcaagtgatccacccaccttggcctcccaaaagtgctgggatgacaggtgtgagccactgtgcctggactagtttgctacttttgtttccaagttccatcttatggaacttctaaaaaattgcatacaataatttaaatgtagacttgataaagagaaaagtattggcatacacattccttgtggagaagctagtgtgttttaaatctttctgcccttaaatatttaagtcagtttttctgacatatcacagcattttcagcgtaattcgaatagcaccagttttttttttttagctgaatggttgtcgaaagtttatatgtttaggtttttttgtttacatatttaatttttaacacagaagaatattaatgatgtccatatcttgttgacattttgatggctatttgtgctagtattttatatatcttttttttttcttttttgagacagggtctcactctgttgtccaggctagagtacagtgctgtgatcatattaaacataagagcataccacagcctccaactcctgggctagagagatccccctgcctcagcctttcaagtagctggggctacaggcacacagcatcgtgaccagttagttttttcattttttgtagaggtggggtctcagtatgttgcccaggctggtctgaaactcctggcctcaagcagtcctcttgcctcagcatcccaaatctctgagattacaggcacgagtcacctcacccagcctatatattaatctaaatgaaataaattttaaataaagttccaagtcttttgtttgtactgcattgtaacattactttttgcttactgatagtccatgaacattttttcatgtcatgtaatcatttctatcgtatgagttttactgataatcatgtactattacatactacatatataattatattcttcctgtaactaatccctaattctgaaaatgttatgtttcttctggcattttagaattatgaattaacaaagcaaatctgagtcaactccatgcgctatttttattcctttgaagacatttctagcattcaaatagtttagatcaacgtatatgagtactttcgtagcttttgacctggttgttaatttgctgcagatttttaccaatttattttgatgccaggggtgtgtgcaaatgtccctgtcttcacaccatctccaatattagttatcacctaggaaacctttgcaaatagtgtgaaattttctatcaactttctcctggtttcatgactttacttttaaaattaaaaaaaaaaaacaaacctgcatcaattggccgtggatacttcttattttgtgtattgtatgctttgccttttattcttacattctgatatgacattattgatttataagccttcttcatttatttacagacataaatattgccagcatgcaatattatgctcacgtttttccactttatttatggttttttgttttgttttgttttgagactgagtttagctcttcttgcccaggctggagtgcagtggtgccatcttggctcactgcaacctccacctccagggttcaagtgattctcctgcctcagcctcccgagtagctgggattacatgtgcctgtcaccacatccagctaatttttatattcttagtggagatggggtttcaccatgttgatgaacaggccggttttcatgagtttttcctttattctaagacatgaagacccttggaggagttccaggttgacaggtgatgctgtattttctttcctaggtagcttttcagatgctgaccttgcggatggcgtttcaggtggagaaggtacagttatcttgttttctgtctcttttctctctccatcccatgatgcccacctgctctgtagaatcactacagggtctaaactgtcagctctctgtgaactcacagtgaaatgttcagccatctctgtgggaactccgcctgtttgctgaggcttcaaggatgtgggaagtaaaggctgccccgtagaggttcggtcctcggagaagagttcagggcccaggcagctgccccacttttctgagggacagggcgtgatgaatgggcccttgtcaccacctcctcacccatccgttcacctgtgtgttcttgcaaataactagtgttgtttcagcttcattttattaggctgttttctgtaatttaaggaatgtgaatattaaagccctgagaatagtgataatgcctgggagtatgcgttctcagagtacccctagagtgtaacaggcagcacctcagctctgtagctgtgtaacatgcacccttagagtgtaataggcaggaccccagctctgtagctgggtaacatgtacccccgtagagtgtaagaagcaggaccccagcctcttcacggtcctggctgtgaatttttccttgaccccaaaccttcccattgcagacgttgtttttgtcttgcaggaaaaggaggcagtgatggtggaggcagccacaggaaagaaggggaagagggtaggtgcacctggcttctgtcttcttgtctctcccacgtggtgttgagaaggggaagcagaatgtctgagagctggcggactgcactggcattggcctcctaaagctactggcaggaggcacgggtgttctgtgccaagtgctcccaagtgatgtagctgcagaggtcccccagcaaaccagccctgctccgggtgcccacgtgacgcggattttatgtttggtcacctgcccacgatgccctggctggcgacccgacccctacatcacgcttcgccttgtccttgtgtttacaaaagctcctacactcaccctaacgatcagaggcttgtgacgcagtatcctcggttgcgcttggcccttgagaacgtcagtaaccaggtgggaggtgggaatgtggatcgcttccaccctggctgtaacaggcattgtgttctccatggaagtgccggtgatgtatctcctgtctcctttttcataaccttttcccttagatgggacaagaaaataatgacagacagaattccttttaaaactgtaaagaaaacaaaatgaggtaagaaagagaaacagagaagtagggaggaagaaaaaagggaaggagggaaggaaagaaggaaggagggatggagagaaggaaggaaggagggaagaagggaaggaaggaagggaggaaaagtgggtagtctacccttgttttaggtatttattatttttatgggtacagttcttgaattctaggctttctttgaagaggtagtaatctgtagccctcacctaggactacaaggtcattttttaaaaaatagctaagaaaacacatgtctggcatgtttatctcaggccatcgttcttggccttctagagagttaatgtctactatgtcacttcatcagggaggggtagttaagcttgaaaaatctttctatgacatgactgtgtcctgcacatattaaaaactggccgagtgaacacaccaccgacaggccatgtttggagccagtgtttttgctgaaagtcagacaattctccttccccgtcgtggagggcggagaagattctatctggagaagggtcctctgaagctcacatctggcatttggaatgaataatctcttcaatggccaggcacgctggctcatgcctgtcatcccagaactctgggaggctgaggcgggaggattgcttgaggccaagagttcgaaaccagcctggccaacatggtgaaaccccttttctacaaaaaatacaaaaattaggccaggtgtggtggctcacacctgtaatcctagcacttcgggaggccaaggtgggtggatcacttgaggtcaggagttcgagaccagcctggccaagatggtgaaaccccatctctacaaaaaatacaaaaattagctgggcgtgtgccatgcacctgtagtcctagctactcgggaggcacaagaattgcttgaacccgggaagcagaggctgcagtgagctgaaatcgtgccactgcactccagcctgggtgacaaagtaagactgcatttcaaaaaaaaaaaaaaactagccaggggtggtggcacacacctgtaatcccagctacttgggaggctgaggcaggagaatagcttgaacccgggacgcagaggttgcagtgagccgagatcgcaccactgcactccagcctgggcaacagagcaagactctgtctccccgccaaaaaaaaaagaattattgctggaataacataaaaaaaaaaaaaaaggctgagtgtggtggctcatgcgtgtaatcccagcattttgggaggcctaggcagcaggcaggttgctttaggctgggagttcgagatcagactgggcaacatagcaagaccccaattctataaaaccacagtaattaaccaggcatggtggtgcacacctgtagtcccagctactcggaaggctgaagtgggaggatctcatgagcccaggagtttgagattgcagtgagctgtgattacatcattgcactccagcctgtttgacagagcaagaacccatctcaaaataatacacaataataataattaattaaatagagatagatttaaaatgtctgcattgaaacccaaagctatcttcaaggggtgaaaaaggagcattctaacgatacaaaacgcattggcaaatgccccaagcattgcaggtctttgcttctttatcttctgcccctgcctgggctccttcctccaggtttgatgtccagctctctctttcttttttgttttgttttgttttgagatggtgaattgctctgtcgcccaggctggagtgcagcggcacaatctcggctcactgcaacctctgcctcccaggttcaagcgattctctggactcagcctcctgagtagctgggattaaaggcacccacccttactcccggctaatttttgtatttttcgtagagacgggttttaccatgttgaccaggctggtctcaaactcctgacctcaggcgattcacctgcctcggcctcccaaagtgctgggattacaggcgtgagccaccacgcccagccccagctctctttccatctgtctttgtctttttttgtctctgccttggttctgctgagcttctgcccgtacctcgctggcctctcttcatgtctcttttctcctgctccactccctccatggtctgaccaggtctgcccagcacgtgcgatgggagattgtgccttgctttgccttcctgtgtatcattctcggcatgcttcctttgcaaatcggtcagctcaggcgtctgagatgttctgaggatcttggtgctctcagactgactgtctctgccagccactgccccctgggatcttctctgcaccgtgcgtgtctcaatcacgatgctgtgtgcttcctcctgcagccgacgccccaggcgtgatccccgggattgtgggggctgtcgtggtcgccgtggctggagccatctctagcttcattgcttaccagaaaaagaagctatgcttcaaagaaaatggtaagtctcagtccgccggtgcctctccttcatgccttgctgattggaaaactgtgctttctttaaaaggcagaaaccaaactcgggctggcacgaaacaggtgcacgatggctgatggttcgtgaaactgctaaaattctggaatcgaaccttctggctttgatttcagggctgttctgccttgtgttttgttgtgtgaaagtttacaagttccccactgctgcagtgcttgggttgtttacgtctaccaagtgggaaatggttggtacatatgccgcggaattgttgctggggttagagacagtcctgcaggaaagccgctacaagttaccctgcagagagcaaaggtggaagacacttagctctgatcattcctgccctgttatttacaaccgatgtcatcatcaggaggagagccgtgaccagggggccgccacggtcctttctccactgagagttaagttaaaagccggcacaaggccggacatggtggctcacacctgtaatcccagcactttgggaggccgagacgggcggatcacgaggtcaggaggagatcgagaccatcctgggtaacatggtgaaaccccgtctctactaaaaatacaaaaaattagccgggcatggtggcgggcgtctgtagtcccagctactcggaaggctgaggcaggagaatggtgtgaacctgggaggcagagcttgcagtgagctgagatcatgtgactgcactccagcctgggcgacagagtgagactccgtctcaaaaaacaaaacaaaacaaaaaccagcacagcggattccctttctgttagtaccgaaaacccacaggcacccaggacctgggaagtttcttggatcgggactaaaatttacaggggaattaggaggaggacgtactcaccattgcaatcctcctaggtcagctggcaggctctttgggaccttgtattgggatccgccgtgaagctgggaagtaagccctgctatttggaacacagctaacgtgcatgcatcactgggcacttacatttagctcttgccttccctcttgcatgaccaagcattgtggtttgcaggaatcccatcgaccgggaacagctactcttattttttatttcttgagacagagtttcgctctgttgcccaggctggagtgcagtggcgcaatctcagctcactgcagtctccaccccacaggttcaagtgattctcctgcctcagcctcctgagtagctgggattataggcacccgccaccacgcccggctaatttctgtatttttagtagagatggggtctcaccatgttggccaggctggtctccaactcctcacctcaagtgatccacccgcctcggcctcccaaagtcttgggattacaggcgtgaggcaccacacctggccaacagctactgttttatggaggagcccctggggtccctcacgcctctgggtgtctgaacttctcaccctacttagatcttaagtccttattcattcttggtcactgatgtcattcactcaaagcactgcctcctgaagattttagagggattcctagaacatttgaatagatgctggtgtggacaaagttagactgtaggggtggagtttccccgtaatctcccatcattccagcatttgacatccacaaacattatttagagcgtgaaatggagagtcctaaacagctttcggatctcaagactttaaatgagctgctcgtgtttatttccccgttcttgctgtggggttttgggcagtgcgtggaagacagttgcctcctacctggtgggcagacgagtgggaaatggtgtttggttgtttcttttttttttttttttttttttgagatggagtctcactctgtcacccaggctggaatgcaatggctccatcttggctcactgcaacctccacctcccgggttctcctgcctcagcctcccgagtagctgggattacagatgtgcaccaccacgcacagctaatttttgtttttttagtagagatggagtttcgtcatgttggtcaggctggtctcgaactcctgaccttggatgatccgcctgccttgacctcccaaagtgttgggattgcaggcgtgagccaccgtgcccagctggtgtttggttgattgaatggcagttttgagcgggacccaaatggacagatgaccacattcaaggagatgcctgtaagagacgtacgattagaatcacgttggaaaaaagcaaacagcataacattcttctcccctcttgcttcttctagaagtagcggaggggttaaaacagtagggactcaatggaagggaatttttgtttgcttttcaatgacatttctttttcttttctgaaactgttcaactcacagcataatattcaaccaggaggtaaggaaggcttgtttgccaggacaggatgcgtaatattctagatgttgtatttcaaactctctggcttttttttttttttttttttgagacggagtctcgctctatcgcccagaatggagggcagtggtgcaatcttggctcactgcaacctcgcgggttcaagcaattctcctgcctcagcctccgaagtaactggaattacaggtgtgcatcaccacacccggctaatttttgtatttttagtagagatgggggttcaccatgttggacacactggtctcgaactcgtgacctcaggtggttcccccccgcaatcttggcctcccaaagtgttgggattataggcgtgagtcaaagcacccggcctcttttttagaatcccagacaattgttgaacacttttgcattaaactacaaagtctctgattgatgattctctgaaaatctttaggtcaacccaaattggattcatgagttgcaaaggatgtttattaccttgtgcgtgcagacgtaggaacttttgggatcttgtaagcctatttcatattcacatcctgtattagtccgttttcacactgctatgaagaactgcctaagactggataattcatgaaggaaagaggattcattgattcacagttcagcatggctggggaggcctcaggaaacttaacaatcatggcagaaggggacgcaaggcaccatcccattatcacgagaacagcatgggggaaccttcgctatggttcagtgaccccaacctggtctctccctggacacatggggattatgggaattacaatttaagatgagatttgggtggggacacagaggctcaccatatcacatctgaagacacacaaacttgggaaagcacccaggaggcttaatagacttgattttgtcaaaaattttgaaatagaattgggaaaaggaaaaacaacttttcctctaccttatccgccccgccacccctgggtcttggtcttgggtggaagcattatctttttttattgcaggaggtggggcaggcatgaacaatgaaagctctcactgggtagaaacaattttcctagattcttcaagaacaaaagcaaatatgtcctggcgaggtggccgacacctgtaatcccagtgctttgggagtccaaggaaagaggattgcttgagcccaggagttcaagatcagcctgggcaacatagtgaaacctcatctctacaaaaaatgtaaaaaattagctgggcgtgcttgcgcctgcctgtggtcccaactactctggaggccgaggtgtgaggattgcttgagcccaggaattggaggctgcagtaagccatgattgcaccactgcactccagcctggacgacagacagagaccctgtctctagatataaaaataaaaatacctttttttttttttttgagacggagtctcactctgtcacccaggctggagtgcaatggcgtgatctcggctcactgcagcctctgcctcccgggttcaagcgactctcctgcctcagcttcccgagcagctgggactacaggcgcgtgccaccacgtccagctaatttttcatatttttagtagagacggagttttgccgtgttagccaggatggtcttgatctcctgacctcatgatccacctgccttggcctcccaaagtgctagaattacaggcatgagccaccgtgcccggcccccaaaataattttttttaaaaaagcatcctttctgaagaattggctcaggggagtccaagattcactttatactaatgagatgctaggctaattttcttctaatattttctataagtctcttattctgatgccaaattaacagaaggtccaactttcaattcctggtttgctttctagttatcctgggattgattttcttggccttttgtaaatgcacaaagcaaagggccaaaaagaaaataaaataaagtataacaaagagaagcaagagatggtgaaaccccgtctctactaaaaatacaagaattagctgtgcgtgatggtgggcacctgtaatatcccagctacttgggaggctgaggcagggaattgcttgaacccgggaggcagaggttgcagtgagccaagattgtgccaccacactccagcctggacaacagagtgagactctgtctcaaaaaaaaaaaaaaaaaaagagaaagaaaacaaaaacaaggcactcttctataaataccaagaccctacctcaaaagaggacctttccaactgcatccactcacagcttggtttttatacctgaattataaaatgagtttaatatttatctcagtgacatgattttgttagtagacatggaattgtgatgttggatcgagttatccggaagacgaaagatgtcagagccctcagcctctggggcaggattttgctttatgggttcgatttccgggatggtgattttgagatctggcaaccccataggttcatggggagcttggagatttcataagaaggatgtgagtatagcatgccctggtccttcaagaaaccatgggccaggcgcggtggcttacgcctgtaatcccagcactttgggaggccaaggcgggtggatcacctgaggtcaggagtttgagaccagcctggccaacatggtgaaaccctggctctactaaaaatacaaaaattagccaggcatggtggtgcacacatgtatttccaggtactcgggaggctgaggcaggagaatcgcttgaacccaggaggcagagttgcagtgagccgagatcgagccactgcactccagcctggggacaagagcgagactttgtctcaaaaaagaaaaaagaaaagaaaaaccatgcccagttttggggatactgttattctaccagacaggctcattttccgggactgtgtcattgcattgaaatctgtggtgtttgttaaatttgtattaaaatgagtcccaggcgagtgagtagacataggtgagtcttcggcatctttccaacaaggagatgcctttatcaaatcctgtgacttgatatagatttactgagaagctttgcagtgttatattttggggttcacggattagaaactccttgtggaatcagatggctctgtctgttataggttggtgcaaaaataactgcggtttatgccattaaaagtaatagcaacatagcaagacctcgtgtctacaaaaaacgtaaaaaaaaaaaaattagctgagtgtggtggctcccagctaattttttacctttttttgtagagacagagtcttgctatgttgccattacttttaatggcaaaaaccacaattacttttgcaccagcctccgttcctcccttcctacagatttgagtttgtggtgcttgggcttctcctggtttttgtccatgtgatacgaaggggcctgttgaagctgcttctctcatgcactcggggtctgtgacttcgcatctgggtgtgttggcttcgcgggggacctggctcagaccactaaccacacggagcctgaccacttcccacagagcccagcttccgtggctggcaaggggtgttcaggatgctgtcctttggctgtggtggctggtcctactgctctgtttgccagggtcctgggctcacagtgggtttcttgaggctttggcaagatgggcgattggctctccctgtctccttctttctctttcttcttctctgcctttcttccttccctcctcctttctttccccctccctccttcttttctctcttccttccctgcttttctctttcttcctttgccctcagttctccctctctctctcttttcattctttcttgaactctccctctttcttcctccctccctcccttcttcttttcctccttttcctttttctctcttccttttctctatctcttcctttcttccttctcttttcttcttatgtacctctttcttttttctctcttctttccttccttcctttctttccatccctccctccttctttccttttcccctctccatcccttcctcctttccttccttcctttctttttttcctctctattctttgtctctcttcatccatctctcctgttcttacatgcctcttttcttccttccttctttcttctctccctccttcccttctttccttccttccttcccttcctccttccctctctccttcccttcctccctccctccctcatttccttcctccctgcttcacttcttcctccctcccttcctccatacctccctgcttccttttttccaacctccttccctcctcgttccttccctctttctgccttcctcccttccttcctcccatcccttcttcctgcttccctcctgctctccctgttccctgcctccctccctgccttcctctgtctctcccttcctccactccttaattttggtttccacttcccactctcacactttgagcctctatcccattacttccttgctcagagcagctctttctaacacctccctgctgctgggagccccagcgcacagcaaaagcagacccagcaccagtttactttttgtattattattttttatcgttttcaaccttccatttcagatggctgaagacctaggggtgagcagagaacccagcccaggcctgcggagcgtcctgaccgtaatcgttttatctgctaagacatagccttaaagcaaacccttccatctgccgctcccctcgccctgctggcaaattcccaccacgatgggattctcaatcacatggcggattctctgccttcagttccatatgcttttgcctttctggatgcacagaagctcattatagcaaatcatatttctgcataagagcttcagaaaatgaagagaaatgcagatattttcttttaaacatgaatctaacagaaacagggcagtgacttccatgttttaatgagttttgtccctaagtccatccctgccaagggaacaaactggggcccagggtggccaccctcttccctgcagtgtcctaggttaagctcactcacgtcctaaggatttgaccttccaggtcatgcatggatttttaaatcttcaacgtttttggccgttgacttgcatttctcactgcacttcctatgaagcagttcttaactctttctgtgatcagtgttccaaacaggtacacaccttggttcctagaaaaacaaaattcatacgttgaggaatcacctaaacatctcctgatcttcacactgtaaggcgtgttgggaattggtgggtggtcaggtccctattcacacatttgagcacggagcctctgcggccgtcttccttggattctctcatatccctgaaaaacacaaattgtacctggattttccttctgtttccaaagtccaccaacttgttcttcaatgtaattgattttaacttgttttctttcttttacttttcttatttttttctttcttttcatttttttcttatttcttttccttctatttattttacttttcttatttgttatatgttatttctttttcttttcttacttttcttcttttttcatttttcttttttaaattggagtctcactctgttgcccaggctggagtgcagtggtgcaatcttggctcactgcagcctccacctcctgggttcaagcgattctcctgcctcagcctcccgagtagctgggactacaggcacacaccaccacacccagctaatttttgtatttttagtagagacggggtttctccatgttggccaggctgatctcgaacttctgacttcaggtgatctgcctgcctcaaccttccaaagtgctgggattacaggtgtgagccactgtgcctggccctttttcttttttctttttttttttctcttatttcttttttcttatttgttttcctttttgctttttctttttatcttatttcttttacttatttttcttttttttacttttatttcttctccgtttttcctcattcttttcctcttatttctttgacttttctgatttctttttttttcttattttcctttttttttcatattccttttaattttttcttacttcttttacttttcttatttgccctcttgtggaaatgaggcacagcctcccttatggttgagccgtagttctagctgagcacggatggtttgatcctcctgtgttggggcactgtatggtgtgagggcacaaaaccttgacccacatgggtctggtcaccttctcacagaggtcacctttacagccccccaactctttgaaggatgtgtcccaaggtgtctcaagtctgatgcaatgaaagctgccccccattgaccacaggactgagtccagaatgtcctgcgtgtttcccagagtgtctgtcctaacaccgcttaaagattagccactgctagacagtgatcctcaggtatatggtctcaggattggccccaagcacacggtgtgtgtgtgtgtataaatatatcttcacaaagcataggtacccattaaagccatattgctttgctgaatggttctaatagctacagatgatttctagcctgaaagaaaagcaccacgaattgtttgaagttgacttgtcagatgtggcatgcttggtctaagttttgacaggaagggtatgtgggtaggggtgtacggagcatctcatgagaccagttctcctcctgagaggtccgtgatgttggaactgttgccccagatggactttgcccttgtgagactttatacttttcaatgcagtttttccctctttaaaactcgccagcttttatgtagtgttttataaaattacaggaataaaaagaatatcttttatgctttttaaccaatgaggggagagggagaaattatttgtcctctgaaatgaatgcaggttttcaatttctagccaggacagtttgctgcaaaatgcacccgtgttgacaacttgtgactggcagaacaaatgacatttgtggtgaacattttcggatcatttcgaatgttcttctcttcagggggttttcctctctttttcttaaatcaaagaatttggccctttatgtgggagtcatttagtggttagggagaacagttgaaactgtggagttcacgtagcgtaaactggcgaggctgtctctgctgctgtcattaaaagttacgctgctggcttggcacggtggttcacacctgtaatcccagcattttgggaggccgaggtgggcagatcacgaagtcaggagatcgagaccatcctggctaacatggtgaaaccccgtctctactaaaaatacaaaaaattagctgggcatggtggcgggcgcctgtagtcccagctactcgggaggctgaggcaagagaatggcgtgaaccctggaggcggaggttgcagtgagccgagatcgcgccactgcgttccagcctgggcgacagagcaagactctgtctcaaaaaaaaaaaaaaaagaaaagaaaaagaaaagttacgctgctgcaccatacaaacgtgttcctttatgaaggcatttgaaccacagatggggccgttttacaaatagcacggtctttgtgagggggaaacgcatggccacagattcgatgagcttctgctgcttccctttgtgttgaaaacgtgggtgttccttcacaccaacactggaaataaataaatacctattgatctgtgcatctcttacgcgtttccaattctgttggcttatgctgtgggtcagaaaagaagcgacaccgacaacatttggggacttgaccctgtttgcattgcggcatgtttgaaacattttttaatggaaatttgggaatagagggccgggcgtggtggctcaggcctgtaatcccagtactttgagaggccgaggtgggcggatcacaaggtcaggagatcaagaccatcctggctaacacggtggaaccccatctctactaaaaatacaaaaaattagccaggcgtggtggtgcatgcctgaaatcccagctactcaggaggctgaggcaggagaattgcttgaacccgggaggcggaggttgcagtgagctgatatcgcgccactgcactccagcctgggcgacagagcgagactctgtctcaaagaaataataataataataaataaataaataaataaataaatttgggaatggaaacaagactgggaaaaaatgctggaggaggaagaaaaccgggtacacaagacgccttggctgtcttgtcctttgatggctggggaagctcttagtgctcggagtcctcactcacctctctgcattctgagggaggtagaaggggggacaggagagccaattcaacctgagaaggatgattggtggaggtgggtaaaggaagaaagtcccctttccctaggtactgaaaagatgctaatctgctgagattctctgtatttatttttatttattttaatttttattttgagacagtcttgctctgtcacccacgctggagtgcagtgccacgatctcagctcactgcaacctccacctcttgggttcaaatgattctcctgtctcagcctcccaagtagcggggactacaggtgcacgccaccacgcccagctaatttttgtatttttaatagagacggggtttcaccatgttggccaggatgggctcgatctcttgacctcgtgatccgcccgcctggcctcccaaagtggtgggattacaggtgtgagccaccatgcccagcctctgcatttatttttatttatttatttttatttttattttgagacagtcttgccctgtcacccaggctggagtgcaatagtgtgatctcggctcactgcaacctccacctcctgggttcaaacgatcctcctgcctcagcctcccgagtagctgggagtataggtgcacgccaccacgcccagttaacttttgtattttttagtagagacggggtttcaccatgttggccaggctggtctcgaactcctgacctcaagtgatccacctgcctcagcctcccaaagtgctgggattacaggcgtgagtcaccacgcccagccgtctgcatttgtttgatgagtttgggggcagttataaataagaatcttattttcacagatgcacgtactttttttttttttatagaaagagcttccatgtgcgtgttcctcagtgtttagggagaagaaagcaacccttaaaatagaggaaaatgaagctgcttggattaccctgttgaagttcatctctgcctgtgccatgcatgaaaaaatactggcaaagtcttcacttacatgagtgttagactccatgttcccagtgggtctcggggttcagaactgagtgctctcatccaagcaataggagcgtcgacctcaggaaagcccaagtgttttgtgtgtattttgaggagtgggttatctgttgcactgagcctctctgtgtattttcttcttcttttcagcagaacaaggggaggtggacatggagagccaccggaatgccaacgcagagccagctggtaagaaggacggggaacgatggcttgcacacgtggccagtgttcccattttatcttctccatcctctcccatcttgctgtcctgctcacattctcaaatttggttgcatggctttgaatgtcttcctttatgtctcgttgctttggagggatactttcaaaagacaatgaatgtgtaaacttcctagggcctgggccttcagagaagacctatatgtgcctaagtctctgtttaacaaaatattaaggaagttttcccaggagttcgagaccagcctggccaacatggtgaaaccctgtctgtactaaaaatacaaaattagctgagtgtggtggtgggcgcctgtaatcccagctacttgggaggctgaggcaagagaactgcttgaacctgggaggtagaggttgcagtgagccgagatcgtgccattgcactccagcctgggcgacacagtgagacatgtttcaaaaaaaaaaaaagttccaagtggcacacgattggtgcatagttgggaagtccacagctggctggtgtgcactgggaattaaaagcccatctcctgaaatataactcgttaagttttgctgtcaactttttttttgttgttagagatagggtctcactctgtcgcccaggctggagtgcagtggcacgatcataacttactgcagcctcgatctcctgggctcaagggatcctcccacctcagcctcctgataagctggaaccacaggcgtgcaccaccgtgtccggctgatttgttgttgttttttttttattttgtagagacaaggtctcactaggttgcccagacagggtctcactatgttgcccatcctgagctcaagcaaccctccgacctcagcttcccagagtgctggggttctaggcgtgaactaccgcacccagcctgctatcaccttctaaaaatcctctcaaccaggtggaaaatgtggttaagaagagactttaattcgtgagaaacttctcagggtaaaaggcaggcattttgccatcagaaccacttttgaaaatggcaagaaaaaaatgtgtgtgtgtatatgtgcgtgtatttttttattttgtttgtgcatacattggaaccttctcatttgcctgagagatgcagtgcttatttttaatagcagctgtcaaattgagagggatttttaatgaaatgatttaaaatattttaattttttttctttttgagatggagtgtctctctgtcacccaggctggagtgcagtggtgcgacctctgctcactgcaacccctgcctcccagtgtcaagtgattctccttcctcagccttctgagtagctgagaccacaggcacccgccatcatgccccactaattttctttctgtttttactagagacggggctttcgccatgttggccagagtggtctcgaactcctgacctcaagtgatctgcccaccttggcctcccaaagtgctaggattacaggcatgagccaccgtgcctggcattccattttaaagatagagacttctacaaagttagtgtctcgccagacgcggtggctaatgcctgtagtcccagcactttgggaggctgaggtgggcggatcacctgaggttgggagttcgagaccagcctgaccaacatggagaaaccacgtctctactaaaaattaaaaaaaaaaaaaaaaaaaaaattagccaggcatcgtggcgcatgcctgtaattccagctactcagaaggctgaggcaggagaatcgcttgaacccgggaggcggaggttgtggtgagccaagattgcgccattgcactccagcctgggcaacaagagcaaaactctgtctcaaaaataataataataataataaaagaaagttagtgtcttgttgactgctctttcgagtcagggaaagatgtttagaacaagctatatcttaaagagaaaaggaagattccttctgcccactgcaatgaagttgtctggcttcattagccagtacattggtatatgtgtgtggagccctcgtgacttgaagggcgtggcattccagtgttttctgccaccattgttcttaattccttcttccaaatcccagcttctccctccaaaatagttttaagactgacatgcagaataaagtttccaaaacttaaatgaatggaccagaaaatctcagcccagcatcattgcaaatcaataaaaactgcacactctcatttagaagatttattcttccatttggtaagttataggcatttgttagtgtctctgtgacgtcgttagtggaaattgccttctgctgttttccttctgctttttctgcagcatccattttttttaatgaatggcatcattcaatgaaattgattgaattgattgagatttagggttttgctttctcgtgatgagttttgggcccatttttcttatgcagaaataaaaccactggctcctgaaagttgtaggaactgtgtccacgtgagtgctcagggacctgggaatgactttcttttgtctctgtctcccacagttcagcgtactcttttagagaaatagaagattgtcggcagaaacagcccaggcgttggcagcagggttagaacagctgcctgaggctcctccctgaaggacacctgcctgagagcagagatggaggccttctgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaaggctggccattattaagtccctgtaactcaaatgtcaaccccaccgaggcacccccccgtcccccagaatcttggctgtttacaaatcacgtgtccatcgagcacgtctgaaacccctggtagccccgacttctttttaattaaaataaggtaagcccttcaatttgtttcttcaatatttctttcatttgtagggatatttgtttttcatatcagactaataaaaagaaattagaaaccaa

SEQ ID NO: 844 - DNA, 50124 bp, Homo sapiens; identical to SEQ ID NO: 843

SEQ ID NO: 845 - DNA, 29066 bp, Homo sapiens
cctgggctgagtttgcagggctgctcccctcacccaaccccttcgagtcctccgcgggctccgccccacccggcccgtgggggaggttccgtcccgccgccttcgcccgcgcgctgcactcgcggacgatctctgctcgccttgggcgcgccgtggcgcgcggggccgtgctggcgctgcggctcctcggcctgctccgccgtctggtggccgccccggtgagcgagcggcgggatccgggtgggaggacgcggggggtggcgcgggctgggcctggggatccgcctggggatgtggggtgcaggggcggggcgccccgcggggacacccggcccctcttccgtgcccggcgggacgcgctgtgcccacggggacccaggtccggaggaggcgcccactttctccccagcgctcttcctggggccaggtgggagccgtttcagaggaaaaagccagcgtttctttcgtaaaccaaaaagtatctgggacaagtcccaatccttttgagttgattcggcgaagatcaggaaggagcccgggagacgggtctatgcctttctccaaagatactattgagagcttcggtatttaaagggggaaagcacgctggaggggaaagaaggaggaaggctcattttaccgaattcacctgttgcaaaagaaaagcagcaggtagaatagtcaattatgtatttgtcttgcgctcactaaattggcactttactaagataaggtcaacagagagttattgcactgtctgcttgggaacagaaggaaagacagcttcctgcctgactcagcttccagctttattattattattattaattattttggcagagtgaactggggttccaagttttaattttccttctacagtttgcagaatcgcaaactcttaaatttaggggaacctggggaagaggtggcatccgattcccccccaaccctggtgacgttcttatggatcttatggatactgcagtctctcttctctttctgtctctcctctcttctctttcctttctctctctcctcttctctccctcttcctctctctctcctctcctctctctctcttctctcctgttccctctctctcttctctctcttctttctctcgcttttctctctcctcactctcctctctccctctctctcccctctttcctctttctctcgcctctctctcacctctctcctctctccccttttctctctctccccctcttctctctctccccctcttctttctctccttttctctctcgtctctctctcctctcctctctcctctctctctcctctcctctctctcctcttttctctctcccatctctctctctcctgtctccttctctcttgtctctcgcctttctcctctctctatctcctcactctctccttctctctcctctctctcttgtctctctcccgcctctctcatctatctcctctctctctcccccctctcctccctctcctctttctctcctctatctcctctctccccctctttctctctcctctctctctcttactccctctttttctgtctcatgctcatcttttactgttttcacctgagggaagagtgatgagaagataggaattcacgttttctgaagtatttagaaacgtggggccgtggtgttttctccacctgtttttgggtcattccttcctcatttctcagaacattggtattaacagctcatttccctcctttaagggctgactttgacttagcgatgcctttcctgatggaggaaacagtgagtaactttttaaagtctcctctgttgctgactttgctgattgtcattgaattattatcattttcaagacatctcttttgcgtgataaatggattgagtttggacagtgggaacataggaagtatatgtgttgtttatttttgttgttggatttttgatatattttttttttgttaccagcatgctggtttttttgttttttttgtttttttttttttttgaagtgtaggttcagagtctcactctgtggcccaggctggagtgcggtggcgcgatctcggctcaccgcaacctccgcctcctgggcttaagcgattcttgtgcctcagcctcctgagcatctggaattacaggcacccactaccacgcccggctaatttttgtctttttagtaggggctgggttttgccatgtggagcaggctggtctctaactcctaaactcaagctatgcactcaccttggcctcccaaagtgctgggattataggtgcaagccatcacgcccagccagtatgctggcttttattttaaaatggttagtctttggaacaacgtaaggcaaatgtgactcccttggccaggtcaggcctcgtgggcatagatctgcgcagtcacacagggacctgtgcacacaagggtgccatgctgctttattgctgtgttgctgccatcttcagattcttcatacagttggaacaatgggtcgcacattttcattttcacaggccctcccaaattctggaggtggtctgcacacctggtttagttttctttgaaaatacttgaagttaaatcctgtacctggaagacaacagaagggaattggcaggaggctacgtgtatgggtatccccaccatgacaaaaacaagggccagtttttacctgtttagtgaacagtctctgtgcaaattgatatttcagtttcttttctcatcgctatggaaattgatttttcattttctggtcgctgtggaaattgatttttcattttcttttctggtcgctatcaaaattgatttttcattttctggtcgctatggaaattgatttttcattttcttgactactaggtactgatgattgcaactctcatgttttacaaacaggtgacccagcaccacctaatgcccccaaaccaaagccagatccaaaccccaaccgacctggtttcactggtaagagcctctaaccctacgggtggtctctatattgtttattgtaactttattttatacttattcataagaatattaattcacattttctcatgttttctcatttctatcatatgacatttactgacaaatactattctatctaaatatataataaaatacattaattcctttaatccctaatgttgaaaacattgtgtcttctgacattttagaattatgaattacaaagccaatttgagtcaactttgtctactctttttcattcctttgaagagatttctggcattcaaattgtctagatcaatgctcatgagtacttttatagcttttaacctggttggttgtttgccccagaattgcaccaatttgatttgataccagggtgtctgcaaatgtccctgtcttcgaaccttttccagtagcaattatcacctacaaaacctttgtcaaatagtgtaattattatatcaaaccggtcttagttttacatctctcattctgaaatgtaaaaagcataatgcatcccaatgggccacggagacttcttcttttgtgtattggatgctttggctttgatccttcaattcatggtgcccgccaccaggcccagctcatttttgtattgttagtagagatggggtttcaccatgttggccaggctggtctggaactcctgacctcagatgttctgcctgcctcagcctccctacctactgatgtatgagccttcttcagtgatttatcaatattaaagattaccagccacttattatgaaaatggttttgcactttatttttgcctttgaatatttttaacaggaatgttttacaagtggtatgtttatttttttatggtgtcttatgtttgtgtggatatcctgctttttgtaactttttttccttttaaattgagaatcattttgctattgtcccttctcttcagagaagtaaaaccttctttttaatttcatttgaattgtttatcaccataggttgattgaaggaatggtaacacgttttcaatgttgagttttttcttttattttctttcctttttttattttggagacagagtctctctctgtcgcccgggctggagtgcagtggcgtgatcttggctcagtgcaacctccacttcctgggttcaagcaattctcgtgcctcagcctcccaattagctaggattacaaacatgcaccaccatgcccggcaaattcttgtattttcagtagagacggggttttgccatgttagccaggctgatcttgaacccctgacctcaggtgatccgcccatctcagcctctcaaagtgctgggattacaggtgtgagccaccatgccggcctgagctttttctttgagattcgatttgtctcttcctcttgttgattctgtcaatgggtttctaaagtgttttttccttgtttttgttactctgaatccattttcatgtccactatttttctgtttatttctgtcatgtagaagagattgtgtatatattttttgcaatccatgaaatgatgaccctttgttaaatttcaattttttttctcttcatttctgaccttttctaagaagttggtcatgttatttggtaatgggtttttaaaattttccctgttcctagatttatacgttctctttacagtttatttgtaatttagttctatggcctttgctagaagactcaggacaacttttaatatgtagagttgtaaatatggtagacaactttttttccagacattaggacaaaaacccaaagagattcacctttaaataaaataagtcatttcaataagtgtctttctcttctagtatactttttttctgaacacataggttctcataccatgagatttcttatttctatacaatgtatgtgaaaaatcatgtgctttttattcattgcttgtgtattttaatatggttttgaaaaaaagattcattttgatgtagcccctcatgtttctttcatttgagcctcccttatcactcccaatataaaatgtgcctcgaccttaattgggatttgaaaagcttggaactagaaggctgggccaggtaaggtggctcacacctgtaatcccagcaccttaggaggccaaggcggctggatcacttgaggtcaggagttcaagaccagcctgaccaacatggagaaaccctgcctctgctaaaaatacaaaaattatcctggcatggtggtgcatgcctgtaatcccagctactcgggaggctgaggcaggagaatggcttgaacccgggaggcagaggttgcagtgagccgagatcacaccactgcactccagccaggcaaaaggacaaaactccatatgaaaaaaaaaaaaaaaaagaactagaaggctggctttgaaactagcatgaatgtcacattagtttgtggagcccagctgggtgggtagagccacttttcagacacagatcagaatccgtcagtcacagatcagatcacagtcacctgccctacctcttacggtctgccttgctgaaggtgttggggacctgggaggagataatggggaatcaacgggacagagttgtgtgcaggcagattcagagtcccaactgggtccaggcagcacagttgatttacaaatgacattctttctctctccctctttctcttgctgtcatctcttactcttttcatctgggggaagaatgatgtgaaaatgatcaggaatttactttttcaaatgagatcctagtcagtgtgatattcagaaaagtctttagtcatgtgggtctctggtgatttctccatctgtttccgaggtcattccttcctcatttctcagagctttactatgaacagaccgattccttcctttaggggcagactttgacttagcagatgcctttggtgagggaggaaacagtgagtaactcgttaaagtctcctctgttgctgatttgttattgtcaccaaatgactgtcatttccaagagacttatctcttttgcataatccatggattgggtttatacagtggaaatattggaagtatatgccttgttgtgttttatttttgttgttgttggatttttgttttttttcccaccaatatgctggcttttattttaaaattgttacagactttggaatgatataaggcaaatgtcacttccctggccaggtcagacttcatgggcatgtgacatgtgatgtcacacagggacctgtgcatacaagggcaccatattggtgtattactcagtagctgccatcttgaaattcgtcataaaattggaacagaatcttgcattttcattttgtgcagggcctctcaaattctggaggtggtctggacacctggcttagttttctttgaaaatacttgaagttaaatcctgtagctggaagatgatggaagggaattggcaggaggctatgtgtatgggcatccccaccacgacaaaaacaagggtcattttttacctgtttagtgaaaggtctctatgcaaattgatttttcatttccttttctggtcgccatggaaattgatttttcattttcttgactgcaaggcactgatgatcgccaactctcatgttttacaaacaggtgacccagcaccacctaatccccccaaaccaaagccagatccaaatcccaactgacctggtttcactgataagagcctctaaccctacggggtggtctctatgttgtttacctggcagtgatgtccgtgtcatctgagaagaggagatttcaggtgagcctgttcctactgttgaattacaaggtaattccagtgttcaagtagtggaaaacctagattacgaaaatatgtttttggtttggattttattttccttttcttgattttacttcaaagataaatggaacttccaaatcattgaataagagcttttagatgtagacttgatatgaggaaaagaatctgtgtgtttcccatggagaagccaacttgttttaaacaattagatttttactgagtgtttttctttacatgtttgtttaatttttaacacagaaatctatccagatggtctaaatcctgttgacatttttatggttttttgctggttatgttattattggcataagaatattccttgaccattttctcatgtcatttaatcgtttgtatcatacgactttacattattatactacagacttaattacatactttggtttctttaagtaatccctaattctgaagttatgtttcttctgatgttttggaattatcaattacaaagcaaatttgactgcccttcatgcactttcctttatgtttgaagatatatttctagagtgcaagttgtttacatcgatgtgtgtgagtacttttgtagcttctgacatggttttgaaattgccccagaattgcaccaatttattttgatggcggcggggtgtgcagatgaccctttcctcacaccgtctccgatattggtgttcaccaaaacatctttatccagtagtgcaaaatgtcatgctaaccttgtcttagtttcacgtctttaattctgaaacttgaaacaaaaacaatgcatcagtgggccatggagacttcttcttctgtgtatgggatactgtgtcttttattcttctattctggtatgtcctccctgatttctagtcatttttgaattatttatagacagtaaacattgcccaatatattatgaaaatgtgtttccactttattgttgcctctgaaaacattttgaacagaagcttttataagcaaggcttgaatttttcttttttatgttgtcttaggtttgtgtgagtttccacctttgtgtaacacatttttccttttaacagaaccattttatcactgtctctcttccttcttgggaaaaagaaaaccatctttttcttttcatttgcattacttacaactatgaattgatttatagagtgctaaaatatttgtaaaatcgagcagattcttctgtgtgcctttttctcctggtgatttatttaaatggatttctaaggtgttttcccgtcagtattgatttgttttggtgagtacgattttatgtgcgctatttgtctctctgtttctgaactatagcaacatttttgtgcattctctcttactctccactgaatgatgaacccttgtgaacttccaattgttttctcttcatttcttaatgtttctgagaagaccgacatattatttgtaagtgattttaaaatttgtctccttttctatgttttttcgttgtcttcagagtgtcttcagagtgcattcgtatttttgttgaattggctttgctagagaacacatgatggctttaagtatgagtgaagagagtagacattttttattcctgatttcaaggtaaaaacctaaagaggttcacctgtaaataaaataaattgtctttacaaaaccagatactcattccaagaagatctctctattctagtatacttttttttctaaacatacaatagtataggttctcatactgtgagacttcttatttctttatacacaatatatttgaaaagtcattggttttttagtgattactaatgtactgttacatggttttgaaaagtgttggattcaaagtttccttcatttaagcctcttttttctcccttccccatataaaaagttgatgatggccaggaatagaggttcacacatataatcccagcactttgggaggctgagatgggagcatcttttgagcccaggagttcaagaccagcctgggcaacatagcaaaaccccctctctacaatgaaatgaaaaattagccaggcttgttggcacatacctgctgtcccacctgcttgggaggctgaggcaggaggattgcttgaggccaggaggcggagcctgcagtgagccgtggtcacaccactgcactccagcctgcgtgacagaggaagaccctgtctcaaaacaaaacaaaaatggttcctcgactttagttaggatttgaaaagcttagaactggaaggcagcctctgaaattatcaagaatgtcacagcagtttgtggaacacacctgggtgggtagacccactttttagacactctctagcccaaatctgatcacagtcattcttcctcacctcttagggtctccctcacagaaggtgttgggggccttggacgagatgttgatgggatgggaataaacaggagcaaataatgtgcaggcgaagttggagttcctgctcagtctgggaggagaattgatttatgaatttctttctttctctctttgtatctatctcttctttctctctctctctctctctccccccagccaccttctgatctctaatccattcatgtgagagaagagcgatgtgaaaatggtcagcaatttgctttttctgatgagatcctggtgagagtcatgttcaataaagtatttagtcacgtggggctccagtgatttctctgtttacaagctcattccttcctcattttctcagaactttggtgttaacagcctgtttcctatttgtaggggctgactttgacttagcagatgcctttcgtgatggaggaaatagtgagtagctctttaaagtctcctctcttgctaacttgcttattatcgcccaattattatcatttgcaagagacttacctcttgagaatgatcaatggaacttgtttgcacagtggaaacctagggagtaagtgtgttgttgtctgtttttgatgttgttggacttttgtttgttttttttttaaccagtccacttgcttttgttgagaaactcctacagtctttggaatgatgtaaggcaaatgtgactcccctggccaggtcagccttcacgggcatgcagcttgtgaagtcacccagggacctgtgtttacaaaagcgccatattggtttactggtctgtagttaccatgttgctcttcttcatacagttgagacgaggggtcccacatttttgttttgcacgggaccttgccaactctgtcactgatctagacacctgctttagtttaatttgatattaagcaatgtagccggaagatgatggaagaaagttggcaggaggctgtgtgtacggttatccctgtcatgacaagcaacaagctccaacttttacctggtccgtcagccatctctatgcaaattgatgtttcatttctttactccaagacactcatgattgcaactctcattgtcacaaacagacgacccagcacctcttaattcacccaagctgaagccaaatgcgaaccctgagcagcctggattcattggtaagtgcttctcactctataggttgtctgtatgttgtccacggtagagtggtatccacatcagatggacgacaggctttcagatgagcaggtgcttgctattgactttttgtacagttactccagtgggcagggagtgaaatacagttttctgaaatagatatttgacttgcgttctatttttagtttgctgattttacttccaagattgtatggaacttctaaaacactgagcacaagattttcttatgaacttggtatagagaaaatggcctgtgcattccctgtagagaaacttgggtgtttttgatgtttttgcccttgaatatttgtatcagctattttgacacatgacagcattctcaggtaatctgactagcaactgttttttgaactgaattgttgtgaaacattcaggtttttagttcttttttgtttttaatttttaacacagaaacataaataatgttcatatcctcttggcattgtgatggttatttgcgcttatattttatatatcagtttaaatgaagcaaacgttaagtaataaagccagtcttttgttcatactgcattgtaacattattattattatttttattattattattattatttgagatggagtctcgctgtgttgcccaggcaggagtgcagtagcgtgatctcggctcacggcaacctctgcctcctgggttcaagcaattctcctgcctcagctcctgagtagctgggattacaggcatgcaccaccatgcccggctaatttttttgtgtgtatttttagtagagacagggtttcaccatgctggtcaagctggtctcgaactcctgaccttaggtgatctgcccacctcggcctcccaaagtgctgggattacaggcatgagccactgagcctggcctattttatacttattaatagtcactgaacatttgctcatgtcattttatcatttatatcatatgacatttactgtcaattatattctatataaatatataatacattaatttatttaatccctaatgtttaaaatattgtgtcttctgactttttagaattatgaattacaaagcaaatttgagtcaacttcatctactttttttttttttattattcctttgaagagatttctggcattcaaattgtctagatgaatgtatatgagtccttttatagtatttgacctggttcgtcatttgccccagaatcgtcccagtttattttgatgatggtgtgtgcagatgtctgtcttcacaccatctctatactggttatcacctgcaaaacctttgtcacatagtgtaaggattatatcaaacttgtcttagtttcgcatctctaattctgaaatttaaaaaaaaatagtgcattccagttggccatggttacttcttttgtgtattggatgttatcccctttattcttaaattctcatatgtacctactgatttataagtcttcttcagttatttatggatattaaagattatcagccacttactatgaaaatgtttttgctatttatttttgccttttaatatttttaacaggaatgtttcataagcaagacctatttttttatggtgtcttatgtttgtgttggttttctggttttgtgacttttattttaatggagaataattttgccattgtgtctcctgcttgggagaagtaaaactgtctttttaatttcatttgaattgtcttcaaacataagttgatcaaagaagttgtgaaacattttcaaagttgagctttttccttgagatttgatgcatctgtttctcctgatgatttttgtcaatggatttctcaattgttttttgtttttgtttttgttttttgtttctctgaatctatttctaagtccactatttttctgtttatactataatatacaaaggattttgtgtatttttctttacgatccacaaattgtttgcaaattatttttttttaatttccccttttctatatttgtacattttgtttacagtttatttgtaatttggttgtactgtctttgctagataaacccaggacagcttttcatatgtagaattgtaaatacagtaaacagcttttatttcaggctttagggcaaaaacccagagagattcacctttaaataaagtaaatcacttcaaaaagcctctttctactccagtatacttttttttccctaaacgtataatagtatagtttctcataccatgaaatttcttatttatatataatatatttgactaattatttgatttttattgattactcatgtactcttacatagttttgtaaaaatgttggatttgatgtagcccctcatgtttcttttatttaagtctccttgttatcccctttcaatataaaaatttccccaacctggccaggcacagtggctcacgcctgtaatcccagcactttgggaggccgaggtgggtggatcacaaggtcaggagttcgagatcagcttggccaatatggtgaaaccccatttctactaaaaatacaaaaattagctggttgtggtggcgggcacctgtagccccagctactcgggaggctgaggcaggagaattgcttgaacctgggaggaggaggttgttgtagtgagccgagattgtgccactgcactccagcctggggaacagagcaagacaccgtctcaaaaaaaaaaaaaaagtttttcccaactttagttgggatttgaaaagcttaaaactagaaggcaaactctgaaaccatggtgagttttcacgtcagtttgtccagcataaatgggttggcagagtcactatttagacaccctctaacccctcttagggcctccctggtggaaggtgttggttacctggggggagatgatatttggacaggaaatcaacaggagagaaccatgtgcaggttagagttggaattccaactctgtccaggcagcacaattgatttataaattattttatttctctctctctggctctcatcttttgttcttttcatcagaagggagagtgatgtgaaaatgatcaggaattcactttttctattgagattctggttagagggatatccagaaaagtatttaggaacgtggggttatggtgttttctgcatctgtttacgagaccatttcttcctcatttctctcagaactttggtgttaacagcctgtttccctcctttaggggatgactttgacttagcagatgccttacatgacaaaggaaactgtgagtaactccttaaactctccactgtggctgacttgcttattatcaccaaattattattgtttccaaaaaacgtatctcttgtgaatgataaatgaaacctgtttgcacagtggaaagttagggagtaggtgtgttgttgtttgttttggatattgttggactttgtttttgtttttaccagtatgcatagttttattttaaaactctcacagtctttggaatgatgtaaggcaaatctgactcccctggccaagttaggcttcatgagtgtgtgacttgttcgatcacccagggacccatgcttacaagggtgccatattggtttatgagtctttagttgtcatcttgaaattcttaatattcagttgagcaaggatttctgcattttcattttacacagtaccttgccaattctgtagctgatctgaaaagctgcctgataggttttattgaaaatgctttatcagtactgtagctggaagatgttggaaggatattggcaggaggctgtgtgtatgggtatccccaccatgacaaagaacaaggtccaatttttatatgtttagtgaacgtctgcatgcaaattgatgtttcattttcttcacttcaaggcactcataatctcaactctcatcttttacaaacagacgagccagcaccactgaacccacccaaaccaaagccaaatccaaaccccaagcagcctgattccaccggtaagagcctctaaccctatgggtcatctgtatgttgtttacaggacagtgatatccatgtcagctgggagatttcacatgaaacctgtgctcactcttcactccttgtacaaggaaattccaaaacctagttttcaactatataattttgatttggattatatttttagcgtcctgattttacttctaagattttaagatttaagtcataaatcttaaatagaatcttaaattctgagattttttggattccacctctaaaaagttgaatacgaggttttaaatacagacatgatatgaaggaagggatagttgcattcccagtggagaggtgagtgcttttcaaatagttagatcgttagtgatttttttttgtttacatgcttgtttaacttgtaacacagaaaaatataactagtgtccaaatcctgttgacagtttgatagttatgtgctagtaacgttatttttggcatattcatatttcttgatgattttcttatgtcatttaagtctttctaacatgacttttactgtccattttatgtccttatttatttcccacataattatatacttcaatatttaattttgacaatgttatgtttcttctaacattttagaattatggatttcaaagtcaatttgaatcaactttatgcacttgtttttattccttcgaatcaatttctagaatgcaaattgttcagatcaatgtgtatgagtacttctgtagttttgacctggttctgaaattggcccagaattatatgaatttattttgatgccagggatatgtgcaaatgtccctttcttcccaccatcgttactgctgctgatcacctagaaaacctttgtcatgtactatcacatgtaacattaatctttgcctagtttcagttctttagttctgcaatttaaaaaaaaatagtaaatagtacatcaatttgccacgtatacttctttttttttctttttttttttttttgagatacagtctcgctctgtcgccaggctggagtgcaggagcaccatctcagctcactgcaacctctgcctcccgggttcaagcaattctactgcctcagctcccaagtagctgggactgcaggtgcatgccaccatgcccggctaatttttttgtttgtttgtttgtattttagtagagatggggtttcaccatgttacccaggctggtctccaactcctgagctcaggcagtccacccgcctcggcctcccaaagtgctaggattacaggcatgagccactgcgcccagcctacttcttctatatgtattgattactttgcctttattcttatcttccgatatgtctgtattgttttataaacgttcctcatttttttatagacattaaatattgccaaccatttactatgaaaatgctttttcatcttatttttgccattgaatagtttaacagtattttttgacaggcaagtcttcaaatttttattcatggtgtcttatatttgtcggagctttctgattttggtgacttttttttttttttttgagagagtcttgctctgtcgcccaggctggagtgcagtggcacgatctccactcactgcaacctctccctcccaggttcaagcgattctcctgcctcagcctccccagcagctgggactacaggcacccaccaccacgcccagctaatttttgtgtttttagtagacacaggatttcaccatattggccaggctggtctcgaactcctgacctcataatctacctgcctcagcctctcaaagtgctgggattacaggcgtgagccaccgtgcccagctgacgttttttcctttgaacttcagaaccaacatgcctgcaaaattgagatttttcttgatattcgatgtacctctttccctgatgatttcttttaatgcatttctagttttttcttttttttcatttttctggatatatttttatgcccactatctttctgtttatttttgttacatagaaaggatttaatatatttttccttactatatcctgaactatgatcccttattaaatttctattttttctcatttcttatctttctaagaagacaatcatattatttgcacatgatttttaaatatttttcaattttctatctttatatgttctctttacattttatttgtatttttgttgtattacctttgatagtaaacccaggacaggtttaaatatgagtgaagagagcagatattttaaattcctgactttaaagcaaaaacccaaagatactcacctttaaataaaataaattgcctttttaaaaaatgtagtcatttcaggaagggtcattctattctggtatacatttttccccaaatatataatattattggttttcataccatgaggtttcttatttctttatatatatatatttggataatcatctggtttttattgattactcattaaaaccacgtaagttattgattactcattgaaaccatgtaagtatattcttacatggttttggaaaaatgtcggatttgatgtagcccctcatgtttcttttatttaagcctccttattatcccctttcagtgtaaaaatttctccagccttagtcaggatttgaaaagcttaaaactagaaggcaacctctgaaaccacggtgaattttcacgtcagtttgtccagtacgtctgggttgatagagccaccttttagacaccctctagcccaaatctgatcatagtcatgtgtccccacctcttagggcctccgtggcggaaggtgttggttacctgaagggagatggtgatgggatgggaaatcaacaggagggaatcctgtgttggcagagttagagttccaacttcgtccagccagcacagttcatttataaattactttgtttctctctctctctctccctctctttccacccctgactcttgctctcatcttttactctttgtgtctgagagaagagtgatgtgaaaatgatcaggaattcactttttcttatgaggtcctggtcacagtgatacttagaaaacacttaagaacttaggcctgtggtgttttctccatctgcttccaggtcatttcttcctcatttctctcagaactttggtgttaacagcctgtttcccttctttaggggatgactttgatttcacagatgtttcttcatggtgaacgaaacagtgagtaactctttaaagtctcctctgttgccgaattgcttatagtttgtttgtgtttttggagtgctgtaggaagagcagtgatgaaggtttgaggcttctagatgcttccatattagttgcctggggctcaggcaggggcacacatgtggacccctggggggacatgacagttgagctaacagctgaggaatgaggatgacttatatcccaaggagtgggtcaaagggtgttttgtgtagcaagtgtggcatgtgcaaagggcctgtggtcagtggaactgagggtgcctgtggggctcagtgagggggaaaagaggaagtcaggcatggcatgggatggaggggaacagagtgaggctacagtcagtgcccagtcttgaaaatgtcccttcgagtgtccctaggggccatccttgttttcagtgcttattacccctgctcccctctgcttgctcccagagagctgtctcctgcctcccagctctgcgtctcagatcctggctctgatcccacgctgctgttgcttacactcatgtacccattgctaatgtcatcattcccttcggcagctaagtgcaaagttaatttcccatttgaaaagcagtctgtactaataacaatcaactgggagacccaaaagagtgcagttaaagagaaaaaaaaaaatcaaactttccctcaaaagaaaccagtgataccatttgggtccacctccctgaggtttgaaagcctctccgttagtgttagttgcttttaggcctcttcttgctgcattagcaaggtgtatctttctctttatatgcagacagtgccctcttctggtgggaggctctcagtgtctgtctacaaatccatgacccaagaggtagaggggtcccaacggtcccacttaacttctgccaaagtggtgcccttgggaatccccaacttcctgtgcccacctgttctagctacttggttcactttgacccagctcttcaggggtgataccctccctcatcaggctcccagatcccatcaggtgttgaaaccccatgtgataggtgaaatactggtccccagagatgcccacatcctaaccccttgatcatgtaaatgtgtgaccttatgcaacacatgggactttgcaaatgggattacattaaggatcttgacatgggacgattatttaggatgagctgtgtaattacagtggaatcacaggttccttagagaggcctgcatcagaggatgaaggagttgttcacatgtggaaagagacagaaataaaagtggagaggaccattgaaaaaaaaagtcattgaaagactttggcacccaggttgccatggctgcccccagcccttcaaattctcctaaagccccaaatgatctttccctggaagatgcaccagcccattggatagcttagatgcagctgttggagggtggatctagcctgtgaggacccagtaacctggacccaatacatgacaacaaggattgaatgagtggtcgtttactgctgagtaattgctggttttcctggctacctgggccctgggtcacatggatgagagggctggaaaaaatgattatcagcacagagtcccagaatctctgtgacttctggtcacagatattttgagtgtatgtatagaaaaaagcagttgttcctacacattcagtgtcagaagtgaaggatgagaggggagaggggtgtgcatgtcaaaggaaaaaacagcttttcccccctgtacgtgaggtcacagcaaatttgcaagattcagtgcatggtgagagaagcaggcagccgctgacatccaggggctggcctggctcccgctacctggcttggggtttcctgttggacctaagaaatgtcacagacaggacatttttaaagtcaataagaaatgtcagacaagagcactgtgatgaagtcaagagaccgtgggttgtgctttggctggttcttgatttatttctgctcaaggcaatcagtatgccaaggtggcatatttcagagtgtcacgtaatgatctacattcttattcagggtggggtgtcctgtaccccatcaactggaaggttgtagcacttcctgctttctagacatggtaaatgaactccctgggtcactgggaaagttgtagcacttcctgcttcctggagatggtaaataaactttctgtgtcacatgggaggttgtagcacttcctgctgcccagagatggtcaatgaacttcctgagtcactgggaaggttgtagtacttcctgcttcctggagatggtaaataaacgtcctgggtcactgaggaggttgtagcacttcctgctttcctagagatggtcagtgaacatcctgggtcactggggaggttgtagcacttcctgcttcctagagatggtcaatgaacttcctggagatgttaaataaacttcctgggtcactagcgaagtttgtagcacttcctgtttcctggggatggtaagagaacttcctgggtcactggggaggttgtagcacttcctgcttcctagacatgataaatgaacttcctgggtcattggaaggttgcagcactttctagtttagagggacattataacacttcctggtttatctggagattgtaatgctttctgattcatagggacattgtaaaactttctggctcacattgttacatttcctggttcaaatggataatagtagcacttcctggttcacagggacattgtgacacttcctggttcttatgggtaattgtagcatttcctggttcacagggacattgcaacgctttttggttcatacacataattgttagcacttcctgattcccagggacattgcaacacttcctggttcatagggataattgtagcacttcctgtttcatagggacattgtaatactttctggttcatacgaataactctagtacttcctggttcatatagataatagtagcaattcctggttcacatggacattgcaacacttcctgtttcacagagacattgcaacacttcctggttcattctgataattgtataacttcctggtttgcagggacattgtaacactttctggttcatatggataatagcacttcctggttcatagggacatagtaacatttccgggttcatacatacggataattgtagcacttcctggttcatacggataattgtagcacttcctggtttgcagggacattgcaatacttcctggttcatatggataattgtagcacttcttagtttttaggatcattgtgacacttcctggttcatagtgacactgccacactttctggttcatatggataattgtagaacttcctggttcataaagacatttggaaccgtctggttcatagggataattgtagcacttcctggttcatagggacattgccacacttcctggttcatctggataattgtagcacttcctggttcatagggaaattgtgacactttctggttcatagtgacattgccacacttcctggtccatgtggataatagtagcacttcctggttcgtagggaccttaccacacttcctggttcatccagataattgtagcacttcctggttcatagggatattgccacactttctggttcatatggataattgtagcacttcctggttcatatggataatagtagcacttcctggttcacaggtacattacaacacttcctggttcattcagataattgtaaaacttcctagtttgcagggacattgtaacactttctggttcatatggataattgtagcacttcctggttcatagggaaattgtgacactttctggtttatagtgacattgccacacttcccggtccgtgtggataatagcacttcctggttcgtagggacattgccacacttcctggttcatccagataattgtagcacttcctggttcatcggtaaattgtgacactttctggttcatagtgatattgccacacttcctggttcatagtgacattgccacacttcctggtccatgtggataatagtagcacttcctggttcatagggacattgccacacttcctggttcatccagataattgtagcacttcctggttcatagggatagtgccacacttcctggttcataaggataatagtagcacttcctggttcacaggtacattacaacacttcctggttcattcagataattgtagaacttcctagtttgcagggacattgtaacactttctggttcatatggataattgtagcacttcctggttcatagggaaattgtgacactttctggttcatagtgacattgccacacttcctggtccgtgtggataatagcacttcctggttcatagggacattgccacacttcctggttcatccagataattgtagcacttcctggttcatagggatattgccacactttctgggtcatatggataattgtagcacttcctggttcatatggaaaatagcacttcctggttcacagggacattacaacacttcctggttcattcagataattgtagaacttcctaatttgcagggacattgtaacactttctggttcatgtggagaattgtagcacttcctggttcatagggaaattgtgacactttctggttcatagtgacattgccacacttcccggtccatgtggataatagtagcacttcctggttcatagggacattgccacacttcctggttcatccagataattgtagcacttcctggttcatagggatattgccacgctttctggttcatatcgataattgtagcacttcctggttcatatggataatagtagcacttcctggttcacaggtacattacaacacttcctggttcattcagataattgtagaacttcctagtttgcagggacattgtaacactttctggttcatatggataattgtagcacttcctggttcatagggaaattttgacactttctggttcatagtgacattgccacacttcccggtccgtgtggataatagtagcacttcctggttcatagggacattgccacacttcctggttcatccagataattgtagcacttcctggttcatagggatattgccacactttctggttcatatggataattgtagcacttcctggttcacagggacattacacacttcctggttcattcaaataattgtagaacttcctagtttgcagggacattgtaacactttctggttcatatggagaattgtagcacttcctggttcatagggacattgtaacacttcctggttcatagggacattgtaacatttccaggttcatatggataattgtagcacttcttagtttttaggatcattgtgacacttcctggttcatctggattattgtagcacttcccggtttatagggaaattgtgacactttctggttcatagtgacattgccacacttcctgattgatatggataatagcacttcctggttcatagggacattgccacacttgctggttcatccagataattgtagcacttcctggttcatatggataatagcacttcctggttcacagggacattgtaacacttcctctttcattccgataattgtagaacttcctaatttgcagggacattgtaacactttctggttcatacggataattgtagcacttcctggttcatagggacattgtaacatttccaggttcatacagataattgtagcacttcctggttcatagggacattgtgacacttcctggttcatatggataattgtagcacttcctggtttgcagggacattgcaatacttcctggttcatagggataattgtagcacttcttagtttgagggacattgtgacacttcctggttcatagtgacactgcaacactttttggttcatatggaaaattgtagtatttcctggttcataacgacatttggaaccgtctagttcatagggataattgtagcacttcctggttcgtagggacattgccacacttcctggttcatctggataattgtagcacttcctggttcataaggatagttgcaacactccctgggtcatcacccccatcctgccatctgctccagccctatgcagccactcagaaatctacttcctatcccatggatttgcctatcaggggcatttcaaacggcctcccatgtggttttgtgcctggcttctttcactcagcataatattttcgaggtccatcgattttgtaccatgcatcagaatttcattccttttgatggcagaatgacattccattgtatgggtagaccacattttgtttatccatacacttgttgttgggcattgggttatttccactgtgtaactaccatgaataatgcttagcacttagcatacggttaagacttctatgtacatacttgtctgagtaactgtcttcaattttttgggtaaatacccaggaggggaatggctgggtcatatgataactctatgtttaaccattgaaggatccgccaggctgcttttcaaagcaaccgcaccattgcaccatcccacaaacaatataagagtgctccagtttctgcacatctgagccaacacttgtcactgtccatatttgtcattagagccatcctagtgtgtatgatgggctatctcattgtggttttgatttgcatttccctgatgaccagataggttggctttcaagttttcatgttctttcttcttctctgtcaagtagatgagtaatacttaaataaatatttcttactcagcattttgatgtatttattcatagccttattaatgcttgactttatttgtttatctctcagatatgggtctctaaatgtcagtttcaagaaggaactgtgttttgttcaactccaaaatccccagatctatctaggacactgcctgaaacacagaaggggttaaaaaaatatggatgaaatataatagcaaatgcatgtcctattttaaaatatcgacagttattctatttgcagaacaataaattcaatgtgaagactaagatactgttgattatttatgtgtgtatgctcgtatatgtatatatacatacatatgtgtgtatacctctacatgtatgtataggtatgtataggtatacatatgtatatgtacagacatatgtataggtatacatatgtatatgtacagacatatgtataggtatatacacatatacaagcatatatatatacatatgcaagcatacccacattatgtacatatatgtaatatatatatatatacacactcacatatacatacacacacacatatatttacacatatctttataaaacacagacctaggatattttccctagaatcaggtccaaggcagatagttgaaaaatgtctgatttctaatttgtggttgaaataaaactaagaacatttcattattttcatcatgatttattttgctgacttgttgaacatatgcaggcttgttacctgggtggactgtgtgatgctgaggtttggggtatgaccgatcccatcacccgggtagtgagcatggcacccaataggtagttcttcagttcttaccctatccctccctccaccctctaggagcccccagtgtctgttcctctctttgtgtccatgagtacccaatatgtagatccacttataaatgagaatgtgcaatatttggttttctgtttctggattagtttgattacaataagaacctccagctccatccacgttactgtaaaggacgtggttttgttcttttctgtggctgtgtagtatcccacagcgtctatggaccacattttctttatccagttcacccttgatgggcatttaggttgattccatgtctttgctatggggaatagtactgtgatcaacatgcttgtgcaggagtctttttggtaggataatttattttccattatgtatgtatccaggaatgggattgctgaactaaatggtagttctctttttagttctttgagaaatctgggagatatgtcttggaatgaacttcatatagctttttactgcctcccttttaaaatgcttccagaaggctgtcccttatttggtgcacagaaactggctaaaaaataaatgtgaccagctgggagtggtggctcacgtctgtaatctcagcactttgggagactgaggcaggtggatcacctgaggtcaggagatcaagaccatcctggccaacatggtgaaaccccgtctctagtaaaaatacaaaaaattaactgggcgtggtggcgggcgcctgtaatcccagctactcaggaggccaaggcaggagaattgctcgaacttgggagccagaggttgcagtgagctgagatggctccactgcactccagcctgggcgacagaacgagattccgtctcaaaaacaaacaaacaaacaaaaattagccaggcatggtggcacacacctatagtcccagctactcaggaggctgaggcaggggaatcacttgaacccgggaggcggaggttgcagtgagctgagatctcaccattgcactccagcctgggcgacagagcaagactcggtctcaaaaaaataaataaatataaatacaattaaaacaaataatataaaaacgtgacctgcagccacctctccaaggggcctggataccaatggaaggaagtgaaaaggaggagatgaaaaatttacaccttgaaagctgaaagtgttctaatattaccaatgctgtggagtcagacacatcgaaagtgactctaatacctcctgacatccttatgttatgaatatgtagacaatagcaaattattctccgcttttttccagctcattgaaacatgttagggaggaacatttctgcattgacaacagctttaaatatttcattagtgcttggaagaaacacaagaatctgtgacgcagaagggaaatgaaaaggaaagcttagtctccatttagttatgttcctcataaatatttcccagaggcaaagatgttctctttcatattaaaaatacaaataaacacttctcattagcccaagaaaatattgtagagattttcattatccaaaaaaggcacactttcaagacacacggaacagagacggcacattgccttagcttgcttctggctagcatgtctggctattgaccggattttatttttaaatgactaaaataatatattaactaaatggtaaaattcatattcagcattggcttgagggcatcggagggttttggctggcccagtcatctctaccagtgaagaaagcaaggaaataggtcatttcactcagggacagcttgaaaacagagatttcatggagcttcctcattccgtcagcctagagtgggattttggctgtcacccttcaaggatgaaaaggtgcagaggacattgggctgcagacagggcgctcgtttaaatgatttaaaagttttggtcagtcgtggtggctcatgcctgtaatcccagcactttggggcgccgaggcgggtggatcacctgaggccaggagttcgagaccagcctgactaacatggagaaaccccatctctactaaaaatacaaaattagtcgggcgtgatgccacatgcctgtaatcccaactactctggaggctgaggcaggagaattgcttgagcctgggaggcggaggttgcggtgagccgagatcgtgctattgcactccagcctgggccacaagagcaaaactccatctcaaaaaaaaaaaaaaaagtttccatctggctggacacggtggcttacgcctgcagtcccagcactttgggaggctgaagcaggtcaatcacttgaggtcaggagttcaagaccagcctggccaacatggagaaaccccatctgtactaaaaatacaaaaattagccaggcgtggtggcgggtacctgtaatcccagctactctgtaggctgaggcaggaaaatcacttgaaccctggaggcagaggttgcagtgagctgagattgcaccactgcactccagcctgggcgacagagcaagactccgtctcaaaaaaaaaaaaaaaaaaaaagtttccatctaagcgagctctgttggttctcccacctctgaccttatgagttttcttctttaacctgcaccttgttctctgagtcactttgcacttgaaggtacagctacagcttccccatcagacttgttggtcgtttatcaaaggatgaaaaagttcttcctcctttgggtctttaaccctgtttcctggtgtaagacagcttttatgtttgctacctgctggaatcaacttgaaattttctcccagaaaatttgtgaatttatcttgttcaagttacttgtggtcaataagttaataaagataggtagacagacagacaaatacattgatacagatagatagattcatgatagatgattgatagatagatattacacagatacatagatacatatcttagacctgatatatacagggtgggtggatagataaatgaataaatagatagatagatattacatagatagatagatacatagattagacctgatatatacagggtgggtggatagataaatgaataaatggcttgattgatggattgatgattgatggattgatggattggtagataaatgaataaatggctagatacatgattgattgattggtaggtaaatgaataaatggctagatacatgattgattgatagatgatagagattagatagatatatagatacatagattagacctgatagatatatggatatatatacaggatgggtggataaatgaataaatggctagatacatgatatagatagagccaatacatacataggtacatagacagggtaggtgggtagatagatgaagacatggatagataaatatacacagagatagatcaatgatagaaatgggtatatagatatatgaatgatagaagatattttgagagagagatgattaataggcaattgattgacatattagatgacagataaaaagtgggtaaaatgcaagtaaactgtaagccaaacgtccacgtggaatagcgtgggaagcattgagaagacgctttttggtgctacctgtttaaacattgaaaaactgagctaataccctccacagtacgatagaggggagggcactgggaatttatacctcccaggaaaaataaatcatggtaaacaggcagagatctttccagattccagttcttgggggtaaaaggtccccaagatgcccagtttgtgacaacctgttttgaactattcagctcaaggtttccattttttctcccaggggagttgcctcgattctgatgtgtttgcttcggtgctctgtgtattgtattcatcccactcttcaattcataaactctggagattcttcaattcactgggcaaaccatatgcctaagtctatcctctgatggaggctcgtacatgcaaaatccaatagcaacctgggaagatttcagtcaagacccaagaggaggctggcatcaggctctcggtcaccgatcttcacattcaggtttcctgatgcactttgcgactctttgggcaacctctggactccttgttcccagggtccacatttagttttatctttactgcattgcttttatgaaaaagaataaaattggatgaaacaga

SEQ ID NO: 846 - DNA, 47966 bp, Homo sapiens
cctgggctgagtttgcagggctgctcccctcacccaaccccttcgagtcctccgcgggctccgccccacccggcccgtgggggaggttccgtcccgccgccttcgcccgcgcgctgcactcgcggacgatctctgctcgccttgggcgcgccgtggcgcgcggggccgtgctggcgctgcggctcctcggcctgctccgccgtctggtggccgccccggtgagcgagcggcgggatccgggtgggaggacgcggggggtggcgcgggctgggcctggggatccgcctggggatgtggggtgcaggggcggggcgccccgcggggacacccggcccctcttccgtgcccggcgggacgcgctgtgcccacggggacccaggtccggaggaggcgcccactttctccccagcgctcttcctggggccaggtgggagccgtttcagaggaaaaagccagcgtttctttcgtaaaccaaaaagtatctgggacaagtcccaatccttttgagttgattcggcgaagatcaggaaggagcccgggagacgggtctatgcctttctccaaagatactattgagagcttcggtatttaaagggggaaagcacgctggaggggaaagaaggaggaaggctcattttaccgaattcacctgttgcaaaagaaaagcagcaggtagaatagtcaattatgtatttgtcttgcgctcactaaattggcactttactaagataaggtcaacagagagttattgcactgtctgcttgggaacagaaggaaagacagcttcctgcctgactcagcttccagctttattattattattattaattattttggcagagtgaactggggttccaagttttaattttccttctacagtttgcagaatcgcaaactcttaaatttaggggaacctggggaagaggtggcatccgattcccccccaaccctggtgacgttcttatggatcttatggatactgcagtctctcttctctttctgtctctcctctcttctctttcctttctctctctcctcttctctccctcttcctctctctctcctctcctctctctctcttctctcctgttccctctctctcttctctctcttctttctctcgcttttctctctcctcactctcctctctccctctctctcccctctttcctctttctctcgcctctctctcacctctctcctctctccccttttctctctctccccctcttctctctctccccctcttctttctctccttttctctctcgtctctctctcctctcctctctcctctctctctcctctcctctctctcctcttttctctctcccatctctctctctcctgtctccttctctcttgtctctcgcctttctcctctctctatctcctcactctctccttctctctcctctctctcttgtctctctcccgcctctctcatctatctcctctctctctcccccctctcctccctctcctctttctctcctctatctcctctctccccctctttctctctcctctctctctcttactccctctttttctgtctcatgctcatcttttactgttttcacctgagggaagagtgatgagaagataggaattcacgttttctgaagtatttagaaacgtggggccgtggtgttttctccacctgtttttgggtcattccttcctcatttctcagaacattggtattaacagctcatttccctcctttaagggctgactttgacttagcgatgcctttcctgatggaggaaacagtgagtaactttttaaagtctcctctgttgctgactttgctgattgtcattgaattattatcattttcaagacatctcttttgcgtgataaatggattgagtttggacagtgggaacataggaagtatatgtgttgtttatttttgttgttggatttttgatatattttttttttgttaccagcatgctggtttttttgttttttttgtttttttttttttttgaagtgtaggttcagagtctcactctgtggcccaggctggagtgcggtggcgcgatctcggctcaccgcaacctccgcctcctgggcttaagcgattcttgtgcctcagcctcctgagcatctggaattacaggcacccactaccacgcccggctaatttttgtctttttagtaggggctgggttttgccatgtggagcaggctggtctctaactcctaaactcaagctatgcactcaccttggcctcccaaagtgctgggattataggtgcaagccatcacgcccagccagtatgctggcttttattttaaaatggttagtctttggaacaacgtaaggcaaatgtgactcccttggccaggtcaggcctcgtgggcatagatctgcgcagtcacacagggacctgtgcacacaagggtgccatgctgctttattgctgtgttgctgccatcttcagattcttcatacagttggaacaatgggtcgcacattttcattttcacaggccctcccaaattctggaggtggtctgcacacctggtttagttttctttgaaaatacttgaagttaaatcctgtacctggaagacaacagaagggaattggcaggaggctacgtgtatgggtatccccaccatgacaaaaacaagggccagtttttacctgtttagtgaacagtctctgtgcaaattgatatttcagtttcttttctcatcgctatggaaattgatttttcattttctggtcgctgtggaaattgatttttcattttcttttctggtcgctatcaaaattgatttttcattttctggtcgctatggaaattgatttttcattttcttgactactaggtactgatgattgcaactctcatgttttacaaacaggtgacccagcaccacctaatgcccccaaaccaaagccagatccaaaccccaaccgacctggtttcactggtaagagcctctaaccctacgggtggtctctatattgtttattgtaactttattttatacttattcataagaatattaattcacattttctcatgttttctcatttctatcatatgacatttactgacaaatactattctatctaaatatataataaaatacattaattcctttaatccctaatgttgaaaacattgtgtcttctgacattttagaattatgaattacaaagccaatttgagtcaactttgtctactctttttcattcctttgaagagatttctggcattcaaattgtctagatcaatgctcatgagtacttttatagcttttaacctggttggttgtttgccccagaattgcaccaatttgatttgataccagggtgtctgcaaatgtccctgtcttcgaaccttttccagtagcaattatcacctacaaaacctttgtcaaatagtgtaattattatatcaaaccggtcttagttttacatctctcattctgaaatgtaaaaagcataatgcatcccaatgggccacggagacttcttcttttgtgtattggatgctttggctttgatccttcaattcatggtgcccgccaccaggcccagctcatttttgtattgttagtagagatggggtttcaccatgttggccaggctggtctggaactcctgacctcagatgttctgcctgcctcagcctccctacctactgatgtatgagccttcttcagtgatttatcaatattaaagattaccagccacttattatgaaaatggttttgcactttatttttgcctttgaatatttttaacaggaatgttttacaagtggtatgtttatttttttatggtgtcttatgtttgtgtggatatcctgctttttgtaactttttttccttttaaattgagaatcattttgctattgtcccttctcttcagagaagtaaaaccttctttttaatttcatttgaattgtttatcaccataggttgattgaaggaatggtaacacgttttcaatgttgagttttttcttttattttctttcctttttttattttggagacagagtctctctctgtcgcccgggctggagtgcagtggcgtgatcttggctcagtgcaacctccacttcctgggttcaagcaattctcgtgcctcagcctcccaattagctaggattacaaacatgcaccaccatgcccggcaaattcttgtattttcagtagagacggggttttgccatgttagccaggctgatcttgaacccctgacctcaggtgatccgcccatctcagcctctcaaagtgctgggattacaggtgtgagccaccatgccggcctgagctttttctttgagattcgatttgtctcttcctcttgttgattctgtcaatgggtttctaaagtgttttttccttgtttttgttactctgaatccattttcatgtccactatttttctgtttatttctgtcatgtagaagagattgtgtatatattttttgcaatccatgaaatgatgaccctttgttaaatttcaattttttttctcttcatttctgaccttttctaagaagttggtcatgttatttggtaatgggtttttaaaattttccctgttcctagatttatacgttctctttacagtttatttgtaatttagttctatggcctttgctagaagactcaggacaacttttaatatgtagagttgtaaatatggtagacaactttttttccagacattaggacaaaaacccaaagagattcacctttaaataaaataagtcatttcaataagtgtctttctcttctagtatactttttttctgaacacataggttctcataccatgagatttcttatttctatacaatgtatgtgaaaaatcatgtgctttttattcattgcttgtgtattttaatatggttttgaaaaaaagattcattttgatgtagcccctcatgtttctttcatttgagcctcccttatcactcccaatataaaatgtgcctcgaccttaattgggatttgaaaagcttggaactagaaggctgggccaggtaaggtggctcacacctgtaatcccagcaccttaggaggccaaggcggctggatcacttgaggtcaggagttcaagaccagcctgaccaacatggagaaaccctgcctctgctaaaaatacaaaaattatcctggcatggtggtgcatgcctgtaatcccagctactcgggaggctgaggcaggagaatggcttgaacccgggaggcagaggttgcagtgagccgagatcacaccactgcactccagccaggcaaaaggacaaaactccatatgaaaaaaaaaaaaaaaaagaactagaaggctggctttgaaactagcatgaatgtcacattagtttgtggagcccagctgggtgggtagagccacttttcagacacagatcagaatccgtcagtcacagatcagatcacagtcacctgccctacctcttacggtctgccttgctgaaggtgttggggacctgggaggagataatggggaatcaacgggacagagttgtgtgcaggcagattcagagtcccaactgggtccaggcagcacagttgatttacaaatgacattctttctctctccctctttctcttgctgtcatctcttactcttttcatctgggggaagaatgatgtgaaaatgatcaggaatttactttttcaaatgagatcctagtcagtgtgatattcagaaaagtctttagtcatgtgggtctctggtgatttctccatctgtttccgaggtcattccttcctcatttctcagagctttactatgaacagaccgattccttcctttaggggcagactttgacttagcagatgcctttggtgagggaggaaacagtgagtaactcgttaaagtctcctctgttgctgatttgttattgtcaccaaatgactgtcatttccaagagacttatctcttttgcataatccatggattgggtttatacagtggaaatattggaagtatatgccttgttgtgttttatttttgttgttgttggatttttgttttttttcccaccaatatgctggcttttattttaaaattgttacagactttggaatgatataaggcaaatgtcacttccctggccaggtcagacttcatgggcatgtgacatgtgatgtcacacagggacctgtgcatacaagggcaccatattggtgtattactcagtagctgccatcttgaaattcgtcataaaattggaacagaatcttgcattttcattttgtgcagggcctctcaaattctggaggtggtctggacacctggcttagttttctttgaaaatacttgaagttaaatcctgtagctggaagatgatggaagggaattggcaggaggctatgtgtatgggcatccccaccacgacaaaaacaagggtcattttttacctgtttagtgaaaggtctctatgcaaattgatttttcatttccttttctggtcgccatggaaattgatttttcattttcttgactgcaaggcactgatgatcgccaactctcatgttttacaaacaggtgacccagcaccacctaatccccccaaaccaaagccagatccaaatcccaactgacctggtttcactgataagagcctctaaccctacggggtggtctctatgttgtttacctggcagtgatgtccgtgtcatctgagaagaggagatttcaggtgagcctgttcctactgttgaattacaaggtaattccagtgttcaagtagtggaaaacctagattacgaaaatatgtttttggtttggattttattttccttttcttgattttacttcaaagataaatggaacttccaaatcattgaataagagcttttagatgtagacttgatatgaggaaaagaatctgtgtgtttcccatggagaagccaacttgttttaaacaattagatttttactgagtgtttttctttacatgtttgtttaatttttaacacagaaatctatccagatggtctaaatcctgttgacatttttatggttttttgctggttatgttattattggcataagaatattccttgaccattttctcatgtcatttaatcgtttgtatcatacgactttacattattatactacagacttaattacatactttggtttctttaagtaatccctaattctgaagttatgtttcttctgatgttttggaattatcaattacaaagcaaatttgactgcccttcatgcactttcctttatgtttgaagatatatttctagagtgcaagttgtttacatcgatgtgtgtgagtacttttgtagcttctgacatggttttgaaattgccccagaattgcaccaatttattttgatggcggcggggtgtgcagatgaccctttcctcacaccgtctccgatattggtgttcaccaaaacatctttatccagtagtgcaaaatgtcatgctaaccttgtcttagtttcacgtctttaattctgaaacttgaaacaaaaacaatgcatcagtgggccatggagacttcttcttctgtgtatgggatactgtgtcttttattcttctattctggtatgtcctccctgatttctagtcatttttgaattatttatagacagtaaacattgcccaatatattatgaaaatgtgtttccactttattgttgcctctgaaaacattttgaacagaagcttttataagcaaggcttgaatttttcttttttatgttgtcttaggtttgtgtgagtttccacctttgtgtaacacatttttccttttaacagaaccattttatcactgtctctcttccttcttgggaaaaagaaaaccatctttttcttttcatttgcattacttacaactatgaattgatttatagagtgctaaaatatttgtaaaatcgagcagattcttctgtgtgcctttttctcctggtgatttatttaaatggatttctaaggtgttttcccgtcagtattgatttgttttggtgagtacgattttatgtgcgctatttgtctctctgtttctgaactatagcaacatttttgtgcattctctcttactctccactgaatgatgaacccttgtgaacttccaattgttttctcttcatttcttaatgtttctgagaagaccgacatattatttgtaagtgattttaaaatttgtctccttttctatgttttttcgttgtcttcagagtgtcttcagagtgcattcgtatttttgttgaattggctttgctagagaacacatgatggctttaagtatgagtgaagagagtagacattttttattcctgatttcaaggtaaaaacctaaagaggttcacctgtaaataaaataaattgtctttacaaaaccagatactcattccaagaagatctctctattctagtatacttttttttctaaacatacaatagtataggttctcatactgtgagacttcttatttctttatacacaatatatttgaaaagtcattggttttttagtgattactaatgtactgttacatggttttgaaaagtgttggattcaaagtttccttcatttaagcctcttttttctcccttccccatataaaaagttgatgatggccaggaatagaggttcacacatataatcccagcactttgggaggctgagatgggagcatcttttgagcccaggagttcaagaccagcctgggcaacatagcaaaaccccctctctacaatgaaatgaaaaattagccaggcttgttggcacatacctgctgtcccacctgcttgggaggctgaggcaggaggattgcttgaggccaggaggcggagcctgcagtgagccgtggtcacaccactgcactccagcctgcgtgacagaggaagaccctgtctcaaaacaaaacaaaaatggttcctcgactttagttaggatttgaaaagcttagaactggaaggcagcctctgaaattatcaagaatgtcacagcagtttgtggaacacacctgggtgggtagacccactttttagacactctctagcccaaatctgatcacagtcattcttcctcacctcttagggtctccctcacagaaggtgttgggggccttggacgagatgttgatgggatgggaataaacaggagcaaataatgtgcaggcgaagttggagttcctgctcagtctgggaggagaattgatttatgaatttctttctttctctctttgtatctatctcttctttctctctctctctctctctccccccagccaccttctgatctctaatccattcatgtgagagaagagcgatgtgaaaatggtcagcaatttgctttttctgatgagatcctggtgagagtcatgttcaataaagtatttagtcacgtggggctccagtgatttctctgtttacaagctcattccttcctcattttctcagaactttggtgttaacagcctgtttcctatttgtaggggctgactttgacttagcagatgcctttcgtgatggaggaaatagtgagtagctctttaaagtctcctctcttgctaacttgcttattatcgcccaattattatcatttgcaagagacttacctcttgagaatgatcaatggaacttgtttgcacagtggaaacctagggagtaagtgtgttgttgtctgtttttgatgttgttggacttttgtttgttttttttttaaccagtccacttgcttttgttgagaaactcctacagtctttggaatgatgtaaggcaaatgtgactcccctggccaggtcagccttcacgggcatgcagcttgtgaagtcacccagggacctgtgtttacaaaagcgccatattggtttactggtctgtagttaccatgttgctcttcttcatacagttgagacgaggggtcccacatttttgttttgcacgggaccttgccaactctgtcactgatctagacacctgctttagtttaatttgatattaagcaatgtagccggaagatgatggaagaaagttggcaggaggctgtgtgtacggttatccctgtcatgacaagcaacaagctccaacttttacctggtccgtcagccatctctatgcaaattgatgtttcatttctttactccaagacactcatgattgcaactctcattgtcacaaacagacgacccagcacctcttaattcacccaagctgaagccaaatgcgaaccctgagcagcctggattcattggtaagtgcttctcactctataggttgtctgtatgttgtccacggtagagtggtatccacatcagatggacgacaggctttcagatgagcaggtgcttgctattgactttttgtacagttactccagtgggcagggagtgaaatacagttttctgaaatagatatttgacttgcgttctatttttagtttgctgattttacttccaagattgtatggaacttctaaaacactgagcacaagattttcttatgaacttggtatagagaaaatggcctgtgcattccctgtagagaaacttgggtgtttttgatgtttttgcccttgaatatttgtatcagctattttgacacatgacagcattctcaggtaatctgactagcaactgttttttgaactgaattgttgtgaaacattcaggtttttagttcttttttgtttttaatttttaacacagaaacataaataatgttcatatcctcttggcattgtgatggttatttgcgcttatattttatatatcagtttaaatgaagcaaacgttaagtaataaagccagtcttttgttcatactgcattgtaacattattattattatttttattattattattattatttgagatggagtctcgctgtgttgcccaggcaggagtgcagtagcgtgatctcggctcacggcaacctctgcctcctgggttcaagcaattctcctgcctcagctcctgagtagctgggattacaggcatgcaccaccatgcccggctaatttttttgtgtgtatttttagtagagacagggtttcaccatgctggtcaagctggtctcgaactcctgaccttaggtgatctgcccacctcggcctcccaaagtgctgggattacaggcatgagccactgagcctggcctattttatacttattaatagtcactgaacatttgctcatgtcattttatcatttatatcatatgacatttactgtcaattatattctatataaatatataatacattaatttatttaatccctaatgtttaaaatattgtgtcttctgactttttagaattatgaattacaaagcaaatttgagtcaacttcatctactttttttttttttattattcctttgaagagatttctggcattcaaattgtctagatgaatgtatatgagtccttttatagtatttgacctggttcgtcatttgccccagaatcgtcccagtttattttgatgatggtgtgtgcagatgtctgtcttcacaccatctctatactggttatcacctgcaaaacctttgtcacatagtgtaaggattatatcaaacttgtcttagtttcgcatctctaattctgaaatttaaaaaaaaatagtgcattccagttggccatggttacttcttttgtgtattggatgttatcccctttattcttaaattctcatatgtacctactgatttataagtcttcttcagttatttatggatattaaagattatcagccacttactatgaaaatgtttttgctatttatttttgccttttaatatttttaacaggaatgtttcataagcaagacctatttttttatggtgtcttatgtttgtgttggttttctggttttgtgacttttattttaatggagaataattttgccattgtgtctcctgcttgggagaagtaaaactgtctttttaatttcatttgaattgtcttcaaacataagttgatcaaagaagttgtgaaacattttcaaagttgagctttttccttgagatttgatgcatctgtttctcctgatgatttttgtcaatggatttctcaattgttttttgtttttgtttttgttttttgtttctctgaatctatttctaagtccactatttttctgtttatactataatatacaaaggattttgtgtatttttctttacgatccacaaattgtttgcaaattatttttttttaatttccccttttctatatttgtacattttgtttacagtttatttgtaatttggttgtactgtctttgctagataaacccaggacagcttttcatatgtagaattgtaaatacagtaaacagcttttatttcaggctttagggcaaaaacccagagagattcacctttaaataaagtaaatcacttcaaaaagcctctttctactccagtatacttttttttccctaaacgtataatagtatagtttctcataccatgaaatttcttatttatatataatatatttgactaattatttgatttttattgattactcatgtactcttacatagttttgtaaaaatgttggatttgatgtagcccctcatgtttcttttatttaagtctccttgttatcccctttcaatataaaaatttccccaacctggccaggcacagtggctcacgcctgtaatcccagcactttgggaggccgaggtgggtggatcacaaggtcaggagttcgagatcagcttggccaatatggtgaaaccccatttctactaaaaatacaaaaattagctggttgtggtggcgggcacctgtagccccagctactcgggaggctgaggcaggagaattgcttgaacctgggaggaggaggttgttgtagtgagccgagattgtgccactgcactccagcctggggaacagagcaagacaccgtctcaaaaaaaaaaaaaaagtttttcccaactttagttgggatttgaaaagcttaaaactagaaggcaaactctgaaaccatggtgagttttcacgtcagtttgtccagcataaatgggttggcagagtcactatttagacaccctctaacccctcttagggcctccctggtggaaggtgttggttacctggggggagatgatatttggacaggaaatcaacaggagagaaccatgtgcaggttagagttggaattccaactctgtccaggcagcacaattgatttataaattattttatttctctctctctggctctcatcttttgttcttttcatcagaagggagagtgatgtgaaaatgatcaggaattcactttttctattgagattctggttagagggatatccagaaaagtatttaggaacgtggggttatggtgttttctgcatctgtttacgagaccatttcttcctcatttctctcagaactttggtgttaacagcctgtttccctcctttaggggatgactttgacttagcagatgccttacatgacaaaggaaactgtgagtaactccttaaactctccactgtggctgacttgcttattatcaccaaattattattgtttccaaaaaacgtatctcttgtgaatgataaatgaaacctgtttgcacagtggaaagttagggagtaggtgtgttgttgtttgttttggatattgttggactttgtttttgtttttaccagtatgcatagttttattttaaaactctcacagtctttggaatgatgtaaggcaaatctgactcccctggccaagttaggcttcatgagtgtgtgacttgttcgatcacccagggacccatgcttacaagggtgccatattggtttatgagtctttagttgtcatcttgaaattcttaatattcagttgagcaaggatttctgcattttcattttacacagtaccttgccaattctgtagctgatctgaaaagctgcctgataggttttattgaaaatgctttatcagtactgtagctggaagatgttggaaggatattggcaggaggctgtgtgtatgggtatccccaccatgacaaagaacaaggtccaatttttatatgtttagtgaacgtctgcatgcaaattgatgtttcattttcttcacttcaaggcactcataatctcaactctcatcttttacaaacagacgagccagcaccactgaacccacccaaaccaaagccaaatccaaaccccaagcagcctgattccaccggtaagagcctctaaccctatgggtcatctgtatgttgtttacaggacagtgatatccatgtcagctgggagatttcacatgaaacctgtgctcactcttcactccttgtacaaggaaattccaaaacctagttttcaactatataattttgatttggattatatttttagcgtcctgattttacttctaagattttaagatttaagtcataaatcttaaatagaatcttaaattctgagattttttggattccacctctaaaaagttgaatacgaggttttaaatacagacatgatatgaaggaagggatagttgcattcccagtggagaggtgagtgcttttcaaatagttagatcgttagtgatttttttttgtttacatgcttgtttaacttgtaacacagaaaaatataactagtgtccaaatcctgttgacagtttgatagttatgtgctagtaacgttatttttggcatattcatatttcttgatgattttcttatgtcatttaagtctttctaacatgacttttactgtccattttatgtccttatttatttcccacataattatatacttcaatatttaattttgacaatgttatgtttcttctaacattttagaattatggatttcaaagtcaatttgaatcaactttatgcacttgtttttattccttcgaatcaatttctagaatgcaaattgttcagatcaatgtgtatgagtacttctgtagttttgacctggttctgaaattggcccagaattatatgaatttattttgatgccagggatatgtgcaaatgtccctttcttcccaccatcgttactgctgctgatcacctagaaaacctttgtcatgtactatcacatgtaacattaatctttgcctagtttcagttctttagttctgcaatttaaaaaaaaatagtaaatagtacatcaatttgccacgtatacttctttttttttctttttttttttttttgagatacagtctcgctctgtcgccaggctggagtgcaggagcaccatctcagctcactgcaacctctgcctcccgggttcaagcaattctactgcctcagctcccaagtagctgggactgcaggtgcatgccaccatgcccggctaatttttttgtttgtttgtttgtattttagtagagatggggtttcaccatgttacccaggctggtctccaactcctgagctcaggcagtccacccgcctcggcctcccaaagtgctaggattacaggcatgagccactgcgcccagcctacttcttctatatgtattgattactttgcctttattcttatcttccgatatgtctgtattgttttataaacgttcctcatttttttatagacattaaatattgccaaccatttactatgaaaatgctttttcatcttatttttgccattgaatagtttaacagtattttttgacaggcaagtcttcaaatttttattcatggtgtcttatatttgtcggagctttctgattttggtgacttttttttttttttttgagagagtcttgctctgtcgcccaggctggagtgcagtggcacgatctccactcactgcaacctctccctcccaggttcaagcgattctcctgcctcagcctccccagcagctgggactacaggcacccaccaccacgcccagctaatttttgtgtttttagtagacacaggatttcaccatattggccaggctggtctcgaactcctgacctcataatctacctgcctcagcctctcaaagtgctgggattacaggcgtgagccaccgtgcccagctgacgttttttcctttgaacttcagaaccaacatgcctgcaaaattgagatttttcttgatattcgatgtacctctttccctgatgatttcttttaatgcatttctagttttttcttttttttcatttttctggatatatttttatgcccactatctttctgtttatttttgttacatagaaaggatttaatatatttttccttactatatcctgaactatgatcccttattaaatttctattttttctcatttcttatctttctaagaagacaatcatattatttgcacatgatttttaaatatttttcaattttctatctttatatgttctctttacattttatttgtatttttgttgtattacctttgatagtaaacccaggacaggtttaaatatgagtgaagagagcagatattttaaattcctgactttaaagcaaaaacccaaagatactcacctttaaataaaataaattgcctttttaaaaaatgtagtcatttcaggaagggtcattctattctggtatacatttttccccaaatatataatattattggttttcataccatgaggtttcttatttctttatatatatatatttggataatcatctggtttttattgattactcattaaaaccacgtaagttattgattactcattgaaaccatgtaagtatattcttacatggttttggaaaaatgtcggatttgatgtagcccctcatgtttcttttatttaagcctccttattatcccctttcagtgtaaaaatttctccagccttagtcaggatttgaaaagcttaaaactagaaggcaacctctgaaaccacggtgaattttcacgtcagtttgtccagtacgtctgggttgatagagccaccttttagacaccctctagcccaaatctgatcatagtcatgtgtccccacctcttagggcctccgtggcggaaggtgttggttacctgaagggagatggtgatgggatgggaaatcaacaggagggaatcctgtgttggcagagttagagttccaacttcgtccagccagcacagttcatttataaattactttgtttctctctctctctctccctctctttccacccctgactcttgctctcatcttttactctttgtgtctgagagaagagtgatgtgaaaatgatcaggaattcactttttcttatgaggtcctggtcacagtgatacttagaaaacacttaagaacttaggcctgtggtgttttctccatctgcttccaggtcatttcttcctcatttctctcagaactttggtgttaacagcctgtttcccttctttaggggatgactttgatttcacagatgtttcttcatggtgaacgaaacagtgagtaactctttaaagtctcctctgttgccgaattgcttatagtttgtttgtgtttttggagtgctgtaggaagagcagtgatgaaggtttgaggcttctagatgcttccatattagttgcctggggctcaggcaggggcacacatgtggacccctggggggacatgacagttgagctaacagctgaggaatgaggatgacttatatcccaaggagtgggtcaaagggtgttttgtgtagcaagtgtggcatgtgcaaagggcctgtggtcagtggaactgagggtgcctgtggggctcagtgagggggaaaagaggaagtcaggcatggcatgggatggaggggaacagagtgaggctacagtcagtgcccagtcttgaaaatgtcccttcgagtgtccctaggggccatccttgttttcagtgcttattacccctgctcccctctgcttgctcccagagagctgtctcctgcctcccagctctgcgtctcagatcctggctctgatcccacgctgctgttgcttacactcatgtacccattgctaatgtcatcattcccttcggcagctaagtgcaaagttaatttcccatttgaaaagcagtctgtactaataacaatcaactgggagacccaaaagagtgcagttaaagagaaaaaaaaaaatcaaactttccctcaaaagaaaccagtgataccatttgggtccacctccctgaggtttgaaagcctctccgttagtgttagttgcttttaggcctcttcttgctgcattagcaaggtgtatctttctctttatatgcagacagtgccctcttctggtgggaggctctcagtgtctgtctacaaatccatgacccaagaggtagaggggtcccaacggtcccacttaacttctgccaaagtggtgcccttgggaatccccaacttcctgtgcccacctgttctagctacttggttcactttgacccagctcttcaggggtgataccctccctcatcaggctcccagatcccatcaggtgttgaaaccccatgtgataggtgaaatactggtccccagagatgcccacatcctaaccccttgatcatgtaaatgtgtgaccttatgcaacacatgggactttgcaaatgggattacattaaggatcttgacatgggacgattatttaggatgagctgtgtaattacagtggaatcacaggttccttagagaggcctgcatcagaggatgaaggagttgttcacatgtggaaagagacagaaataaaagtggagaggaccattgaaaaaaaaagtcattgaaagactttggcacccaggttgccatggctgcccccagcccttcaaattctcctaaagccccaaatgatctttccctggaagatgcaccagcccattggatagcttagatgcagctgttggagggtggatctagcctgtgaggacccagtaacctggacccaatacatgacaacaaggattgaatgagtggtcgtttactgctgagtaattgctggttttcctggctacctgggccctgggtcacatggatgagagggctggaaaaaatgattatcagcacagagtcccagaatctctgtgacttctggtcacagatattttgagtgtatgtatagaaaaaagcagttgttcctacacattcagtgtcagaagtgaaggatgagaggggagaggggtgtgcatgtcaaaggaaaaaacagcttttcccccctgtacgtgaggtcacagcaaatttgcaagattcagtgcatggtgagagaagcaggcagccgctgacatccaggggctggcctggctcccgctacctggcttggggtttcctgttggacctaagaaatgtcacagacaggacatttttaaagtcaataagaaatgtcagacaagagcactgtgatgaagtcaagagaccgtgggttgtgctttggctggttcttgatttatttctgctcaaggcaatcagtatgccaaggtggcatatttcagagtgtcacgtaatgatctacattcttattcagggtggggtgtcctgtaccccatcaactggaaggttgtagcacttcctgctttctagacatggtaaatgaactccctgggtcactgggaaagttgtagcacttcctgcttcctggagatggtaaataaactttctgtgtcacatgggaggttgtagcacttcctgctgcccagagatggtcaatgaacttcctgagtcactgggaaggttgtagtacttcctgcttcctggagatggtaaataaacgtcctgggtcactgaggaggttgtagcacttcctgctttcctagagatggtcagtgaacatcctgggtcactggggaggttgtagcacttcctgcttcctagagatggtcaatgaacttcctggagatgttaaataaacttcctgggtcactagcgaagtttgtagcacttcctgtttcctggggatggtaagagaacttcctgggtcactggggaggttgtagcacttcctgcttcctagacatgataaatgaacttcctgggtcattggaaggttgcagcactttctagtttagagggacattataacacttcctggtttatctggagattgtaatgctttctgattcatagggacattgtaaaactttctggctcacattgttacatttcctggttcaaatggataatagtagcacttcctggttcacagggacattgtgacacttcctggttcttatgggtaattgtagcatttcctggttcacagggacattgcaacgctttttggttcatacacataattgttagcacttcctgattcccagggacattgcaacacttcctggttcatagggataattgtagcacttcctgtttcatagggacattgtaatactttctggttcatacgaataactctagtacttcctggttcatatagataatagtagcaattcctggttcacatggacattgcaacacttcctgtttcacagagacattgcaacacttcctggttcattctgataattgtataacttcctggtttgcagggacattgtaacactttctggttcatatggataatagcacttcctggttcatagggacatagtaacatttccgggttcatacatacggataattgtagcacttcctggttcatacggataattgtagcacttcctggtttgcagggacattgcaatacttcctggttcatatggataattgtagcacttcttagtttttaggatcattgtgacacttcctggttcatagtgacactgccacactttctggttcatatggataattgtagaacttcctggttcataaagacatttggaaccgtctggttcatagggataattgtagcacttcctggttcatagggacattgccacacttcctggttcatctggataattgtagcacttcctggttcatagggaaattgtgacactttctggttcatagtgacattgccacacttcctggtccatgtggataatagtagcacttcctggttcgtagggaccttaccacacttcctggttcatccagataattgtagcacttcctggttcatagggatattgccacactttctggttcatatggataattgtagcacttcctggttcatatggataatagtagcacttcctggttcacaggtacattacaacacttcctggttcattcagataattgtaaaacttcctagtttgcagggacattgtaacactttctggttcatatggataattgtagcacttcctggttcatagggaaattgtgacactttctggtttatagtgacattgccacacttcccggtccgtgtggataatagcacttcctggttcgtagggacattgccacacttcctggttcatccagataattgtagcacttcctggttcatcggtaaattgtgacactttctggttcatagtgatattgccacacttcctggttcatagtgacattgccacacttcctggtccatgtggataatagtagcacttcctggttcatagggacattgccacacttcctggttcatccagataattgtagcacttcctggttcatagggatagtgccacacttcctggttcataaggataatagtagcacttcctggttcacaggtacattacaacacttcctggttcattcagataattgtagaacttcctagtttgcagggacattgtaacactttctggttcatatggataattgtagcacttcctggttcatagggaaattgtgacactttctggttcatagtgacattgccacacttcctggtccgtgtggataatagcacttcctggttcatagggacattgccacacttcctggttcatccagataattgtagcacttcctggttcatagggatattgccacactttctgggtcatatggataattgtagcacttcctggttcatatggaaaatagcacttcctggttcacagggacattacaacacttcctggttcattcagataattgtagaacttcctaatttgcagggacattgtaacactttctggttcatgtggagaattgtagcacttcctggttcatagggaaattgtgacactttctggttcatagtgacattgccacacttcccggtccatgtggataatagtagcacttcctggttcatagggacattgccacacttcctggttcatccagataattgtagcacttcctggttcatagggatattgccacgctttctggttcatatcgataattgtagcacttcctggttcatatggataatagtagcacttcctggttcacaggtacattacaacacttcctggttcattcagataattgtagaacttcctagtttgcagggacattgtaacactttctggttcatatggataattgtagcacttcctggttcatagggaaattttgacactttctggttcatagtgacattgccacacttcccggtccgtgtggataatagtagcacttcctggttcatagggacattgccacacttcctggttcatccagataattgtagcacttcctggttcatagggatattgccacactttctggttcatatggataattgtagcacttcctggttcacagggacattacacacttcctggttcattcaaataattgtagaacttcctagtttgcagggacattgtaacactttctggttcatatggagaattgtagcacttcctggttcatagggacattgtaacacttcctggttcatagggacattgtaacatttccaggttcatatggataattgtagcacttcttagtttttaggatcattgtgacacttcctggttcatctggattattgtagcacttcccggtttatagggaaattgtgacactttctggttcatagtgacattgccacacttcctgattgatatggataatagcacttcctggttcatagggacattgccacacttgctggttcatccagataattgtagcacttcctggttcatatggataatagcacttcctggttcacagggacattgtaacacttcctctttcattccgataattgtagaacttcctaatttgcagggacattgtaacactttctggttcatacggataattgtagcacttcctggttcatagggacattgtaacatttccaggttcatacagataattgtagcacttcctggttcatagggacattgtgacacttcctggttcatatggataattgtagcacttcctggtttgcagggacattgcaatacttcctggttcatagggataattgtagcacttcttagtttgagggacattgtgacacttcctggttcatagtgacactgcaacactttttggttcatatggaaaattgtagtatttcctggttcataacgacatttggaaccgtctagttcatagggataattgtagcacttcctggttcgtagggacattgccacacttcctggttcatctggataattgtagcacttcctggttcataaggatagttgcaacactccctgggtcatcacccccatcctgccatctgctccagccctatgcagccactcagaaatctacttcctatcccatggatttgcctatcaggggcatttcaaacggcctcccatgtggttttgtgcctggcttctttcactcagcataatattttcgaggtccatcgattttgtaccatgcatcagaatttcattccttttgatggcagaatgacattccattgtatgggtagaccacattttgtttatccatacacttgttgttgggcattgggttatttccactgtgtaactaccatgaataatgcttagcacttagcatacggttaagacttctatgtacatacttgtctgagtaactgtcttcaattttttgggtaaatacccaggaggggaatggctgggtcatatgataactctatgtttaaccattgaaggatccgccaggctgcttttcaaagcaaccgcaccattgcaccatcccacaaacaatataagagtgctccagtttctgcacatctgagccaacacttgtcactgtccatatttgtcattagagccatcctagtgtgtatgatgggctatctcattgtggttttgatttgcatttccctgatgaccagataggttggctttcaagttttcatgttctttcttcttctctgtcaagtagatgagtaatacttaaataaatatttcttactcagcattttgatgtatttattcatagccttattaatgcttgactttatttgtttatctctcagatatgggtctctaaatgtcagtttcaagaaggaactgtgttttgttcaactccaaaatccccagatctatctaggacactgcctgaaacacagaaggggttaaaaaaatatggatgaaatataatagcaaatgcatgtcctattttaaaatatcgacagttattctatttgcagaacaataaattcaatgtgaagactaagatactgttgattatttatgtgtgtatgctcgtatatgtatatatacatacatatgtgtgtatacctctacatgtatgtataggtatgtataggtatacatatgtatatgtacagacatatgtataggtatacatatgtatatgtacagacatatgtataggtatatacacatatacaagcatatatatatacatatgcaagcatacccacattatgtacatatatgtaatatatatatatatacacactcacatatacatacacacacacatatatttacacatatctttataaaacacagacctaggatattttccctagaatcaggtccaaggcagatagttgaaaaatgtctgatttctaatttgtggttgaaataaaactaagaacatttcattattttcatcatgatttattttgctgacttgttgaacatatgcaggcttgttacctgggtggactgtgtgatgctgaggtttggggtatgaccgatcccatcacccgggtagtgagcatggcacccaataggtagttcttcagttcttaccctatccctccctccaccctctaggagcccccagtgtctgttcctctctttgtgtccatgagtacccaatatgtagatccacttataaatgagaatgtgcaatatttggttttctgtttctggattagtttgattacaataagaacctccagctccatccacgttactgtaaaggacgtggttttgttcttttctgtggctgtgtagtatcccacagcgtctatggaccacattttctttatccagttcacccttgatgggcatttaggttgattccatgtctttgctatggggaatagtactgtgatcaacatgcttgtgcaggagtctttttggtaggataatttattttccattatgtatgtatccaggaatgggattgctgaactaaatggtagttctctttttagttctttgagaaatctgggagatatgtcttggaatgaacttcatatagctttttactgcctcccttttaaaatgcttccagaaggctgtcccttatttggtgcacagaaactggctaaaaaataaatgtgaccagctgggagtggtggctcacgtctgtaatctcagcactttgggagactgaggcaggtggatcacctgaggtcaggagatcaagaccatcctggccaacatggtgaaaccccgtctctagtaaaaatacaaaaaattaactgggcgtggtggcgggcgcctgtaatcccagctactcaggaggccaaggcaggagaattgctcgaacttgggagccagaggttgcagtgagctgagatggctccactgcactccagcctgggcgacagaacgagattccgtctcaaaaacaaacaaacaaacaaaaattagccaggcatggtggcacacacctatagtcccagctactcaggaggctgaggcaggggaatcacttgaacccgggaggcggaggttgcagtgagctgagatctcaccattgcactccagcctgggcgacagagcaagactcggtctcaaaaaaataaataaatataaatacaattaaaacaaataatataaaaacgtgacctgcagccacctctccaaggggcctggataccaatggaaggaagtgaaaaggaggagatgaaaaatttacaccttgaaagctgaaagtgttctaatattaccaatgctgtggagtcagacacatcgaaagtgactctaatacctcctgacatccttatgttatgaatatgtagacaatagcaaattattctccgcttttttccagctcattgaaacatgttagggaggaacatttctgcattgacaacagctttaaatatttcattagtgcttggaagaaacacaagaatctgtgacgcagaagggaaatgaaaaggaaagcttagtctccatttagttatgttcctcataaatatttcccagaggcaaagatgttctctttcatattaaaaatacaaataaacacttctcattagcccaagaaaatattgtagagattttcattatccaaaaaaggcacactttcaagacacacggaacagagacggcacattgccttagcttgcttctggctagcatgtctggctattgaccggattttatttttaaatgactaaaataatatattaactaaatggtaaaattcatattcagcattggcttgagggcatcggagggttttggctggcccagtcatctctaccagtgaagaaagcaaggaaataggtcatttcactcagggacagcttgaaaacagagatttcatggagcttcctcattccgtcagcctagagtgggattttggctgtcacccttcaaggatgaaaaggtgcagaggacattgggctgcagacagggcgctcgtttaaatgatttaaaagttttggtcagtcgtggtggctcatgcctgtaatcccagcactttggggcgccgaggcgggtggatcacctgaggccaggagttcgagaccagcctgactaacatggagaaaccccatctctactaaaaatacaaaattagtcgggcgtgatgccacatgcctgtaatcccaactactctggaggctgaggcaggagaattgcttgagcctgggaggcggaggttgcggtgagccgagatcgtgctattgcactccagcctgggccacaagagcaaaactccatctcaaaaaaaaaaaaaaaagtttccatctggctggacacggtggcttacgcctgcagtcccagcactttgggaggctgaagcaggtcaatcacttgaggtcaggagttcaagaccagcctggccaacatggagaaaccccatctgtactaaaaatacaaaaattagccaggcgtggtggcgggtacctgtaatcccagctactctgtaggctgaggcaggaaaatcacttgaaccctggaggcagaggttgcagtgagctgagattgcaccactgcactccagcctgggcgacagagcaagactccgtctcaaaaaaaaaaaaaaaaaaaaagtttccatctaagcgagctctgttggttctcccacctctgaccttatgagttttcttctttaacctgcaccttgttctctgagtcactttgcacttgaaggtacagctacagcttccccatcagacttgttggtcgtttatcaaaggatgaaaaagttcttcctcctttgggtctttaaccctgtttcctggtgtaagacagcttttatgtttgctacctgctggaatcaacttgaaattttctcccagaaaatttgtgaatttatcttgttcaagttacttgtggtcaataagttaataaagataggtagacagacagacaaatacattgatacagatagatagattcatgatagatgattgatagatagatattacacagatacatagatacatatcttagacctgatatatacagggtgggtggatagataaatgaataaatagatagatagatattacatagatagatagatacatagattagacctgatatatacagggtgggtggatagataaatgaataaatggcttgattgatggattgatgattgatggattgatggattggtagataaatgaataaatggctagatacatgattgattgattggtaggtaaatgaataaatggctagatacatgattgattgatagatgatagagattagatagatatatagatacatagattagacctgatagatatatggatatatatacaggatgggtggataaatgaataaatggctagatacatgatatagatagagccaatacatacataggtacatagacagggtaggtgggtagatagatgaagacatggatagataaatatacacagagatagatcaatgatagaaatgggtatatagatatatgaatgatagaagatattttgagagagagatgattaataggcaattgattgacatattagatgacagataaaaagtgggtaaaatgcaagtaaactgtaagccaaacgtccacgtggaatagcgtgggaagcattgagaagacgctttttggtgctacctgtttaaacattgaaaaactgagctaataccctccacagtacgatagaggggagggcactgggaatttatacctcccaggaaaaataaatcatggtaaacaggcagagatctttccagattccagttcttgggggtaaaaggtccccaagatgcccagtttgtgacaacctgttttgaactattcagctcaaggtttccattttttctcccaggggagttgcctcgattctgatgtgtttgcttcggtgctctgtgtattgtattcatcccactcttcaattcataaactctggagattcttcaattcactgggcaaaccatatgcctaagtctatcctctgatggaggctcgtacatgcaaaatccaatagcaacctgggaagatttcagtcaagacccaagaggaggctggcatcaggctctcggtcaccgatcttcacattcaggtttcctgatgcactttgcgactctttgggcaacctctggactccttgttcccagggtccacatttagttttatctttactgcattgcttttatgaaaaagaataaaattggatgaaacagatacagagtattggtgtcaacctaagtattggtgtcaacaaagagatggtttggatctggttccccaccacatcttaggttgagttggaatccccggtttggaggtggcgcctggtgggaggtgactgcattatgcgggtggtttccattgaatggtttaccactgtcccccatggtgctgttgtggcggaagtgagttatcatccaatctggttgtttaaagggtgcaacaacttccccaccccgtcctgctcctgctgtggccatgtaagatgtgcctgtttcccctctgccttccgccatgattgtaaatttcctgaggcctccccagccgtgcttcctgtactgcctgtggaaccgtgagccaatttaaacctctttttctttataaaattaccctgtctcaggtatttctttatagcagcgtaaggactgactaatacactctgtaatagaaaagatgtttatttgggagtatagtagtgcgctgagaatagatgtgccatattaaactgtgttcatattcagggaggtaaaggggaaaaaaggattttaaaggaaataatgaagaggattccataattcttttcaaatgattatccttggctaaaaagatcaataacatggtgacaccagtctgagtttggacagccagtttttgggcagatgtcctcgtggaagtatttttctttgcaagggtgagatttttgcagtctcttacgatagtttttgttatcaggcatataagcataaaaaccattaatatacactagagatgcattgaagagcttataaaattgttaaggttttcttctttggtcagtgtctaaaatatgagtcagatatttccttggttatctttgagatttatgtggtcccaggtttctcctgggtgggtagaaattactgcagcatgtacaaaactgtccttcatgccatatttcttcctaccattatacgatgaaaactaacaaaagagagttttataaaatgttcttcctctttctctctggtaccaataggaagcacaattgtttccccatggttcttcacaaaggttctattgcactaagttttaaagccttgtgtatacacaatcacattcacatataccacacatacacgtgcatatacacagttacatccgtacagatacatacatgcacatgtatacacagataaacacatacatgcacaaatatagacacatacacagacacacattcacatgtatgcggacacacacacatagacacatatacctatgcacagaaaccatacagatatacacatacataacatacatgcacaggtatacatacaaacatacacagatatgtgcatacacatatacacacataacacatgcatgcacacatatccacaagcctgcagatatacacacgtacacacagatatgcatattcatacataccaaacatacattcatacttacacctatacacacacatacacaaacacatacagagatatacacacatgcacacaaatacatacacacatacatacacagatacacatgtacatacataccaaacatacatgcatacttacacctacacacatacacaaacacatatacacaaacacacatacacagggatatgcacatgcacacagatacccacatacacacgtacatactcacatagagttacacacacacacgtgcacacgcaactttggcataatggaaatttgatgattggtcattggagtcaaccatacagcccctgtcagaaacaaaggaccaaagtcgaaggggacatggatgcacaaacatctcaacatctacggaaccacgtaacttggagaaacatgcaaccaactaaggacagaagattcgagtgactgcaactctgttttttttttttttttgagatggagtttcgctcttgtcacccaggctggagtgcaatggtgtgatctcggctcaccgcaacccccgcctcctgggttcaagcgattctcccacttcagcctcctgaatagctgggattacaggcatgcaccaccatgcccagctaatttcatatttttagtagagatggggtttctccgtgttggtcaggctggtctcgaactcccaacctcaggtgatccgcctccctcggcctcccaaagtgctgcgattacatgcgtgagccaccgtgcccgtcctaactgcagctcttactttggaattcaggcagctacggagccaagattcctggagcccacaggcgtgtggctaatacatttcccttcctttccatagaattgggttggttttgttgcactgggtgtctggtagctccggagagaacaaatataaatgtgaaaatgcataccttggtcatcagtgtttctcaacaattctccatcccacttaacaaggcctctgctagaactctggggtccgttccaagaggaaaaacatccctgcctagaagaagcaaatggaagaatgtactctatgctgccatgtgtgttctcatcaggccttatctaagtttctcaccaggagatgttgaaaaatattgcttgatggacgaagggtaacgtactgcagttgtttattgagaaatgccagccgtcatctcttgctcgttagctgctctgaatgctcttagaaggcaccattcatgccgctgtattcgggactgctgaattgtgccacattccttggtgttacgcgtgtctcttgttgatgaagttctaaccacagtgccattgtgaggctggaaatgtccttgggtgaaaaagcggcccctgggtcacctttcccatgattcaggtgcatgtgaacccctctagtgctttactgccagggtccaggagagagggaaagaatgtcactgtcccagcatcctctaatttacttgacaacacaattgttctagtgtcaagagttttgttttgttttgtttttgagatagagactcgctctgtccctcagactggagtgcagtggcacgatctcggctcactgtaacctctgcctcccgggttcaagtgattctcctgcctcagcctcctgaatagctgagattacaggcacctgccatcatgcctgactaattatatttttgtagagacggggcttcaccgtgtcggccaggctggtcttgaaccactgacctcaggtgatccgcctgcctcagcctccaaaagtgctgggattacaggcctgagccaccatgcccagccaggtatttttttttttttcttcagctcaagaatgaagtttttcttagtatcctgtagctaaaatgatgcttctccaattttatttattaaaaacgcctaacgctggccgggtgcagtagctcacgcctgtaatcctagcactttgggaggccaaggcaggtggatcacggggtcaggagattgagaccatcctggccaacatggcaaaatcccgtctctactaaaaaaaaatagaaaaaattagccgagtgtggtggcgggcgcctgtagtcccagctactcaggaggttgaagcagaagaagcgcttgaacctaggaggtggaggttgcagtgaaccgagctcgcgccgctgtactccagcatggcaacagagtgagactgtttcagaaaaacaaacaacaaaaaaaaacaactaatagtaatgatcacatttttgggctcaaacatcttaattctggaaagaggagatgccacaatggataccacactaaagagatgctctggagaattttgcaagggaagaaattgtcatcttagggagggcacactggggaagcttttcagacactggtcattcaccggtatgattagaagaaatgccacacagacctcaggataccttgacccagacggggtcactctgatgccttctgaagtgagaaattgatcacgttaccacagctagtcaccactcactgggtgacttcagacaaagaaaattgacgttgtcaccgttccaaagaccagaagtctgagatctaggcgtgagcagggctgcgctaccctggaggctctaggggaggatccttcctgcctctcccagctcctgggggttccaggtgttcctgggcttgtggccacatcactccaatccctgcctccatctccacgtggccgcctcctctgtgtctccaaatctctatctccttgtaaggacactagtaattggatttagggcccaccctaaatctgggatgatctcatctcaagatccttcacttaagtatgtctgcaaggaacctatttctaaataagatcctgtttctacattttgagggtgaggacatgcacatcttttttttctttttttgagacagactctcactctgtcacccaggctggagtgcaatggcacgatttcagctcactgaaacctccacctcctgggttcaagcgattctcttgcctcagcctcctgagtagttgggattacaggcgtccaccaccacacctggctaatttttgtatttttagcagagacagggttttgccatgttgctcaggctggtctcgaactcctgaccttgtgatccgcccgcctcagcctcgcaaagtggtgggattacagacgtgagccactgtgcctgccgcacatatctttttatgactcacaacaatatgcaactctggcatgcaatcatgctagtggtttacttgggcagaccctccaggcctgcgtggcaagggagtgggggttcacgccacagcaaagaggaggaaggaaaacccctgtgcttcagctttttcggatcacaggaaagagcaaacccagcaattcaagggcagcggtcaaagactgcaggtatagagcatgagaagcagtgagcacagggctggaggggggcacagaaatggtagcaaaggtcagggatatgaggggatagcttgaggtggggccgaccttcatgggagggatggcagaaggcgaagatgattcaaagggaggatggggcaccggtaacatcagctccaggagctcaggaaagtgtagaagggagctccttctccatccaagactgaccccgtgtctctcacgctttggtgcaaggatgcatggatgctgagactcataggaagggtgtgtgaggcatgaagcatgtgggaagtggaaaaagggaaagaggaggagaagggctgtggggaaataagtgagtagaattgaggaaacagaccattgacttaattcttgaaaggattcaaaggccaggtgcagtggcttatgtcagcaaccccagttactcaagaggctgagagaggaggatcacctgagaccaggagtttgagatcagcctgggcaacatggtgaaactccgtctctactaaaaatacaaaaattggctgggcaggctggtgggcacctgtaatcctagctacttgggaggctgaagcaggaaaattgcttgaaccaggaggcataggttgcagtgagctgaggtcgtgccattgcactccagcctgggcgatagaatgagactctgtctcaaaaacaaaaaaacaaaacaaaaaagatacgggttgagcacagttgctcatccctgtaatcctagcactttgggaggttaatgcaggaggattgcttgagaccaggaattcaagtccagcctgggcaacatagtgagaccccatctctaaaaaaacaacaagaaaaacacaaaaatatacatcatgacacctgtattcacactcctcatatactgcagacaaatgccattttgaagagagggagctttattcctgagtgggcggaggaagaaggatgaattgaggaagtgtgttcattacttgtcagctgccaacactgaaaacaacacatgtttattttcttacatttctgtaggtcaggagtctgaaatggatttcactattttaaaatcaaggtgttgggaggcttgcagtctctccagaatctctaggagagaattcatttcttactttttctagtttttacaagccacctgccatccttggctcattagccgttaccccatcttcaaagcacatgactccgacctctgcttccatcctcacatcccttttttctgcggttaaatatctcccttcctctccttataaaagccctgggaccccactgtgattccatagatcattcaaaaaatgtccccatcttaagaaccttacctgaatcctatctgcaaattcctctttgtcctaaaagttcacaagttctaagaattaggatgtgggcatctctggggaccaggattgtacctgccacatagggtttgaacacctgatgggatctgggagcctgatgagggagggtgtcacccctgaggggctgggtcaaagtgaaccaagtagctagaacaggtggtcacaagaagttggtgattcccaagggcaccagcttgggagaagtaagtggggcagctggggacccctccacctctagggtcatggatttggagccaggcactgagagcctcccaccaggagagggcaccgtctacatataaagagaaagataggccgggcacagtggctcctgcctgtaatcccagcactttgggaggccgaggtgggtggatcatctgaggtcaggagttcgagaccagcctggccaacatagtgaaaccccgtctctaccaaaaatacaaaaattagccgggtgtggtggcgggtgcctgtaatcccagttactcgggaagctgagacaggagaattgcttgaacccagaaggtggaggttacagtgagccaagatcacaccactgcactccagcccgggctggagtgagactcagtcttaaaacaacaactagctgggcgtggtggcacacacctgtaatcccagctacttgggaggctgaggcacgagaatcgcttaaacttgggaggcggaagttgcagtgagccgagatcacgccactgcactccagcctggctgacagagcgagactccatctcaaaaaagaaaaaaaaaaaaaaaaagagagagagaaagatacacattgtatatgcagcaggaccaggcctaaaagcaactaacactaacagagaagttttcaaacctcaggaagatggacccaagccatatcactggcttcttttcaagggaaaatttgatttttttttcccttaactgaactcttttgggccaccctgttgactgtaatgagcacagactgcgtttatcgtgggaaatgaactttgcaatgaattactccaagaaatgatgccgttagcaatgggtacatgagtggaagcaacagcagcgtgggatcagagccaggatctgagagatgcagagctgggaggcaggagaaagctgtctgggagcaagcagagggtgctagacccaatgaacatggcaagcaaggctagaccctgaggacagtcaaagggccattttcaaggttgaggactgactgtggcctcactgtgttcccctccatggcacgccatacctgagctcctctttccctcctcactgagccccacaggatcctcggttccatcgaccacaggccctttgcacgtaccacacttgctacacaaaactttctgcctctaccttgtgctgtcttcatacttcaattgtcagctccactgttagctccatggtcacttgcccttaaaagttcacatctgtggccgggtgcagtggctcactcctgtaatcccagcactttgcgaggccgaggcgggcggatcacggggtcaggagattgagaccatcctggctagcacggtgaaaccccatctctactaaaaatacaaaaaaaatagctgaatgtggtggcatgtgcctgtggtcccagctactcaggaggctgaggcaggagaatcacttgaacctgggaggcggaggttgcagtgaatggagattgcgccactgcactccagcctaggcgacagagcgagactctgtctcaaaaaaatttaaaaaaaaataaaaaagttcatatatctgtgtccctgcctgacccaagctgaccatgttataagcatctagaagcctcacctccttactgcggctctgaccacggcactacttttatatcctgtgggcaattttgtttaaatatccgctttcctcgttagacgctaagcaacatgggagtgagtgtctggccatggtttgctcatctgtgcatctccaggactggctgggttcctgggtatgaagaagcagcggtccacacacatgggtgaacctgtgcttcttctcaccactacactgcttggcttccttatttccttcctgtcacctggaatgcctaccctgtacttctctccagctccaacaccatcatttaccacctcgttcagctcccaggcatcctagaagcctttcctgaccacaggggtgcatcgtggtgcacaattccttcagctgccactatggtgcaagatgagtctagaagaacagttttgctgtgcggtcacccttactcactattgtgattttgcctttaacatattgaaaaagacacagaaaacacacaccatccgatcagttagttgcagacacatcgcccgatgctaagaatgtgctgtgttttaaattgacgtctgttggctcttcagcttctgctctgggcttcttatgtccccactcggccctgaatcccattcccccaaatctcagtaactttggtggcttttgcaccagccaaaatcagatcctaggtcttgagcaaaaccaagagcaaggaaaaaaatcccacatgggaatctgagacctcactctaatgacttcagttgctgttgacttgatttccttcaactgccgaaggaggttagaacagtttcctcttgcttctaggacaaagcatcacagactttgcagcttaaaacaatgcacatttctttgcttacagttctggaggtaagaagtctgaaattagtttcctggggctcccatcaaggtgtcagcagggctggcttccttctggaggctctaggagagaaacggtttgcttgacatttccagcttctagaggctgcctacacgccttattatgtagctgctccctccatcttcaaagccagcagtgtagcatcttccaatctctctctaactctgaccctcttgcttccctctttccatgataaagacccatgtgataacattggtcctacctgggtaatccagtaatgtcttctcatctcaagctcagctgatcagcaactttcattccatctgcaaccttcatttcccttgcacaggttctgggaatcaggacatggatatctttggagcctgctattgcttctacctacaactggtgttacaagacttggcccacttaatcttgcaaattctttctgcccctctcctgtgcttaatgagatctgttctctatgaatgttcaggacctcaggagtagggaccccaaaggctgggggcaaagtagatgtgacaggtgccaagcataggatgtgtgaccagattcggtcatgtgattacattgtgaagtgacccaggcattttcattaagaaggaaagtggttgtaggaggaggaaattgaacacaacccacacatgggtggttggaaaatctgagacctctcgtgggcatgctcatccatttcactcaccggtacaggggaaattcttagacctgtcagtgcaactatttgaaataaacatccaagaaaggcagcaaacttcaggtaggatgaagtcagaagtccaccctgaagcacagtaaaagccacaagacagaagtgactgatcccatcccagggatcctaaagaagattatcatcagacttctcattggaaactttggaagtcggaaggcagtaggctgataaattcaaaatgctaaaaaagaaaaccaatgaaaacatgctaaccaagaaaaaaaaatgctacatggctgaagaaatcatgcagaaatcttagcaacattttaaatgatccaacaaggtctgttgtttctgcgcaaatatgggcaaacatgagctggtatagcttatttttatgggtgcagggagcatgcagttatctccactagcatgtttttgtttgtttgctttgagatggattctcactctgtcgcccaggctggagtgcagtggcacaatcttggctcactgcaacctccgtctcccgggttcaagcagttccctgcctcagcctcctgagtagctaggattacaggtgcccaccaccatgcccagctaatttttgtatttttagtagagatggggtttcagcatcttggccaaggctggtcttgaactcctgaccttgtgatccactcacatcagcctcccaaagtgctgggattacaggtgtgagccaccgcatccagcctgtttttcttttcaactcatgcataggttcagaatttagttccaggtatgtgagagctccttgtagatgtttttcatgatgaggcacctggcttaccagactttatctgacttcttgctttatcttcccaacagttcagcaccgtggtgcggtacagggtcccattagcaggtctcatttcccaccactgactgaacatcagcaggctcaatccacaagtcaggggctggggatgtcttgtcaagaattccctctttaggggcaggaatgaaatttataacaacatccatactgtttgatggagccctctctacatggcaggtgctttgcaagcactttcagaaaatctgcaccaaaccttatagtaagaatgatcgctgtcattctacaagtcagaaacttgaagatcagattggtgacatgttcagctaatgcactgctaataaacagcagaagtgaaattcaaatatcaagacatttgtcctcaaagtctatgcttgtaactagattatggccctgatatcctaggggtgaatcagtttcagtttcccttcctggacccccagcaagtagtacatgggaattattctagtccggtatagcggggagcagtgtaaacagataaacaaggttttccggggccctggtttaggcaaataaatcttacaacttatctggctctttcaagtcgacttcagacttcgccttgctttctagactgttttgcctaatggaaaatagtgtttgtatctttagaaaatgtaatacgtgattttcccctctcaatattttgcaggtcagagatattgctttgatctattttcacataataattattatttgaggtctcaagaccagcatcttcatctgtgtggggctctgagttaagggctttccagagactcactcctgccgtttcttctaactcccttgagcagaggccagcagtagagaaacttgataaataacacaagtgctataatccctgagtcctctaagaaatgagacacaaaggaaagatccagggacattttcacagatgtgcccaattccagtggccccaggtttcccaccctgctgttgatattctgccacccatagtcgtgatcatctggctacaaaacagcaggcaaggctgtgcatgagtgatgttacaggtgggctcatggctacatggatgtctagacatgtctaggtgtccatatgcaggacctgagggaaagtgagaaggagggagggatgggtgaatagatggatagataaatggatggaaaggtggacgaatggatagatgcatgaatggatggtgaattggtgggtaaaatggagggatggatgggtgtttggatggatatttggatggatggatggatggatggatggatggatggatggatgagtgaatggctgagtggatgggtagacaggtggatggatggagagatggataagtgtttgatggatgaatagacacatacatggatggacaggtgtttgggtggatgtgtaggtggaaaggtggatagatagatagatgggtggatggatagagggactgatggatcactgaatacatgtgtcaatgaatgggggatgtatcattggagggatgggtgagtggtatggtggatgagtagatgaatgagtgggtggatagatggatggatggatggatggatggttggatggatggtaaggtggatgagtagatgggtggatgggtggatggatggatggatagatggataggtagataagtagatgattggatggatggatgcatgagtaaacaggttcatggatgggtggatgagtggatagatggatgggtggatgtgggtggctggatagatatgtagatagatgcaaaggtgaatgcaaagagaaggatagatttatgaggatgcaagtgagaatttttctccttaggtcatcaggggaaaattaaatccttacccacggagacatctttcatttgagtcaggcagaggccctctttttctctctcctggtgaccaggacaaagagaaatgcaggtgtagagagctctgatcagggagccctgcctgcctcctgtcctgggtgacctttaccaaatcctctcctgcgttgggtctccctaaccttgattttcaaatggtggcttcagggctttgccttttctgtgtctgtggttctctgtcatctatcaagtctcccagggagccccttcttgcctcccctctgtccctttggcccccactccagaccccagactgggttcagggttcctctctagaagtcactgatgggagcccacaccctgaaaatgcctttagtcttcattccagcctctcctctctgccaagtgagctgcccttgctggcagcagtcacttcctcacacagggggatgcttgttccagcacactgagtaagtgctgtctcctgagtgggaattggcttggcacaggcgaccgtatgactgtttcaaaaagtcattcaaattctttgtcttgtacatcctgtctggaagcacgtatatacattcccgcctccccactgggcacgctcttacccttgcgctgccattctggtgctaggagctgtttgtgctgtccactgggtggacagagacgtcttccccatgaaaagaggaatcagggttttcatgtatctcttagaagccgggcatttggcaccggggctcatgaacagctgatttttgaagtggtcccagggaaagctcagttggtgactgataagaagaaggtctgggctgggtgcaggtctcacgcctgtaatcccagtacttttggaggccgaggcaggcagatcagtcaggagattgagaccatcctggccaacatggtgaaaccccgtctctactaaaaatacaaaaattagctggccatggtggtgcacgcctgtaatcccaggtactcgggaggctgaggcaggagattcgcttgaatcccggaggtggaggttgcagtgagctgagatcatgccactgcactccagcctgggcgacagagcaagactacgtctcaaacaaaaaaaaaaaaaaaaaaaaaaagaagaaaggaagaagaagaagaagaagaagaacatctgaagaattgggatactgaggcatcatcttccttgcccagtggatctgtggtttcataccctgggtctcctgaagctttggggtttttctcattttttttttctttgagatggagtcttttttctttataaattatccagtcttagttatttctttatagcaatgtgagaacaaactaatggtgctggtctcctcaaggaaactcctgccacaccccctccctcatcttctttctctctgtctttttgttttgaggtggagtctaactctctcgcccaggctggagtgcagtggtgcgatcttggctcactgccacctccgcctcccgggttcaggtcattctcctgcctcagcctcccgagtagctgggattacaggcgcccgccaccatgcccggctaatttttgtatttttagtagagatggggtttcaccatgtgggccaggctggtcttgaactcctgacttcaagcgatccacctgcctcagcctcccaaagttctggggtgacaggcgtgagccaccgcacctggctggggatcctttttcatctctggtggacaacaaggtgtattttcctcttgctggtccagggggcagcagagggagaaggagactacagtgtttgggggtccgtgtgtgtgttcttttcccccctggtgcctgctgtgggaggtcacataatgcagatggataatgatggcacagacatatcctcgctgttggcctctcccactttacttcatttgtgatggatgcaccacccattgagttgattataaaaggctgataaggctgggcacggtggctcacacctgtaatcccagcactttgggaggccaaggcaggcggatcacctgaggtcgggagttcgagaccagcctgaccaacatggagaaaccccatctctactaaaaatacaaaattagctgggcgtggtggtacatgcctgtaatcccagctactcaggaggctgagacaggagaatcgcttgaaccagggaggcagaggttgcggtgagcagagatcgtaccattgcactccagcctgggcaacaagagggcaactccatctcaaaaaaataaataaataaaataaatgaatacataaataaaaggcataataagcaaattgctaactgtggggtctgtgactatggactctttcttgtgttcaaaatagcttttctgcagagttaactgtgcaaacccaggacagcagattctgtttgtgcccttcaagtggtttagatttcagattaccaagatagaaaaatatgtttgactacctgtccacagttctgtattttcagttcttataatgggactacaaataagacaacctgagcctttgtttcccatacccctgaatgcacagaaccagagttctgaacgatgtttttgtttgtttgcttttgagatggagtttcactcttgtcgcccaggctgggtgcaatggtgcgatcttggctcattgcaacctccgcctccgaggttcaagtgattctcccacctcagcctcccaagtagctgggattacaggcatgtgacaccacactcgggtaattttttgtgtttttagtagagacggggtttcacatgttggccagggtggtcttgaactcctgacctcaggtgatccacccatgcggcctcccaaagttgttgggattacaggcgtgagccactgtgccaggcctgagcaatgtttaaatcctcaaagcatcactagaattctgataactgtttttacaaagaaggaaaggaatcattattggcaaggatgtggaaacattagaattctcctactttgctggtgggaagttaaagtggtgtagccactatggaaggcagttttatggctcttcagaaaattaaacacagaattaccaagtgatgtagcaatcctacttctacctaatacctaaagatactgaaaacaaatgtgtaaacagaaatttgtacacaaatgtatgtagcaatatccaaaatgccaaaaggtgaaaacagtccgatgtccatctaatactaaatggataaaccccatgtgttccatccatacaatggaatattattcagccacgaaaaggaatgaaacagtcacatgctacaacatgaatgaaccttgaagacgttatgctaagtgcagaaagagagacacaaaaggtcacatattgtaggagtccatttatataaaatgtccagaatagttaaagccatcaagacagaaattgaactcatggttgcttagggctgggggcagggaaaatgaacagtgattacttgataggtacgaagtttcctttggcggtgatggcagggttctggaactagatagcagtgatggtggcataacactgtggatgtagtcaatgcgcctgaattgttcacttaaaaatggtaaaaacgggccgggcgcggcggctcacgcctgtaatcccagcactttgggaggccgaggcaggcggatcatgaggtcaggagttcgagaccagtctggccaacatggtgaaaccccgtctctactaaaaatacaaaaattagttggctctggtggcgcatgcctgtattgctagctactcaggaggctgaggcagaagaatcgcttgaacccgggaggcgaaggttgcagtgagctgagattgcgccactgcactccagcctgggcgacagaatgagactccgtttcaaaaagaaaaaaaaaaaaaaaaaagatgaaaacaggctgggtgcagtggctcacaccttttaatctcaactctttgcgaggccaaggtgggaggattgcttgagcctaggagttgaagaccagagtgggcaacacagatccagtctctaccaaaaaattttaaaaaatcagctgggcacggtggcgtgtgcttgtagtcccgtctcctctggaggctgaggtgggaggatcacttgagcccaggaggtcaaggctgcagtgagaggtgtttctgtcactgcactgcagcctgggtgacagagggagacccccatctctaaaacaaataaatacatatgtacacaaatgaaaaggttaaatgatgaaattaatgttatgggtatttttccacaacaacatgcttccccacagaaatctcagtggagaagacaggagtgtggcagaccaacatgcttctggagctccacaaagctgtccctttaattggcagcacgcctggtgaaggctgtttgctttgtggacgttgacctccacctgctggcccagtgactcctgctatcttcattttgtccagttcacctctcagtccccagagccgtacaaccatctataggttcttgcttctcccttttcccctagaagcatctcctgggaatcacccctgaccaaaagccccaggcacctctccaagaccccctacagaagcctaaacagcccttacattcattgcctttggacctacccgaagtcaacaagttccaaactcgtcagaaactgggagaagtctcagccccaaatcaatagcagccgttgtcagctcctcccagctcaaagtcccccagagatcggttccctggtctgagtcaggaacgagagactgaaaagcatggggatctggtgctttttcttcatagggttagtcgctttccccaccaaaaaacctaccaactgaaagatcactgattggatgggtcaaccagcctcagctaccagatgtctttgagatggggagccagccccctaaagctgagtctctgtgtgtggcttccaaatacctggtcccctgggtgcagacagaagagaggacgcagaggctggacatctcccagaggagggggagactggctggtcaccagataatcttgcttccctctctgatgtcataggaacatgaacagacttggagatgctgattgaaagtacatgtcacctgaaggagacattggttccagagccattaattcctaacctcctaccatactctctgcatggtggaagatgccagaacattctcagagcttgagaaaaaagaggaattgagagaagggacgggggtcaagagatagagaaggtgagaggaatgtgagagaagcaggggacggaggagaagagaggaaggataactcagaagctcaggtctaacttcaccccactccccttaggacccccccactctaactgttgtttctgagagttcctgggggccacccataaacaatgaggttaaatgtaaatggaagggcaggactctgttgaagtctgcagaaggtaccctgttggctgcatagtcaccagctctcatgacccaaagaggagagtgagcaggtgactggatcatcagtgagggtaaatctggaagacagaattggagccaggtgcagtggctcacaactgtaaccccagcacctttggaggccaaggtagaaggagcacttgagcctcaggagtttgagaccagcctgggcaacatagccagaccctgtctctacaaataatttttaaaaattcattgaaggatttctaaagaccacttgagtggtttatgtctcctggagtcagaacccagggaggatttttgctgaaataccaaagccgcagggagcatgaatagagatgttcagacagaaattaagtttgaagaaatagactttggcagagaggcacgtggccacagacaagaactcatcatgcattcattctttcactcactcagcaaacattaaatggactctgtctaactgcatttccctctcttgacaagagggatacatcggagagagacaggctgaaggaatgtagagttgatattggacctgggagctttccaaaggcactgtgctctcctgtgcccttcttcgcatcccagtctctacgatgttgaccgtgttcgtgggtttcacattgctgttgacataccagaaagaatatgcatgaaccacagtgacaaatgtcattcataatcattttcagcacagaataacctacagaaatgtcttctgtgtaccttcccctgcaatattttgtgattctgatgcaactggagacaaaacatctcttatccatggcctctcttgaatcaattttatctccaatctgccttttcatgggtactctaacaagaaagcaaacaaggaaagttcagctggtctagcagttctgagacagcaaattatctcactgttgatgtggacaaagagcctcttgcagaaagactatacttaactctgagaatctgggtcccagcttttttttttttaatccagagagacgtaaatctgaaagaatctgagtcccagccgagctgagagaggagtaaaatcacggaggcatgcctccactcagaacacatcattatcgtgcttttatatggaaggcacagccattcactcattgtccgatagacgtttccattgaacgttggatctcttcaaaccaagtgtctgcaaacatgatgggttttgcactgatgctgaggatgaatccaacaggaaagatacagagaaacatcacattgcaccccagagacatatgcaattattgtttattgattaaaaatataatg

SEQ ID NO: 847 - DNA, 22702 bp, Homo sapiens
tccctgtcttgcgttcctgtgttttctaatgcacgcccgaggtaagaggcattttgctttgagggagatctgcctgggcatggatttttctattcttgctttaagaaactctttccaaaggagttgctatgaagtgaatggggataatttgcccaatgggattagaaaggagactaagagcgatgggtggctgagaggggagggagaagacgggctgctcccatttggaatctgggaattagatccagaagggcaggatgttagctgataccatctagatattcgccatattttcctgttttgatccatgtgtcccaagcgtttaaaaaatgacctatttaactccatgattcaagcatgactgggtgtgtgtggaatgtcagtcatttctttctgattttaaaaattagttctgaccatttccatacagtaaaagtagagttgaaactacttcatcccgtggggcagattaccagagattcgtttgccggaagggttgcatttattcagatttttaaatcttttcctaaacactgtcattcattcttgcaaattaaaaccacctgaattgttcacatcaaaaacttcgatataaacttgcaggctggctgtcccagatccaagattagatttttcagttccgtacgaggacctctttaagaaactccaatgaactcataaagtacaggatttgaacaacggttgagtaagtttctttggtcattttcatgtggcgatttcagagaagggaacacctgggcgcatcttaagagagagaagtatttctgttaggagttaaaacacatcattcagatgtccctgtggcagcatttcctgtttatcctatttaaagacatggacgtcattaagattggagttggttgtttatgggcggaggcggtgtcgggatggatagatcctggtggacatagtctaggatctgcagtgagaattttttattattctgtgctgtcttcagatctcacctagtaagtggacaatgtggccatgcattcattagcttctgtttacagggagatgttcaacagtaaacccacctccccagaaaagtacttccaggagtttgtatcattcacagtaagagccaaaggttaaccatatccccttgggcaaatcaacttctacaaagtgcggatacagacagttcccaacttaccatggtttgacatgatggttcaatttaagatttttcaactttacaacggtgtaaaattggtatgcattcagtacaaacgaaaactgtactttgagtacccatacaacttttcttttttttttttgagatgtcgtgtcgtttcattctgttgcccaggctggagtgcagtgacacaatctgagctcactgcaacctccacctcctacgttcaagcaattctcctgcctcagcatctcaagtagctgggattataggtgcccaccaccacacccagctaatttttctatttttagtagagactgggtttcaccatgttggccaggctggtcttgaatcttgacctctggtgatccaccggcctcccaaagtgctgggattataaatgtgagccaccatgcccggccccatacagccattctgtttttcactttcagtacaatgttcaataaattatgtgaggtatgcaacacctcattataaagttgactgtgtgctagatgatttgtccatccgttggctgatgaaaagtgttctgagcactctgaaggcaggtaaggctaagctatggcgtttggtagggtagttgtattaaatgcacttacaacataaaatattttcttttttttaatgtgttttaatttttttgagggaggggcccactgtgtcacctagactggagtgcggtggttccatcatagctcactgcagtcttcaccccaggggttcgaacaaacctcccacctcagcctccagagtagctgggactacaggcatttgccgctgtgcctgactagtttttaaaactttttgtagagacgggatctcactatgttgtccaggctggacttgaacatctcagctcaaacgatcctcctgccttggcctccccaaatcttgagattacaggcatcagccaccataccctgtcctgcgctaaattctttgactgacggcagcacttcctatgcactaggcatggattaacttagttgattgtccctcagccctatgacgggagtgtcgtgcctgatgtcattttacagatggtgtattagtcagggttctctagagggacagaactaatgcaatagaaatatatatagagagaggagtttattaagtattaactcatatgatcacaaggtcccacaacaggccgtctgcaggctgaggagcaaggagagccagtccaggttccaaaactgaagaacttggagtctgatgttccagcatccaccatgggagaaagatgtaggccagaagactaggccagtgtctcttttcacatttttctgcctgcttatattctagccacagcggcagctgattagatggtgcccacccaaattgagggtgggtccgccccttccagtccactgactcaaatgttaatctcctttggcaacaccctcacagacacacccaggatcaatactttgtatccttcaatccaatcaagttgacattcagtattaaccgtcacagatatgggtaaactgaggcactgaggatttggacgggggcagccggcagcggaatctgagctgtcctgtagctctgtctgggaagactccagtgagcatcccgctctatcccaagccttgtcttctgaaaatcagaatcatccctcctccaagtgttacaggaaaggggtccggatccagacgccaagacggggttcttggatctcgctccataaagaattcagggctagtctgtaaactgaaaacaagtttattaggaaagtaaaggaataaaagaatggctattccgcagagcagctcttagagctactgcttgcccatttttatggttatttcttagtgatatgctaagcaaggcttggattattcatgcctcccctttttagaccatgcagagttcctgacattgccgtggtatttgtaattgtcatggtgctggtgggagggtaacactgaggacaaccagaggccactctcatcaccatctgggttttggtgggttctggccggcttctttactaccacctgttttatcagctaggtctttatgacctgtatcttgtgcagaccttcagtctcatcctgtgactcagaatgccttaatcatctgggaatgcagcccagtaggtttcagccttctattgcccagcccctattcaagatggagtcgctctggttccagtgcctctgacacaagtagcgccccttagggaggttacaggagggactggaaggaaagtgaggtctggatcagggcccttctgtgtaaataagatgatgtacatgcagcagctgggtatgtcctgggtaaaaattagttaaatgcacagacgaccctgtttcatccccagccatcaccagctggaaatggggcacattcccaagatcccaaaaacattctgcaaggctggtgcgatgattgctatgaagtacttaagaaaacagattattgttcaggatcaatagctaatgcatgtggggcttaatgcctctgtgacgggttgatgggtgcagcaaaccaccatggcacatgtttacctatgtaacaaacctgcacgtcctgcacacgtatcccggaacttaaaataaaataaagaagacagaatattgttaatggttaatatgctgtaaatcattatgatgattactaaattatcaatacaaaagaagataatagcaagacggccatattcctaatagaggttgacattttagcagccctacatttccactgtatttaattagtatttgccgtccaatccagaggggcatgaaggagcacgagacaaaatcaggtcttctaacagctgagaagaagctgagaaccagaagtggaaaccccaaagggcagtgtatgaaatgtcatttattgaggggaaaaaaaagaaaatgacagagttcgatagaagaaataagcactagtgtttacataatcagtagggtgactttagtttacaataatctattgtagacttcaaaatagaagagtcggaatggttctaatatgaaggaaagacaaatatttaaggtggatggatatcccaagtaggctgatttgatctttacaaattatataaatgtattaaattattacatgtaccctgaagctatgtacatctgttatgcatcaattaaaaataaattaaaagaaaaggatatatgtccaggatatacaccagctaagacagtctcttccaagtctattgtacattattcccttatcagatttgaaacctgagagttccctgacgccccctcacaggatgtgcaacaggggtgtgtttgatctgtttgaccgccacacactgaaacctcttatgggaggcagaacttgcagacgggcaggtgcagcagctagtgtgagtgtttttgagctctgggccccacggtagcatctagggatgggtgcctgcgacccccgaagccctagtgggcgttttacggtgctcttttagctctgccatccgcacgtggcttaagtgttagccagctcagtgccgtcttggtacccgggttcttgtccagcatccaggaagaatcaggtcacacgaaccagctgaaggatggtaaatgcagaagagtttgttgccagatggagatgactcttagcgggatggttggggagttggaaaggggatggagtgggcagatgatcttcccctggagtttggttgtcctgcggctaatctcttctccaaccatccccagctgaacacctctcagtgttcagatgttccttctcttctctccttctctgctgtgctgctctttggttcctcaccttttctgctcatctgtctgtctgcacatggggtctggggtttggggttatatgggtacaggacaggcaggcatggtgggtcaaaaggcaacatttgggcacaaaaataggaatgcctgtttccatttaggactacaggtttccaggcttgagggcggggcctttgctggggaactgccctcttgtatctagtatcttcaggcctcctgtccgtatcaacatgacttaaaatgtgtgtgcatttgtatagagctgtgtttctatgtaaagactaaaaaagacttatgaaaaagatcactcagagctctgaacagtagcaaatcatatttctgagtacttcctgttgagtaaaggtaagtgaggattgtgccaagtatttttcattacttgctgcattaggttgtcacaggctgtttagtttacttctaaaaattgggatatggggaagttgtgggccgggcacagtggctcatgtttgtaatcccagcagtttgggaggccgagttgggcagatcacttgaggtcaggagtttgagaccagcctggccaacatggcagaacgctgtttctactaaaaatacaaaaattagccaggcatggtggggggtgtctgtaatcccagctattcaggaggctgagacaggagaatcgcttgaacccaggaggcggaggttgcaatcagctgagatcataccactgcactccagcctgggtgacagagtaagactccatctcaaaaaaaaaaaaaaaaaaaaaaaaaggaaaaaaaagttatgatgatcgcctaaggtgagaagccataccacgccagcgtacagaaccccaaaccacgccagcctcatcctacgtctcagttatatttttcttgacttgcttccattctggtgccccctctctccctgccccctccttccctgcaaaggatctagcaaatttgtaggtgtggaaagggaaccacaaatgggtcatttccctgccattgtcacctggagcgtgtagccatttcgtgcagtgattctctgtctttgatgtgcaggtcatcaccttgaagggaggaggtattaaaagcgccacccagtccccacccactgaggtctttattcagcaggtgtgggtcaggcatttgggagctgggagacctgcattttaagaagcaccccaggtgatgcccaagcggagctatgtgcttcttttaagagatgatgactccgtgtgcaaccgtgtggttacctttgcgtggagtctcatggatcactgccacagtggggaggcagctctgtgctctccaattcggtgatgtgtcattcactctatgcaggcccaaggtgacacccccagatacaggtgctgccatccagccattctcaaccagggatcatgtttatccacagggacacttgtcgatatcttgaggctttgcgttgccacactgatagcagggatgctgctggcatctagtgggtggagcccagggatgctggtcaacaccctgcagtgcacaggacgccccacagaaaagaatgatccaacctcatatgtcagtaggactgaggctgaggaatcttgccttagcatgagagatcctgtctgtctgtctgcctatctctagatctatctatcgtctaccattatccatccacctatctgtctctattatatacacctatcatctacctaatctatctgtcaatgattttctgtcatctattatctatctatttatctatctttctacctacttctctatccaactctcatctctattacctatctatgtatctatgtatctatctatgtatctatctatccatccgtctatcaatctatctatttatctagcagtccatcatctatctgtgacattcttctgctacccagggataattgtgttcctcgagtaacacttggcaatgtctggaaacaattttggtagttgcactgggatgggtgttctcgcattcggtgggtggagacaaggcatgttgttcaacaccttacagtgcacaggacagcacccatgacagagagttacgcagccccaagtgtcattagtgctgtagtggagaacctgctgttagttataacttctaaccctgcgaaaggggacaggttggaaatgtcatgctcctgtacgctgtaggaggtatagttgtctggaggtatagttgtctggaggtatagttgtcctgtacagtataggaggtacggtatagttgtctgggcatttctaaatggatcttactgtcagaatgcacttgtaggatcttttccccatagggcatagagccatggcacatataacccagaagctgagcattccatagtttccttcttggagtaggaaggggctgtgcagaaaaagtctatggctgtttggcacctgagtgtgaagacatctggcaaatattggagccaattagcagacaagcacggagtccaagaaatgtctcccctttcttggataacaactgacccttcctgtgagggcccccctcattccagccattttcctctttctcattggcacacagggggtagaaaagtggggttctgcctgcaggtggggctctgccagacacggcaaagctcctggggattcccccgatggatcaggggccagaggcacctaaacctgtgagcgatgtgtgcagccacggtgctgaggctgggaaactctgctgtagtctgtgaatcccaacctctgggaatgcttcagaatcagattctgggctgatctggaatctgcatgtggctggattctggtctgatccaggcatggaggcgtgtgcctgtaatcccagctactcgggaggctgaggtgagagaactgcttgaacctgggaggcagaggttgcagtgagctgagattgtgccattgcactgcagtgagctgagattgcaccactgcactccagcctgggcaacagagcgagactctgtctcagaaaaaaaaaattaaggaagagtattattgagagcgtaggccaggcgcgtgatgttgctgagatgaaactgtctctctagattcccaaaccctggttatctccactgaaccaggctgtccaatggcatccccattgtaattgaccatgttccatggtttaaatctgttgtgagccaaattgtaccctcctcaattttacaaatggaagtcctaacctgcaggacctccaattgtgactgtgtttggagatggggtctttaaagaggtgattcaggctgggtgcggtggctcatgcctgtaatcccagcactttgggaggctgaggctggcagatcatgaggtcaggagatggagatcatcctggctaacacggtgaaaccccatctctactaaaaatacaaaaaaaaaaaaaaaattagctgggcgtgcctgtagtcccagctacttgggaggctgaggcaggagaatcgcttgaacctgggaggtggaggttgcagtgagccgagatcgcactactgcactccagcctgggcgacagagcgaggctctgtctcaaaaaaaaaaaaaaaaaaaaaagaggtgattcaggcaaaatgaggtcactaggttgggccctgatccaacaggactgcagaccttataaaaagacgagatgaagacacagacatgcacacagggacgatcctgtgaggacttagggaaaagatggcatccacaagccaaggagagaggtctcagtaggaaccagccctgcccacaccttgatctcagacttccagcttccaggcctgtgggagaatcaatgtccactgtttaaacagcctggtctgtgggactttgctatggcagcagccacagtggacaaacacatttgtattccaatgaatgagttacctctgtaagggttgaattgtgcgtctccaaaatttatatattgaaggcctaatccctaggacctcagaacatgactgtgtttggtgatggggtctttaaagaggtgagaagggtacaatgagctcaggaggttgtgccctgatccaataggactggggtccttataaaaagagtagataaggacacagacacacacagagggatgaccctgtaaagacacagggagaagagggtgtctacaagtcaagaagagaggcctcaggaggaaccagctctgcccatgccttgatctcagaattccagcctccaggactgtgggagaataaaagtctgtggtttgtaagccacccagcctatggtattctgtgatagcagcctgcaatggactaagacatctcataagaagagcagatgaggacacagacatgcacatagagggatgaccacgtggggacacagggagaagatggtgtctacaagcccaggacagaggcctcaggaggaaacagccttgcccatatcctgatctcaagacgtccagcctccagggctgtgggagaatcaatgtctgttgcttataagccacccagtctatggtatgctgtgacagcagcctgaaatggactaagacacctcataagaagaggagatgaggacacagacgcacacagagggatgaccacgtggggactcagggagaagacggcatctacaagcccaggagagaggactcaggaggaaccggccctgcccacaccttgatctcagacttccagcttccaggactgtgggagaatcaaggttgttgtttaagctgcccagtctttgggattgcattgtaacaactctgggaagccattaccaagtctctgtcctgcaaagtgagatccatggatctgcagccttgacatcccctgggagctgatgagaaacactgtgtcttgggcccagacagacctgctgaagcatagtctgtgtgtcacccatgtcctgagggatccgtgtgcatgccactctgggaagacgggtttataacacaccgtcaaccagtgcctcattgcatggtctgcggtattttcctcgagttttccttgcaccaaagatgtcttgctttttgtgatgaatgatcattccttcctcttcgacgacaaaatacttcgatctctgcagacaccgtctgttgtgttacagacagacactgaggcctgaattctcattaccaatgtctgctctaatagagcttcaatctgcaactgcataatatggtcactgggaagtcaagaacggggccagttggttgaccttctggggagaggctgggctgcttggatgctgagaccgtggagggttcatgggttccgaggagcagatcatgcaccagggcggcctgctcagctctggtgtctgcagccccggtgagcttgagcattagggagtccctggatattcatgttgaggtgtggaggaggagactccagctgtgtttgatttcctgtcctgctggaaatataaacttcttaaccaattagagaacagaatggatttcatcttatccatggggctaaagtagaattcagcccttggcaaacaagccccccgggaataagattccccattggggcagcagccttccttgtcactttctgttgcaacctacggtcctaacctagtcatatgatttaattttttttactctgtgaatcatgccgtcctgggagagagtgagatggagcaaggacaaccctcttaggggcctgccaggcactctccctagcatggaaataaaggaaaaccttgagttccttcaagggaaattccaggcacctcgctggccttgagaagtacatggagcagcttgataagcaagaaggtgattgtagtgtagaacaatagccaaggaagttagagcctcaatatgtttagtttcctgtaaagactaaagataacatccttttttgagatggagtcttgctctgtcacccaggttgcagtgtagtggtgcaatcttggctcagtgcaacctccagcacctcctgggttcaagtgattctcatgcatcagcctcccaagtagctgggactacaggtgcacaccaccacgcccacatttttgtatttttagtagacacagggcttccccatgttggccagtctggtctggaactcctgacctcaggtaatctgcctgccctggcctcccaaagtgctgggattgcgggtgtgagccaccatgcccagccaagataacatcttactatatggccctgagttgattttcaggaacccagacccccaccaaataaaaaatgccatctgctggctcatagacgttgggtaagagaaactgaggcctgaattctcattacaaatgtttgttctaaattccttccctggggcatgtggcggtgggaggggggtggaaggggggtgaggggacgtgctggaggaagtcacaccaatggccacaactaacattgatttctgctgaccccaaatgctcagacaaacttggcctccttaaccaatgacaaatcagagaaactttgaatccacattaagcccctgcttccaggtatcccgcctttttagatcaaagcaatgtatagcctgcatgtattatggctttgcctgtaacctctgcctccttgccattgaaaaccctcagctactggccacccaggaggttgggtcttgaggcatcaaggaggttgcttgatgccctctaaatagctcggaataaacgcctcacttcctcacgctgcaatcccaatggcggtgttcggctttactgcacagggccggtggacctaagttgagttagtgggaggtgttcgaaccagggcaactccaggttgagtaggggctgtgtaaaatgaggccgagagctgccgggctgcattcccggatggtcaaggcattctaaggcacaggatgagataggaggttgacacaagaaacaagtcataaagaccttgctgatgaaacagcttgccgtaaagaagtcggccaaattttaccaaatccaagatggcgatgagagtgacctcgggtggtcctcacttgtgtcttcccaccagcaccatgacagtttacaaatgccacggcaatgtcaggaagttaccctatatggtctaaaaagaggaggcatgaatgggccactccttgtttagcatatcctcaagaaagaaccatacaaatgggcaaccagtggccctcggggctgctccgtctatggaggagccattctttattcctctgcttttctaataaacttgctttcattttatggactcgccgcaaattctttcttgtgcaaggtccaagaaccctgtcctggggtctgattccagacctctttccggtcacaagttcagtcacaagaaccattatcatatgctttctatatatacacataggtattttttaattgctgaactggagtcaaagagaaaccttaggatttgcctgaaggaagtcaagatttgtccttctcggggtccctgtgccagctttgtaaaacctcggaactttcccctctgtgggcttcctcaagctgaggagggctctatgggcttagtacccactaagtggcttcatctgcagcagctgacccaagaaagttgatttaaatgaacccacacttcagaggaaaccagtacaatccgatgtaaagaaataaaaaataggccgggggcggtggctcatgcctgtaattacagcactttgggaggccgaggcgggtgaatcacttcatgccaggagttcaagaccatcctggccaacatggtgaaaccccgtcattactaaaaacacaaaaattacctgggcgtagtggcatgcacctgtagtcccagctactcaggagactgaggcactagaagcgctcgaaccagggaggcaggggttgtagtgagccgagagtgcgccattgcactgcagcctgggcaacatagtgagattctttatccaaaaaaaaaaaaaaaaaaaaaaaaggctaggcacggcggctcatgcctgtaatctccgcactttgggaggccaaggtgggtggatcacgaggtcaggagtttgagaccagcctggccaacatggtgaaaccccatctctactaaaaataaaaaaaattagttgggcatagtagggggcgcctgtaatcccagctactcaggaggctgaggcaggcgggagaatcaattgaacctggggggcagaggttgcagtgaacagagattgcgccattgcactgcagcctgggcaacatagtgaggttctgtatgagagaaagagagaaagagggagggagggaaggaaggaaggaaggaaggaaggaaggaaggaaggaaacaattgcttgaaagggctttgtttcaccagggcacgcagatcaaaggacattggattgaataatgaaacagaagagcctgtctgaatttactaatgtggttgcacgtcccgtaatgattgcagttggctctaattcagttccgtggtgtataaattctgctggcaatagctgtaattggggtcagggatttagatagtctctgtgtgttccttttcattttctgctcagagcctgctgggagctgattttcttctttaaagcgaggtaaataattcagtggggagcagaggttttgctgtgggtccattgctctcctgtgctgcgtggcagctgtgctggtggcagctaatattcagtgggcagtggcctcgacattgcattattattcgagcaatggtactgttctttgctttgcaaaattgctgtttgttatattgactttctggggtcgtggcccctgaagcattactgaaaatcatggacatgaagcagatttattaactggagaaaagacatacaaatgtatttaatgtgtatacacgggagcattcagaatgaagaccccaagttacaaggggagattgtctatatttatgctttggttcatccaagtctggacagctgtgtagaaatagggttggacaaaaagggcctgatccaatgctaatggcctgagtggggaaacccagccaggcctgtgtgtctagattcttcttggcctctctctctctctttttttttgagacggagtctcactctgttgccaggctggagtgcagtggcacagtcttggctcactgcaatctccacctcccaggttcaagcaattctcctgcctcagcctcctgagtagctgggattacaggcacgcaccaccacgctcagctaagttttgtatttttagtagagacggggtttcaccatgttggccaggatggtctcgatctcttgaccttgtgatctgccctcctcggcctcccaaagtgctgggattacaggcgtgagccaccgcacccggcctcttcttggcctctctgaacagtgctccttccttccgggtatggggctgggagcttctctgggatggggggtcttaggacgcccaaacaaggcaggtcagggaatttccttatggccacttttttttttttttttttttttttcaagacagattcttgctctgtcacccaggctggagtgtactggtgtgaactcggctcactgcaagctccgcctcccgggttcacgccattctcctgcctcagcctcccgagtagctgggactacaggcgcccgccaccacacccggctaatttttttgtatttttactagagacggggtttcaccgtgttagccaggatggtctcgatctcctgacctcgtgatccgcctgcctcggcctcccaaagtgctgggattacaggtgtgagccaccgcgcccagcctgtgccactctttatacagataggatagagggaaagttagattcctgtttttaggttttatggctggcttcggggggaaaggcgttcttgtttctgggacccgtcttggggaagagggattctagttccttcggtgccttaggggagaatgggactcagagacatgggggctggagaagttccgagagaaacttctgcttctgaggctgctgctgaggcctgcacttggcggtattgtttcgtaagcctgaaccacgtgcaggtctgaatcaacataaagaatttgggtgggaggcaggggaactccaataagaagcatctttgaatccggcaggggtggaatttgggtcccagaggggtttggtgactgcaggctacagaagaatgcttcaaagtgctgtatcacatggctttgctccgaagggtcccgagcacagctttaccgggggctcatgtgtaacgctcggcccacccatccaccaacaggagccacttaatcgacatctccaggatgccagcaaccgaggaccgttgtcatagtcccagcacaaaatgaggctgctttcttcttgggggtttagggatcccagaccacaaggatttgattaaaagccgctcagttcactaactataagcaaagcaaatcagaaatagatctcctgttcctgccccgtcttatgttcccagtggaaaataaaccccgtgaaagcaatggcgtcatgtgcaacccgaccttggagacagagaccccagagttagcgttgtctacctgggacatctcccagcccaggggtcttactccagacccgtgaggaccccaggcgtggctttgctgcaacttccctggagaggagagaggacagggggccctgcctgggagatagatttgctgcctggcatgcgggactggagactgtctcagtgcccaggccgtctgatgctggccggagtccgcctggtttatgtaacgaggtctggatgtgaccaacaacggcctcgtgtgtgtgagtcacgcgtgcagcaacttctggctgtagtgcaacccctgaaaccaagcaaagcctaaagcccccaggctccacttcctctgtgaccctccccacccccaattcctgtcatctctcagggtcatccggagcatctcaaagctgaaggagcctccgctgcaacctggcctcctgctgcaggatgagacgagctgtctgcagccctcccgtgccacctgcctgttttatgcaacagcatttcagagaggagggactgggaggggagagacaacaccgaggcctttggttatttagggcaacagcagggagtggccgggtgcacagattggaggagattaagtggttgctgaggggatgcctgggattgctgggatgggcggagacataacacagtgaaagatattggtcaacggcgaacacagattggaatgtaaattctcagggtgtgtgcatagccgggacgcttaactttggcgtcctggacaggtgtctcgactggaactgctggcagccttggaggggagatgttgcacagatccaagaggctgacacggttcctgtcccccagcccagtctgagcagcttggaccatgatgatcaagagcgctggaggaggccaggtgcggtggctcacgcctgtaatcccagcactttgggaggccaaggcaggtgggtcacttgaggtcaggagttcgagaccagcctggccaacatggtgaaaccctgtctctactgaaaatacaaaagttagctgggcgtgatggcatgcacctgtaatcccagttactcagacggctgaggcacaagaatcgtttgaacccaggaggtgggagttgcagtgggctgagattgtgccactgcactccagcctaggcgacagagagagacgccatctaaaaacaaaacaaacaaaaagaaaacaacaataaagaaaaaataagaagagagctggatggagcaaagatttgctgggttgttcttaaaggcgagcctgtagtgatcgctggtaacagagaacgtcatctgagagggacgtgggggctcccagagtttgagagaaacggccgtgtgggatttgacctgtgatggcaccgccagctcccagcctccagtctgggcccaggggcagctgctgtgtgcaccctgggctcagagttccccttccctccaaggtttgtgactttgtcctgacttagggattcctgtctggggatgcgtcttctgctccggagaggccctaattgcctccacaaggagcggcaaagcctgcccgggtggcatctgactggagccatgccacagcctatacgaatctatgttggagcccttgaaccttcccccagagcaagcgtcaccgaggcagaccgatttttgggagggagacagacatcagagcgggggagacccagtacctagggctcacctggttcccccaggcttagcctcctccagggcttagtgtttgagtgagagattgtcccccctggacaattctgtagattctgactctgctcctgccttgccctgaacttcccagaacctcagtttcttcctttgggaaatatgcatgctggtcataccaacatccttgggtgggcagatgagactcttgggtgcctggcattactgcaacagaactcaatgcatagtaagtgctgactcaatgtgctcctggctgcatcctctacttcctgataaattctctggtggtgttttctctacaaggctagtactggcaggggcaagtgaggaacaagatcaaggtgtgcatatatgtcagcaagagggacccttcaccctcacaaattctgcagtgtgtttttaatgatgtgtcccaaagatgtgaatgttctcttctctctgctgcagacacattcattagattaactgcttttggatcaggtaggaacctcagcttgtccacacaggttgcttcctgaccctgtatttgtcagtgtaggctagctgctataacaaacagcccccaaagaattaaaagtttatctcttgtttgtgttgcagccaggtgaggtggcaaaggtgtcctatgctccatatagtctctcaggcatccaggaccctcacattgttgtgcttcaccttcttctagggcagcccctctcaacctagactctgtgcgtgtgtggaggggtggggggggcgttggggggcggggatatgcctgtcctaagctgtgagtgggacagtccaggagagaagtctatgtgcttggagagaggcttccttcaaagtttcctggccatgagcaggaatgaagctctgacacaggttgcaacgtgaacgcaactcaagagcatcatgctcaatgaaagaagccaggcacaaaataccacatattgtagaattctatttataagaaatttgcagaacagacaattcatggagacagaaagtggatagtggttgtcaggggctggggaggcgggaggggaactaactgctgaatggggacaggggtcttcttttgggtgatgagtatgctctgggactaggtggaggtggtggttgcatctcccatgtagctcatggtcaggttagttttagtgctctgggcgaccctaggcttgcaggaggaggggagcagcatgaggtgaggaacaagggggattctggcctttccatcatggggtgacttatgccctgtttgctcccaataggtcaaagagactttgatttggcagatgcccttgatgaccctggtaagtgccgatatttcaaggggagccttcccttttcagcttggatctaacagcatcagctgtatagttactttggggttggattgggccagtgttgggaatttcttggtcttgagatctctgttctttgcaggagattgcagacaccttgagacaaacctttacacactctctaaaagtctcagactcatttcttggtaggtctgtgcttctaaacctgtggtttaggaatatgctagtattttattattttattttactttattttgttgagatgggagtctcgttctgatgcccagactggagtgcagtggtgcaatcatagcttaccacatagcctcgacttcctggctcaagtgatcctcccacctcagcctcccaagtagctggaacaacaggtgtgtgcccccatgccaagctaatttttttcttttttcttttttgtagaaacggattctcactatgttgcccaggctggtcttgaacccctgggctcaagaaatccttctaccttggtttctcaaaacactgggattacagacgtgcctcaacatgcctggcccagtttctgcttttcttacacttcagttcatatccctcattgtcccacaccccgatcccaatccatggcctccaatctccccagtttctgcttttcttacacttcagttcatatccctcattgtcccataccccgatcccaatccatggcctccaatctcccctcccagagcacacttcattccgttctcccctcaacttctctggttaccttcactgacggggctgtgagtttttcttctccagggcactgaggacctggaatcttcccattctgtgttttcatcagtccaagttcagctagaacctttctggctgaccagaatgctgaaaatatgtgtcctgggccctgcagaaagtcctgcttgaggcagatagtctgattgagattcaggtgtattcagaccgcggtgggtgggagaaagggaaagatttggtttctgatgcaggcacaatggaaccaaacatttattttgaaagaaaaataaacttttgtgtacacagaggaagaatccattgggctttagcattgggaacaactggttgaccagtgcagttacataatggtgtttgttggaggaagagagaatgataaccagatctgatcctaaaaagccaacaacaagatgataggaactcatctctctcccagttttctgcacacagtgatgtttttgctaataattatcctaaaaggcagatacaaaattgttgtcagtgcaacaggaaaatgtaatgactcaccccaacatggagatgccatttctcccatgaagttagaaaaggtgaaggttgaatcctaccctgtcaaggcagattgaggggtgggggttagaggcaggtgtgtggttgcaaccactttggaagcattgggggattatctccaaaattcagactgagtgtgttgcaccagcgtttggtctggataaagaatgaggcatatctgcaagagaaccctgtgcaatagtgaaggaggggctggctggtaggctcagatacagaacaagacatgttattgatctgaaagatcactgacatgtgacccaggagttccacttctagacagatacccaagagaattgggagcagggactcaaacagttatttgtgtacccatgtttgcagcagcaatattcacaataagccaaaggtggaaacaacccaactgtccatcaggggatgaatgaatgaacagaatgtggtccctccaggcaacagaatatgatttggctgtaaaaaggaagggggttctgatgcgtgctacatgagccttgaaactgtgctcagtgaaacaagccaggcacaaaaggccacagggtgtaggatcccattaatatgaaatgtccagaataggcaaattcagagagacagaaagtggattagcgattgttgggctggaagaggggacaaaagggagggactgctcgtggctatggggtctccttttggggggatgaaactgttctggaactagatacaggtggtgattgtacaatattgtgaatatatgaaacaccattgaattgcacactttaaaatgtcaaattttatatgtgagtttcacattaattttttaaaaatcacataaataaacttattttccactcacctgctactaccttttcattgctcacctagaaggctgccagtgcctgcaaacacatctttgaatgcatcgttttgctaccaagagccccccatgaatgggcaggcatgtgcctgttcatccacagcccttcctcatgggaaggaagccccagtgcagaggaaccacagtcacctgcatggcgactgtggggaattcacttttcactgtctatactgcctgggctttaagaaactctgtgagtgtatcactattttaaaaaatagttataattttacattttaaaaaggagacagagaaaggaaggatgggagagagggagggagggtgggaggaggaaggaagggaaaaggaagagaagaaagaaaagaaggaaacaatgaaaggacagaggaaaacagggagggagggaggaaaaaggatggaaacaaggagggaagaaaaggaagaagagagggaacgatggagggaaggaaggaagaagaaaggagaggagataagaaaagactgaggggaggaaggaagaaggagaggaatgaaggaggaagggaagaaaggaggggggaaggaaagaaagaaaaataggagaagaaaggaagaaagaaaaagaataagggaaggacggagggaaggaaggagagagggagaggagaaaggttggaggggaggaaggaagaaaggagggtggggaggaaggaaagaagaagggggaaaaggagagagggaaggaaggaaggaaggagagaaggaaggaaggagagaaggaaggaaggagagaaggaaggaaggagagaaggaaggaaggagagaaggaaggaaggagagaaggaaggaaggagagaaggaaggaaggagagaaggaaggaaggagagaaggaaggaaggagcgaaggaaggaaggagagaaggaaggaaggagagaaggaaggaaggagagaaggaaggaaggagagaaggaaggaaggagagaaggaaggaaggagagaaggaaggaaggagcgaaggaaggaaggagcgaaggaaggaaggagagaaggaaggaaggagagaaggaaggaaggagagaaggaaggaaggagagaaggaaggaaggaagaagggagggcaggaagggagagggaggtggcaggaaggagaaaaggtgatgagaaaccttctattaaaatacaggacatgcgaaaccatatgccccgtttggaggttcaagctctccttcttgcagtctctgcatccccagtgaatgtccgcaccacacacaaacccgtgttccagccgcctcctaccaaggcaatgctaggctgttatgtaaaccatgctttcaaatacggtgtttcctctgtttggaagaagtctggccattgcacagccctgaagctccaattttcccagccatggccgactccacctcctttgagccatcttcctcaaacctcctcctgccctcgtctgcccatccacactgcacacccaggttcactaagcagggcagtcacaggctgcaccctgagcactcctgacctgatatccacatccatgcaatacatatttgctgaatgaataaatgaatgaatgaaagaaagtgagataagccatcattctggaagctgcaagtctttctccttcttttcttttgcctccccctgcctcaccctccaccgtccagccctgtggtggctctacgggcaggtggctcacttacttgtcttggatgttctcagctactttggccatcctgtgggcatcctcacagcctcaagggtggattgtttttgaatggattttaagggtgttttcttgtcttttttctcaattcaacatggaatttgtgtctatatcatttactttgtatggctttgtcactcccttttcacctttcatcagggcgttcatggcctttcttcatgcttccaatgaatcttcaatgcatattgcatttattttctctctttgttcacagaacccaccaagaagccaaactcaggtgagtgtctcttcagctgggaaaaactgaggcaacgtccttgaactgatgcttacggaggggatggttgaggatgttttacagaactgtggggtatatgaaagagatgcaacaactgtaccagatagcagatattgaaagcaaaatgtggtgattagggaaatgcaaatcacaaccacagtgaagcaccacttcgtccccactgagatggctaaaatctaaaatggaaaataacaagtgttggcaaggatgtgatg

SEQ ID NO: 848 - DNA, 29823 bp, Homo sapiens
atgcaggctaattttttttttatttttgttttgtagagctagagtttcatcatgttgcccaggttggttttgatcacgggagtgatcctcctgtggtggcctcctaaagtgctgggatgacaaccaccatggccagctggtttgtttcaatttgagtgacaaaatttaggaatcggggctccagcttttcactgcagacatttattgtgggtcatcttccctaaggcaccagcagagggggaacgggccacagcagggctgcagccacggtctccagatgttgcccagcctgtccagctgcagaggaactgggctgagtgtccgctggtgttcccacaccgcctgctggactcgttccatcacctgatagaacacgggctctgaggctggtgtgaggatgtgggtctcagaagggtctcttgagaggtcaaagagcaaaggtggatcgtggtggactactttttccccaaagcacgggcagacctttcttccatagcaggcaccggctccctctggctggaacacaggcgtcacaaagtggactttccacattgttcctcctggtggaaagataatcattacagagttggcatagagaaatagggtgccttgctggagaatggcatcttcatagggctaaaaggtaggcctaacccaagcgtccatcgatggatggacagataaacaaaacatggtacatcttacatggcatactctgcagctatgagaaggaatgacacaatgacacaggctgcaacatcaacgaactttcaaaatactacgctcagagaaagaagttacaaaagagcacacattgcatgattccattcacattgaatgtcaaggatagggaaacacataatgacaggaagtagagtagtggtttccagggtctgcagggtgtgaaatggagagtgactgctgataggaacagtgtctgcttttggcgtgatgaaaatgttctggagctacatagacgtggaggttgcacaacactgtgaaagcacgaagtgcctgtgaattgcactcagtcagttttttcttttcttttcttttcttttctttttttttttttttatttgagacagagtcttgctctgtcgcccaggctagagtgcagtggtgcaacctccgcctcctgggttcaagtgattctcctgcctcagcctcacaagtagctgggattacaggagtgcgcctgtaattgttcacaaagaagatgaagtcgtgttaaggtcaggtgattaaaacatttggaagcacatctagatgcataaaatagactacaaaaggctgggcgtggtggctcacacctgcaatttcagcattttgggaggccaagatgggtggattgcttgagcccaggagttgcctgggcaacatactgagaccttgtttcaacttaataaagaaaaattggagaccaggcgtggtggctcatgcctgtcatcccagcactttgggaggccgaggagggtggatcacttgaggccaggggttcaagaacagcttgcccaacatggtgaaaccccatctctactaaaaatacaagaaattagccaggtgtagtggtgggcacctgtaatcccagctactcaggaggctgaggcaggagaatcacttgaacccgggagactgcagttgcactccagcctgagcgacaaagactagtctcaaaaaaataattacaaaaaaataagaaaaaaaagagactagaaaagtcttgaacacatgtgtgtgcaagcatgtgtgcgtgcgtgtgtgtatgcatgcacatacgtgtgtgtgatgatgataaaagttgcacttcatatagtgcagggaagaaagaatgaaatatagcccatacatggtgctgaaactataggtaacgactccccatcgttttaagacgattggcaggtgatctcagaaggcatgtcgctggaatgagagggacacatattgacaaaaactaaatttaaaaagctcgtggagaaaaacggaagtgcggagacatggagatggactctggaatgcagctccatccctagcctgttctagggcatggtgctttcctgcacagagggactctttccctaagggtgttaggaaggggctcccctactcactgtcccgttgatgccacctggctgcgtgcagaaacctctcacaataatgcatcaggaactcgtggtctgagtgttgggctgtccccaggagcaagggcagaaggtcttggccgtcaatcactctgcaggaaggaacatggcatggctcagggttggaacagggactctggacatttgtccctccagcatccaccagtcccagccccaggtggtgcactctccttatgttgtatcagtggagggaaagtctgggtgtgaacgcagatggatggaaggcatgtgtgtgcattagcacgcttagaagaagaatgcagcagctgcccacgttagtcaccaccaaacgtcacctttggctaaaaagtaattaattggccaggcacagtggctcgtgcgtgtaatcccagcactttgggaggtcgaggcgggtggatcacctgaggtcaggaattcgggatcagcctggccaacatggtgaaaccccgtctcaactaaaaacacaaaaattagccaggtgtgctggtgtgtgcctgtaatcccagctactcgggaggctgaggcaggaggatcgcttgaacccaggaggcggaggttgcagtgagcctagatcgcaccactgcactccagcctgggcaactgagtgagactcagtctcaaaaaaaaaaaaagaagaaaaaaaagctgaaagagccagcacccaaaggctggaatgtaacaaaagcccactaagagttctacccaggcctttcctggaccttgaagcgcgataaaataatgaagggattcttaacaggacccatttaggattaaacaagttttattggggatctgaaggaactccccagacctccacaaacaagttttattggggggtctaaaagaactccccaaacctccatgatttagcaggagacaagataagggtaatcaccccagcacctggaaccatctagattaagtcaacttactgaggctccagaggaaggtcctcaggactcagaccttagttctagatgaaaggaagttgaatcacttatgtctttagatggatgcacgcttacatgtggacatacagcttagaaggtatagaagctctggaaaactttgtaattttgagttggtctagtgatcatttccagccttctccccgtatctggttacagaaataaaactcctttctttcctcgttcatttgcatctcgttattgggccatgagaataagcagcccgaccctcggtttggtcggggaacaatttcagggacgccttactgcaaagccaaagtgacatgttcatttgccataagtgttgctgtgtctgtgcaaagctgaattgtttctttgggttgttctgtacctgtcctggggcacctcgccgcccgccagccggaccacggtggggaacacgtccatcagactcgtgggctcgccaatcactcggccggccgggagcaccccgggccagcggaagatcccgggcacgcggatcccaccttcccatcctcccatgcccttcccacctgggtttgaacagaaacaaaagaaagtggttaaaaaccagaaatagatgctcagcctggctgatttaacttttctgcttgtttcacttgtttgaagtttctctctccctgagtctctcaatttctctctctctctctctctgttttagtgacattaaaacattcaatctcatgtagttcccctgtagaggtttgattttatattttttattaaccttgttattggttagtgtgcattggattaagttaggtccttcactacaaatgactcttgttcttagaagacacagacacagaggagaaggccatgtggagacggaggcaaagactggagtgatgtggccacaagcccagggactcctggaacccccaggcgctgggagcagcaggaaggatcctcccctagagcctcaagaagaaagtggatacaactataacgtattgaacagtgaccccaaaacatgttcatgtcatatctcccagagcctataaatgagactttatttggaaatagggggtttgcagatataatcaagttaaggaccttgagataatcctggattagggtggccctaaatgcaatgacagatgtccttctaagagacagaagaggagacacggacacagagaagaaggtcacgtggagacagaggcagagactggagtgatgcggccacaagcccagggatgcctggagcccccggtaactgggagaggcaggaaggagcctcccctagagcatccagaaagaagtggattcaattgcaatggattgcactttagtcctcctgaaacatatatccacaccctgatccccagattctgtgaatgggaccttattttaaaaaggggtccttgtagatgcaattaagtatctcaagatcgtcgcggagaaggatggactctaagtccaatgacagcattctaagagacagaagaggagacacagacacagaggagaaggccacatagagacggaggcagagactggagtgatgtggccacaagctcagggacacctggggcccccaggagttggcagaggcagggaggagcctcccctagagcttctggcgggaacatttccctgagacacgttgatctcaaactcctggtctccagggctgggacaggataaattcctgttgtttaaagctccgccagtttataatactgacattcttgatggcacagagaaccagattgggtagaggatacattaacgtcaatggcaatgagataaagaaggtttctgaggagtcaggccttcaatgtgaagttgttgtgggaaggcattagtggatgtagttggcatttatatatcccgttttacatatgtactagactgatggatccatctacttcaaagcaaatatacatcataggtatatttgccaatattagcctaaaaaggctctttcaaggactgaaaaataaagctctctaagcagggagaagacaaaatgtgtaagcacaacagtgtgaagtcatgtacacggggcagcacattttagcatctttgtggtacacgaaagaatggcgtgtttggaaacaatggaatacaggtttgaatataatgtggccagctaggtgtctacccttctaccttttttttttttttttttttttttgagacagagtcttactctgtcacccaggcgagagtgcagtggcacaatctcagctgactgcaaccttcacctcccaggttcaagcaattctcctgcctcagcctcctcagctgggattacaggcgtgcaccaccacgcctggctaatttttgtatttttagtagagatgaggtttcaccatgttggccaggctggtctcaaactcctgacctcaagtgatctgcctgcctcggtctcccaaagtgctgggattacaggtgagagccactgcgcctggccttatccttcttggatgcattgtctgaaggtaaaattcaaacctgagtccacacaatggaatatattcagccatggaaaggaatgaaacatttccacaacacagatgaacctcagaggcatcatgctaagtaaaaacaaaaaaactccacatattgcatgatttcatttacataaatgtctagagtaggaaaatatacaatgatacaaaataattttgtggccaggcatggtggctcacgcctggaatcccagcactttgggaggcccagctgggaggactgcttgagttcaggagtttcagaccagcctgggcaacataacaagaccctatctttacaaaagataattttaaaaattaaataataaacaaatcaaaaataagtttttgggtgatggatgttagcacgggggaaaagggagtgactgctatgagtagaggatttttttgtgaggtgatgaaatgttctgaaataaacagtggtggaccacatgtggtggctcatgcctgctgtcatcccagcaccttgggatgccaacgtgggaggatcacttgaggtgaggagtttgagaccagcctgggcaacatggcaaaaccccatctctacaaaaatacaaaaattagccaggagtggttgcatgcacctgtagtcccagctacttatgatcgctgagacaggaggatcacttgagcccaggaggcaaaggttgcggtgagccaagatcgtaccactgtactccagcctgggagatagagccagactgtctcaataaaaataaataaaaataataacaataaattttacgaatgaaaatagtgattgtaaaacaaaaataaaattctaaggacccccaaccatctgaatggacttcctcctcacccagagctctttaaaaacttaacctgagaggctgtttcaggccgtgacaggaagcgggagtcgaacatgcctcatgattcctctctggcattaacatccacacagcctttaggtctgataagaagcatgttacaacctcttgtctctgaagcctagtacctgaaggcttcctctgcaaataagaacttgggtgtccacaatctttttttttttttttttttttttttgagatggagtttcgctttgtcgcccaggctggagtacagtggcacagtcttggctcactgcaacctccgcctcccaggttcaacggattctcctgcctcagcctcccaagtagctgggattacaggcacgcaccaccacacccagctaatttttgtatttttagtagagacagagtttcaccatgttggccaggctggtctcgaactcctaacctcaagtgatccacccgccttggcctcccaaagcgttgggattacaagtgtgagccactgtgcctggcctccacaatcctttatcttaacccagacattcctttctgttgatcccaggtctttagagaaacaacgaattgtcaaccaggaaatgtttaaatctacctgtaggctggaagccccgtggctttgagttgtcccacctttctggaccaaaccaatgtgtctcttaaatgtatttgattgctgtctcatgcctccctaaaatgtataaaaccaagctgcgccttgaccatcttgggcacacgttctcgggacctcctgagggctgtgtcacaggccatggtcactcctatttggctcagaataaacctcttcaaatgttttacagagtttagctcttttcatcgacatgatgatggttacacaactctgataatctactaaaaattccttaattgtgcacaaaaacgtggcaggccacgtctcactaacacaggcctccgtaacaactgtttcagcactgacgagtggtgaagttaaatagcaaaagctgaaacaaccagcgcctgtatacaaaggccgggatgtcacaaaagccccccaggagttctgcccaggcctctcctgggccttgaagcgtgacaagataaccaaggaattcttagcaggacccttttaggattaaacaagttttattagaggtctgaaacaactccccagacctccgcgatttagcaggagacaaggtaagggtaatcagccctggcacctggacccatttatttatttgtttatttatttattttattatttttgttgttgagatggagactctctctattgcttaggctggagtgcagtggcgcgatctcagctcactgcaacctccgcctcccaggttcaagcgattcttctgcctcagcctcctgagtagctgggactacaggcgtgtgccaccatgcccggctaatttttgtatttttagtagaggcgaggtttcaccatgttggccaggttggcctcaaattcctgacttcaggtgatccacgcacctcggcttcccaaagtgctgggattacaggcatgaaccaccgtgcccggccacctggacccatttagattaagtcaatttacttagtctccagaggagggtctccgggactcagaccttagttacagattagaagaagttcatcactaatgtctttagatgagtgcacacttacacgcagacatacagcttagaaatagaagctctggagaactttgtaattttgagttggtctggcaacaatttccagacctccctgtaaccggttacagaaataaactccctcctctcccagttcatctgcatctcatttttgaaccaccagaataagcagcctgaccctcagtttggtccaggaacaaaaattcaaactggagtatgtcaaattaccacttttgccctggataggaaaaatcactgtccctgagcaataatattgaccctcctggaatagattgccctgctgggaattgcagggaagagataaacttgcaagatgaagatctgggagcatctcagtcttacctttataaattccattccagccaccatactgggtgtttccaagttgattctctagggaaccgccgtgatccgacgtaaaataaatgagggtgctgttgctcaaaccctccacgtccaaagtgtcaaggatccgtcctgcaaagaacagatgtttttggggccgtcgaaatggaaaaatatcagaaatgcagctctgaagtgtatgctttagcattcgggggctagccacaagaatgaagccttagttttaacgcataatggaagtcagctgttggataattttgatatcctttgttggagattgatgtatgactttatatgcaccccatcctttggtcagaattttaggcaacgtacaaggacaaaatatcaaaaacttaaaagtgcagcatgcaggctgggcacagtggctcacacttgtaatcccagcactttaggaggccgaggcaggaggatcatttggggtcaggagttgtagaccagcctggccaacatgatgaaactacatctctactaaaaatacaaaaattagccgggcgtggtggcacatgcttgtagtaccagctacttgggaggctgaggcaggagaatagcttaaacccgggaagtggagattgctgtgagctgagatcacgccactgcgctccagcctgggtgacagagtgagactcggtctcaaaaaaaaaaaaaaaaaaaaaaaaaaaaaagtgaggcatgtgaatattcctgagaagaaagcatagactgaaaatgcagaccagtcctcaaaagtgaccctgagcttcttgcagccacacacaagggaactcatgtcattaatgtcactcacagttggccgggcacagtggctcatgcctgaaatctcagcaatttgagaggctgaggtgggaggctctttgagcctatgagtttgagaccagcctgaacaacacagcaagaacttgtctctacaaataataaaaaaattagccgggtgtggtagtgcacacctgtggtcccaggtacttgggaggctgaggtgggaggattgcttgagcctgggaaggcagggtgcagtgagccacggttgcaccactgcactccagcctgggtaagagtgagaccctgtcggccaggcgcagtggctcatccctgtaatcccagcactttgggaggctgaggcgggcggatcacaaggtcagcagttcgagaccagcctggccaacatggtgaaaccccatctctactaaaagtacaaaaattagccaggcatggtggcgggtgcctgtaaacccagctactccggaggctgaggcaggagaattgcttgaacccgggaggcggaggttgcagtgagctgagaccgtgccattgcactccagcctgggcaacagagtgagactcggtctcaaaaaaaaaacaaaaaaaacaaaaaaaaaaaaacaaaacaaaaagtgagaccctgccacacacacacacacaattaactttttctccttccatgcctagcttgttgaggaaacaattttttttttttaaatacgtcgttcacccaaatctctgatggcaattattctgaggatcctgggattcgcagcccaccaccacctaaaccctgcggttcctaagttcttttttgggaggcagggatgtgctgtgcccatatacaggtgctcacccagccctgactcactcaagcaatattccccttccatcctgttctaaacccaggaaatataatgagggaatgaggcaagacaatccggccccacaggagtttatattcccctgggggaaatggaaaatcaacctacctaacacatggtcacgaagagaagcaatggtgatgctgtgttaggaaaaaaagaagaaagaagacagaaagaagaaagaagaagaagaggaagaagtggaagaggaagaagaaggaggaggaggaggaggaatatgaagaagaagaataagaagaagaagaagaagaagagggggaggaggagaaaggaggaagaggaggaggaaaacaaaggcaaaacaaaaaaggaccacaggagaatgggggagaagatgattggggaggagctactttaggggtgcgtcagggcaggctctgaagaggagccagtgaagcctgaggaagcattccaggagggaacagcaggtgtggaagccctgacaggggacaaatgtgaaagatactgtgtggcgtccacgtggccagaatgcagcaggtggggaggacaagggggttgggtagaggtcagactaggatctgggcagcagcaggtcatggggcttttgtaggtgataggaggaaatttagtcctattttcagtgcagtggagccactagccactctacagcggagaggaattttatctgctctttcttttgtttgtctaccacatggcaataggacgtagacatctttggggccaaaattctgtatgccacttgggaattcagacgtggaaatctctgaggtcattattctctctaacacatggggattaagacgtggacatctttggagtcattattctgtctagcacatggggattaggatgtggacatctttggggccattattctgtctcccacatggggattagaaagtggctatctttggggccatttttatgtctaccacatcaagattaggacgtggatgtctctgcagccattattctgtctagggagtggacagctttctgccacatgggattaagatgtggacatctttggccgaatcgcattgcctcccgtgcatgtgttatggaattcaccctctgctaatgcagtgaagatctgtgctataatattttgcactcttaaaatccaatcgcactgcaatcgctattctgcatcttctgtctttaaccttctcattctttgtttcctttcctgcttctattgctggaagggaagcagcccattttccctggaagtgcacttacctaccatccagtccatctcctctacgttgtccccatacagcccgtggagactcttcccgaggaagttctccatagtgataagagggatgtgaacgtgtagaaaggaaacaaagaggaggaaaggcccatgcttattcctaaaaataaatacgaagcaattaaggtgacttttttggtaaaacagagattgaagtcctgtagatactaaatacggatctcacttgtcacatcattactcaaatgtcttctcaactctgctcaccaaaaagaaacactcaaaactcttcttcaacggaaaattaattcttatatttaacaatcttccttttttttttttttttttttttttggctattttaaagacagggccttgctctgttacccaggctggagtgcagtgacatgatctcagctcactgcagcctcaatctcccaggctcaagtgatcctcccacctcagcctcccaagtagctggggccacaggcatgtgctaacaggcccagctaatttttttttttttttttttttttttttgtagagacagggtctcactatgtttactaggctggtcttgaactcctcggctcaagtgacctgcccctgcccatctcggccttccaaagtgttgggattacaggcgtgagccaccatgcctttctggtctgttacctctctctgtttttcattttgagacggattgtggctctgtcgcccaggcgggggtgcagtggcacgatctcagctcactgcaacctctgcctcccaggttcaagcaattctcctgcctcagcctcccaagtagctgggatcacaggcatgcaccacaacacacgtcttgtttaagactctttaacatcatgacttttcccttcccttctgaaatctatttaaaaatccacactgggccaggcgtggtggctcacacctgcaatcccagcattttgggaggctgaggcaggagcattgcttcagcctaggagttcaagaccagcatgggaaacatagcaagaccccatctctactaaaaatacaaaaattagcgggatgtggtgacatgcacctgtactcccaactgctcaggagggtggggtgggaggattgcttgaccctgggaggaggaggttgcggtgagctgagattgcgccactgcacttcagcctggacaaccggattgaaatcctgtctcaaaataaataaataaataaataaaaacccacactgatctaatgcatcttttcccccccgaatattataatgttctaactctactgcttaatgcaaagttaaaagaactgtaggttactgacatgacttttattttgttcaattatttcaatatctatttttaacctcaagctttagcttatagaataagtggtgccacacattccattttctttataattgctatcacgtagtgaggattaggacataaaatagttataaaaaacacactttacaaatgaggcatattgggttattcatattatttccattgtcctccttgaaagcagtgttttagcttctccctcccttcacccggccttcatggtctaatctagatccttgaagcctaagagcaatggtgaaggtgttagccttaattagaacacgtcaggctgggcatggtgtctcatgcctgtaatctcagcactttgggaggctgaggcaggaggatcacttgagcccaggagttcgagaccagcctgggcaacatagccagatcctgtcacatttaaaatcaaaaagaacacaacagtcttaccctgctttaatttgcaagctaattgtcaatgtcctttctgtcatacattaggtattgccatgaagaactctctaagaggctggatgcagtggctcacgcctgtaatcccagcactttgggaagccaaggcgggtagatcacttgaggtcaggagttcaagaccagcctggccaacatggcaaaacccatctctattaaaaatataaaagttatctgagcatggtggtgcatgcctgtaatcccagctacttgggaggctgaggtacaggaattgcttgaactcaggagcggaggtcgcagtgagccaagattgcaccactgcagtccggcctgggccatagctcgagactctgtctcaaaaaaaaaaagaaaaaaattatctaagaatgttgtaggagatgatgacaacctcattgtcaccaggtaaggtgacttttgatggtgttaccatctttactagaatgcccttggggagcatgaaaatagctgtgtagtactgagaactagtttcatcccatttctcctggtcccacacaggaattttccttgccataaaattgaccgcaggctgaattctgccaaaagacatctgacttctgaagatagacttttttttaagtttataattgattataaagcccttcaggtgatgcaggttacttaaatagtgtctgtggtgatccgaggatgctaatggaataagactgaccccagagtagtagcaaattccagctgacctgtaacaatttctttttgagacaaggccttgctctgtcgcccaggctcccttcatagcctcactacatagcctcaacctcctgggctcaagtgatcctcctgcctcagcctcccaagtagctgggcctacaagtccatgccaccacagccagctaatttttaaaatttttgtggaaatggggtcttgctgtgttgtccaggctggtctctaactcctggcctcaaattatcctcttgcctcagtctcccgagtagctgggataacaggtgtgtaccactatgcccagctcagctgtaacaatgttttaatggacacaaggcaagtcacagggctccactgaccctcatctatgccccattcttaccaaaaaattgtccttctaggtcatggctatcccattcttcaaacgtcaattaaagaaaacgactttttttttttgagacaggttctccctgtgtcacccaggctggagtgcagtgatgtgacctcacctccctgcaacctccacctcccaggttcaagggattctcccacctcagcctcccgagtagctgggattacaggcatgcacctgtaaagccccacattgggctaatttttgtatttttagtagagacggggtttcaccatgttggccaggctggtctcgaactcctgacctcaggcgatcctcccacctcagcctccaaaagcactgggattacaggaatgagccaccatgcctgactgaagaagactatttaggatgcgttttcattccaaagctgagtgcttggaggaagctgacccttttctgctgaccttttgagaaaggacgcaacctcctgcagaataaggggtgtcgttctttggaagcacatgggctgctccgtgatggtgtggtttctcatcagaaagcaatcggcatggacaatcagagcacccacaaaataggagcttgcgaggaggaggacggccgaaagggctgaccagatgaccggcatccacgagacgggtatcaggtgtgtgagcttccctgctaccagtgtgagggcaaccaaggccaggacttggaagaggaagttgagtttttgttccaggttgacacgcttctctgagagttcccagcgggcgcaatcacccatcaaggagaaaggcattccgtagaaatggtcaaagccatgatggagagggtggtggcaatgatcactggctgactcacagttgagacccagatgccattttcctgagaggcaaaaaggatgttgatgtgacaagcatctgagcataactggacatgtcgatattgactgtttgtcacattcctgatactctgttagacactggggggccaggagattgcaaagaagtgtgggcagcattagctgttatttgcaccacaatctggcctcatcgtttcaggggaatgaggaccccatgtgtcagctttaaccaaaatattagttacccgtgacaggtggaacaaattactgtaaaactgttcacttaatacaacagaaatctatcctctcccagtcctagagaccaggagtctgagatcaaagtgtctccaggccacactcaaattggaggctctaggggaggatccttcctgcctctcccagctcctgagggctccaggcctccctgggcttgtggccgcatcactccagtctccatctccatgtttccatggcgttgtcctctgtgtgtgtctgcgacctaatctcttgtctcataaggacagcagtcatcgcagtagggcccactgtagagacctcatctttacttgattatatctgcaatgactctattgtgagctggatcctggcctgcctcaaattcatgagttgaagccctaacacccaggacctcagaatgtgactgtgtttggagacagggtgttcaaaggataattaatgtaaaatgaggtcattagtttgggcactgatatggtttggctgtgtcctcatgcaaatctcaccttgaattgtaataatccctatgtgtcaagagtggagccaggtggagataattgaatcatggaggtggtttcccctacactgttctcatggtagtgaatgagtctcacaagatctgatggttttataaatgggagttcccctgcacatgccctcttgcctgccgccatgaaagacatgcctttgcttctcctttgccttccaccatgattgtgaggcctccccagccatgtgaaactggaagtccattaaacctcttttctttataaattacccagtcttgggtatgtctttattagcagcgtgagaacagactaatacaggccttaatctgatagaacttgtgtcctataagaagaggatagtaggacacagacacacacatactctctccagaggctctaggggaggatccttcctgcctctcccagctcctggtggctccagctatcccttggcttgtggtcgcctcactttaatcacactgctttctcctctctgtggcccaatcttcctctacctccatgttaaacgaagccttgtccttgcacagtgggcccagctggataattcaggatcatcttctcacctcaagattgttcacttaatcacatttacaaagactctttttgcatataagctaatatttgctagattcagaggttagggcctgacatctctgggaccattatttagtctattgcaccttgttttgcagtgcaatgatgaaggccggaaagcaccatgtgatatcagcagcatgggcaaaagacttctggactttggaattgttctctctttgagaaaccactatcatagtggccatggttgaagtgggtggtgggttttgcaaggcacacctttcaaattcagtcaaaggaatatagtctttgcttccatgtagccactactatggtgttgacaaagagatgtcaaccaccccaatgctgtctgccatctggaaaacctcatgatttcccaatggatatcccttaaggatagactcttctgtcttagaaaaattatagttggccaggcatggtggttcacaactataatcccagcactttgggaggccgaggtgagaggattccttgtgcccaggattgctggagaccagcctgggtagcatgggaagaccccatctctacaaaaaaaaaaaaaaaaaaaaagaaaaaaaagaaaaaattaaccgggcatggtggtgcaagcctgtagtaccaactgcttgggagactaaggtgggaggatcacttgagtctgggaggtcgagactgcagtgagctgtgactgcaccattgccctctagcctgagtaacagagtgagtaccctgtttaaaaaaaaaaaaaaagtctattggaaaaaatacacctttgtttgacagcgatgactgaatctccccagaatttgttttttttttttttttggtaaaaaattaaacaaagaacattttataatttttaatttttagaaatatagtttattgaattttatactcattgtatccactagtcatgttgtttgttatcaataaatggaactgttgataacaatcattactataacacaataatgataatggcaacttggtctcctctcaaggaactgttgtcattaattttatttttcatccaatacatgacatgtttgttgacttgtagaaaaataaccatgttagttatggaagctgacagggaggtactaaatctagtaaagacattttcatacacaccaaggggaaaaataggtagcattacagaaatttttgatgcaagaatatattttttcttatttttttttatcatggcctacgagaacattgtttgagatgccaaatatttcattaagttgatgttccttttctttctttctttttctttttcgtagagacagggtttcgccatgctgcccaggctggtctcaaagtcctggcctcaagcgatccacccaccttggcctcccaaagtgctgggattacaggcatgagccaccgcgcctgaccagagtcacttttgtaagggcactaatcccacacatgaggctccaccttcacgacctcatcacttcccaaaggcttcacctcctgccaccatcacctggggggtaagggtttcaacataggaattttagggggacacaaacatttagatggcagcactaaactagccaagttgatccataaaccaaccagaaaagagctgaaggtgttcagtctaagacattcatgtctaagacaaaaagtccatgtgaagggtgggagaggatcccacagaacaaagaagcaattatgtgttgtgcaatggagcttggaacatatgccataggcatgagcacattttatttattttttaatttatttttatgtatttttttgtagacgtggggtcttgctatgttgcccaggcgggtttcaaacttctgggctcaagcaatccttccgcctcggcctctcaaagtactgggattataggcatgagccaccttgcctgagctggtatttcttgagtatctactttgcagaaaacaacctggaaaggaacatggttcctagatacatgcagctttctgtctagtgggaaatcccacagcacctcacccactttcctttccaaactctttagctgaatgtcccttccatataaaagtcatgtgcttaccacttttaaaaacgtacataccaatgagtccagtggcatagcctttctctttcagtatttttgcaaaagttgtctcatttgttggaagacctccagatgctccggtccactgaagaacacggtaaccaatgctggaaaccatccctttgagcaattattaagagaaagaattactgttccacattttttttcctgtttgttatttattatttattcaaaaatagaacacttggtaaaaatctctcttacttaaaattaaattgaaaatggacttcctatatgactttgcctagtggattgcatttttggcagcaaagtaaatgattaatttattgaaaaccttagcgagaagatggactttcctgttatgtgcaggttataagcaatataattcagtgaaaaaggactaaaaatttaaatggttttttgtttgttaattaatttatttaaagatggggtcttgttctgtcgtccaggctggaatgcagtggtgtaatcaatgtccactgcagtctcaaccacctgggctcaaacgatcctcccacctcagctacctgagtagctgggactacaggtgtgcaccaccacacctggctaatttttaaattttttgcagagacagggtctcactctgtcacccaggcttgagtgcagtggcatgactatagatcactgcagccttgaactcctgggctcaactgatcctcccacttcagtctctcaagtagctgggactataggggctcatcaccatgcctagctaatatttttaattttttggcagagacggggtctcactatgttgcccaggctggtcttgaactcctagactcaagtaaatcctcccacctcagcctcctaaagtgttgggattagaaacatgagccattgtgcctgaactaaaaatgattttataatttcatcaaactcttgatataatctaaaggttctcaaagttgtctgcccattggaatcgtgtggggagcttcaaaatattctgacgcctggttatcaccccaggggtgctaattttcattggtcttgggtggaacttgggctttgggatggtgggaatatcctctggatgattctaacgtactgacaaggttggtagccactgataaaattttattctgctctccagacattccaaatctctacccaagggtttttttgtttgtttgtttgttttgggacagagtcttgctctgtcacccaggctggagtgcagtggcgccatctcggctcactgcaatctccgcctcccgggttcaagcaattatactgcctcagccttccaagtagctgggattacaggcactcatcatcacgcccagctaatttttgtattttcagtagagacggagtttccccatgttggtcaggctggtcttgaactcctgacctcaggtgatctgcctgcctcagcctctcaaagtgctgggattataggcatgagccaccgtgcccagcctctacccaagtgctttaaaatgtaggtgttatgtattattattattaaggttttatcattcagctatggcaaggccaacagatcaggagatgactgtcattggagagatagtttattactcacagtttctgatagtttattactcacagttcaagaggacgcaggggtgagccatgctgtgtgactatatggggaagctccagggttggtcaggaggcagagggagtgaggggaaagcatggaaaaagcctttcttatttattgtttttcttttttggaaagtaatgggcaaggtagggtaagccggcttaagactggccaggttgtacaatttccgtgggctttcatctgcaggggctgtccctagaaagctggtacctgattctggggggattagggcaaggagagagtagccccatatatgaaaatctcataaaagtgatggttgggggtgtgggctctggactgtttggtttatgcatgaaaggtgcactcccaggtgacttgtttgctatctctaagaattggctagccctgggagggccagtcctgccaaggtcagcaaagccctaagatgtcaaagcatcagaatataaaagctgcctgggcacggtggctcatgcctgtaatcccagcactctgggaggtcaaggagcggggatcttttgagcccagcatttcaagaccagcatgggcaagatagagagaacaccccccagtctctatttaaataaaaaataaaaaaaccaaaatgtaagaactagaaactgtgacgaatacaccaggctgcaccctagtgcagttgtaaagagagactgacctgatcgcacagggtatctgcccgtgaggaaggcggctctgcttggggtgcacaaagatgcggcagagatgtgttgggtcagcttcacgccgtcctctgcaaggcggtcaatattcggagtcctatggagggacaaattaacagctttacttgttaaaattagacaggcttttcataagcatagctacatgctacttcatagaaggtctgctggtcatcgctgagtgcttcaagatgttctcaggaatgacccaaaggtaatgtcaaagatttctaatgtcttctgaactttcgaggaaacatcaactcatttaaataggaatgagtggctggacgcggtggctcatgcctgtaatcccagcactttggaaagccacagcgggaggatcgtttagggccaggagttcaagaccagccgggccaacatggcgagaccctgtctctacaaaaaaatctacaaaaatagaaaaattagccaggattggtggtgcatgtctgtagaaccagctacttgggagactgaggaaggaggattgcttgagctcaggagtttgaagctgcagtgagctgtgattgcaacactgcacttcaacctgggtgacagagagacaacctgtctctaaaataaataaatgaatgagtagatagagtgactaagtttccacaaggcactgttggtactgagagaccgacctcagagggaatgcagaactgagagcccagggcaccttctctggagctcacagtgttcatgggaaggtttgacttcatggacgccaacacactgtaagtactacatgagggtggaaggctggaattcggacaggaggacggactagctctagctcttgacagatggacacgccatattttggcattaggagggtgtggacttgtctgtctgaagcagagcttttcagcaggggaggattgaaatcccgcataagtgctgggcttggctagatggatagggttgggagtgagacagagatcaatattggtcttctgcttacaggcaacgacactgatttctcctgtatgtttgtttatttgtttgtattttgagactgagtctcactctgtcacccaggctggagtgcagtggcactatttgagtctcactacaacctccccctcccgggttcaagtgattctcctgcctcagcctcccaagtagctgggattacaggtgcccgccaccatgcccagctaatttttgtatttttagtagagacgggggtttcaccatgttggccaggctggtctcgaactcctgacctccaagtgatcagcctgccttggcctcccaaagtgctgggattacaggcgtgagccaccacggccagcctactttttgaaacagggtctctgtcgcccagagtgcagtggtctgatcacagctcactgcaaccttaaactcctgggctcaagtgatcctcccacacctcaccctcttgaataactaggattacaggtgcatgccatcatgcctggctaattttttttttaatttaaaaattaatgtgccaggcgtggtggctcacgcctgtaatctcagcactttgggaggctgaggcaggcagatcacgaggtcaggagattgagaccatcctggctaacatgatgaaaccccgtctctattaaaaatacaaaaaattagcggggtgtggtggtgggcgcctgtagtccaagctacttgggaggctgaggcaggagaatggcgtggacccgggagacggagctggcagtgagccaagatcatgccactgcactccagcctgggtgacagagcgagactccgtctcaaaaaaaaaaaattaatgtttatattttctagagacaggatttcactatgtttcccaggctggtcttgaactcctggccttaagtgatcctcctgcctcagcctcccaaagggctggtattacagtcatgcccggctgatagcatttctaaagcattgtccattatgtactgggtggataaaaatcatatttaaaaaatgaaatgaggccaggcacagtggctcacacctgtagtcccagcactttgggaggctgaagcgggtgaatcacttgaggccaggagttcgagaccagcctggccaatatggcaaaaccctgtctctactaaaaatagaaaaattatccaggcatggtggcgggcgcctgtaatcccagctactctggagagtaaggcaggagaatcactggaatcgcagaggcggaggttgcagtgagccgagatcgcaccactgcactccagcctgggcaacacagtgagattctgtctcaaaaaaaaaaaaaaaaagaaaagaaatgaggccaggtatggtggtttacatctgcaataccagcactttgggaggctgaggtgtgtggatcacttgagcccagaagttcgagacgaggctgggcaacacggcaaaaccccacctctacaagaaacttacaaattacccaagcatgatggtgggcacctgcagtcccagaattactcgggaggctgaggcaggaggatcacttgaacctgggaggtcaaggctgcagtgagctgtgattgtaccagtgcagtccagcctggaccacagagcaagactttgtctcagagaaaaataaaaaataaaaataaataaataaaaataaaaatgaaatgagcagtcatatgtaggatggattgaggtgaggttagtgctggcatgggaagaaagtaacattagggagagttagaaaacgcagaagtgcagaactcttgaagtgtgaactgccaagatcaagggttatatgcattttcagtggcttctctttcttctggtgtctgcattgggggcaccaggtgagtaattctctgtcccttgcctcatggtgttgttgccatagcagccaatgtccccaatgccaaggtcgtccgccatcagaagaaggatgttcggtcgggaggcggaaatgtcgctggaagctgatggtgccaaacttagcagtacagcgagcatcgctggcagccagctcctgaaacacaaactgtcagagactgcgtcatgctcctgtccatctcatttgcagaacttgtgtatgggggaagttggcatcactattttaagaggtattgatattatcatcacatttcagaatagctttgaggacatctcttaggcatttgattgtttttctctggttacaattaactgataccgttgatggctttatttggccttgaagttttttgggttttttttgatgctgtaaagtctgttgttaagtgattaaactcatgattaacagaaagccttggtggggtgcagtggctctctcctgtaatctcagtattttgtgaggctgcagcgggtggattgctttaccacaggagttcaagaccagcctgcgcaacatggtgaaaactcatctctacaagaaatacacagcttagctgggcgtggtggcacgtgcctgtagtcccaactcctgggaaggctgaggtgggaggatcgcttgagcctgggaggttgaggctgcagcgagctgagatcgcaccactgcagggcaacagagcaaggctgtctcaaaactacaacagcaacaagaaaaagcaaaaacagccagaaagcctgccttagtcatggtttcttggatggatcgggtccccagaacagctattgccccttctccattccctcttcttcattgttcttccttaagcaaactgtgttgaacatagggaatggaggctggggttagggtttggaccacccagcagagcaaggaagagacacaagcttggggcaaggtgagaacacagtgagctgctacttctgagtctatgaaaaccctctgttcattgtagcacacagatgaaaatacccaggactgacttctttagcccactggtatctgatgagaagtgggtttggaggtgaaggaggttccagcctggaggagaaagccctggtagttgcgtaccatgagggaacatttccgcaggggttggtgacatacagcctgccactatcattgctgcctctttcatcgatgccaccctgggaatgcacatggacagcagggccatagtgtcccaatccccagtgggatgcagtaaagatgtaatctgagtctccaaggtttgtagtaggggaaaccctgattttccctggaaaaccagacacctggccgatggtagcggttgatgcccacctgatttgcagagaatgaaatacaattccttctgaggctgcctggggcaacatcaaatcaagggagcctggagcacatctattaatcacgggtctcatgcttcattctccagatgcaggataaatcactatcagtgcattctgagaaagcaccatcaagagatccagaagcggtcaggcgtggtggctcatgcccattatctgagcacgttgggaggccaaggtgggagcattgcctgagcccaggtgtttaagaccagcttgagcaacatggtgagaccctgtctctatataagaaaggaaaaaaaataaagaagggaaggaaggaagaaagagagagagaaagaaagaaagaaagaaagaaagagaaagaaagaaagaaaagaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtggcaggcgcctgtagtcccagctactcgggaggctgaggcaggagaatggtgtgaacccgggaggcggagcttgcagtgagccgagatcgcgccactgcactccagcctgggcgacagagtgagactccgtctcaaaaaaaaaaaaaaaaaaaaaaaaaagaagagaaagaagggaaggaaggaagagaaagaaagaaagaaagaaaggagactactaatgagtgcatataattgtatcttaccaagaatggtgcagatgtaacatgttgtctctctctctacttcctgtaagacataaagatgtccacaatcacattgacagcagaaattgacctgattataaataaaacagtaagtaagtaattaggggaactttgattcccgttcatgatatcaatagcaaaaatatcttaaaacaatgatcaaaatctataaaggaatgctcttcccgagtgaaaaggcttcaaaaatgtttaatactatgttaagaatgtaaaacgtgtttcaatacacagccagatggtcttcagagaaagaggaagaaagtggtcatagggtctccatcccctttatcagctttcatagcccatgagtgatcacaaagtgatgagagaatcccagtgtccggaagcagattattttgtcttctgcttcccgagcccagggcaggggtgattcctaatgtccagaaatgcagagagagagtcctgatttggaagggggaagcggggaaagatcaaagcttggatgatacacaaaagaatctgagtagagggtatgaagatcagaaatacaatgagaggctgcgcgtggtggctcatgcctggaatcccagcactttgggaggcggaagtgggaggatttgcttgagcccaggaggtccagacttgaaaacagaactgggagtgtcagtgtgaaggaaaaaggcctagaggactctgcaggcactgagtgctgcatgaaggagagacgcattcgccttcattgctaggggtaggtgctgccgggagagggggcgaccattgcccacacttggaaatgttctgtccacagagggaaacgggcgacccccaaagcacagaggggcggcccctcagtctcgccgagaagtgagggagagcccagggtgtagagcaggaaaggaatgagatggaagataacaattagagttgcaggcagcaagaggtcaccttcagggtactgcagtggtctgaccccatgtggcttgtgcatgggactgaggacgaagctctgatttttctttttatcttgcccaaattcctatctaaggggtctggagagtcatgccctacaaaccaaaaattctcatcagaagggtttcatttaactatatattgtgacttactttccaatctgactctggcataacatgagaccaataagaaaatcaaaatattttacccaaaaacatgtttctttgccatatcttgaaatggccctgcaaagctgtcctttgtggggaaaaatttgcatctgtaaagatgtaaagaatctctattcacatagatattcacatctttttctaccggacccttccaatcctgaaaagattgactaagactctagcaccttttaaaagtctgaataggaaacaattgtcatctattgtctctaagggcagccgctacaagacttcaaaataaccttggtctccacaatcttttctcttaacctgaagatttcttttctagggatcccagggttttttttttttttttttaatctttcttttttatttttttgagacggagtcttgctctgttgcccaggctggagtgcaatggcgcgatcttggctcactgcaagctccgcctcccgggttcaagtgattctcctgcctcagcctcctaggatcccaggtctttagatgaactcaaccaattgtcaaccaggaaatgtttaaatctatgtataagctggaagccccctgactttgagttgttccacctttctggaccaaaccaatgtgtatcttaaatgtatttgattgacacctcatgcctccctaaaatgtataaaacaagctgcaccctgaccaccttgggcacacgttcttgggtcctcctgagggctgtgtcatgggccatggtcactcttatttggctcagaataaatctcttcaaatattctacagagttcgcttcttttcgttgacaggacatgggcatgcatagaagataaagagacaggagcatgcagatgtgttgggtttctgcctctgagtaaccaggggagtgacctggccacttttagaagggccgagcggccagtgagtgaggacacactggagccagcaggcactgagagcctagaagtggccgtggtgtctgtccaggtgaaacctgaccaaggatagacacagctggtgtgggagcggggagggcagagaggaggggtgggcaaggtccgcagggctgcgaaaccccagggtgtgagtgggagagaagcgattggttgagggatttcccctcaacgccttttcggggatgctgggaggggtgtttgctcctagcaggattcaggcacaaaaccagtcttctgagaaagacaatgagctttgtgaaaggaaaataaatctcaaggcccgcaagtcaataagctaaagggaaaagtcaagcggggaactgcttagggcctctgcctcccattctagtcaaagtcccccctttgctcactgagatagatgcgtatctgattgcctcctttggaaaggctcatcagaaactcaaaagaaggcaactgttcctctctcacctatctgtgacctggaagccccctccctgcttacagtcttcctgcctttgcttcaagttttccggcctttccagaccgaatcaatgcacttcttacattattgatggatgtctaacactgaattgctacatctccaataattttctgtctgtcgaagagaaaaagaccttagatatcatttgtgctttgtttagaacacagaaggaagggataaggtgtacgccgtgctcgtgaggtttttttgtttatttgttcgtttgttttaccctagagagcacacacaattctcatattctaaaagtaatagcaaaagacgcaattacgtttcaccaacctaatagcatcttcaccgggaaagagattgatttaaaattgtacatggagagaaaaccaaaatgagcattttaataccctcagcattgctttctgacctacaatgacatgctgccaatggtcagaaaacggaataaaagcaaaatactgtacaaatgtaatgagaaaaccccaaaccaccacaaactaggggaagatggtttttgcagcaatcctgcccagcagtggtttatctctgggtgtggagatttaggaaaagtgctctttttctaatttttcttttcttttcctttttttttttttttttttttttttgagatagggtctggctgtttcacccaggctggagagcaatggtgcgaccatagttcactgcagcctcaaattcttgggctcaagcgatcctcctacctcagcctcccaagtagctgaaactacaggcacatgccactatgcctggctattgatttttttttttttaagtagaggtggggtttcctcttttgctcaggctggtctcaaactcctgggctcaagcaatccacccgcctcgacctcccaaagtgctgggattacagacgtgagccaccgtgcccgacctaatttttctttctcccgcaatgttatgtatttataagtaaaaatatgaatattttttcttggagaaaaacgttaaataaataaagagatggtgataacagccttgaatgagtttaattttggaaactgtgacattgaggtgacccagagcatggggcctgcccaaggcctctcctgcagattagaaaacagatcccccttctccaggaaagagctgcattcctaggcctgtaagtcacgggtacgtttctgctttatcaaaacaaactgggcaattattcagagacagaaaagggaacggggagctctttgttcaccacgctattcatgcctggtcacggagcccaaatccagcacaaatgaacattcacaggactcacctctgctcctgggctccttcctgaatccccgatcaagaagaggaaggttctctcccaaaggaagcaagcgtgaaggcagagagcacttgcacaaggctttgagctgggaatgattaacttcgagtttgtttttcccaagtcagaagatcagagagagttaggacagacagagcagactccccccacatcgcagcatgggggaatctcaaagccacgcccacgtctaccaa

SEQ ID NO: 849 - DNA, 45932 bp, Homo sapiens
caaaagaggcagagcctttgcagaacagcctgtctgttctgctcctagacattagagagataatacggctgataggtgagttggggaaggcttgtttggacacattttctcagccttttttttttttttttaacctctggtagaaacgggcatagttgaaagatccattgacctattgtattctgaaactcaatggatcatcagcttaggcactgagaaatggattccaaaccaattttagtgtgagcaagtttctctcctttctgttactctcataccctttcttctttcttccctccctccctcccttcctttttctttcttaaccaagaacgtgtgtgtgtgtgtgtgtgagtgtgcgtgcgtgtgtgtctgtgtagtgtgtatagtatgtgtccagagtatacatgctttggaacaaaatgaatttaaggaggaatgcgtttgtattttgtccttagtgttattttaaggtacaaatatgggtaataacttgcagactacagatgggcttttctttcattgtaatgcatttggctgtcatatcccttagtcctaacccctctgccactgccaactaaatataaccattagtcattcagtggtttctgcattttgcagtcaaaaaagagggagctcattttgattaattgcctctttccttattcaggacacagaagctttctgagtttaaacttttaggcttggcaggacattgagacaatgctcttgggccagcatgtttcagggcaggttttgccactgagacaattcatccaagagccccaggacttggggcagcaggagttcttttaaaaatgggccaaaagacgggcagagcacttgaggtcagcagttcaggaccagcctggccaacatgctgaaaccccatctctactaaaaatacaagaattagccgggcgtggtggtgcacgcctgtagtccccactactcaggaggctgaggcaggagaatggcttgaacccgggaggcagaggttgcagtgagctgaggttgcaccactgcactccagcctgggtgacagcgagactccggctcaaaaaaaaaaaaaaggtcaaaagaatgaactcattgaaagttcaggatttgtgcagtagtggccttggaaaatcaatttaaaaatgtcggaattagggatatggctcacaagtctagtgtgaatttcatgctgggaactaatttaattgacacatgaatgatactttttttttttttttttggtcttttaaatcacgtctgtgtcttctgccaaagacaacaagaaggtattccaagctgcacaatgaggcccaggtaggtaaagccatatactgcattgtgagcacattgaatctaatgtataattctgtgtatttgtgaatccagccttataggtagaggcatttaatatcatctgcctttttttcttttttctttttcttttcttgtaacctactatgagtcaacatgctgtctttatatggctggccataagatgtctaagttcattctctcgacttagtaagtgtgtaagttttttaaaaaggtaggagttaggcaattgatagagatgtaaactgtaaatttccaacagatacatatgagtttatgtttatttttatttattttagagacagggtttcacagggttttgctctgtcacccagggtagacgacagtggtgcagtcatagctcactgcaacctccaactcctgggctcaagagatcctccagcctcagcctccagagtagctgggacctcaggtgcttatcgccacgcccagctaattttttatttttattttttgtagagacaggttctcattttgttgcccaggttggtcttgaactcctgggctcaaggaatccccccgcctcagcctctcaaagtgctgggattacaggtgtgagccaccattgtgcccagccgtatacatgattttaaagtgttgtaaaaacaggaggtgaaaaaattcaactaactttgcatagatgaaaagcatttctataacttcggggatttggcccacagtcctgagcatgtagcttttgcctgcaagacattctcaatcttcaaggagatgtttgcatacagcaaaaaaattgtactcttctgtggctgtcattgtttcagagtatttacaaaggactctgagagccaatagggatgaactcctgtttgtattttttctctcagaggagatatttgaagtgggttttgaaacatgtatagacatgagataggaattgaatcaataatccacatgtccaatattcattacctgataactgagtagggatatgctgagaagagcgtcatgtgtttccttaagaaaatatgacctcagctgggactgagcaaaactatgaagtggactcaggtggtcctcagagtccacgtttctttcttttcctcaattcagttctttccccaacttccacttttcctttacttggtaattccttattttattttatttatttatttttttgcttgtttttcttttctccagccaaagctgctattctcacactttttcttcttttgagggtctcgtcctgtagcccaggctagagtgcagtggcgcaatctcagctcactgcaggcttgaactcctgagctcaagcgatcctcccacctcagcctccagagtagctgggactacaggcatgcaccaccacacccagttcatttttacatttttttgtagggatggggtctcactatgttacccaggctggtgacgaactgattctcctgcctcagccccccaaagagctgggattacaggtgtgagccactgcaacctgactttttaaaaatttggagtaatgataaattgcatgtatttattctttttatattatgaatattttatttttatttattttttctttctttttaaattcatttttctttttatttttttcctttttaaatttctttttctttttttattgtcccttgagtcaaaaaagctgacatataaacattgcatagatttatggtgtacaacttgatgttttgaaatacgcctgcattttggaatagctcaattatgctaatgcatgttacctcatccacttacctatttgtgatgagaacactttgagtagattttatcagtaattttcaactctaaaatacattcttattaactacagtcagcacaagtacaatagattctttgaacttatttctcctgtcaaattgaaattttgtatccttcgaccaacatctccccaacccctccactggccccccagctcccagcaggcatcattctaccctttccttctatgagatcaactttttgagatttcacatagaagtgagatcatgtggtattggtgtttctgtgccaggcttattttccttagcataatgacctccaggttcatccacgttgttgtaaatgacagaatttcattcttttttaacgctgaataatattccacggtgtatatgtaccgcattttctttatccattcatgcaatgatggacactgaggttgatttcacagtttggccattgtgaatagtactgtaaggatcacacacacccacatgcccttaaattagaataaaaattctaattttagaatgaagttaaggttaaatcccttacctgtagagactcatttaagtcccttaaatgaggttaagtccctggaagagggagttaacctcaggagtcttatcgtctccgtcctctgcaatgatttgcccctgagtacgtgttttcagacttccctcctggaagggcatctactttagccttttaaaaaaaattcaatagtttttggggagcaggtgatgtttgattacatggataagttctttagtggtgatttgtgagattttgatgcacccatcccctgagcagtgtacactgcacacaatgtgcggtctttgatccctcactcccctcccaccctttccctgagtccccaaagtccattgcgtcattcttatgcctttgcagcctcatagcttagctcccacttatgagtgagaacatacaatgtttggttttccattcctgagttacttcacttagaataattgtctccaactccatccaggttgctgcaaatgacattattttgttcctttttatggctgagtagtattccatggtgtgtgtgtgtgtgtgtgtgtgtgtgtgtgtgtatgaatatgaaaatttgatatggatagatagatacctgcagatctatacagataaagaagatgtgttatatataggtatctacagatctatagatatcaagagtgtctcgctccaagcaccaagcactgctgctgaatggcagcagaagtgcccaaagaaatgcgctcttggcttctcactttgtatacaatctatagctatctatctctatatatcacattttctttatccactcattgattgatgggtatttgggctggttccacatttttgcaactgcaaattgtgctgctgtaaacatgcgtgtgcaagtgtcttttgttgttgttgttgttgttgttgttgtttttgatggaacctcggtccgtcacccaggctggagtgcagtggcacaatcttggctcactgcaacctccgcctcccgggttcaagtgattctcctgcctcagcccccctagcagctgggattacaggagtgtgccactacactcggctaatttttgtacttttagtagacacagagtttcaccatgttggccaggctggtctcgagctcctgacctcaggtgatccacctgcctcggcctcccaaagtgctgagattacaggtgtgagccaccacacccggccgcaagtgtcttttatatataatgccttcttttcctctgggtagatacccaggagtgggattgctggatcaaatagtagatctacttttagttctttaaggaatctccatactgttttccacagcgcttgtacattcccactaacagtataaaaggattcccttttcactgcatccatgttaacatctgttgttttagcctttattttatgcaaagtgagaagccaataacgcattacgttgggcacttccgctaccattcagcagcagtgctcggtgcttggagagagacactcttgagcttcaggagatgcctgggagatccacgtgatctccaaagacccctgttgtgttgtgttgggaggtggatcctgaatccacccagagaagcctgataccaataaaatccctgcttgctttccaggagacccttggtcttcatgtctttggtgtgtgcactcttgaacacatgccaggcacacagggtgcatgacgacaagcctaatattgtcctaatcatggttgatgacctgggtattggagatctgggctgctacggcaatgacaccatgaggtaaggcggtttcatggccagtcatacgttcgtcagtcgttcaggttcagcaggctggctgtacggctgcatctatgtgcaaaaccaaatgtatttgttgggacttttttttaagttactttaaactttttgatagttttaaattatttagattatgtaatagttttacaattacatttttaataattttaatttgaatctctttcagtttttaaacttaagaaataataattgtccatcttcacagggtacacagtgaggtttggatacatacaaagtatagtgatcagatcagggtaatcagcacatccagtgcctctagcattaaccaggatggtcatagtaaaagcatggctatctggacccgagtcctggctctgcatttactagctctgaagtcttagagaagtcgctgaacctctctgtgcctgttttcttatttgtcgaatgcagagaaggctttatatccctgagtttatgtgtgtaaagaacttagaatagtacctaacacacaactaccctctatcatacagcctattatgaagcatgatgattgtatgtacatgtacatatacagatatgaacatataaatgtcattatataaatatatgtgatatattcatatatgaatatattctataatatataaagtatatatcatacatttattatattacatatccatatattatgaatatatgaacatacattcaatgtataaacatatatgaatatatttataatatatgaatatataatattactaatatatatgaatatgttattcatatatacatgaacatatacatatttctatgtctatgaatatatattcacttttatataaatgtatttttaaaaattaaatataaatatatttaaataaatatataaacatatatttatatattttataaaagtacatttaaataaatatatgtaaatatatattcattttatataaataaatatttatataaaatgaatatatcttcatacatattgataatatataaaagtatatattatcaatatatattgataatatataaatatatatttatatatataatatataatattcataataggctgtatgatagagggtagttgtgtgttaggtactattctaagttctttacacacataaactcagggatataaaggcttctctgcatttgacaaataagaaaacaggcacagagaggttcagcgacttctccaagacttcagagctagtaaatgcagagccaggactcgggtccagatagccatgcttttactatgaccatcctggttaatgctagaggcactggatgtgctgattaccctgatctgatcactatactatatattaataaataaatatatattatttattaatatatatttaattatacatatataaatattttaatataaataaatataatataaatatttataaatatatttataaataaaattatatataattataaatatataattaaatatataattaataaatatatattataaatatagatttataatatataaatatatattaataaatatgtatgaatttatgaatatatattcaattatatatattcataaatatataaatgtgaatatgtatattcagcagaattcattctgtttcctaatttggtgagccaatagattctttaagatggtgagcttgtatttttaacaatgggcattctgaaagaagaaaaacagatatgaaacaaactcagtgctttgtggtggataatagaagctatctgtattagccattcttatactgagcttaggagtacatcgttatcagacgtacatcatacacttttaagatcattgcgttgtatgactaatagatgctgaaggtagtcatcacagttttcgacaacggagctaggagtcatgaaaaagtagtcgccaaaaattaaccattgcttatgagaaaagaagagaggactcaccgaaaagcgcagaaacatggtgtccataaatggcagatatttacagagagtatgttagcgtggggtatcggtgttttgctgaaaatactagcaatttgagaagtgagattataatgtgaaatctaaaaccaggcacatgtgccccaggaatgcagtttacaatttttttctttgcaaaataaataatgttttaaaagttggtaggtgacttccatatctgaaaaaaaaatcagatgcacaccttggtaaagctggaacttctccttgcaccagttacctgtcataatttctctcatgaataaatgtagaactcattatattttattttcatccaagaggagactgattctttttccagaagtctctccagcctccagaaatctcttgttaaattattttttaattgacgaattatagttctgtgtatttctggtgtacatcatgatgttttgattcatggatccattgtggaatagctaaatcaagctaattaacatgcacaaccacacatacttattatttatatgtggtgaaaatggtgaaaattatagcaatttcaagaatagaatacattgttattaactatagtcaccacaatctgcaacagatctcttaaatttattcctctatgtgaggaataaatcaaatagaggatttattcacgtttggctccgtgaaatgttgtatcctttaacctacctgttctcgaccctcaccccagcgcctgatacccaccattctactgtctacttctgagtttgctattttagattccacacataagtgagatcatgcggtatttgtctctctgtgcttggcttatttcatttaatctaatacccttccagttcatctgtgttgtcgaaaatggtgggatttccttcttttgaatatttaatcatatgacagttttgcaacctatgcagactgcagggaaatgtatctatcaaaccagtgagtgggtgggtctgtgagtagttaggcataagtaaggtctgtaagcaattagcctcgatgaatcagaccccaatcccttaagcattttattttgtaaggctgaagtacagtgaatggacaccatatagtggcacccaggtatatgaaccctgcagaacaacagctgcctggaatctcagtcatacttcaccttgacacgggcaaaaaagaaaaatgaactccgtgtgcagttacctgctctgggtacctggaaatcataataaacagagatgttgtttatcttcagatctctctgtctctctctctgtctctctctctcctctttctgtctctacatctctttctatgcctatgcgtgtctctgtcacccctctctgtctgcttgtctctttctatctctctctctgtctctctctgtctccctctctttgtctgcctgtctctctatctctctctctgattgtctctctctgtctccctctctttgtctatctcattctatccatttctttctatctctttctgtctctctctctccctctctctgtccttctgtttccatctgtctctccatctctttctatgtctgtctctgtcttccccctttctctgtctgcttgtctctctatgtctctctgattgtctgtctctgtctctgtctctctctttgtctatctcactctatccatttctttctgtgtctttctctctttccttctctctccctctgtctgtatctttccatctctctctgtctctctcttcctctcttcttctctctctccatctctctctctgtatctctctctgtgtctctttctctcttttcatctctccctgtttgtctctctctgtttttctttctgtctccctccatctgtctctttttccacctctctttctgtttctctctgtctccctccctctgtttatctctctttccatttctttctgtctctctcttaatctctgcatgtctctttccatctctctctttctgtttctctctctctgtctttctctctctctcttgtcttctctctgtccctctctgtctttctctgtctccctctttctgtctttctctctccttttttctgtttgtctctctctttccatctctctctgtttctctctgtgtgtcttaccctttgtctctttctctgtctcttttcatctctctctttctgtttttctctttctatccttttctgttgctctctttctcgtttgtctctctctctctttcatcctttctttctgtctgtctctctctctgcctcgctttctgggtctctccctctctccctgtctgtctctcctctctctttccacctgtgcctttctgtttgtccttctctgtcttcctctcgctcttcctctctgcttcccccgccccccaccttttccttctctccaatacaccttccctctcccccttcaggacgcctcacatcgaccgccttgccagggaaggcgtgcgactgactcagcacatctctgccgcctccctctgcagcccaagccggtccgcgttcttgacgggaagataccccatccgatcaggtgcgcaaactggcgggctctgctgggctctgccctcatgttaggatgtgaggaaacaaaaatgtggcttgaccacgttaacaagtaaaaaagggctgggcacgatggctcacgcctgtaatcccagaacttcgggaggccaaggtgggaggattgcttgagcccaggagtttcaaaccagcctgggcaacagagcaagaccccatctccacaaaatttttttaaaataagttgagcatggtggcatgtgtctgtggtcccagctacttgggaggctgaagtgggaggatcgcctgagcccgggagtttgaggctgcagtgagtgtgatcacagcattgcactctagcctcgttgatagagcatgtgttagaaagaaaaaaaaagatacaaaggaaagaaaagaaaaagcacacatgtgcataggtgcactggcacacacagctagcactggtcacatcaaaatggctgcgcttctcagagatgcaagatcaccctgtgtgcttcagttgtcttttgatgcaatgagagttttttatctgaattccaagtcacaaggtgtacatttgagtttcccaggtcaacaaagataagctgtcttggaatgaagtaattaatacaacatgtgtttacacattcagtctgtcaccaaaaaatatctttttttttctttcaaaccacaaagtcatggccgggcatggtggctcatgcctgtaatcccagcactttgggaggccaaggcaggtggatcacttgaggtcaggagttcgagcccagcctggccaacacggtgaaagctcatctctactaaaaatacaaaaattagccggacatgggggcatgcacctgtagtcccagctactcaggaggctgaggcaggagaatcgcttgaacccgggaggcagaggttgcagtgagccaagattgtgccactgcattccagcctgggtgacagagcgagactctgtctcaaaacaaacaaacagcaacaacaaccaaaaacccacaaagtcataaaccaagaaatagctatcagatttttggacaactttcatcacagcattttacccatggagacagtagtattatccccttgctcaatttatatcaattttattttatttattattattattattattattattatttttgaaatggagtctcgctctgttacccaggctggagttcagtggtgcaatctcggctcattgcaacctctgcctcctgggttcaagtgattctactgcctcagcctcctgggtaactgggattacaggcacgtgccaccaggcctgtctaatttttgtatttttagtagagatggagtttcgccatgttggccaggctggtcttgaactcctgaccttaggtgatccacccacctcagcctcccagagtgcggggattataggtgtgagccaccgcacccggccatatatcaattttagataaaacaaaaatgaaatgagaagaacgaaattatcgtaagctctagttgtcatgttctcattactttttaatttattactattattttgagacaaggtcttgctctgttgaccgggatggagtgcagtggtatgatcacagctcactgcaacctcaaccttccaggctcaggtgatcctcccacctcagcttcctaagtaactggaaccacaagtgtgcaccactatgcctggctaattttttaactacttagggtattgctgtgttccccaggctggtctcgagctcctgaactcaagccatcttccctctttggcctccaaaagttctgggattacaggcatgagcaactgcacccaacctggtgactttttttgtttgtttggttttttgcttttgagatagggtctccctttgttgcccaggctgaagtgcagtgtcacaatctcagctcatcacagcctcaaactccagggctcaagcgattctccctcctcagcctcctgagtagctgagattacaggtacccgccaccatgcccagctaatttttgtatttttggtagagatggggtctcaccatgttaaccaggctggtcttgaattcctgagctcaagtgatcggcccacctcggcctcccaaagtgctgggattttaggcatgagccaccgtgcctggccaaaagtagctatttttaaatgtgctattcagtagcatgtagctctttcccaatattgtacaaccatcacctctatcgaattctagaacatttccatcacccacaaaggagatcttgtccccatgaagcaatcactccccattcccccttctcgcagcccccggtcaccaagaatccactttccgtctctacaaacatgtctgtcctggacatttcacataaaaggaatcatacagtatgtgacagtctgtgactggcgtctgtcaccaagcataatgttttatggtagcctgggtcagagtttcatttatttttatgttgaatactattccctcgcatggattcactacagtttctccatccattcatcaattgatgggcagtcaagatgtttctattgtttagtgattgtgaggaatacaactatgaacatacatgtacaagtttttctttgaataccagttttcaatccttttgggttcctcaggaacctcaattcttttgacattccccaggagtgaaattgttgggttgcatggttctattttttttttttttttttttcagatggagtttcactcttgttgcccaggctggagtgcaatggcgcaatctcggctcactgcaacctctgcccctgggttcaagcgattctcctgcctcagcctcctgagtagctgggattacaggcatgtaccaccacgcccagctgattttgtatttttagtagagacggggtttccccatattggtcaggctggtctcgaactcctgacttcaggtaatccccctgccttgtcctcccaaagtgctgggattacaggtgcgagtcaccacatccagtcatatagttctatttttaaaggtgagggaagtgggcttggggcatggtggctcacacctgtaatcccagcactttgggaagctgaggagggcagatcagttgaggccaggaattcaagaacagcctggccaacatggtgaaaccccatctctactaaaaatacaaaattagctgggcatggtggtacatacctgtaatcccagctactcgggaggctgagacaggagaattgcttgaactcaggaggcagaggttgcagtgagctgagatcatgccactgcactctagcctgggcagcagagtgagatttcatgtcaacaacaacaacaaaaaaaaaaaaaaaaaaaaaagagagagagagaaaaaaaaaaaagaaaaaaaaatggtgagggaagtagtcttcgcttgtgggtacagatgccgcagtttaatgccaaattatgtggattccagatagcggttcttggaggcagaataaaatcgcacgtatcaaccctactgccagtctgctgacactgactttggacgagaagaaagaaaaggtcttttttggctgagtgcagtggctcatgcctgtaatcccagcactttgggaggccaaggcgggcagatcatgaggtccggagatgcagaccatcctggccaacatgatgaaactccgtctgtactaaaaatacaaaaattagctgggtgtggtggcgtgcacccatagttccagctacttgggaggctgaggcaggagaatcacttgaacctgggaggtggaggttgcagtgagctgagatggcactgctgcactccagcctggtgacaaagcgagacttcatctcaaaaaaaaaaaaagatcttttcttagtctgtttgggctgctataacaaaaataccatagactgggaggcttatctacaacagacatttactgctcacagttctggaggctggaagtccaagatcaaggcatgccagattcagtgtctgctggggacctgcttcctggttcatacacggcgccctcttgctgtgtcctcacatggtggaaggggtgagggagctctctggggtcccttttgtaagggcactgattccattcttgaggctccaccctcctgacctcatcccctcctaaaagccctacctcctaaccattaccttgcagatgaggatttcaatgtgcaaattttgtagtgacaaaaatattccctctgtagcaacacctactcattgtacttttttccacactacatctaggtatggtttctagtggtaatagacgtgtcatccaaaatcttgcagtccccgcaggcctccctcttaatgagacaacacttgcagccttgctaaagaagcaaggatacagcacggggcttataggtaagacacaagaattggtgttagtcattgatcataaggtaatcatgtcctttgttctacccttgatttatgactttcttggaaacgctgtattttacaatgtcttatgtaaaggcgcagtggcccatgcctacaatcccagtactttgggaggccaaggtgggaggatcgctggaaaccaggagtttcagaccagcctgggcaacatagaaagaccccgtctctaaaaatataaaattagctaggcattgtggcatgtgcctatggtcccagctactccagaggctgaggtgggaggattacttgtggcaggacttcttttctttattattatttttaaaacagaggagtctcactgtgtcacccaggctggagcacagtggcacaatctcggctcactgcaacctccatctcctgggttcaagggattcttgtgcctcagcctctcaagtagctgggactacaggcgcgtgccaccacgactggctaatttttgtatttttagtagagatggggtttcatcatgttggccaggctggtcttgaactcctggcctccagtggtctgcctgccttggcctcccaaagtgctgggattatggatgtgagccaccacacctagtctgattcttcacacagctcagtgataggagatgttttaaaatgaatatattacaagaacataaaatttttctggctctgcctgcccgcatagtctctcaccgtgtatcctgtcatctgcctctttatttcactaaaaatggaccacacagattttcttctcactgccaaggatgatagaagtcctcagccacccagtagttggaactccaactactattcctgtttgggaagcctgggtttcagctggtgtgagaataacatgctgttttaaatcccttcaatttttgtaatacatctgctgttgataagagaaggcaatctccgtggggttgcaggacaggaagcctaagccagtagcactgcctctcctctacctatccccacaggcactcagaggttgatggaagcacaggcattcttgatggggccctcaccacatacaggaagctgttaatattcctagtagatacacattatcgcagcctctgagggtttgctgatcatccacatgctagcaggactcacaggcaccctttggtgatcattcaaggtgtggtacgttttactgaataagtcccttacttcgatcagttttaatgagagcccctaggatttgcagtcagccagctattcatccatccatgctggtccatcctccatgatttatctatagctatcatcggtcatctctctctctttctccatccatccatcaacccatatatctctatgcatctatccatccatctacctgtctatctatctacctgtttgtctattgatcaatccatcatctatcatttatctatcatctatgaatctatctacccatcatctatctatcatctataatctattcatccactcattcatctatcatgtatctatctatccatcatctatatctgtctatttatctagccattcattcatctatttagacatctctctatccattcacccatccacccatatatctctatccctgtctatttatctatctgtctactcacccatctatcctttcatccacctacatatacaaatatgctccatctgtcctccatcatttatttgtacgtgtcatatttattacatctatgtctctattgatatatacatacacatatgtatacatagatgcatactccataatttatttttatccatatcttacctgtctattcatccacccacaacacagatctattcatgcatctctctatctaatcacccactcatccaggtatccatctgtccacctacacacacatatatacatgctccatctatcctccatcatttatttgaatctgtcctatcctatcttatctatttatctatctatccatctatccaactactcactctatctctatcatctatttatctatctatccattcatctatcaatccatctatccatcatatctatctatctatctattcatctatcctatctatctatccacccatagatctccatccacctatctactcacctactcagccacccacctatctatccatgcatccacttacacatacatacatgccccatctatccatccatcatttatttgtatctatcatatttatcacatctatctctctattgatatatacatacacatatgtatacatagatgtatacaccataatttatttttatctatcatatcccatctgtctattcatccacccacaacacagatctatttgtgcatctatctaattagctagtcatctatcgatccatccatccacctacacacacatctatacatgctccatctatcctccgtcatttatttgaatctgtcctatcctctcctctcctctatcctatctatctatctatctatctatctatctatctatctatctatctatccatccatccatccatccaaccactcactctatctctatcatctatctgcctatctttctgtctacatattatctatcatctatctttctttctatcatctctatttatctagctagctatatctacatatgcatctgttcatctgtctatctacctatctttctgtctacatattatctatctatatatctacctacctatcatctctagctagctagctagctctatctatgtatacatctattcttccatcaactataacctgccttgtctctgtgatgtatctattcttccatcatctgtaacctgccttgtctctgcggtgtatctattcttccatcatctgtaacctgccttgcctctgtgatgtctctatctttgtggctatgactttgtcttctcagtgaatgagaaaatttctagttcacgtcattgacagaaactcacaattctatttttctcccttattgtttatcctatcctgttgctcacaaccggatctgaatacaaacttcctctgtaaactaaagaagaacaaaaaaaatgtggctaagtggcactcggattttttagaggaaggagaatatctctgctactttatttttgtgtattagctgattgtttcacgtgaagaatgctcacatggtttttgcaatgtgctggcatatgttgacatattgatgcgtagatgtgtttgtgtgtttggttttaggcaaatggcaccaaggcttgaactgcgactcccgaagtgaccagtgccaccatccatataattatgggtttgactactactatggcatgccgttcactctcgttgacagctgctggccggacccctctcgtaacacggaattagcctttgagagtcagctctggctctgtgtgcagctagttgccattgccatcctcaccctaacctttgggaagctgagcggctgggtctctgttccctggctcctgatcttctccatgattctgtttattttcctcttgggctatgcttggttctccagccacacgtcccctttatactgggactgcctcctcatgcgggggcacgagatcacggagcagcccatgaaggctgaacgagctggatccattatggtgaaggaagcgatttcctttttagaaaggtaagcggaataattacaaattcatgtaataatgataatgatctcttttttaaaaggacctagatagatctgtagggtgattgtagtttataataatctattgtacacttctaaatagctaaaagagaataagtcaaatggctctagaataaagaaaagacaaatatttaaggtgatggacaccccaattacactgatttgaaaaaataaatcatttgtaataattctttacaaattatatgaatgtattaaattgtaacgtgtactcttaaactatgcacatctataatgcattaataaaaataataggggatgatggtattaaaaatattgagttaggaaatggaatattgctaaatggtgtaatagggttagataaaaatatgaagtgtattgaagaccagttggactcttcagttggtacctaaagcggtggtaccttgtttgggctcctgttattaaaatcatggcctctctattggctctgaaatttatatgttgtcagaccatggacgcagaccctagtaacttaaactcacaaattgtttacgttaatttacaatgcatcttgtcatcatgttaacttacaacagggaatatgtacatatacaatatgtatatactatactatatatgtatatatataatatattttataatattttttgtctggttccctgatacatatagataaatatatatatatatctggaaatcagatgaaaaaagtaagttttccattgcattatgttcctgttgttaaaaaacaaaaaaaaagctacttggggaaattaaaatcagaaggcttctctttgagcatgtgatacgtaagggctatttcatgaattggatgaggtaaatggtcaaaggtgattgttataaaaactttatgcatccagaacacaatgactggaaattttcaagggtatctatcctcttgttgttggaccttctttctttaaaaaaagcctgtaaacacattttttcatttgctttttccatattgattgaggcttaatctttaccaatagccattctaggatctggattttcaggatgtaaggtgtcttgtgtactctggtacatagctttgtcctcactctgtagcccaagtgaaggtgataaatatgtagtttggggctggcagcggtggctcagcactctgggaggccgaggagggtggatcatctgagaccagcctgaccaacatagtgaaacgccatctctactaaaaatacatattagctgggaggctgaggcaggagaatcgcttgaatccgggtggcggaggttgcagtgagctgagatcacgccattgcactccagcctgagcaacagagggagactctgtcttaaaaaaaaaaatgttgtctgggagtaataaagccatacttgctctgtagatgcaactgaatgcttggtgtcacttagagcaaatctttctgttccctggtacctttccaaatgtgcagagttctatgaatttttacagacagagcatcaatatgtgcaaattagcaccaaccactctgaaagtatatgataagcaatcctattctcttctgtctgccagttcgtcttcaaacattcccacacagttctccttaggaatttacatgagtacttgaagaacagatcctatggttgagatgtacattgttcaccaaaacctctgtcgagtttcaaaagttccatatgatccacaataacacaatattgaatggaaaaaacaatggtgaagaggaaatataaagacttggacgttgtgacaataagctcatggcttaggttcatgaatgctcaaaactatttttatctggattctcagtgtatgactctcctacagttgctataacaaatcactatagggctgagtccaatggctcatgcctgtaattccagcactttgggaggctgaggtaagcgatcacttaagttctggagattgagaccagccaaagcaacatatgggagccatatttctacaaaaaatacaaaaaaattagttggatatgatggcatgcatcagtagtcacagctactcaggaggctgaggtgggaggattagttgagcctgggaggttgaggctgcagtgagccgtgattgcaccactgcactccagtctgggcaacagagtgaggccctgtcttaaaaaataaaaaaaattaccacaaatgtagtggcctaatgcaacacaaagttattattctgctgttcttgaggtaagaaatccaaaattaaacttgtgggctaaaatcaagatgttggtggggctagttacttctaggggttctaggggagaatctgttttctctttcttctagtttcttgaagctgcctgcattctttagcttgtagggttttgttttctgactcagacccttctgcatctctcttataaaaggacatttctgattccactggacctacccagataacccaggataatcactttgtctcatgatccttaattcattcccatctgcaaaaaccttttaccatgtaatatcacatgttcacaggttttgagaatgaggatgtggatatctttggaatggggcattattcagctgatcactttgaccacgactctttattttggcagcttagtttgggatgcaaactatttaattttaaatatttaatgttcagagctgtgcttcctctgtaggctctaggggaggattcttcctgcccttccccactcctggtggcttcaggcatccctgggcttgtagccgcatcactccagtctctgcttcatctgcatatggccttcccctctgtgtttgtgtctcatcttctgtctcttataacgacaatagtcattggatttagtgcccatcctaattccaggatgagctcatcttcagatccttaattaattacctctgcaaaggtcttgatatccaaataaggtctcattccaggttctgggctttaaaatatatggacttatatttctgggggctactattcaaactactacaattgtatccagtttcttctggaggctctaggggaggatctcttctgcctcctctagctcctggtggctccagatgccccttggctggtggttgcattactccatttccacatggcctcttcttctgtgcttgtgtctcctcttctcctatagggacaacattattggattggggactcatcctaatccagaatgatcacatcttaagtaattaaatctccagaggccccatttccaaataaggtcccattctgaggtttcaagtgaacgtgaattttgaggggtcactgttcaagacaccatgacataagtcttgtttttaaaattcattttttttatttctttatattttgatatctcaccagagcagaaatttcccaacgaatggcatttgtgctgtgtgttttcctgggtagctgaggacttatcattcatgcagatggattatcaaaattaacagcgggtcagcctagttccctgtatcctcatgtgagaacctacagggtgcaaatggcttgccaaggcattcctgtttgtactggcttatggctcgtgaaactcttgatctggctaagaaatgacttccataccactgtctcttgatgtatctcagggtgtgaccctagtttgaggcttcacgagcagtgagaacatccaccaaacagagctggatttgacttttcgcactcgcatgatatgggaggtccgtgttggcttgcagtatattctacagctgtcctggcatctgagaatcaaaggaactgtgatggtgtcacaggactaccaggttcatatgcctgctgcacagtaacataccaatacactgaggcagcagggtttatggcagagaaaggtttaataattgcagggcaattagtgcgaacatgagaggagacctcaaatccatctttttttttttttttgagactgagtatcactctgttgcccaggctggagcgcagtggtgcaatctcagctcactgcaacttctgcctcctgggttcagcgattctcccacctcagcttccccagtagctgggattacaggagcccatcatcatatctggctaatttttgtatttttagtagagataagatttcaccctgttggccaggctggtctcaaactcctaacctcaggtgatccgccatcttcagcctcccaaagtggtgtgattataggcgtgagccactgtgcctgtcctcaaacccatccttccaaggagttctgggctggattttttaggggaatcatggagggtcttggggtcactgatgggttggggtaagagggaatggaatcatcagaatatggaaatggtatgctttggtaagtcagcttctcatagggtccttcagagaagcagacatcagcagtttccctggtatgcacaacctgaaagattattgcaaatggaaaacttaacatttcatgatgttatgttatcatcctgtaacaggatctgtgcgattctagaacaaataggtaccaaacaagtaggaatacatagatgagagggcaagctgacctcaggatcaaagctgagtatgctgcaagcttagttcattttgtttctcccgctcccttcctctctgattgattttatgaagtttatagagatggtttcagtagcattaccaaaggggttagggagcagttgaggtgctgcaggatcatggagtccattctatgcaggatggggcccttgggtggacccactctatcttctgcagcttggagaagaaggaagcaggtcatgtctatgagaagccaaaacaatagttttcacattcatagatattgaaaactcacaagtagtttcattgatgtcttctcaggcacagtaaggaaactttccttctctttttctcctttcttcacgtgcacacacctctccccaccacggacgatttcactggcaccagcaagcatggcttgtatggggataatgtggaagagatggactccatggtgggtaagtcacaggacttaagtggacagaaactaacgtgttctgataggacaggacacctgaaaactgctcttggtcaacctgtagagtgaagagaattatgcctatgggacagagtggtctgagacattaatgaggtaatagttgctagcaattgagaaagtcagcaaaaaaactatatgcatttcctctcctttctttgcatgctgtccacttatcaacttgggtctttgtctacttgactgcgtctccagtgctggccagataacaaatcaaatcttcttttcaaaaatttcaactcttgttttagattcagggagtacatgtgcaggttttttacctgggtgtattacgtgatgctgaggtttaggatatgatcaaacccttcacccggacactaagcatagcacgcaatagttagttttcaacccttcccccactccttccttcacccctctagtagtccccagtatctattgtactgatctgtgtgtccacatatacttgatgttatgctcccacttattttgtttcatttttaaaaataaattttattgtgtattttaagattcacaacgtgacgttaaaagatacgtatagatagtaaaatgattactatagtgaagcaaatagtaatcattaagtaacataatatagtaatattaagtaatagtaatatagtaagcaaatgtatctatcatctcacactgttacttttttgtgacaagatcagctaaaatctatttaacaaaagtccagctgagcacagtggcttccatctgtaatcctggcactttgggaggctgaggcaggaggatcacttgagcctaggagtttgagaccagcctggacaacatagtgagaccctgtctctacaaaaatacaaaaattagctgagtgtggtggcatgtgcctgtagtcccagctacttaggagactgaagcgggaggattgcttgagcccataaattgaggctgtagtgagccatgattgcaccactgcactccatgcactccagtctgggtgacagtagctcccacttataagtgagaacatgcagtatttggttttctatgtctgcattaatttgcataggataatgtccaccaccggcatctatgttgctgcaaaggacatgatcttgttcttttttatggctgtgtaatattccatggtgtatacgtaccacattttctttatccaatccaccattgatgggtgcctaggttgatttatgtctttgctcttgtgaatagtgctgtgatgaacatatgagtgcacatgtctttttttttttttgagacaagatctcactctgtcactcaggcagaagtgcaatgacatgatctcagctcactgaaatctctgcctcctgagctaatgcgattctcctgcctcagcctcctgagtagctggggctatctataggcacatgctactgcgcccggctaatttttgtattttttgtagaggcaaggtttttccatgttacccaggctgctcttgaactcccaagctcaggtaatatgcctgcctcagcctctcaaagtgctgggatgacaggcatgagtcactgcacccagcccacatatctttttgatagaaagagaaatcatattttcagactctttagtgacatagccaaactttatttcaggtctgttgagcaccaatatcttagttggggattgggaattaactggtaagtcagaatccagtaccctcatgaactcatcctgtagagagaacaatgtaaatgggacgtcctaggacttacatggtaaatgtattgattagcaaaatggctttaattttccaacattaatgaaagaaaaccatgagtgaaactcacatatatgcaggacacaaatttaaagtataatattttccagacacagatattgtgaaatatatgtcactaaatagaaagacgctttggaaaattaagcctggaaaaagcaaagccaatttgcatagtcttaaacacataaaaaatatgaagtatttaaaaatataaataatattcaaaccaaatacatgaacatgaatagatgtttatgtaggtataagtgtgtgtgtctgtgtctgtagtgtttgtgtacatatgtatagaaacagatgattgacagagatagatgatggatagatagatgataggtaaatagatgatagatggatagatagatgatggactgatagttgatagatgataggtagatagatagatgatggatgatagatagatgataaatagacgatagatgatcgatagaaagatagatgattgagagatagatacatagataaacagatgatagatgacagagagacagatgatagattgatagattatagatggatacatgaatagaaagatgaataaacagatatatagatgatagatggatagatatatagataagtacatgatacatatgacagatgatagatgacagataagataggtgattgatagataagatagatagatgataggatagattgacagatacgtagatgataggtaggtagatagatgatagatagatacatacatacatacatacatacatacatacatagatacatagatagatagatagctatgcatacccctcttactttctgcctccaccagcactagtccttaaagtttagattcttaatattgcactcaatctcaaaaatcgtggcgatcctatttttgatttgatctttgaaaatcaatgaaataggtcattcaaactcaggctgtgataagtaaaagacattactatttgctttaaaaatttaaattaacaaagctcccaaagtatctaatttaataaacctgatgatgtgtcatagtgttcaaacaaggcactttgggtatgactttaatttcgatgggatttttctggtgacattcagataatattacgcaaacggatgggtgtgttgaatctggttggacaagctgtgatatctgaaaattatattttgaaaaagcgcaactgagatgtacatgatactggtgcccagaggttttgaatgttttgtccacacagccagaatcaagcctttaggaagaataaacatctgctttaatatataattttagcaattctcaagcaaacatatatttaccctgaaattatttatcccagaagctgtaacaataccccaagtcctaagaattgttgcttttcttattagaaaagttgatttgtggccattcctggtagagatatcaccttcctgccttttataattatcataggtggccgggcgcggtggctcacgcctgtaatcccagcactttgggaggccaaggcgggtggataacgagttcaggcaatcaaaaccatcctggttaacactgtgaaaccccgtctctactaaatatacaaacacatccgtggtggcgggcgtctgtagtcccagctactcgggaggctgaggcaggagaatggcgtgaacctgggaggcagagcttgcagtggccgagatcgcgccactgcactccagcctgggcaacggagcgagactccgtctcaaaagaaaaaaaaattatcatgggtttcccacagcagtgccctgaaataatggagtctactgatagaataaacatttattttcattttttaataatttccaccttttattttagattcagggagtacgcatgcaggtttgttacctgggtatattgcatgatgccaagatttgaagtacaatagctcctgtcacccagggagcgagcatggcaaccaatagatagattttcagcccttgtcccccaccttccttctccccttttggagtccccagtgtctattgttcccatctttatgtccatgagtacccaatgtttaactcccacttatgagaacatgtggtagttggttttctttttctgtgttaatttgcttaggacaatagcctccagctgtatccatgttactgcaaaggatgtgattttgttcttttttatggctgtgtagtattccatggtgcatctgtaccacattttctttatccatgtagattggttctatgtctttgctattgtgaatagtatgataatcatgcaagtgcctgtgtctatttggtagaatgatttatttccctttgggtagacacccagtaatggcattgctgggtcagagggtagttctgttttaagttatctgagaaatctccaaagtgctttccacagtggctgagccaatttatattccaaacaatagtatataagtgttgcatcttctctgcagcctcaccagcatctgttcctcttttatttttttgacttattgggttcgtgcaaaagtaactgaggtctttgtcattgaaagtaatgatagattgatagattatagatggatacattgaaagtaatgacaaagacctcaattacttttgcaccaacctaatagtagcctttccagctggtataataaacacttttaaaagtgatacttcctatgggccatgcactgttaccagtgtattctggatgaatccccacaacatccccggagacgagtatcatcttcatcatcatgtttatctccattcacagagaaggaggcaaaagtatgtggcctttggtggctgctcctggagataagccagggttgggctccaaagctcttactccctagctcagctacctcttatgcagggcaaagaagtcatgttgaatgatgaggaaggagagctacattcttctctgaagtctccagtagccccattagactcctacagaccgtcatttcacaggagtcagaaaaactccaaaaacttcccccaacctggcttcctgcttccttcgagcccagcgagaggctttcattggagataccacccttgccccacccaggggaaaatctctgatgccgaatgagtcatgcatttctgcatgggcaagagtccatcagcttggatctgaagagcaggtttctcaagaatgcagataagaaagtaaaatgtgcaaaaatgagtaggagaaatggccttatcagcaggagatgagacaaggatgagggtcttggctgagcctgttgtacagacagttgtgagtggtggaatcccagggcaggcctgtctgtggacagcaacacagcttgggcagcaaccctggacagggcagaactgcaaaggaggctgtaaacatgtatttctatgtcatatatatatataatttatatgaaatatttgagacacatatataaaatataacttaaccctttataatatatatatttatattatttgttatacatattagtattaataatttgaaagttatcatatatatgaatatatattatgtatttctgtagcatataatttctatatttatttatttatttcagttgatgttagaaaggtacgaatcatttccatggttgtaatccctgctactttggaggctgatgtggcaggatcatttaagcccaggagtttgaggctgcagtgagccacgattgcaccactgcactctagcctgggtgacagagcaaaatcctgtctcagaaataatcatttccatggccactatgtaatctctctaaattttaagatataaatagaataattgaatataattgaataatattaagaatacaaacaactcaaagtaatttaatattatttgtaaagaacagaattgcctatgttaaaaaccctagagtttaataaaacacatatcagcacatagatgacatatgatattataataaaattatattacatataatttatattatagttatattacttatatacatcattatattattatgttcatatataatataaacatatcattaatatacaattattagattttaatatattatatggttctatcttatatatatcacaattatgctatgcatattatatattatgtacatgtatacatcagtaccatagaggttttattaaactttctggggtttccaacataggtatgttcactacatttaatgttaagtttgtattttatgtgttaaagtatgtatttaactttaatgttaattgcattagtcaggttatgtacaaaaataagttacataatgacaaaaatattcttatttttctggtattaatgaaatagtttcaatttttacttttaagcataatgttgactgacgctttgaatattttaattcttaatattttgagagacttataagatgtgcattaattagatagtagccaggaaaattcttgcatgctttctagtattacctaactatatatatgtatatgtagttaactatatacatgttatatatcatgctgttgatattatctatattttatatatatctaacaatataacttataaaacatttttattatatacataaatacatatatactacatgttatgtagtatatgtgttctaaagattgatatataatataataaatacatttgtttttgtatagtatatgttagtatagtattagtccaatagtataattagttacatttatatattagctatacataaatatattagctatatataaaaatatattagttatacatatatatgaagtctacagtgtttctctgttgggtatatgcaccaaaattaagaccttttctttttgttaaaaataatgcatttcaagatacaatggatcaccagctactattcattatagctccaatgtcaataactaaaatatttagaaataatttttcaagcagtaaatgagtatctcgaagctgactcatgaaagaaaacttgaatacatggaaaggaagagtggattgtatacatgtattagttatttcaaagttaatattgaaggctaaggtagctctgattagagcattaattactgttctctggggagtggtcattatagaggtgatgatgaaatacacactgaataaactgataggaaataaactttccagaaacatctgatgagaaagtctttggtagaaaacatcaagaaacacttctgtgatcataagaaatgctatcaaaaagataactacaaaaattaaaacgcagaaatacaagatttgacttttagatcaatgaagcagaaaataatagccttagagcaggtctgggaaagagaaggacattacattcggtacaataaagtttttaaatcaaggtggcaggggtgaaaggtgttggggaaagtttgtgttatgagttgacttacatccccccaaaaaggtatgttcaagtcataatccaaggtatgtgagaatgggatcttatttggaaatagggtcgttgcaggtggaatcaagttaagatgaggtcattgggggtgggtcctaatccgatatggtgaattaggatgaggctgctacatgccaaggaaggctaaggactgatgccaactgtctgaagtgaggaagaggtaaggaaaggtcctcccctagaaacttcagagagagagagtgactctgccaacacattgattttgaacatctggcccccagaactgtgaaagaataaatgtttgttgttttaagccacctcatttgtactaatttgtttcagcagcccaaggaaattcacagagttagtttaggaaaaaccattaccaattcaattagcatgcttttccatacacattaaggacattgagtgaaacaaaacaaaaattggaagaagctatagttaaacagtaaatttacatctggatgaggtatagtgttagtaatagcaaaaggttatctgataagtagcatgactaaaggccctatgcaaactgaggaaatattagcaacaacatgacattgttttaactgcttgacaaataaagagttcttataaatcaataatggaaacacataattccttccaaaaatatcagcaaaattttaaacatcttttacagattaaaagtacaaatattagagtggacacaggaggaaactcatgatcattcataatgtaccataatcacctatcaaacattagatactgatgaggaattgagaaaatgaactattattaatgccaaaagttgttcattatggcattttaaattatggcaaagtatgaaaattaaccagaatagtgaacaacagtaaaatggttaaataatttatactacttaaaaataaagtatcataaattgtttaggccaggtgtggtggctcacgcctgtaatcccagcactttgggatgccgaggcaggcagatcacctgaggtcgggagttcgagaccagcctgaccaacatggagaaatcctgtctctactaaaaatacaaaattagctgggtgtggtggcgcatgcctgcagctgaggcaggagaaatgcttgaacctgcgaagcggaggttgcagtgagctgagatcgtgccattgcactccagcctgggtaacaaatgcaaaactccatctcaaaataaaatatatatatatacacatacacacacaacacacacacacacacacacacacacacacacacacacacaatggacacttttccagccattaaattgtacatataattttttaaatttatttttttaattgagacagggtctcactgtgttgacaagggtggtctcaaatacctgagctcaagggatccgccttccttgccctcccaaattgctgggattacaggtgtgagccatgatgcccagtcttgaataattttttaacacgaagattttccgagaaataatattggatgaagaaagcaagttgaaaaccgttcatacaatatcaacccaaatagagagagagagatgcatctacaagagtatgtgatatggtttggctgtgtccccacccaaatctcatcttgaattgtagctcccataattcccacatgttgtgggggggacctggtgggagataattgaatcatggaggcagtttcccccatagtgttctcatggtagtgaataagtctcatgagatctgatggttttataaggggaaactccttttgcttggctctcattctctcatgtctgccaccgtgtaagatgtgcctttcacctcccatcgtgattgtgtgtcctctccagccacgtagaactgtgattccattaaacctctttttctttataagttaccccgtctcaggtatgtctttattagcatcgtgaaaacagactaatacagtatgtaacaattttttttaaatagtcaaatggcaatggggcaggaaattggtggtctttattttcctccttataattttctttatttttttgtatttcccaagctattttgtatttttataatcagaaaaatattagctttgttgttttttcttgctacttttcactatttactgaaaagtagcaagaagagtaaaaacaactcccgtgtccccttcacccatctttcccaattgttagcaatttatcaaatatatcttctctcgcccctcttcctttctcctgatcatcctctttcttcctctctctctctttctctcttccacctccacatgtttcttatgcttctgaatatttgggaataagatgcagatatgatgttcattaaatttagaaactttagtgtgtattttctaaaacaaagacattctcctacatcatcactgcgaatcatcaaaatcgggaaattaacatgggtggattcttaggatttaattcacaaatcccagccaaacttctccagctgtcctcaaaagaaaatttatacacagcaagcaaaaccaatggacaaacaaaaaccaaccaacaaaacccctacttcctctaccctctttctgttctggtccatggattttcttgttgtatctgtttaaactcctctgatctggacaaagactgagcaatctttattctttcttgaattcaaagaccttgacattttctgagaataaagaccgggtatcatctagaatgtcccttgaattgggttggtttgacatttccttcaatggaagtggaagtgatggtgtgttctcaatccagtagacaagtaagtgaattagccccaacaatggttataaaattcttcatctcttgattaaatggtgtcttccagttttctccactgtaaagttacttattttgtcattacttaataatttgagatttttaactattttatgggagatactttgagatgaagccaatattttggttcttatcaaacatttaatgccaggtttagcatccattgatcattttctcttggatgaattttcagtgcgatttttgctaaaagtattgtggtaaatttttaaaagtattttaaaatataaattctttcttaacttgcccttacttgtgtgccttggctctagaagaaaatttctaaggtatagtactttaggaatgttaatgtaatgttatctgagataaccaacagtagaacacatagaattagacacgtttgagactaataagctttttcataattatgcataatacagactgggtttgggaactctaggaatttagctattttcctataaaaatgattggaaatgtggtttattttgaatacattcttcctcttttaacttgcccattgagtctaattctcccaacctagtcatcctattctctatttaaaatatcaaataagaagggaagggaaaatggttaaagaattacttatctaaatcatctgcaagaatatatcaaataaattatgtgaacccaacagtgggagtgtcttattcttgcctctgtctcctcaaattctgtaacaatgtctgccttctgtgagcagagaggttgcataaaccgtgactgccattctgtgcaacatcagtcagaataccactacagtccttcgtttcatatccagtgggaaaaactgtatttctctgtttaatgttttcattctgcatgaaggaaattatcaaggagaatttgtccttttaaatgataccagtagcaactgatgttcatttgtattgccataatatttttttcttaaagcaggtcatcttttatttcttaaaaattttggactctcagttttttgtttttttgttttttgtttttttgagatgagtctcactctgtcacccaggttggagtgcagtggcacgatctgagctctctgcaacctctgcctcccgggtgtaagcaattctctgcctcagccacctgagtagctgggattacaggcctgtgccaccatgcctggctaatttttgtgtttttagtagagacagggtttcatgatcttggccaggctgatcttgaactcctgaccttgtgatccacccacttcagcctcccaaagtgctgggattacaggcatgagccaccgcgcccggcctgactctcagtttttttctctttcaatggtttgtcaatttaaactgttaatgcacatttcttttcttttgtggcttttgacatagggtcacaccatccttgttttcctttagatagctcatgcccatttgacttaggggtgaaatacctcataatgtcattatttttacttgtctcttgtatattattttaggcaagattcttgatgctatcgatgattttggcctaaggaacaacacccttgtctactttacatcagatcacggagggcatttggaagctaggcgagggcatgcccaacttggtggatggaatggaatatacaaaggtgaggagaggaactcatgcaagtgatctggtggtgaataagcttttttgtggttcttataattaaagcccatgacacaaaggaatgaggcctgaaaaactgaacaagtttgtttaatttgactcttagtaaaatgaagtattggaccaaggtcaagaaaattggtcttacatttgttaacatttctgtggaaggaagccatttatgtagagggagcatctagaaatatgcctttctgacaaccctatcaaattatgaggagttagcacaagcagatgcttttatggggtctttaaagaaatatctactcattcattccatttatgagattattgagagattaaatgagggggagtgtgattcctagagaacagagatcagaaaccagggatccttcatcattaagaagtcttcgacactctcttccaaggatatagtacagcatagaaagtagacaagcctgtcttgggtttcatgattaaattcacatatactgattttatgtcctgctgtaacatttagtccacaaaataggtccataagctactacattggccagtctataatgtgtaacctgatgttagaatattatcttcatttgtgaaatgaggattaaaaaaagaaaaagaaaaaagataattatctggaaaatgtcgagtatattttatcatatgtcttgagagagattttaaagtattttctagaggaaaatacgttgttattcatgcaactacagattccacagtcttggattcggtaggaaattataatttctgtatgaatgaggtaaaggctctgcctccatcttgcagagggtatgaatgtgtactctttagagcgtgtagcactaaagtgtgcacttaggacccaaaacaaatccttagtggaaattgttattatagacattctattttaaaaaaaaaattcagtagttttggggttacaggtggtttttggttacacagataagttctttagtggtgatttctgagattttagtgcaccgtcatctgagcatgtactctgttcccaatatgtagtatttttttcctcagcctactcccaatcattccccaaagtcaccagagcccattatatgattcttatgcctttgcattcttgtagcttaactcccacttataagtgaaaacaggctgtttggttttccattcctgagttacttcacttagaataatggcctccagctccatccaagttactgcaaaagatattatttcacttatttttatggctgagtagaattccatggtgtatgtacaccacgttttctttatccacctgttggttgatgggtacttaggcttgttccatatctttgcaattgagaattgcactgctataagcatgcgtgcgcatgttagacattgtatgtttgcttatgggaactgtttttaaaaatttttggctcatgcctgtaatcccagcactttgggaggctgaggcaggcggatcacaaggtcaagagatcgagaccatctggccaacatggtgaaactccatctctactaaaaatacaaaaattagctgggcatagtggcggacacctgtagtcccagctactcaggaggctgaggcaggagaatggcgtgaacccaggaggcggaggttgcagtgagccgcgatagcaccactgcactccagcctggcaacagagcgagactccatctcaaaaaaaaaaaaattaacttttcagcatgccatgacataatgtagattttactctgattaacttaataaaataagagtcaattaacacaggacagtggccacttctcctaatttccccctggaaatcctggtgtatgcctgtcatcttggtataattaagacaactttctgcttttattctcaataataccttgatgtggacaataagttaccatatgtccatagtattccatttgttttcaaggtgcatgaatcaacagtgagcaaaataggcagaaatcctcgtcttcatggagtttatatcctactggagggaggcacagcagaaaataaaataaaataaataaataatatggcatattagaaggtggctgtaaataagaaaaaacacgagagtaaagaattctggggtgggactgccatttcaaataaaatgttcaggcacgcctcattgaggttactgtgagttccataaaattgggggctggatacaagaaaaatattaattaaaaaaaatataggaagttactttgagcaaaggtatgagggaggttggaaatgaagtaggtgtatatttgagataagaacactttaagtagagaaaatagccatgcaaatagaatgtaaatgtccaatattacatatgcttagttatttaatcaaaaacctaccagcagcacaggaaaatataattctgtagacgtgcactacttaccccactaggactctacatagagtagacactatacaaatgtgatctcttttgatactagcttaccttttaaatacattcaatacagtgactattttaactaggcacaataattgaacttaattgcattgtcttataggtggaaaaggcatggggggctgggaaggtggaatccgcgtcccaggaattgtccgatggcctggaaaggtaccagctggacggttgattaaggaacctacaagtttaatggatattttaccaactgtcgcatcagtgtcaggaggaagtctccctcaggacaggtgatgtcatataaactgttaacaagagcttattttcacccttcttccttctcagaagattcagaacaaggagactgactctatcctggcagacccactttttccctagtatctacacagttttaccttcctatatgactgtgtctattcagcatttttcagaagagaccagtcttttctttttttctattgaggtaaaatatacatatataatttaccatctttaccatttttcagtatacagttcagtggtaataaacatacttattttctttttttccccttcattttcctctcatctctcccctctggtcatcactattctactttctatcttcctaagattcactattatttatttttagctcccacactgagtgagaagatgtgatgtttgcctttctctgggcttggcttatttcacttaacataatggccaccagttccattcatgttgctgcaaatgacaggaattccttcttttttagggatgaatagtattcccttgtgcatatataacactttttaaaaagttaatttgtctgccgataggtggttaggttgattctatagcttggctattgtgaagagtgctgcgataaacatggaaatgcagctattcctttgatctgttgatttcttttcttttgggtgtataccaagtagttggatttctggatcacatggtagctctatttttggttttctgaggaacacctcaccacgcaaaacagataaagcaaattacaaccgaaaatagagatggacagatttataaccagaggtcctgaacaagtatcagagaccagtcttagatactaatctaatgcggaccatcttagatactttaacattttcaattgagagaaagatggagacaggaagctttggagatgaagacatggtaggtaaaactcactcatctctataagaaagggaaaaataatcctagtctctggtgtgaaagatctggaagactgagaagaaggtaagatatttgaggatgctttgaactctatcatgaatactttgaatttcttcaagaggagatcgttcatactacattgctccattccctggcagcaaccagcctaggtaggtttgctgctgattgacagttcattgatcacagctctgcaagggaatccagatgggttagaaccgcagctatgtctctcctccaagcccacagagttcttgtaatatttctttcttcacgtaacaaagctaatctatttctgaagaaataggttctgttggcactaatacagaaaagaaaaatattttagaagtcatggttaacttactgaaaaacaaactatcaagaactaatcaagacacatccccaagtttgcctttctaatatttaaaaatttatgtttgatgctagcagatatctctatcaacacactaaggctggaatttattttataattttcgggactgaactttagatgaagacatttttattttctgcctggaaagaagttagtcattgatgatgctaacacaggaaagaaaaaatattttattctttatttttatttattttatttttgagacagagtttcgttctgttgcccaggctggagtgcagtggcacgatctcagctcactgcaacctctgcctcccgggttcaagtaattctcctgcctcagcctctccagtagctgggactacaggcaccggccaccacgcctgggtaatttttgtatgtcttgtagagatgggttttcgccatgttggccaggctggtcttgaactcctgacctcaagtgatcctccctcctcaacctcccaaagtgttgggatttacaggtgtgagccatcatgaccagcccagaaaaaatatttaaaaaaccactgtgaagttattgcaaaaagaacctatcaaaaaactatggagaagcccagctttcctgttctaccatttagaaatagttgttttaagaagtctgtcgttccacatagcccaacagcctgttagggagacggcaaatgtccaggcacaatattgttacgttgcatgagggtggaaggcaactgctgccaagttccagccgttgtcctcacgttaaaaagaagaacgagttgattggagtcactcatcactccagtgcattcggcgccatgagattacatgctcatttggtcaggggtttagggttatgagtttggtgtccttgataagatgtatagtacagctgtcctttcctgcctgcaaccatgactccactagccataggctaagtcttcagaggacgcaccatctttgtagttcaacgggaagtggaagaatatcgcgaagatgactaaggcactgtggtgggagacctaacctcagcttcacgtacaggtcggcgtgccgggtactactcatcaggttgattttttggttattcctatgcttggttctcccaagcctctttatttgaattcatgacttctttggcatgtgcattgaccagttaaatatgtccttgctaatagagaatagctgtactacgtagaagggaacaaacagcaaattcacagtatcaggctcactgtctatgacaccagcatcatgagggcctgtggatacctctctcctgtctgcttcaatccccaacacaatgaaatcaacaagaagaactcaaaagcggctctcacctgtacagaaatgaaggctgctaatactgtaaaagccaaatagttatttatttttagaattaacacaatttgtttcaccacctcatcacacaaaacagataaagcaaattacaaccaaaaatagagatggacagatttataaccagagatcctgaacaagagtgtagaatagacaaaaaagaaaagtaaagataaaacagaggacaccattaatgtgtagaaacacgggaatctgaggatgcaatggtttatcaaagtgttgggaaaaaatgacttatcaggtatgtggtttaccaatacagctgtcccttggtatccatggggggttggtctcaagacctcacgtggataccaaaatacccagatgctcccgtccctgatgtaaaatactgtagtatttgcatattacctacacacatccttttgtatatattaaatcatctctagattactcataatacctaatacaatgtatgtaaatgccacataaaatagttgttatattgtaccctttagggaataatgacgagaaaaagtctgtacatattcagtacaaacaagaccgtccctaaaaggaccataagcctaaatgtaaacccaaaattataacacttctaaataaaacataggagaaaatcattgtaatattcagataagaaaataatttttttagatttatcaaaaaagttgcaagctataaaagaaaaaagtgatagattagtcattatcaaaatttaaaatttctgcttttcaaatgtcaatatcaagtaaataaacatgtgacctcagtccattagtggagaaaaaaagaaaagaaagaaaaaattaaaatattaaatatgaacttaaaagaaagtttaaaagaaaagaaaaagacaagccgtggagtagaagcaaatagtcatccctctgaactcagaggttctgcatctgcgaattcaatcaactgcagatcaaaagtatttcataagattttctagaataaagaatctagaatagcctaaaattttttgaagaagaaaatcatttgaagactcactacataattccaaaatttactataaagctagagtaatcaagtttaaaagagtaatcaggatggtgttctaatgctctaaatttttaaaattgatatttaatattttaatttttttctttttttctttttccccactaatggagtgaggtcacatgtttattttcttgacattgccatttgaaaagcagaagttttacattttgataatggctaatttatctttttttcttttataacttgtgatttttgtgataaaacttaaaaaaaattttcttatcaaaagatcacagtgattttctcctatgttttcacttagaagttttatagttttgggtttacatttaggcttatggtccacattgagttaattttttaatgtggcttgaggtataggctgagatttattttccttgcatttggatatccaatttgtctactgtcatttattgaaagacagtcctatctctactgaattattttgagcatttgttgaaaagcagtatacgtgttggtcaattcctggactctcctatttcattgatccattgaaacccttatttcaacactacactgtctcaattagtctagctttatagtaaatctgggagttatgtagtgagtcttcaaactattttcttcttcaaaaaattttaaaccattctaggatctttattttcccatgtaaattttggaataagtttcttcctttcaacataaacctttctgaaattgtgattgagattgctttaaatctatagatcaatttgcagaaaattgatgtcttaaaaaactttgaattttccaatcaataaatatagttcatttctccatttatttctcttatttggtgctttgtggcttttctcatacaaatttttcacataaaaatgctatccctaaatacttcatgctttctcatgttatagtacatgatactttaaaaagctattcccagctattcattgcaaatatatagacatttttaaaagttgttattgtattgtgtgatcttgctagtcttactcattatttccggcagttttttcagtgataattaacataggaaatcattgtatctgatagtaaatatagttttatttcttttaagatcctttttaggcatggcacggtggctcacacctgtattcccagcactttgggaggccaaggcagataggtcacctgaggtcaggagtttgagaccagcctgaccaacatggtgaaaccccgtctctactgaaaatacaaaattagccaggcatggtggcacacgcctgtaatcgcagctactcaggaggctgaggcaggagaattgcttgaacctgggagatggaggttgcattgagccgagatcgtgccgttgcactccagcctgggcaacaagagcaaaactctgtctccaagaaagaaaaaaaaatcctggctgggcgcggtggctcacgcttataatcccagcactttgagaggccgaggtgggtggatcccctgaggttgggagttcaagaccagcctgactgacatggagaaaccccatctctactaaaaatacaaaattagctgggtgtggcggcacatgcttgtaatcccagctacttggaaggctgagacaggagaatcccttgaacccgggaagcagaggttgcggtgagcagagatcacaccactgcccctcagcctgggaaacaagagtgaaactccatctcaaaaaaaataaaagagaaaaatccttatctgggatgtattattatgtgtcccattacaaagcaggttttattattattgctttctaatacaaggcataagatatattttctaatataaatttttaaaattcattttagtttagattcagggtcccatgtgcaggtttgttatttggatatattgtgtgatgctgaggtttctattaaattcatcacccaagcagtgaacatagcgcccaacgggtagtttttcaacccttccctcctccctccctcctgcttttcggagccccccagtgtctaatgttcccatcttcatgttcatgtgtacccagtgtttagctcccatttgtaagtgagaacatggtgattggttttctgtttgtgcgttcatttactccatttctcatataaaattagaagtatatgactttttagtgattacataaaattttttcaaagggtagcaatataattgcaaatgaagttcagatttatgaaattgccataaattgctgagctgtggagagctctgtgtcgcagccaaggctgtctgatcttttcgcctttggggcatgcattgtcacattcctcggcctcatcatttcaggatcagaacttagctttcttctcttgtccactggagtgtaatctcccagagagcatgcatgagttttcctaaagactcagtacgctgtcctctggacctgaggcatgacgcagtcttcaccaagtacccttcaggtagcttgggacccaacgtcccttctcctcattttccttatctgcactgtctgtgtctctgcagggtcattgacggccgagacctcatgcccttgctgcagggcaacgtcaggcactcggagcatgaatttcttttccactactgtggctcctacctgcacgccgtgcggtggatccccaaggacgacagtgagtgctcaacccgttgcttcctgttccctgccaggagcagggtcactcaggtgtatcctgaacgcattcttcctttcctctctagaccggtcctttcattccagggctcactgaacacatggttttggagaagtttctcagaattgctcttctgcagaaaggcaggtgggggtaatggagatgctaattggcttcacttaattatctcagcagtcgcacatacattaaaacatcacattgtgcatggaaaatctatgcaatttttacttatcgattacactttaataaagaaaacagatgtatgaacataagatttgcctataaagttagagagacacttttacgaaacatacatttttagtcaggtgtggtggatcacgcctgtaatcccagaactttgggaggccgaggcgggcagatcacttgaggtcaggaatttgagaccagcctggcaaacatggcaaagccctgtctctactaagaaatacaaaaattagccaggcatggtggtgcacacctgtagtcccagctacttgggaggctgaggcggtagaatcacttgaacccaggaggcagaggttgcagtgagctgagatcacaccattgcactccagcctggaagacagagtgagactccatctcaaacaaaaacaaaaccaaaaaatatatatacatttttagaaacaggactgatatctgctggaaaatgtgtatatcatttcaccagggaactctaatgttctcgttttgttgtaaggattgcataatatttagcattgacgtgtgggcaaaaagaagcccaagaaccagccttgagaagacggaagaagacaagagaagccagcaccttgggtgcatgcctctgatgtgctttctttctttcttttttttttttttggagataaaaaaatatgtattgaatatcttctatgggcaggttattttgtaggcataagtggtcatggctaaactttcatttataaaaatcaattctaggcagactaaagataaaatgtaagattaaaagtgttagaagaaaatgagtttatgacccagaaattggaagttttttaaatttttaaaaagtggcacacatataataatatgcacacattgcacatgaaaattggggatatctagtgatattttgagataggcaatgcatagtgatcagattagaataattggcacatccatcatctcaaacatgcataatttctttgtgttgggaacattgaatatcctccttctagctatttgtaactatgtaacatattattgttaactatagttattctacagtgtttagaacaggagtccccaacttttttggcaccagggaccagttttgtaaaagataatttttctgcagactggggtgggggatggttttgggatgattcaaatgcatgacatttattgtgcactttatttctatcattattatattgtattacataatgaaataattctacaactcatcatcatgtagaatcagtgggagccctgagcttgctttcctgcaactagatggtcccatctgggggtgatgggagacagtgacagatcatcaggcattagattctcatacgtagcctgcaacccagatccctcgcatgcacagttcacaataggtctcgtgctcttatgagaatctgatgcagccactgatatctgacaggaggaagagctcaggcaataatgccaacgatagggaatggctgtaaatacagagataaagcttcgctctctcccccaaccactcacctcctgtgtgtgaccaggttcttaacaggccacgaacaggtaccagtttgtggcctggggactggggacccctgctatagaacactaggacttcttcctttgatctggctgaagtgcgcatcatttgacgagtctctcttttctcctccaggtgggtcagtttggaaggctcactatgtgaccccggtattccagccaccagcttctggtggctgctatgtcacctcattatgcagatgtttcggagaacaggttacctaccacaacccccctctgctcttcgatctctccagggacccctcagagtccacacccctgacacctgccacagagcccctccatgattttgtgattaaaaaggtggccaacgccctgaaggaacaccaggaaaccatcgtgcctgtgacctaccaactctcagaactgaatcagggcaggacgtggctgaagccttgctgtggggtgttcccattttgtctgtgtgacaaggaagaggaagtctctcagcctcggggtcctaacgagaagagataattacaatcaggctaccagaggaagcctttggtcctaacgagaagagataattacaatcaggctaccaaaggaagcactaactttggtgctttcaagttggcaaggagtgcatttaatagtcaataaattcatctaccattccagattattaaaggcccactggttgttccact

SEQ ID NO: 850 - DNA, 71260 bp, Homo sapiens
tagtggagacaggctctcaccatgttgaccaggctggtctcgaactcccgacctcaagtgatccgccggcctcggcctcccaaagtgctgggattacaggcgtgaaccaccactcctggcccttctgttacttttccactgctgttgagatagaagtcactgttgggatccaacctttttgtttgtataaactggtgagtttgtgttgatatctcttgctagagttctgaagtaaaagctataggatctttgtgtgagtgtgcatgcgtatttagatgtgtttatgtacatgcacatatgtgtgcacatatacattttttacgtgctttagccctgaagtgtcaaattggcttcaagtcaaagagtactcataaattaaataataagccaaaacgcttttcaagttcacgtgacttacataaatctttaataaataagctggctttaaaattattggtacgatagtattagaaatatcttaaaaattgtcagcatacatgtttgtttgcatttactgatcaagcagtttcatatttacctctgacagatattataaggtgtcaaaatttggcataaggcttacaaaactataaacccagcaacccagcatgaaacacaataatctttgtttctgtactttttgagaaataagacgtttaatgttattagtgtagtaaaaagagctaaatcccaagttatcagtaaaatatatatatatttaaaatttttgcttaggcaaacacagaaaattcatagactataaaaatggttaacagggaaataactttaaatgatgactatcagagttttcacagataatctaggtaaaagattttataaaattaattaggtaaatgtaatgaaacaaatgcctgtaaataaatataatttagaatctaaagttaaataatagatattcactaaatgtctgggccattttcaatttaaataaattgtattatagaaaaacttttctaaaaaatatgttcttattcaaagctaagttattttcatctaattccatgtttatttatttatattttttgagatggagcctcgctctgtctcccaggctggagtgcaatggtgcagtctcagctcactgcaacctctgcctcccaggttcaagcgattctcctgcctcagcctcccttgtagctgggattacaggtgcccaccaccatgcctggctaatttttgtaattttagtagagataggggtcttgccatgttggccaggctggtctcgaactcctaacctcaggtgatccacccacctaagcctcccaaagtgctgggataacaggtgcaagccaccgcacccggccagattctaggtttatttaagggttatttatgaaatatggtaaaaggaaccaagaaacaagagatgtaaagaaagttaggctgcgtgcattgggtcacacctgtaatcccagcactttgggaggctgaggcaggcggatcatgaggtcaggagtttgagaccagcctgaccaacacagtgaaaccccacctctactaaaaatataaaaattagtcaggcatggtggcatgtgcctgtaatcccagctactcaggaggctgaggtaggagaattgcttgcacccgggaggcagaggttgcagtgagccaagatcgtgccactgcactccaggctgggtgacagagcgagactactccatctcaaaaaaaaagaagaagaaagttacaaggaggtatttttggtaagaaatgttaaaagaaaaataattttgtatgagaaagaatcttgttgtttaagagagatgtttaggacagaacagaaaatccaagcaggttgtatatggtctgtgcaagtcataatacagtctgtaaaaaaggaattcaaaaaaatttttatgtaattaagtttgctataactaaaaggaaattataatcattctaggtattggacttcaataataaaaatacagtaatgcaaaaggagatcattggttagaacaagattttcttaaaatactgatgtactcagtgaaattgcaagaagttttttatttttgaattccataatctcttcttgaaattcttcagatggacatcctaggggttccacttctgctgcatcctgcttgcctcagagctttccctcttttgaaaaggcctgggatggtaactctctccttcaacttttgctggctcccgtaattttttaaaaattaatagtctaaaggaagagagagaatttttgaaaacaggcaagtgaaaaatgttataggatgtgcctctatctgtgtgtctgtctataagtttatttattgtctgtttgtttgattgatttgtttattttggagacagggtctcactctgtcacccaggctggagcgcagtggtgtgatcttggttcactgttcccttgagcactgggctcaagggatcctcctgcctcacctcagccatccatgtagctggaaccacaggtgcatactatctcgcccagctaattttttgtattttttatgtagagatggggttttgccatgttggccaggctggtctcagtcctgagctcaagcgatccacccgtcttggcctcctaaagtgctaggattacaggcgtgtggcaccatgcctggccttgtctgtaagtttctatctgtcatgaggaagtaatatttcagtaccaaattatatgaaagagctctaatcaaatggcttaaagaaaagtaagtgcttatcagacaaccaaaagctagctcagatgcttttaattgacattcctttagtaatctttggtaagactaatttggtaaatttaatttcaaaatcctgtccagtggtttaaaatcttagagtcacgttagatgggactgttcccctgaccttgacccccttcgtgggcaggaactggagtggctcatgttactcagcctgcagtttgtggacagctatgtgttaacagctcagtgaagggtcaaggtgacagccttctgcatctgtccttttggacaccgacttcttgtttggtgtccaagaatcatcaggtcacacaaactgaaagatgatgaatgtggaggactttattgagcagtggaagtggctcttggtggaagaggagctggaaaggggatggtgtgtgaagaaggtgatgtttctctgaagcctagccttctctggctgggctcccctccaaaaccacaccgtctgaagttagtcatgtttatctgtagtctccaatgctcagttacttctctgctcgccactcagtagcttgtatccctgccggtcagctgcttgtgttgcttttttctttttctttttcgtttttcttcctgccagctggtctggtccttatgggcacaggatagggggcagggcaggccaaaaaggcaatcatctgggcagagaaacgaggtcagctgctttcactagggccgagcttccagacttgaggttgtagtttagccgggagcccagccatcctgtatcaatgttagattaaattaggcaatcctaggttttgcactggaaattagggttactgggagttggaatagtaggagagtaagatgtatttttggtgaggtttataaaaacacaaagatgtggtttttgccaaagaaaatgtaatgtttagaggctatttaaaggtcactttaaaataaatggaaaattatgtagataaaactcattggagaaagagaaaaataaagaggtggggaatgagaaacctttgacttttgggtggccacgtggtcacacatggtaatgaagtggcatcattttctggggtaaatacccgagattcattgtctcatggccacagaaatcgaggacgtggacacacagaatgaggttgagagcagaagtttagtaggcaaaagaaagagaagagctctctgcagcagagcggggtcctggagaagtgggttgctgcttctttgctgaaatgcagcaagttttatagatgagcttgaggaggcagtgtatgatttacataggacgcaaaagattggttggaccaggtgtaccattttcatagggcatgtaaagctggttaggactagatgtgtcatttgcatagggcatgaaaagctgggctaatcttttttttttttttttttgagatagaattttgctcttgttgcccaggctggagtgcaatggcgccatctcggctcactgcaacctccacctcccgggttcaagtgattctcctgcctcagcctcctgagtagctgggattacaggtgcctgccaccacacctggctgatttcgtacttttagtacagatggggtttctccatgttggtcaggctggtctcaaactcctgacctcaggtgatctgcccacctcggtgcctaatcttttattatgcagatggactctttacctggctagtgccatgtcgcctgttttttttgtttgttttgttttgttttgttttttgagacggagtttcactcattttgcccaggctggggtgcagtggcgtgatcttggcctaatgcaacctctgcctcccgagttcaagcaattctcctgcctcagcctcctgagtagctgggattacaggcatgtgccaccacgcctggctaatttttgtatttttttaagtagagacggggtttcaccatgttggccaggctggtctcgaactcctaacctcagatgatccgcccgcctcggcctcccagagtgctgagattacaggcgtgagccactgcgcctggcctctggttttttactgtacacgtggtgacaaagaaaagggaagacggagcctccatgttgaacatacctggcttccaggtagccctttcccattggcacagctgccagcatttacccattcaagcttccagcttgcttattatctatgcctgcagctctattttccaggctgctctttgttaaaaagaaatgatttgggggctcctttttaaaaagggaaattctgccaaggactcttttaccctcactatctgcctgaataatttctttctagttcctctatcagtaaggagatgcagctggcttgtcttcagtcactaaaggtcaaagccaccagaggaatttagagatggatcctactcatagtcccagggaatttcgttcactggatatatagcaaatgcaaattaataaggaaaaagtgaactattcaatcccttgcttactgcctctgtagttgctaaaatgaaagtaaaagagtgctgccttgggcgtgaaggcagcaccaagctcagatgtgggtctgtctcagatcaggccagtgacctcaaagcttcctacacaaggaaaaattaagccacgtcaaccaaaagttacctctgagacctgtgattaccaagaagatagacatgtggaggaagggcaaaaccaagtaactattaaacccagagggtatttacagggctgttcaatcttttggcttccctgggccacactggaagaaaaattgtcttgggccatgcataaaatacacaaacactaatgatagctgatgagaaaaaaaaaaggcaagaaaatgtcgtaacattttcagaaagtttacacatttgtgttgggccacattcaaagctgtcctaagccacgtgcggcccgcgggccgtggattggacaagcttgaaaaggaattggttcatcttctagattggtatcgtcagcttcctgagttcccttttctaaaatgggttgtaagaatgactactttaagaacagtatgtttaatttttttttttttgagaaagggtctcattctgtcacccagactggagtgcagtggcatgatctcagctcatcgcaacctccacctcctgggttcaagtaattctcccacctcagcctcctgagaagctgggattacaggcacacgccaccatgcccggctaatttttctattttttggtagagatggaatttcaccatgttggccagactactcttgaactcctgacctcaggtgatctgcccaccttggcctcccaaagtgctgggattacaggcgtgatccactctgcccaccgatatgcttaatttttaaatgccacagaaagaaagagcatgtttgggctggtgcagggcccgcagctcactcactattaaacacttgctgatgagtgtatgggacccagatgcacaggaagtttttcctgaggaaatggccagcctggtggactaggtaaacaccactacaaggtctgtttatcctgaaaaggggactgcccagccctccctataaaatgccaagtggagcaccctagataaagcagctgatgtgcttcatatgcaagccatgtgggattggcttaatgatgaccgggatattcaccagctgaatatgcccattacccaatgtattagtccgttttcatgctgctgataaagacatacccgagattgggcaatttacaaaagaaagaggggtaattagacttacagttccacgtggtgggggaagcctcacgatcatggtggagggcagggaggaacaagtcacatcttacatggatggtggcaggcaaagaaagagagccaagcgaaaggagtttctccttgtaaaaccatcagatctcgtgagactcattcactaccacaagaataatatggaggaaactgccaccagaattcaattatctcccaccaggtccctcccacaacaatgggaattatgggagatacaattcaagatgagctttgggtgtggacacagtcaaactatatcaccgaggtcatagtgtgaaaggaaaataaatctcaggaccccaaaatcactaagccaagggaaaagtcaagctgggaactgtgtcaggcaagcctgcctcccatttgattcttaaataagacagctacaaagataagaagctacatacccccctcacaatttgtgcttaaggaaattccttgtggacaaaggacagacggaactcaaagtcatccttccaaggctcccctgagacaaatgcttatctgataacttcctctgcctcattgcttatgtaaaagtacagattcacggagccagcctaaattgtgtattcagtggaaagctgatcaaggactcaaaagaatgtaaccttttgtctcgtgtctacttctaatctgaaagctcccacttcaagttgtcctgaattactgaactgagcccatgtatgtcttacacatattgattgatgtctcatgtctccctaaaatatataaaagcaagctgtgccctgaacaccttgggcacatgtcgtcaggacttcctgaggctgtgtcacaggtgcacgttctcaaccttggtaaaataaactttctaaattgactgagacctgtctcagatattttgggttcgcaatagattctcagtgtattaatgatgttaggtgaagaactgtgaagctcataaatttggaaaggaaaggtttatttctataaatgttgtggttcaagggtccccttctacaagagcaccccaggtgacattactcttgcagaatcaaacaatggtttgagaaaccttatcaaatttgcagttgtagctttccctcatgggtcttacagatgctaccaaaagactagggtgtcaacgagaagagacaaactgtaaatttttttaagaggtttattctgagccaaatatgagtgaccatggccgcccgtgacgcagacttcaggagatcctgagaacatgcgcccaatgtggtctgcgtacagcttggttttctacattttagggagacatgagatatcgatcaatacatgtaagacgtacattgtttccattcaaaaaaggtgagataactcaaagtgggggattccagctcatggatggacaagacacagaaggttgcattcttttcggtctttgatcagaatacacaatttacatgtgacggaggttggggggtgggggtggtgggtagaggaatagtgactgatgcctgttcagtgaatctgcaagtttgcgtaaacaatagggcaggggaatctatcagatatgcatttgtctcaggtgagcagagagggctgactttcacttctgtctctcctttgacccacacctgtgaagataagccaaggtgaaattgaacagaactgttttagggtaaagatcttgaggtccacaaaaaatttctttgtgggcaaattatgaaagaggtatgtagctttttgttttgttttgtttgtttgtttgtttgtttttgtctccatagctgtcttatttaggagaaaatgggaggcaggtttttctgatgcagttcccagcttgccttttccccttggcttggggattttggtttcctttcactaattaacaaacaaaattaataaattaacaaacaaaaacagggaagggaaaagtgagtcaaagggctcatgccagaagggtggaaatctttagataattattttgttattattattaatttttctttttttgagatggagtttcgctcttgttgcccaggctgacatgcaatggtgccatcttggctcactgcaaccccacctcccaggttcaagtgattctcctgcctcaacctcctgagtagctgggattacaggcacctgccaccacgcccagctaatttttttgtatttttagtagagacgaagtttcacaatgttgggcaggctggaatctttagataattgttaagaaataaaagaaaaggaaaattgatggagttaaaacaaaagactttacaacatgatcaaaggttgggtgggccacagggagccccaactggtcccccaacatgaaggggccccatgccagttttcttcatttgcctcagattggagaagtttaagaaaaattgaggctgggcatggtggctcaagcctgtaatcccagaactttgggaggccaaggcaggcggatcatctgaggtcaggagttcgagaccaggctggccaacatggtgaaaccccgtctctactaaaaatacagaaaaatttgctgggcgtcgtggcacgcacctgtaatcccagctactcaggaggctgaggcaggagaatcgcttgaacccaggaggcagaggttgcagtgagcagagatcatgccattgcactccagcctgggcaacaagagcgaaactctgtctcaaaaaaaaaaaaaaaaagttttagagcaggaatgaaaagaaggaaagtacacttggaagatggccaagtagctgacctaagagatcaagtgtatggttgacctttagacttggggttttataggttggcatgcttctggagtcttgtgtcccttctccgctgagtcttcccttggggttgggctgtccacatgcacagtggcctgccagcacttgggaggggagcatgcgcagtgtgtttactggagttggacgcatgctcacttgaggcgttcttcccttaccagctgaatgttcctagaaggttatagaccagttaaactccaccgttttgcttctcagtgtgcatgcttgagcccactcactcacctcctgagatcgtattgggaaactgctgaccaccagttttaggtgttttctatttactgggagacggcctttccctggtgctgactgtgaccaattattattttagagagacagtttaataaccgcctgatgctcgcctgacattcctggtggggctggggagagcctttcctgccttgctcatgcctgactagctacctactgtaacaataactgaactctttctaccgatttccagtgagaaaatctatgcatctatctatgacctgcaagcccccactttgaagtgtgtcacctttcctggctgaaccaatgtccatcttacatgtattgaggggtgtcttatgtctccctaaaatgcataaagccaatctgtaactcaacaaccctgagcacatgttctcaggatctcctgagggctgtgctatgggccagtagtcactcatatttggctcagaataaatatcttagaatagtttacagagtttgacccttttcatcagcagaggcatacactcttgctatgggatgttaaccgaagctaatggaaataatggtgtccaaaagagttccgtgatgaaacgtaaatggttcatgtaggacctgctacctggggaatgcaaagataatatacaaggagggagcttctttttcctcttcagactgactctgtaactgtgagaagatttttgccttccaaagttattagtgtgttcatttttatctcttaggaaaaaagtggcaaagttggagatggtgtacactttcctttattgcttgactgaggttaaaaatttggccaggcatggtggctcactcctgtaatcatagcattttgagagcccaaggccaaggatagcttgagccaagaagttcaagaccagcctgggcagcatagcgagaccttgtctctacaaaaaataaaaaaattagctgggtgtggtggtgaacacctgtaatcacatctacttggggggctgaggtgggaggattgcttgagctcaggagctggaggttgcagtgagccaagattataccactgcactccagcctgggcaaccaagcgagatgctgtctcaaaacaacaacaacaacaaaaagaacaacaaaaaacaaaaaaaaacttgtattctattgtctcccatcagattatttttaactaattttattttaatcacttactgttgagtcacctctgagattttctattccagtggcgtccttataaaatgaagcttccttgtcaactgcacttgttataacaccgagcttctgctaagaaaaagcaaatgcataactctgtataacctatctcccatgacagggtctatgcctcgctgtatttaagcattcattttagttttcagcaatgtagtactttcacctatattttgtcaaattcaaacacttgcaatacttcatttattttttctgcatgtccttcatattttggctttgctagtccactttggccaaaaagctttgattctttaagtataggcctaaatatcctatcttaagcatgggtgtaattttcttctattaccaacagaggttcttttatagtttttgaaatcactgattaaaaagaaacagctcaaattatattctactgtaaaaatgatacattcagcctgggcacggtcagtcacatctgtaatcacaatacgttgggaggctgaggcaggaggatcacttgagtccaggagttgaggctgcagtgagctgtgatcacaccactgcactctagtgtgggtgacagtgagaccctgtctcaaaaaaaaaaaaaaaaagatacattcaaagaagtcaaaataaaacagtataaaacctatctccctgattgcagctacctttttttatgcatacgcctgcaatccttttacacctatcacacactaaaaatgttttacagttattgttattgcacacagaaggcatctaggaatgttttaaagaacctgtctctctgaagttcatcctgcttatctaacttgtctatcaaggaaattattttcttgattattattgctgagaaagactgggtgaggttgctaccccagaattagcagatgcaaatcaggaggaagtgaacaggctgcaaattagcaagttctggcatggggtgaggcaatggcagaaaatcggtttcctgggaaccatgcccaggaactagcctgacattgtgagaaagctcccaacattcataatgagttgcatattaaattccagggaagggcactgtaggtaagatggaccacatttggaaatacactttttcagacgttttatttagggagaatttctgacatgtcctccgataatttgaacttccttgatttgcagttgtacattgagagatcatttcttggtcaaaataaatgttcagcaggtgtgaatgctgtatccacaacttttttttttttttttttttgagacagtctcactctgttgcccggggtgaagtacagtggtgtgatctcagctcactgcaaactctgcctcccaaattcaagcaattctagtgcctcagcctcccgagtagctgggattacaggcatgtgccaccatgcctggctaattacaacttaatttttaaatttgggcagatttacaaaactatcaagctattaccctgcagcatccttagccctaagcttgtcactacttgtaatgtatttttattttatttatttattttttgagacagagtttcactcttgtcgcccaggctggggtgcagtggcatgattgcggctcactgcaacctccacctcctgagttcaagcgattctcttgcctcagccttccggaccacaggtgcatgccaccacgcctgggtaattttttttttttttttttttgaggtggagtttcgttcttgtcattcaggctagagtgcaatggtgtgatcttggtttactgcaacctccacctcccaggttcaagcgattttcctgcctcagcctcccaagtagctgggattacaggtgcccaccaccacacccggctaatttttgtatttttagtagagacagggtttcaccatgttggccaggctggtcttgaactcctgacctcaggtgatccacctgcctcggccttccaaagtgctgggattacaggcatgagccactgcacccagcctacctactggactttttttcggagacacactgtagtttctcaagaaagaatgcctgttcctggtcccagctgcacactcactttacagtgtgtgctgtacttggtcaagtgtattgatattgaaacacaagccagactggatggaccttggtcataaatcatggggcagctctccttcactgtcagataaaatccaaattctctattactacctccaaggtcccagcattgacgatctgttcttttcttcctgaagggacatcacccccggttctcagggtgtctcctcacaggcttcttacaaatgcctttcctcaggaatgtggctccacaatgacttttttttaattaaaaaatttgcagcctacaatcagcctcctcaattattattattattattaattgttattatcattacttgaaacagggggagagtctcactatgtggtccagactggtttcaaactccttgtctcaaaccatcgtcttgccttgacctcccacagtactgggatgacaggtgtgagcccccgcacctaagtgtcctcttaaaacccatgaagtcttttagggctgtctacttttctctatggaattcaaatcgctaagcattcatgaaagtttagataaggtggaaataaatccaacctttaggatggatgcatgaaactgctctcttttttttttttttggtagagttttgctgttgttgcccaggctggagtgcaacggcacgatctcggctcactgcaatctccgcctcccaggttcaagcgattctcctgcctcagcctcccgagtagctaggattacaggcatgtgccactacgcctggctaatattttttgtatttagtagagacagggtttcaccatattggtgggctggtcttgaactcctgacctcaggcgatctacccacttcagcctcccaaaagtgctgggattacaggcatgagccaccacatccagccaaaactgcacttaaaatccaatctttggccgggcgcagtgactcatgcctgtaatcccagcactttgggaggccaagacgggcagatcacctgaggtcaggagttcgagaccagcctgaacaacatggagaaaccccgtctctactaaaaatacataattagccgagcatggtggcacatgcctgtaatcccagctactcggaaggctgaggcaagagtatcacttgaacctgggaggcggaggttgcagtgagcccagatcgcgccactgcactccagcctgggcaacaagagcaaaactccatttcaaaaaaaaaaaaaaaaaaaaaaatctaatattgtccccaattcctacttttgggagtaaactatgcctatttcaaactattgctggacaagattgcctggtttctgcttccccttatccctcttgttcaagtcaaccagtcaggaaatataaagaatgatcaaggaaacctccaagttaacacagaaatacgtatatatggtgaatgctgtctgcagacagcttatggccccatggtactagccgtcatagcacatggcaaagttgtcctattgactctgctgtcagcccctgcgtggaagaccaaataaaggtgctgggacagaaggatgaaaaggaatcctaggataaatatctcatcttcatcgtccctgggttggataattctgagggtctgtcgttgaatctcagtgtttctgcacagcactcagcttcaatagcccagtggcaagctgcttcataagtacaacctctactggcttcctgcctttccctgtctctcttcctctttccctgaccaatgctccctcaattacctccctaataacctacttggatttaaggtttgaaaaagaaatgcggcatcattctttttgtcttaaatttttaattaaaaaaaatttttttcgagatgggatcttgctctgttgcccgggctgtagaacagtggtggaattacgatacggctcattgcagcctcaaaccctttagctgaagcaatcctcccacctcagcctcctgagtaactgggaccacaggtgtgtgccaccgtgcctggataatttttgtaaaatattttttgtagagacagggtctcactagttgcccaggctggtctcaaactcccaggctcaatcaatctgcctgtctcaacctctcaaggtgttgggattacaggcgtgagccactgcgccgggtcgcaccatcattcctattttttttttttttttttggaaatgaagttccctctgtcacccaggctggagcacagtggcgctatctcggctcactgcaacctctgcctcccgggttcaagtgattctcctgtctcagcctcctgagtagttgggattacagtcatgtgccaccacacctggctaatttttatatttttagtagagacggcgtttcgccctgttggccaggctggtctcgaactcctgggctcaagccatctgcttgcctcaactcccaaagtggtgagattccaggcatgagccaccactcctggacgaagcatcattcttaatttcaatgtctagtctagacatttaaaagaattgaacatattggatcgtatcaaaacaacatcttgttgaagagaatgaccctctccacccaacctgaaacagatggaggcagtgctgactttatctcaatcttaaacaaaatctgtttcactcaattttcttgtagacaggccgactgctttattagaaaacaggagaacattgacctttttctatgattctcttccgatcaccctaggtagaattcctttcactttctaacctgtgtctgtttcaacccaggatacattaagcttgttgtctgtgacactttattgaactttttaatagccacgactgacactgatcctctctgctgagagaggagctattctgattccattcattgtgactccaaagtctaccctggaagtcagatgctcaggtgggattttataaatattccatgaacaaatgaacttcggctttggggtaaaagagtcggttgcccatcatttgatagatccctggatattttttcataaaaaacaccctagcaggttgcttattgcaaaatgacatgtgtcatatcttctctggagctgaatattgttaagcaaaatttatattaatgagaagcaaaaaaaagtttgtttgttttgctttgcttcagcaagaattatctgttgcatcagaaatgcagggagcacttttgctctttattagcgtttttttccccagaaactctgacattactaggacacttggtcatctgtgatctgcttaaaagctctcttcagctcctggaagagtaggtggttctgattctctttcggtgagatggtttatggagccctcttcatcccataattctgaagagtaacaggcagaacgtcttattagggggcagctgaaatcgtctagggaatgtggctagggagtgtcgtcatctttacatcaaaggctatgcacagataacacgccaatcctgatttcacccatgagaaaagtgaactccaagaatttcaggaatgtagacgtgtcgatgataaacattgcatttattacaatttcactttatttcctagaagaggggacattatatttcctggccagatgctaccctttgaaagaaatgcaaactttgataaaatagacatgctatcaatttccttaggggagctttatcttcactgggtcactatacccagcatgacagtaaagtctgccatgtgtttcttgtcccactggaaaaaaatacatagaaaagctatgtacaaggactgtattaagattcatctatgtctttcagagatggcaggcaagtgccatttctgaacaatttgggtgaagtcagacacatgcaccttaccccgacaaccactcaatggacagcagaacattgcaaatcatgacctgtaataggactgtctttgacttacacagctcaggaaacaacacttggtttggtcaaaggtttgttccttttcatttcgtgttctagtgttttcttttcctgcccttatgacagttgtgtgcaatggcattattgcattaaatagacacgactgattaggtagcatgaaccatagtttagaatttggctaagtgtggctatgttactgtctgttttttctttttctttttttaggagatagggtcttgctgtgttgcccaggctggagtacagtggctattcagacatgtgattccaccactatcagcacgagagttttgacctgctgcatttgtgacttagggtggttcaccaggccttaggcagcctggtggtcttctgctcctgggaggtcaccaagctggtgctgaacgtagtgcagatacttgatcagcctagcgcaccatagcccagaacttctgggccgaagcgatcccccacctcagtctcctgagtagccgggaccacaggcaggctacttgctgtttttgtcaacataaaagggagtcagaaaaggcagaacatatcaagatcagtaaatctaggctgggcatgatggctcacacctataatcacagtgcttcatgaggccaaggcaggaggattctttgaggccaggagttcaaaaccagcctgggcaatatagggagaccttgtctctacaaaaaaatagaaaataaagaaattacccaggtgcagtggtgcatgcctgtagttccagccactccagaggctgagactggaggatctttcgagcttaggaggctgaggctgcagcgagctcttatcacaccagtgcactccaacttgggtgacagaatgagaccctgtctctaaaagaaaaagaaaaaaagagattagtaaattctttagaaaccaagattttaccatgagcagttgcatgaaggtggaaaacctttctgtgattataagtagggattctgaaagaagtcctcaaagtgaatacttattccatggagaaacagaatgaattgagagagtcctggaagctgggaggagaggaatctgtagaaagcagagtcacttaactaattcaccaatgagactgcaaaccgatggtcatggagctgccatgggaatctgaattacagtcacttttattctttgtattttattgtttggattgaaaatgcggccaggcacggtggctcatgcttgtaatcccagcactttgggaggctggggtgggtggatcacctgagatcaggagtttgagaccagcctgaccaacatggtgaaaccccgtctctactaaaaatacaaaaattgggattccattccaagatggccaaatagaaacagctccggtctacagctcccagcgtgatcaacacagaaaacgggtgatttctgcatttccaactgaggtatcttgttcatctaattgggactggttggacagtgggtgcagcccacagagggcaagccgaaacagggcagggcattgcctcacctgggaagtgtcagaggatttccctttcctagccaaggaagctgtgacagactgtacctggaaaactgggacactctcgcccacatactgcacttttccaatggtcttagcaaagagcacaccaggagattatatcctgcacctggctcggcagttcccactcccacagagccttgctcactgctagcacagcagtctgagattgaactgtgaggcagcagcctggctgggggggtgggcatccaacattgctgaggcttgagtaggtaaacaatgtggccagggaagctcgaactgggcagagcccactgcagctcagcaaggcctactgcctctgtagattccacctctgggggcagggtatagctgaacaaaaggcagcagaaacttctgcagacttaaacgtccctgtctgacagctctgaagagagcagtggtgctcccagcatggtgtttgaggtcttagaatggacagactgcctcctcaagtgggtccctgacccccttgtagcctaactgggagacacctcccagtaggggccaactgacaactcatacaggtggtgcccctctgggacaaagcttccagaggaaggatcaggcagcaatatttgctgttctgcaatatttgctgttctgcagcctccactggtgatatccaggcaaacagggtctggagtggacctccagcaaactccaacagacctgcaggtgagggatctgactgtcagaaggaaaactaacaaacagaaaggaatagcatcaacatcaacaaaaaggacatctacaccaaaactccatctgtaggtcaccagcatcaaagacaaaaggtaggtaaaaccacaaagatggagagaaaccagagcagaaaagctgaaaattctaaaaaccagagtgcctcttctcctccaaagggttgcagctcctcacgagcaacggaagaaagctggatggagaatgactttgacgagctgacagaagtaggcttcagaaggtcggtaataacaaacttctccgagctaaaggaaatgttcaaacccatcgcaaggacgctaaaaaccttgaaaaaagattagacgaacagctaactagaataaatagtgtagagaagaccttaaatgacctgacggagctgaaaaccacagcataagagctacgtgatgcatgcccaagcttcaatagccgattcaatcaagtggaagaaagggtatcagtgattgaagatcaaatgaatgaaataaagtgataagagaagtttagagaaaaaagagtaaaaagaaatgaacaaagcctccaagagatatgggactatgtgaaaagaccaaatctacatctgattggtgtacctgaaagtgacagggagaatggaaccaagttggaaaacactcatcaggatattatccaggagaacttccccaacctagcaaggcaggccaacattcaaattcaggaaatatagagaaagccacaaagatactcctcgagaagacacataattgtcagattcaccaaagttgaaatgaaggaaaaaatgttaagggcagccagagagaaaggtcgggttacccacaaagggaagcccatcagactaacagtggatctctcggcagaaactctacaagccagaagagagtgggggccaatgttcaacattcttaaagaaaagaattttcaatccagaatttcatatccagccatactaagcttcacaagtgaaggagaaataaaatcctttacagacaagcaaatgctgagagattttgtcaccaccaggcctgccctacgagagctcctggaggaagcactaaacatggaaaggaacaaccagtaccagccactgcaaaaacatgccaaattgtaaagaccatcgatgctaggaagaaactgcatcaactaacgagcaaaataaccagctaacatcataatgacaggatcaaattcacacctaacaatattaaccttaaatgtaaatgggttaactgccctgattaaaagacacagactggcaaattggatagagtcaagacccaacagtgtgctgtattcaggagacccatctcatgtgcagagacacatgtaggctcaaaataaagggatggaggaagatctaccaagcaaatggaaagcaaaaaaaaagcagaggttacaatcctagtctctgataaaacagactttaaaccaacagagatcaaaagagagaaagaaggccgttacataatggtaaagggatcaattcaacaagaagacctaactatcctaaatatatatgcacccaatacaggagcacccagattcataaagggagtccttagagacctacaaagagacttagacttccacacaataataatgggagactttaacaccccactgtcaatattagacagatcaacgagacagaaggttaacaaggatatccagtacttgaattcagctctgcaccaagtggacctaatagacatctacagaactctccaccccaaatcaacagaatatacattcttctcagcaccacatcacacttattcaaaaattgaccacatagttggaagtaaagcactcctcagcaaatgtaaaagaacagaaatcacaacaaactgtctctcagaccacagtgcaatcaaattagaactcaggattaagaaactcactcaaaactgctcaactacatggaaactgaacaacctgctcctgaatgactactgggtaaataacgaaatgaaggcagaaataaatatgttctttgaaaccaatgagaacaaagacacaacataccagaatctctgggacacatttaaaacagtgtgtagagggaaatttatagcactaaatgcccacagaagaaagcaggaaatatctaaaatcaacaccctaacatcacaatgaaaagaactagagaagcaagagcaaacacattcaaaagctagcagaaggcaagaaataactaagatcagggcagagctgaaggagatagagacacaaaaaacccttcaaaaaaatcaatgaatccaggagttggttttttgaaaagatcaacaaaattgataggccgctaacaacactaataaagaagaaaagagagaagaatcaaatagatgcaataaaaaatgataaaggggatatcaccaccaatcccacagaaatacaaactaccatgagagaatactataaacacctctatgcaaatgaactagaaaatctagaagaaatggataaatttctggacacatacaccctcccaagactaaaccaggaagaaattgaacctctgaatagaccaataacaggctctgaaattgaggcaataattaatagcctaccaaccaaaaaaagtccaggaccagatggattcacagccaaattctaccagaggtacaaagaggagctggtaccattacttctgaaactattccaatcaatagaaaaagagggaatcctccctaactcattttatgaggccaacatcatcctgataccaaagcctggcagagacacaacaaaaaaagagaattttagatcaatatccctgatgaacatcagtgcaaaaatcctcaataaaatactggcaaaccaaatccagcagcacatcgaaaagcttatccatcatggtcaagttggcttcatccctgggatgcaaggctggttcaacatatgcaaatcagtaaacataatccatcacataaacagaaccatcaacaaaaaccacatgattatctcaatagatgcagaaaaggcctttgataaaattcagcagcccttcatgctaaaaactctcaataaactaggtattgatgggacgtatctcaaaataataagagctatttatgacaaactcacagccaatatcatactgaatgggcaaaaactggaagcattccctttgaaaactggcacaagacagggatgctctctttcaccactcctattcaacatagtgttggaagttctggtcagggcaatcaggcaagagaaagaaagaaagggttttcaattaggaaaagaggaagtcgaattgtccctgtttgcagatgacatgattgtatatttagaaaaccccatcgtctcagcccaaaatctccttaagctgataagcaacttcagcaaagtctcaggatacaaaatcaatgtgcaaaaatcacaagcattcctgtacaccaataacagacaaacagacagccaaatcatgagtgaactcccattcacaattgctacaaagagaataaaatacctaggaatccaacttacaagggatgtgaaggacctcttcaaggagaactacaaaccactgctcaacgaaataaaatgacacaaacaaatggaagaacattccatgctcatggataggaagaatcaatattgtgaaaatggccatactgcccaaggtaatttatagattcaatgtcatctccatcaagctaccaatgactttcttcacagaattgggaaaaacgactttaaagttcatatggaaccaaaaaagagcccagattgccaggtcaatcctaagcaaaaagaacaaagccggaggcaccatgctacctgacttcaaactatactacaaggctacagtaaccaaaacagcatggtactcataccaaaacagagatatagaccaatggaacagaacagaggcctcagaaataacaccatacatctaccaccatctgatctttgacaaacctgacaaaaaccagaaatggggaaaagattccctatttaataaatggtgctgggaaaactggctagtcatatgtagaaagttgaaactggatcccttccttacactttatacaaaattaattcaagatggattaaagacttacatgttagacctaaaccataaaaaccctagaagaaaacctaggcaataccattcaggacataggcatgggcaaggacttcatgactaaaacaacaaaagcaatggcaacaaaagccaaaatagacaaatgggatctaattaaactaaagagcttctgcacagcaaaagaaactaccatcagagtgaacaggcaacctacagaatgggagaaaatttttgcagtgtacccatctgacaaagggctaatatccaaaatctacaaagaacataaacaaatttacaagaaaaaaacaaacaaccccatcaaaaagtgggcaaaggatatgaacagacacttctcaaaagaagacatttatgcagccaaaagacacatgaaaaaatgctcaccatcactggccatcagagaaatgcaaatcaaaaccacactgagataccatctcacaccagttagaatggcgatcattaaaaagtcaggaaacaacagatcctggagaggatgtggagaaataggaacacttttacactgttggcgggagtgtaaactagttcaaccattgtggaagacagtgtggcaattcctcaaggatctagagctagcaataccatttgacccagtaatcccattactgggtatatacccaaagcattataaatcatgctgctatcaagacatatgcacactattcacaatagcaaagacttggaaccaacccaaatgtccatcaatgatagactggattaagaaaacctggcacatagacaccatggaatactatgcagccataaaaaatgataagttaatgtcctttgcagggacatggatgaagctggaaaccatcattctgagcaaactatcacaaggacagaaaaccaaacactgcatgttctcactcataggtggtaattgaacaatgagaacacttggacacagggtgggggacatcacacaccgggcctgttgtggggtggggggttgggggagggatagcattgggagagatacctaatgtaaatgacgggttgatggatgcagcgggccagcatggcacatgtatacctatgtaacgagcctgcatgttgtgcacatgtaccctagaacttaaagtataataaaaataaataaataaataaataaataaataaaataaaatcaggagaaaaaaaattggccagtcatggtggcaggtgcctgtaattccagctactcaggaggccgagacaggaaaatcgtttaagaccaggaggcagagattttagtgagctgaaattgtgctgctgcactccagcttcggcaacagagtgagactctgtctcaaaaaaaaaaaaaaatgcacatgccctttatatgtaaattttcattttagggaataagttcacatcttcttaacatatattattttggtgtttttagacaattccagttcaaaattcctctccaggtacatttacctgaagaaatctgcatctctggtctaatgcaagatctggtttccaggctgggcgcagtgactctcgcctataatcccagcactttgggaggccgagatgggaggattgcttgagcccaggagtttgagaccagcctgggcaacatagtgagattatgtaaaaatacaaaaattatccatggactagtgggtgcctgtagtcccagctattcgggaggctgaagcaggaggatcactcgagcctggaagtcgaggctgcagtgagctgtgatcaccataattttactccagcctgggtaacagagagacaaccagtctcataaacaaaacaaaacaaaatctggtttctagagtttatagaatcatacaacagcatgtttcatggagcgttccatctcacaaggtggtgtttggtttagagagggttatgtatgccctctgatattctcaaatctttatttaaaatgctgggagagttgctatctggctttgcatcagtgtttaatataatagccatccttttggggtgggtgttgacgaacagcacacctgccatcttccaaattataccccacactttgtcttgttgaatattattaagatataaagacagggaagaccttccatttccctcccacgtccccaccacctttagttgggagcacagatgtccctgaggcactgctatagaccatgaggtcaccgcaacacaagggacatcaaatgggattgctctggctcaaaacagccagtcttaattctggtgcgatgaatggctttggtggtcgtcccagataagaacattcagcgtcagcaagaaaggctgtaggtatttggctgaatgtaatgttttgttgttgatgtgctgttgtttttcttttcctgggtgtgtagtaggagttgcaaatgcgggctgcagattagcaacgggaaccatctgggtgagcctagcagggaccagccctcccatgggagagagaggtgacacggagcagctgatgctttcgtaatgattcgaggcagctgccaaaagaggcagagcctttgcagaacagcctgtctgttctgctcctagacattagagagataatacggctgataggtgagttggggaaggcttgtttggacacattttctcagccttttttttttttttttaacctctggtagaaacgggcatagttgaaagatccattgacctattgtattctgaaactcaatggatcatcagcttaggcactgagaaatggattccaaaccaattttagtgtgagcaagtttctctcctttctgttactctcataccctttcttctttcttccctccctccctcccttcctttttctttcttaaccaagaacgtgtgtgtgtgtgtgtgtgagtgtgcgtgcgtgtgtgtctgtgtagtgtgtatagtatgtgtccagagtatacatgctttggaacaaaatgaatttaaggaggaatgcgtttgtattttgtccttagtgttattttaaggtacaaatatgggtaataacttgcagactacagatgggcttttctttcattgtaatgcatttggctgtcatatcccttagtcctaacccctctgccactgccaactaaatataaccattagtcattcagtggtttctgcattttgcagtcaaaaaagagggagctcattttgattaattgcctctttccttattcaggacacagaagctttctgagtttaaacttttaggcttggcaggacattgagacaatgctcttgggccagcatgtttcagggcaggttttgccactgagacaattcatccaagagccccaggacttggggcagcaggagttcttttaaaaatgggccaaaagacgggcagagcacttgaggtcagcagttcaggaccagcctggccaacatgctgaaaccccatctctactaaaaatacaagaattagccgggcgtggtggtgcacgcctgtagtccccactactcaggaggctgaggcaggagaatggcttgaacccgggaggcagaggttgcagtgagctgaggttgcaccactgcactccagcctgggtgacagcgagactccggctcaaaaaaaaaaaaaaggtcaaaagaatgaactcattgaaagttcaggatttgtgcagtagtggccttggaaaatcaatttaaaaatgtcggaattagggatatggctcacaagtctagtgtgaatttcatgctgggaactaatttaattgacacatgaatgatactttttttttttttttttggtcttttaaatcacgtctgtgtcttctgccaaagacaacaagaaggtattccaagctgcacaatgaggcccaggtaggtaaagccatatactgcattgtgagcacattgaatctaatgtataattctgtgtatttgtgaatccagccttataggtagaggcatttaatatcatctgcctttttttcttttttctttttcttttcttgtaacctactatgagtcaacatgctgtctttatatggctggccataagatgtctaagttcattctctcgacttagtaagtgtgtaagttttttaaaaaggtaggagttaggcaattgatagagatgtaaactgtaaatttccaacagatacatatgagtttatgtttatttttatttattttagagacagggtttcacagggttttgctctgtcacccagggtagacgacagtggtgcagtcatagctcactgcaacctccaactcctgggctcaagagatcctccagcctcagcctccagagtagctgggacctcaggtgcttatcgccacgcccagctaattttttatttttattttttgtagagacaggttctcattttgttgcccaggttggtcttgaactcctgggctcaaggaatccccccgcctcagcctctcaaagtgctgggattacaggtgtgagccaccattgtgcccagccgtatacatgattttaaagtgttgtaaaaacaggaggtgaaaaaattcaactaactttgcatagatgaaaagcatttctataacttcggggatttggcccacagtcctgagcatgtagcttttgcctgcaagacattctcaatcttcaaggagatgtttgcatacagcaaaaaaattgtactcttctgtggctgtcattgtttcagagtatttacaaaggactctgagagccaatagggatgaactcctgtttgtattttttctctcagaggagatatttgaagtgggttttgaaacatgtatagacatgagataggaattgaatcaataatccacatgtccaatattcattacctgataactgagtagggatatgctgagaagagcgtcatgtgtttccttaagaaaatatgacctcagctgggactgagcaaaactatgaagtggactcaggtggtcctcagagtccacgtttctttcttttcctcaattcagttctttccccaacttccacttttcctttacttggtaattccttattttattttatttatttatttttttgcttgtttttcttttctccagccaaagctgctattctcacactttttcttcttttgagggtctcgtcctgtagcccaggctagagtgcagtggcgcaatctcagctcactgcaggcttgaactcctgagctcaagcgatcctcccacctcagcctccagagtagctgggactacaggcatgcaccaccacacccagttcatttttacatttttttgtagggatggggtctcactatgttacccaggctggtgacgaactgattctcctgcctcagccccccaaagagctgggattacaggtgtgagccactgcaacctgactttttaaaaatttggagtaatgataaattgcatgtatttattctttttatattatgaatattttatttttatttattttttctttctttttaaattcatttttctttttatttttttcctttttaaatttctttttctttttttattgtcccttgagtcaaaaaagctgacatataaacattgcatagatttatggtgtacaacttgatgttttgaaatacgcctgcattttggaatagctcaattatgctaatgcatgttacctcatccacttacctatttgtgatgagaacactttgagtagattttatcagtaattttcaactctaaaatacattcttattaactacagtcagcacaagtacaatagattctttgaacttatttctcctgtcaaattgaaattttgtatccttcgaccaacatctccccaacccctccactggccccccagctcccagcaggcatcattctaccctttccttctatgagatcaactttttgagatttcacatagaagtgagatcatgtggtattggtgtttctgtgccaggcttattttccttagcataatgacctccaggttcatccacgttgttgtaaatgacagaatttcattcttttttaacgctgaataatattccacggtgtatatgtaccgcattttctttatccattcatgcaatgatggacactgaggttgatttcacagtttggccattgtgaatagtactgtaaggatcacacacacccacatgcccttaaattagaataaaaattctaattttagaatgaagttaaggttaaatcccttacctgtagagactcatttaagtcccttaaatgaggttaagtccctggaagagggagttaacctcaggagtcttatcgtctccgtcctctgcaatgatttgcccctgagtacgtgttttcagacttccctcctggaagggcatctactttagccttttaaaaaaaattcaatagtttttggggagcaggtgatgtttgattacatggataagttctttagtggtgatttgtgagattttgatgcacccatcccctgagcagtgtacactgcacacaatgtgcggtctttgatccctcactcccctcccaccctttccctgagtccccaaagtccattgcgtcattcttatgcctttgcagcctcatagcttagctcccacttatgagtgagaacatacaatgtttggttttccattcctgagttacttcacttagaataattgtctccaactccatccaggttgctgcaaatgacattattttgttcctttttatggctgagtagtattccatggtgtgtgtgtgtgtgtgtgtgtgtgtgtgtgtgtatgaatatgaaaatttgatatggatagatagatacctgcagatctatacagataaagaagatgtgttatatataggtatctacagatctatagatatcaagagtgtctcgctccaagcaccaagcactgctgctgaatggcagcagaagtgcccaaagaaatgcgctcttggcttctcactttgtatacaatctatagctatctatctctatatatcacattttctttatccactcattgattgatgggtatttgggctggttccacatttttgcaactgcaaattgtgctgctgtaaacatgcgtgtgcaagtgtcttttgttgttgttgttgttgttgttgttgtttttgatggaacctcggtccgtcacccaggctggagtgcagtggcacaatcttggctcactgcaacctccgcctcccgggttcaagtgattctcctgcctcagcccccctagcagctgggattacaggagtgtgccactacactcggctaatttttgtacttttagtagacacagagtttcaccatgttggccaggctggtctcgagctcctgacctcaggtgatccacctgcctcggcctcccaaagtgctgagattacaggtgtgagccaccacacccggccgcaagtgtcttttatatataatgccttcttttcctctgggtagatacccaggagtgggattgctggatcaaatagtagatctacttttagttctttaaggaatctccatactgttttccacagcgcttgtacattcccactaacagtataaaaggattcccttttcactgcatccatgttaacatctgttgttttagcctttattttatgcaaagtgagaagccaataacgcattacgttgggcacttccgctaccattcagcagcagtgctcggtgcttggagagagacactcttgagcttcaggagatgcctgggagatccacgtgatctccaaagacccctgttgtgttgtgttgggaggtggatcctgaatccacccagagaagcctgataccaataaaatccctgcttgctttccaggagacccttggtcttcatgtctttggtgtgtgcactcttgaacacatgccaggcacacagggtgcatgacgacaagcctaatattgtcctaatcatggttgatgacctgggtattggagatctgggctgctacggcaatgacaccatgaggtaaggcggtttcatggccagtcatacgttcgtcagtcgttcaggttcagcaggctggctgtacggctgcatctatgtgcaaaaccaaatgtatttgttgggacttttttttaagttactttaaactttttgatagttttaaattatttagattatgtaatagttttacaattacatttttaataattttaatttgaatctctttcagtttttaaacttaagaaataataattgtccatcttcacagggtacacagtgaggtttggatacatacaaagtatagtgatcagatcagggtaatcagcacatccagtgcctctagcattaaccaggatggtcatagtaaaagcatggctatctggacccgagtcctggctctgcatttactagctctgaagtcttagagaagtcgctgaacctctctgtgcctgttttcttatttgtcgaatgcagagaaggctttatatccctgagtttatgtgtgtaaagaacttagaatagtacctaacacacaactaccctctatcatacagcctattatgaagcatgatgattgtatgtacatgtacatatacagatatgaacatataaatgtcattatataaatatatgtgatatattcatatatgaatatattctataatatataaagtatatatcatacatttattatattacatatccatatattatgaatatatgaacatacattcaatgtataaacatatatgaatatatttataatatatgaatatataatattactaatatatatgaatatgttattcatatatacatgaacatatacatatttctatgtctatgaatatatattcacttttatataaatgtatttttaaaaattaaatataaatatatttaaataaatatataaacatatatttatatattttataaaagtacatttaaataaatatatgtaaatatatattcattttatataaataaatatttatataaaatgaatatatcttcatacatattgataatatataaaagtatatattatcaatatatattgataatatataaatatatatttatatatataatatataatattcataataggctgtatgatagagggtagttgtgtgttaggtactattctaagttctttacacacataaactcagggatataaaggcttctctgcatttgacaaataagaaaacaggcacagagaggttcagcgacttctccaagacttcagagctagtaaatgcagagccaggactcgggtccagatagccatgcttttactatgaccatcctggttaatgctagaggcactggatgtgctgattaccctgatctgatcactatactatatattaataaataaatatatattatttattaatatatatttaattatacatatataaatattttaatataaataaatataatataaatatttataaatatatttataaataaaattatatataattataaatatataattaaatatataattaataaatatatattataaatatagatttataatatataaatatatattaataaatatgtatgaatttatgaatatatattcaattatatatattcataaatatataaatgtgaatatgtatattcagcagaattcattctgtttcctaatttggtgagccaatagattctttaagatggtgagcttgtatttttaacaatgggcattctgaaagaagaaaaacagatatgaaacaaactcagtgctttgtggtggataatagaagctatctgtattagccattcttatactgagcttaggagtacatcgttatcagacgtacatcatacacttttaagatcattgcgttgtatgactaatagatgctgaaggtagtcatcacagttttcgacaacggagctaggagtcatgaaaaagtagtcgccaaaaattaaccattgcttatgagaaaagaagagaggactcaccgaaaagcgcagaaacatggtgtccataaatggcagatatttacagagagtatgttagcgtggggtatcggtgttttgctgaaaatactagcaatttgagaagtgagattataatgtgaaatctaaaaccaggcacatgtgccccaggaatgcagtttacaatttttttctttgcaaaataaataatgttttaaaagttggtaggtgacttccatatctgaaaaaaaaatcagatgcacaccttggtaaagctggaacttctccttgcaccagttacctgtcataatttctctcatgaataaatgtagaactcattatattttattttcatccaagaggagactgattctttttccagaagtctctccagcctccagaaatctcttgttaaattattttttaattgacgaattatagttctgtgtatttctggtgtacatcatgatgttttgattcatggatccattgtggaatagctaaatcaagctaattaacatgcacaaccacacatacttattatttatatgtggtgaaaatggtgaaaattatagcaatttcaagaatagaatacattgttattaactatagtcaccacaatctgcaacagatctcttaaatttattcctctatgtgaggaataaatcaaatagaggatttattcacgtttggctccgtgaaatgttgtatcctttaacctacctgttctcgaccctcaccccagcgcctgatacccaccattctactgtctacttctgagtttgctattttagattccacacataagtgagatcatgcggtatttgtctctctgtgcttggcttatttcatttaatctaatacccttccagttcatctgtgttgtcgaaaatggtgggatttccttcttttgaatatttaatcatatgacagttttgcaacctatgcagactgcagggaaatgtatctatcaaaccagtgagtgggtgggtctgtgagtagttaggcataagtaaggtctgtaagcaattagcctcgatgaatcagaccccaatcccttaagcattttattttgtaaggctgaagtacagtgaatggacaccatatagtggcacccaggtatatgaaccctgcagaacaacagctgcctggaatctcagtcatacttcaccttgacacgggcaaaaaagaaaaatgaactccgtgtgcagttacctgctctgggtacctggaaatcataataaacagagatgttgtttatcttcagatctctctgtctctctctctgtctctctctctcctctttctgtctctacatctctttctatgcctatgcgtgtctctgtcacccctctctgtctgcttgtctctttctatctctctctctgtctctctctgtctccctctctttgtctgcctgtctctctatctctctctctgattgtctctctctgtctccctctctttgtctatctcattctatccatttctttctatctctttctgtctctctctctccctctctctgtccttctgtttccatctgtctctccatctctttctatgtctgtctctgtcttccccctttctctgtctgcttgtctctctatgtctctctgattgtctgtctctgtctctgtctctctctttgtctatctcactctatccatttctttctgtgtctttctctctttccttctctctccctctgtctgtatctttccatctctctctgtctctctcttcctctcttcttctctctctccatctctctctctgtatctctctctgtgtctctttctctcttttcatctctccctgtttgtctctctctgtttttctttctgtctccctccatctgtctctttttccacctctctttctgtttctctctgtctccctccctctgtttatctctctttccatttctttctgtctctctcttaatctctgcatgtctctttccatctctctctttctgtttctctctctctgtctttctctctctctcttgtcttctctctgtccctctctgtctttctctgtctccctctttctgtctttctctctccttttttctgtttgtctctctctttccatctctctctgtttctctctgtgtgtcttaccctttgtctctttctctgtctcttttcatctctctctttctgtttttctctttctatccttttctgttgctctctttctcgtttgtctctctctctctttcatcctttctttctgtctgtctctctctctgcctcgctttctgggtctctccctctctccctgtctgtctctcctctctctttccacctgtgcctttctgtttgtccttctctgtcttcctctcgctcttcctctctgcttcccccgccccccaccttttccttctctccaatacaccttccctctcccccttcaggacgcctcacatcgaccgccttgccagggaaggcgtgcgactgactcagcacatctctgccgcctccctctgcagcccaagccggtccgcgttcttgacgggaagataccccatccgatcaggtgcgcaaactggcgggctctgctgggctctgccctcatgttaggatgtgaggaaacaaaaatgtggcttgaccacgttaacaagtaaaaaagggctgggcacgatggctcacgcctgtaatcccagaacttcgggaggccaaggtgggaggattgcttgagcccaggagtttcaaaccagcctgggcaacagagcaagaccccatctccacaaaatttttttaaaataagttgagcatggtggcatgtgtctgtggtcccagctacttgggaggctgaagtgggaggatcgcctgagcccgggagtttgaggctgcagtgagtgtgatcacagcattgcactctagcctcgttgatagagcatgtgttagaaagaaaaaaaaagatacaaaggaaagaaaagaaaaagcacacatgtgcataggtgcactggcacacacagctagcactggtcacatcaaaatggctgcgcttctcagagatgcaagatcaccctgtgtgcttcagttgtcttttgatgcaatgagagttttttatctgaattccaagtcacaaggtgtacatttgagtttcccaggtcaacaaagataagctgtcttggaatgaagtaattaatacaacatgtgtttacacattcagtctgtcaccaaaaaatatctttttttttctttcaaaccacaaagtcatggccgggcatggtggctcatgcctgtaatcccagcactttgggaggccaaggcaggtggatcacttgaggtcaggagttcgagcccagcctggccaacacggtgaaagctcatctctactaaaaatacaaaaattagccggacatgggggcatgcacctgtagtcccagctactcaggaggctgaggcaggagaatcgcttgaacccgggaggcagaggttgcagtgagccaagattgtgccactgcattccagcctgggtgacagagcgagactctgtctcaaaacaaacaaacagcaacaacaaccaaaaacccacaaagtcataaaccaagaaatagctatcagatttttggacaactttcatcacagcattttacccatggagacagtagtattatccccttgctcaatttatatcaattttattttatttattattattattattattattattatttttgaaatggagtctcgctctgttacccaggctggagttcagtggtgcaatctcggctcattgcaacctctgcctcctgggttcaagtgattctactgcctcagcctcctgggtaactgggattacaggcacgtgccaccaggcctgtctaatttttgtatttttagtagagatggagtttcgccatgttggccaggctggtcttgaactcctgaccttaggtgatccacccacctcagcctcccagagtgcggggattataggtgtgagccaccgcacccggccatatatcaattttagataaaacaaaaatgaaatgagaagaacgaaattatcgtaagctctagttgtcatgttctcattactttttaatttattactattattttgagacaaggtcttgctctgttgaccgggatggagtgcagtggtatgatcacagctcactgcaacctcaaccttccaggctcaggtgatcctcccacctcagcttcctaagtaactggaaccacaagtgtgcaccactatgcctggctaattttttaactacttagggtattgctgtgttccccaggctggtctcgagctcctgaactcaagccatcttccctctttggcctccaaaagttctgggattacaggcatgagcaactgcacccaacctggtgactttttttgtttgtttggttttttgcttttgagatagggtctccctttgttgcccaggctgaagtgcagtgtcacaatctcagctcatcacagcctcaaactccagggctcaagcgattctccctcctcagcctcctgagtagctgagattacaggtacccgccaccatgcccagctaatttttgtatttttggtagagatggggtctcaccatgttaaccaggctggtcttgaattcctgagctcaagtgatcggcccacctcggcctcccaaagtgctgggattttaggcatgagccaccgtgcctggccaaaagtagctatttttaaatgtgctattcagtagcatgtagctctttcccaatattgtacaaccatcacctctatcgaattctagaacatttccatcacccacaaaggagatcttgtccccatgaagcaatcactccccattcccccttctcgcagcccccggtcaccaagaatccactttccgtctctacaaacatgtctgtcctggacatttcacataaaaggaatcatacagtatgtgacagtctgtgactggcgtctgtcaccaagcataatgttttatggtagcctgggtcagagtttcatttatttttatgttgaatactattccctcgcatggattcactacagtttctccatccattcatcaattgatgggcagtcaagatgtttctattgtttagtgattgtgaggaatacaactatgaacatacatgtacaagtttttctttgaataccagttttcaatccttttgggttcctcaggaacctcaattcttttgacattccccaggagtgaaattgttgggttgcatggttctattttttttttttttttttttcagatggagtttcactcttgttgcccaggctggagtgcaatggcgcaatctcggctcactgcaacctctgcccctgggttcaagcgattctcctgcctcagcctcctgagtagctgggattacaggcatgtaccaccacgcccagctgattttgtatttttagtagagacggggtttccccatattggtcaggctggtctcgaactcctgacttcaggtaatccccctgccttgtcctcccaaagtgctgggattacaggtgcgagtcaccacatccagtcatatagttctatttttaaaggtgagggaagtgggcttggggcatggtggctcacacctgtaatcccagcactttgggaagctgaggagggcagatcagttgaggccaggaattcaagaacagcctggccaacatggtgaaaccccatctctactaaaaatacaaaattagctgggcatggtggtacatacctgtaatcccagctactcgggaggctgagacaggagaattgcttgaactcaggaggcagaggttgcagtgagctgagatcatgccactgcactctagcctgggcagcagagtgagatttcatgtcaacaacaacaacaaaaaaaaaaaaaaaaaaaaaagagagagagagaaaaaaaaaaaagaaaaaaaaatggtgagggaagtagtcttcgcttgtgggtacagatgccgcagtttaatgccaaattatgtggattccagatagcggttcttggaggcagaataaaatcgcacgtatcaaccctactgccagtctgctgacactgactttggacgagaagaaagaaaaggtcttttttggctgagtgcagtggctcatgcctgtaatcccagcactttgggaggccaaggcgggcagatcatgaggtccggagatgcagaccatcctggccaacatgatgaaactccgtctgtactaaaaatacaaaaattagctgggtgtggtggcgtgcacccatagttccagctacttgggaggctgaggcaggagaatcacttgaacctgggaggtggaggttgcagtgagctgagatggcactgctgcactccagcctggtgacaaagcgagacttcatctcaaaaaaaaaaaaagatcttttcttagtctgtttgggctgctataacaaaaataccatagactgggaggcttatctacaacagacatttactgctcacagttctggaggctggaagtccaagatcaaggcatgccagattcagtgtctgctggggacctgcttcctggttcatacacggcgccctcttgctgtgtcctcacatggtggaaggggtgagggagctctctggggtcccttttgtaagggcactgattccattcttgaggctccaccctcctgacctcatcccctcctaaaagccctacctcctaaccattaccttgcagatgaggatttcaatgtgcaaattttgtagtgacaaaaatattccctctgtagcaacacctactcattgtacttttttccacactacatctaggtatggtttctagtggtaatagacgtgtcatccaaaatcttgcagtccccgcaggcctccctcttaatgagacaacacttgcagccttgctaaagaagcaaggatacagcacggggcttataggtaagacacaagaattggtgttagtcattgatcataaggtaatcatgtcctttgttctacccttgatttatgactttcttggaaacgctgtattttacaatgtcttatgtaaaggcgcagtggcccatgcctacaatcccagtactttgggaggccaaggtgggaggatcgctggaaaccaggagtttcagaccagcctgggcaacatagaaagaccccgtctctaaaaatataaaattagctaggcattgtggcatgtgcctatggtcccagctactccagaggctgaggtgggaggattacttgtggcaggacttcttttctttattattatttttaaaacagaggagtctcactgtgtcacccaggctggagcacagtggcacaatctcggctcactgcaacctccatctcctgggttcaagggattcttgtgcctcagcctctcaagtagctgggactacaggcgcgtgccaccacgactggctaatttttgtatttttagtagagatggggtttcatcatgttggccaggctggtcttgaactcctggcctccagtggtctgcctgccttggcctcccaaagtgctgggattatggatgtgagccaccacacctagtctgattcttcacacagctcagtgataggagatgttttaaaatgaatatattacaagaacataaaatttttctggctctgcctgcccgcatagtctctcaccgtgtatcctgtcatctgcctctttatttcactaaaaatggaccacacagattttcttctcactgccaaggatgatagaagtcctcagccacccagtagttggaactccaactactattcctgtttgggaagcctgggtttcagctggtgtgagaataacatgctgttttaaatcccttcaatttttgtaatacatctgctgttgataagagaaggcaatctccgtggggttgcaggacaggaagcctaagccagtagcactgcctctcctctacctatccccacaggcactcagaggttgatggaagcacaggcattcttgatggggccctcaccacatacaggaagctgttaatattcctagtagatacacattatcgcagcctctgagggtttgctgatcatccacatgctagcaggactcacaggcaccctttggtgatcattcaaggtgtggtacgttttactgaataagtcccttacttcgatcagttttaatgagagcccctaggatttgcagtcagccagctattcatccatccatgctggtccatcctccatgatttatctatagctatcatcggtcatctctctctctttctccatccatccatcaacccatatatctctatgcatctatccatccatctacctgtctatctatctacctgtttgtctattgatcaatccatcatctatcatttatctatcatctatgaatctatctacccatcatctatctatcatctataatctattcatccactcattcatctatcatgtatctatctatccatcatctatatctgtctatttatctagccattcattcatctatttagacatctctctatccattcacccatccacccatatatctctatccctgtctatttatctatctgtctactcacccatctatcctttcatccacctacatatacaaatatgctccatctgtcctccatcatttatttgtacgtgtcatatttattacatctatgtctctattgatatatacatacacatatgtatacatagatgcatactccataatttatttttatccatatcttacctgtctattcatccacccacaacacagatctattcatgcatctctctatctaatcacccactcatccaggtatccatctgtccacctacacacacatatatacatgctccatctatcctccatcatttatttgaatctgtcctatcctatcttatctatttatctatctatccatctatccaactactcactctatctctatcatctatttatctatctatccattcatctatcaatccatctatccatcatatctatctatctatctattcatctatcctatctatctatccacccatagatctccatccacctatctactcacctactcagccacccacctatctatccatgcatccacttacacatacatacatgccccatctatccatccatcatttatttgtatctatcatatttatcacatctatctctctattgatatatacatacacatatgtatacatagatgtatacaccataatttatttttatctatcatatcccatctgtctattcatccacccacaacacagatctatttgtgcatctatctaattagctagtcatctatcgatccatccatccacctacacacacatctatacatgctccatctatcctccgtcatttatttgaatctgtcctatcctctcctctcctctatcctatctatctatctatctatctatctatctatctatctatctatctatccatccatccatccatccaaccactcactctatctctatcatctatctgcctatctttctgtctacatattatctatcatctatctttctttctatcatctctatttatctagctagctatatctacatatgcatctgttcatctgtctatctacctatctttctgtctacatattatctatctatatatctacctacctatcatctctagctagctagctagctctatctatgtatacatctattcttccatcaactataacctgccttgtctctgtgatgtatctattcttccatcatctgtaacctgccttgtctctgcggtgtatctattcttccatcatctgtaacctgccttgcctctgtgatgtctctatctttgtggctatgactttgtcttctcagtgaatgagaaaatttctagttcacgtcattgacagaaactcacaattctatttttctcccttattgtttatcctatcctgttgctcacaaccggatctgaatacaaacttcctctgtaaactaaagaagaacaaaaaaaatgtggctaagtggcactcggattttttagaggaaggagaatatctctgctactttatttttgtgtattagctgattgtttcacgtgaagaatgctcacatggtttttgcaatgtgctggcatatgttgacatattgatgcgtagatgtgtttgtgtgtttggttttaggcaaatggcaccaaggcttgaactgcgactcccgaagtgaccagtgccaccatccatataattatgggtttgactactactatggcatgccgttcactctcgttgacagctgctggccggacccctctcgtaacacggaattagcctttgagagtcagctctggctctgtgtgcagctagttgccattgccatcctcaccctaacctttgggaagctgagcggctgggtctctgttccctggctcctgatcttctccatgattctgtttattttcctcttgggctatgcttggttctccagccacacgtcccctttatactgggactgcctcctcatgcgggggcacgagatcacggagcagcccatgaaggctgaacgagctggatccattatggtgaaggaagcgatttcctttttagaaaggtaagcggaataattacaaattcatgtaataatgataatgatctcttttttaaaaggacctagatagatctgtagggtgattgtagtttataataatctattgtacacttctaaatagctaaaagagaataagtcaaatggctctagaataaagaaaagacaaatatttaaggtgatggacaccccaattacactgatttgaaaaaataaatcatttgtaataattctttacaaattatatgaatgtattaaattgtaacgtgtactcttaaactatgcacatctataatgcattaataaaaataataggggatgatggtattaaaaatattgagttaggaaatggaatattgctaaatggtgtaatagggttagataaaaatatgaagtgtattgaagaccagttggactcttcagttggtacctaaagcggtggtaccttgtttgggctcctgttattaaaatcatggcctctctattggctctgaaatttatatgttgtcagaccatggacgcagaccctagtaacttaaactcacaaattgtttacgttaatttacaatgcatcttgtcatcatgttaacttacaacagggaatatgtacatatacaatatgtatatactatactatatatgtatatatataatatattttataatattttttgtctggttccctgatacatatagataaatatatatatatatctggaaatcagatgaaaaaagtaagttttccattgcattatgttcctgttgttaaaaaacaaaaaaaaagctacttggggaaattaaaatcagaaggcttctctttgagcatgtgatacgtaagggctatttcatgaattggatgaggtaaatggtcaaaggtgattgttataaaaactttatgcatccagaacacaatgactggaaattttcaagggtatctatcctcttgttgttggaccttctttctttaaaaaaagcctgtaaacacattttttcatttgctttttccatattgattgaggcttaatctttaccaatagccattctaggatctggattttcaggatgtaaggtgtcttgtgtactctggtacatagctttgtcctcactctgtagcccaagtgaaggtgataaatatgtagtttggggctggcagcggtggctcagcactctgggaggccgaggagggtggatcatctgagaccagcctgaccaacatagtgaaacgccatctctactaaaaatacatattagctgggaggctgaggcaggagaatcgcttgaatccgggtggcggaggttgcagtgagctgagatcacgccattgcactccagcctgagcaacagagggagactctgtcttaaaaaaaaaaatgttgtctgggagtaataaagccatacttgctctgtagatgcaactgaatgcttggtgtcacttagagcaaatctttctgttccctggtacctttccaaatgtgcagagttctatgaatttttacagacagagcatcaatatgtgcaaattagcaccaaccactctgaaagtatatgataagcaatcctattctcttctgtctgccagttcgtcttcaaacattcccacacagttctccttaggaatttacatgagtacttgaagaacagatcctatggttgagatgtacattgttcaccaaaacctctgtcgagtttcaaaagttccatatgatccacaataacacaatattgaatggaaaaaacaatggtgaagaggaaatataaagacttggacgttgtgacaataagctcatggcttaggttcatgaatgctcaaaactatttttatctggattctcagtgtatgactctcctacagttgctataacaaatcactatagggctgagtccaatggctcatgcctgtaattccagcactttgggaggctgaggtaagcgatcacttaagttctggagattgagaccagccaaagcaacatatgggagccatatttctacaaaaaatacaaaaaaattagttggatatgatggcatgcatcagtagtcacagctactcaggaggctgaggtgggaggattagttgagcctgggaggttgaggctgcagtgagccgtgattgcaccactgcactccagtctgggcaacagagtgaggccctgtcttaaaaaataaaaaaaattaccacaaatgtagtggcctaatgcaacacaaagttattattctgctgttcttgaggtaagaaatccaaaattaaacttgtgggctaaaatcaagatgttggtggggctagttacttctaggggttctaggggagaatctgttttctctttcttctagtttcttgaagctgcctgcattctttagcttgtagggttttgttttctgactcagacccttctgcatctctcttataaaaggacatttctgattccactggacctacccagataacccaggataatcactttgtctcatgatccttaattcattcccatctgcaaaaaccttttaccatgtaatatcacatgttcacaggttttgagaatgaggatgtggatatctttggaatggggcattattcagctgatcactttgaccacgactctttattttggcagcttagtttgggatgcaaactatttaattttaaatatttaatgttcagagctgtgcttcctctgtaggctctaggggaggattcttcctgcccttccccactcctggtggcttcaggcatccctgggcttgtagccgcatcactccagtctctgcttcatctgcatatggccttcccctctgtgtttgtgtctcatcttctgtctcttataacgacaatagtcattggatttagtgcccatcctaattccaggatgagctcatcttcagatccttaattaattacctctgcaaaggtcttgatatccaaataaggtctcattccaggttctgggctttaaaatatatggacttatatttctgggggctactattcaaactactacaattgtatccagtttcttctggaggctctaggggaggatctcttctgcctcctctagctcctggtggctccagatgccccttggctggtggttgcattactccatttccacatggcctcttcttctgtgcttgtgtctcctcttctcctatagggacaacattattggattggggactcatcctaatccagaatgatcacatcttaagtaattaaatctccagaggccccatttccaaataaggtcccattctgaggtttcaagtgaacgtgaattttgaggggtcactgttcaagacaccatgacataagtcttgtttttaaaattcattttttttatttctttatattttgatatctcaccagagcagaaatttcccaacgaatggcatttgtgctgtgtgttttcctgggtagctgaggacttatcattcatgcagatggattatcaaaattaacagcgggtcagcctagttccctgtatcctcatgtgagaacctacagggtgcaaatggcttgccaaggcattcctgtttgtactggcttatggctcgtgaaactcttgatctggctaagaaatgacttccataccactgtctcttgatgtatctcagggtgtgaccctagtttgaggcttcacgagcagtgagaacatccaccaaacagagctggatttgacttttcgcactcgcatgatatgggaggtccgtgttggcttgcagtatattctacagctgtcctggcatctgagaatcaaaggaactgtgatggtgtcacaggactaccaggttcatatgcctgctgcacagtaacataccaatacactgaggcagcagggtttatggcagagaaaggtttaataattgcagggcaattagtgcgaacatgagaggagacctcaaatccatctttttttttttttttgagactgagtatcactctgttgcccaggctggagcgcagtggtgcaatctcagctcactgcaacttctgcctcctgggttcagcgattctcccacctcagcttccccagtagctgggattacaggagcccatcatcatatctggctaatttttgtatttttagtagagataagatttcaccctgttggccaggctggtctcaaactcctaacctcaggtgatccgccatcttcagcctcccaaagtggtgtgattataggcgtgagccactgtgcctgtcctcaaacccatccttccaaggagttctgggctggattttttaggggaatcatggagggtcttggggtcactgatgggttggggtaagagggaatggaatcatcagaatatggaaatggtatgctttggtaagtcagcttctcatagggtccttcagagaagcagacatcagcagtttccctggtatgcacaacctgaaagattattgcaaatggaaaacttaacatttcatgatgttatgttatcatcctgtaacaggatctgtgcgattctagaacaaataggtaccaaacaagtaggaatacatagatgagagggcaagctgacctcaggatcaaagctgagtatgctgcaagcttagttcattttgtttctcccgctcccttcctctctgattgattttatgaagtttatagagatggtttcagtagcattaccaaaggggttagggagcagttgaggtgctgcaggatcatggagtccattctatgcaggatggggcccttgggtggacccactctatcttctgcagcttggagaagaaggaagcaggtcatgtctatgagaagccaaaacaatagttttcacattcatagatattgaaaactcacaagtagtttcattgatgtcttctcaggcacagtaaggaaactttccttctctttttctcctttcttcacgtgcacacacctctccccaccacggacgatttcactggcaccagcaagcatggcttgtatggggataatgtggaagagatggactccatggtgggtaagtcacaggacttaagtggacagaaactaacgtgttctgataggacaggacacctgaaaactgctcttggtcaacctgtagagtgaagagaattatgcctatgggacagagtggtctgagacattaatgaggtaatagttgctagcaattgagaaagtcagcaaaaaaactatatgcatttcctctcctttctttgcatgctgtccacttatcaacttgggtctttgtctacttgactgcgtctccagtgctggccagataacaaatcaaatcttcttttcaaaaatttcaactcttgttttagattcagggagtacatgtgcaggttttttacctgggtgtattacgtgatgctgaggtttaggatatgatcaaacccttcacccggacactaagcatagcacgcaatagttagttttcaacccttcccccactccttccttcacccctctagtagtccccagtatctattgtactgatctgtgtgtccacatatacttgatgttatgctcccacttattttgtttcatttttaaaaataaattttattgtgtattttaagattcacaacgtgacgttaaaagatacgtatagatagtaaaatgattactatagtgaagcaaatagtaatcattaagtaacataatatagtaatattaagtaatagtaatatagtaagcaaatgtatctatcatctcacactgttacttttttgtgacaagatcagctaaaatctatttaacaaaagtccagctgagcacagtggcttccatctgtaatcctggcactttgggaggctgaggcaggaggatcacttgagcctaggagtttgagaccagcctggacaacatagtgagaccctgtctctacaaaaatacaaaaattagctgagtgtggtggcatgtgcctgtagtcccagctacttaggagactgaagcgggaggattgcttgagcccataaattgaggctgtagtgagccatgattgcaccactgcactccatgcactccagtctgggtgacagtagctcccacttataagtgagaacatgcagtatttggttttctatgtctgcattaatttgcataggataatgtccaccaccggcatctatgttgctgcaaaggacatgatcttgttcttttttatggctgtgtaatattccatggtgtatacgtaccacattttctttatccaatccaccattgatgggtgcctaggttgatttatgtctttgctcttgtgaatagtgctgtgatgaacatatgagtgcacatgtctttttttttttttgagacaagatctcactctgtcactcaggcagaagtgcaatgacatgatctcagctcactgaaatctctgcctcctgagctaatgcgattctcctgcctcagcctcctgagtagctggggctatctataggcacatgctactgcgcccggctaatttttgtattttttgtagaggcaaggtttttccatgttacccaggctgctcttgaactcccaagctcaggtaatatgcctgcctcagcctctcaaagtgctgggatgacaggcatgagtcactgcacccagcccacatatctttttgatagaaagagaaatcatattttcagactctttagtgacatagccaaactttatttcaggtctgttgagcaccaatatcttagttggggattgggaattaactggtaagtcagaatccagtaccctcatgaactcatcctgtagagagaacaatgtaaatgggacgtcctaggacttacatggtaaatgtattgattagcaaaatggctttaattttccaacattaatgaaagaaaaccatgagtgaaactcacatatatgcaggacacaaatttaaagtataatattttccagacacagatattgtgaaatatatgtcactaaatagaaagacgctttggaaaattaagcctggaaaaagcaaagccaatttgcatagtcttaaacacataaaaaatatgaagtatttaaaaatataaataatattcaaaccaaatacatgaacatgaatagatgtttatgtaggtataagtgtgtgtgtctgtgtctgtagtgtttgtgtacatatgtatagaaacagatgattgacagagatagatgatggatagatagatgataggtaaatagatgatagatggatagatagatgatggactgatagttgatagatgataggtagatagatagatgatggatgatagatagatgataaatagacgatagatgatcgatagaaagatagatgattgagagatagatacatagataaacagatgatagatgacagagagacagatgatagattgatagattatagatggatacatgaatagaaagatgaataaacagatatatagatgatagatggatagatatatagataagtacatgatacatatgacagatgatagatgacagataagataggtgattgatagataagatagatagatgataggatagattgacagatacgtagatgataggtaggtagatagatgatagatagatacatacatacatacatacatacatacatacatagatacatagatagatagatagctatgcatacccctcttactttctgcctccaccagcactagtccttaaagtttagattcttaatattgcactcaatctcaaaaatcgtggcgatcctatttttgatttgatctttgaaaatcaatgaaataggtcattcaaactcaggctgtgataagtaaaagacattactatttgctttaaaaatttaaattaacaaagctcccaaagtatctaatttaataaacctgatgatgtgtcatagtgttcaaacaaggcactttgggtatgactttaatttcgatgggatttttctggtgacattcagataatattacgcaaacggatgggtgtgttgaatctggttggacaagctgtgatatctgaaaattatattttgaaaaagcgcaactgagatgtacatgatactggtgcccagaggttttgaatgttttgtccacacagccagaatcaagcctttaggaagaataaacatctgctttaatatataattttagcaattctcaagcaaacatatatttaccctgaaattatttatcccagaagctgtaacaataccccaagtcctaagaattgttgcttttcttattagaaaagttgatttgtggccattcctggtagagatatcaccttcctgccttttataattatcataggtggccgggcgcggtggctcacgcctgtaatcccagcactttgggaggccaaggcgggtggataacgagttcaggcaatcaaaaccatcctggttaacactgtgaaaccccgtctctactaaatatacaaacacatccgtggtggcgggcgtctgtagtcccagctactcgggaggctgaggcaggagaatggcgtgaacctgggaggcagagcttgcagtggccgagatcgcgccactgcactccagcctgggcaacggagcgagactccgtctcaaaagaaaaaaaaattatcatgggtttcccacagcagtgccctgaaataatggagtctactgatagaataaacatttattttcattttttaataatttccaccttttattttagattcagggagtacgcatgcaggtttgttacctgggtatattgcatgatgccaagatttgaagtacaatagctcctgtcacccagggagcgagcatggcaaccaatagatagattttcagcccttgtcccccaccttccttctccccttttggagtccccagtgtctattgttcccatctttatgtccatgagtacccaatgtttaactcccacttatgagaacatgtggtagttggttttctttttctgtgttaatttgcttaggacaatagcctccagctgtatccatgttactgcaaaggatgtgattttgttcttttttatggctgtgtagtattccatggtgcatctgtaccacattttctttatccatgtagattggttctatgtctttgctattgtgaatagtatgataatcatgcaagtgcctgtgtctatttggtagaatgatttatttccctttgggtagacacccagtaatggcattgctgggtcagagggtagttctgttttaagttatctgagaaatctccaaagtgctttccacagtggctgagccaatttatattccaaacaatagtatataagtgttgcatcttctctgcagcctcaccagcatctgttcctcttttatttttttgacttattgggttcgtgcaaaagtaactgaggtctttgtcattgaaagtaatgatagattgatagattatagatggatacattgaaagtaatgacaaagacctcaattacttttgcaccaacctaatagtagcctttccagctggtataataaacacttttaaaagtgatacttcctatgggccatgcactgttaccagtgtattctggatgaatccccacaacatccccggagacgagtatcatcttcatcatcatgtttatctccattcacagagaaggaggcaaaagtatgtggcctttggtggctgctcctggagataagccagggttgggctccaaagctcttactccctagctcagctacctcttatgcagggcaaagaagtcatgttgaatgatgaggaaggagagctacattcttctctgaagtctccagtagccccattagactcctacagaccgtcatttcacaggagtcagaaaaactccaaaaacttcccccaacctggcttcctgcttccttcgagcccagcgagaggctttcattggagataccacccttgccccacccaggggaaaatctctgatgccgaatgagtcatgcatttctgcatgggcaagagtccatcagcttggatctgaagagcaggtttctcaagaatgcagataagaaagtaaaatgtgcaaaaatgagtaggagaaatggccttatcagcaggagatgagacaaggatgagggtcttggctgagcctgttgtacagacagttgtgagtggtggaatcccagggcaggcctgtctgtggacagcaacacagcttgggcagcaaccctggacagggcagaactgcaaaggaggctgtaaacatgtatttctatgtcatatatatatataatttatatgaaatatttgagacacatatataaaatataacttaaccctttataatatatatatttatattatttgttatacatattagtattaataatttgaaagttatcatatatatgaatatatattatgtatttctgtagcatataatttctatatttatttatttatttcagttgatgttagaaaggtacgaatcatttccatggttgtaatccctgctactttggaggctgatgtggcaggatcatttaagcccaggagtttgaggctgcagtgagccacgattgcaccactgcactctagcctgggtgacagagcaaaatcctgtctcagaaataatcatttccatggccactatgtaatctctctaaattttaagatataaatagaataattgaatataattgaataatattaagaatacaaacaactcaaagtaatttaatattatttgtaaagaacagaattgcctatgttaaaaaccctagagtttaataaaacacatatcagcacatagatgacatatgatattataataaaattatattacatataatttatattatagttatattacttatatacatcattatattattatgttcatatataatataaacatatcattaatatacaattattagattttaatatattatatggttctatcttatatatatcacaattatgctatgcatattatatattatgtacatgtatacatcagtaccatagaggttttattaaactttctggggtttccaacataggtatgttcactacatttaatgttaagtttgtattttatgtgttaaagtatgtatttaactttaatgttaattgcattagtcaggttatgtacaaaaataagttacataatgacaaaaatattcttatttttctggtattaatgaaatagtttcaatttttacttttaagcataatgttgactgacgctttgaatattttaattcttaatattttgagagacttataagatgtgcattaattagatagtagccaggaaaattcttgcatgctttctagtattacctaactatatatatgtatatgtagttaactatatacatgttatatatcatgctgttgatattatctatattttatatatatctaacaatataacttataaaacatttttattatatacataaatacatatatactacatgttatgtagtatatgtgttctaaagattgatatataatataataaatacatttgtttttgtatagtatatgttagtatagtattagtccaatagtataattagttacatttatatattagctatacataaatatattagctatatataaaaatatattagttatacatatatatgaagtctacagtgtttctctgttgggtatatgcaccaaaattaagaccttttctttttgttaaaaataatgcatttcaagatacaatggatcaccagctactattcattatagctccaatgtcaataactaaaatatttagaaataatttttcaagcagtaaatgagtatctcgaagctgactcatgaaagaaaacttgaatacatggaaaggaagagtggattgtatacatgtattagttatttcaaagttaatattgaaggctaaggtagctctgattagagcattaattactgttctctggggagtggtcattatagaggtgatgatgaaatacacactgaataaactgataggaaataaactttccagaaacatctgatgagaaagtctttggtagaaaacatcaagaaacacttctgtgatcataagaaatgctatcaaaaagataactacaaaaattaaaacgcagaaatacaagatttgacttttagatcaatgaagcagaaaataatagccttagagcaggtctgggaaagagaaggacattacattcggtacaataaagtttttaaatcaaggtggcaggggtgaaaggtgttggggaaagtttgtgttatgagttgacttacatccccccaaaaaggtatgttcaagtcataatccaaggtatgtgagaatgggatcttatttggaaatagggtcgttgcaggtggaatcaagttaagatgaggtcattgggggtgggtcctaatccgatatggtgaattaggatgaggctgctacatgccaaggaaggctaaggactgatgccaactgtctgaagtgaggaagaggtaaggaaaggtcctcccctagaaacttcagagagagagagtgactctgccaacacattgattttgaacatctggcccccagaactgtgaaagaataaatgtttgttgttttaagccacctcatttgtactaatttgtttcagcagcccaaggaaattcacagagttagtttaggaaaaaccattaccaattcaattagcatgcttttccatacacattaaggacattgagtgaaacaaaacaaaaattggaagaagctatagttaaacagtaaatttacatctggatgaggtatagtgttagtaatagcaaaaggttatctgataagtagcatgactaaaggccctatgcaaactgaggaaatattagcaacaacatgacattgttttaactgcttgacaaataaagagttcttataaatcaataatggaaacacataattccttccaaaaatatcagcaaaattttaaacatcttttacagattaaaagtacaaatattagagtggacacaggaggaaactcatgatcattcataatgtaccataatcacctatcaaacattagatactgatgaggaattgagaaaatgaactattattaatgccaaaagttgttcattatggcattttaaattatggcaaagtatgaaaattaaccagaatagtgaacaacagtaaaatggttaaataatttatactacttaaaaataaagtatcataaattgtttaggccaggtgtggtggctcacgcctgtaatcccagcactttgggatgccgaggcaggcagatcacctgaggtcgggagttcgagaccagcctgaccaacatggagaaatcctgtctctactaaaaatacaaaattagctgggtgtggtggcgcatgcctgcagctgaggcaggagaaatgcttgaacctgcgaagcggaggttgcagtgagctgagatcgtgccattgcactccagcctgggtaacaaatgcaaaactccatctcaaaataaaatatatatatatacacatacacacacaacacacacacacacacacacacacacacacacacacacacaatggacacttttccagccattaaattgtacatataattttttaaatttatttttttaattgagacagggtctcactgtgttgacaagggtggtctcaaatacctgagctcaagggatccgccttccttgccctcccaaattgctgggattacaggtgtgagccatgatgcccagtcttgaataattttttaacacgaagattttccgagaaataatattggatgaagaaagcaagttgaaaaccgttcatacaatatcaacccaaatagagagagagagatgcatctacaagagtatgtgatatggtttggctgtgtccccacccaaatctcatcttgaattgtagctcccataattcccacatgttgtgggggggacctggtgggagataattgaatcatggaggcagtttcccccatagtgttctcatggtagtgaataagtctcatgagatctgatggttttataaggggaaactccttttgcttggctctcattctctcatgtctgccaccgtgtaagatgtgcctttcacctcccatcgtgattgtgtgtcctctccagccacgtagaactgtgattccattaaacctctttttctttataagttaccccgtctcaggtatgtctttattagcatcgtgaaaacagactaatacagtatgtaacaattttttttaaatagtcaaatggcaatggggcaggaaattggtggtctttattttcctccttataattttctttatttttttgtatttcccaagctattttgtatttttataatcagaaaaatattagctttgttgttttttcttgctacttttcactatttactgaaaagtagcaagaagagtaaaaacaactcccgtgtccccttcacccatctttcccaattgttagcaatttatcaaatatatcttctctcgcccctcttcctttctcctgatcatcctctttcttcctctctctctctttctctcttccacctccacatgtttcttatgcttctgaatatttgggaataagatgcagatatgatgttcattaaatttagaaactttagtgtgtattttctaaaacaaagacattctcctacatcatcactgcgaatcatcaaaatcgggaaattaacatgggtggattcttaggatttaattcacaaatcccagccaaacttctccagctgtcctcaaaagaaaatttatacacagcaagcaaaaccaatggacaaacaaaaaccaaccaacaaaacccctacttcctctaccctctttctgttctggtccatggattttcttgttgtatctgtttaaactcctctgatctggacaaagactgagcaatctttattctttcttgaattcaaagaccttgacattttctgagaataaagaccgggtatcatctagaatgtcccttgaattgggttggtttgacatttccttcaatggaagtggaagtgatggtgtgttctcaatccagtagacaagtaagtgaattagccccaacaatggttataaaattcttcatctcttgattaaatggtgtcttccagttttctccactgtaaagttacttattttgtcattacttaataatttgagatttttaactattttatgggagatactttgagatgaagccaatattttggttcttatcaaacatttaatgccaggtttagcatccattgatcattttctcttggatgaattttcagtgcgatttttgctaaaagtattgtggtaaatttttaaaagtattttaaaatataaattctttcttaacttgcccttacttgtgtgccttggctctagaagaaaatttctaaggtatagtactttaggaatgttaatgtaatgttatctgagataaccaacagtagaacacatagaattagacacgtttgagactaataagctttttcataattatgcataatacagactgggtttgggaactctaggaatttagctattttcctataaaaatgattggaaatgtggtttattttgaatacattcttcctcttttaacttgcccattgagtctaattctcccaacctagtcatcctattctctatttaaaatatcaaataagaagggaagggaaaatggttaaagaattacttatctaaatcatctgcaagaatatatcaaataaattatgtgaacccaacagtgggagtgtcttattcttgcctctgtctcctcaaattctgtaacaatgtctgccttctgtgagcagagaggttgcataaaccgtgactgccattctgtgcaacatcagtcagaataccactacagtccttcgtttcatatccagtgggaaaaactgtatttctctgtttaatgttttcattctgcatgaaggaaattatcaaggagaatttgtccttttaaatgataccagtagcaactgatgttcatttgtattgccataatatttttttcttaaagcaggtcatcttttatttcttaaaaattttggactctcagttttttgtttttttgttttttgtttttttgagatgagtctcactctgtcacccaggttggagtgcagtggcacgatctgagctctctgcaacctctgcctcccgggtgtaagcaattctctgcctcagccacctgagtagctgggattacaggcctgtgccaccatgcctggctaatttttgtgtttttagtagagacagggtttcatgatcttggccaggctgatcttgaactcctgaccttgtgatccacccacttcagcctcccaaagtgctgggattacaggcatgagccaccgcgcccggcctgactctcagtttttttctctttcaatggtttgtcaatttaaactgttaatgcacatttcttttcttttgtggcttttgacatagggtcacaccatccttgttttcctttagatagctcatgcccatttgacttaggggtgaaatacctcataatgtcattatttttacttgtctcttgtatattattttaggcaagattcttgatgctatcgatgattttggcctaaggaacaacacccttgtctactttacatcagatcacggagggcatttggaagctaggcgagggcatgcccaacttggtggatggaatggaatatacaaaggtgaggagaggaactcatgcaagtgatctggtggtgaataagcttttttgtggttcttataattaaagcccatgacacaaaggaatgaggcctgaaaaactgaacaagtttgtttaatttgactcttagtaaaatgaagtattggaccaaggtcaagaaaattggtcttacatttgttaacatttctgtggaaggaagccatttatgtagagggagcatctagaaatatgcctttctgacaaccctatcaaattatgaggagttagcacaagcagatgcttttatggggtctttaaagaaatatctactcattcattccatttatgagattattgagagattaaatgagggggagtgtgattcctagagaacagagatcagaaaccagggatccttcatcattaagaagtcttcgacactctcttccaaggatatagtacagcatagaaagtagacaagcctgtcttgggtttcatgattaaattcacatatactgattttatgtcctgctgtaacatttagtccacaaaataggtccataagctactacattggccagtctataatgtgtaacctgatgttagaatattatcttcatttgtgaaatgaggattaaaaaaagaaaaagaaaaaagataattatctggaaaatgtcgagtatattttatcatatgtcttgagagagattttaaagtattttctagaggaaaatacgttgttattcatgcaactacagattccacagtcttggattcggtaggaaattataatttctgtatgaatgaggtaaaggctctgcctccatcttgcagagggtatgaatgtgtactctttagagcgtgtagcactaaagtgtgcacttaggacccaaaacaaatccttagtggaaattgttattatagacattctattttaaaaaaaaaattcagtagttttggggttacaggtggtttttggttacacagataagttctttagtggtgatttctgagattttagtgcaccgtcatctgagcatgtactctgttcccaatatgtagtatttttttcctcagcctactcccaatcattccccaaagtcaccagagcccattatatgattcttatgcctttgcattcttgtagcttaactcccacttataagtgaaaacaggctgtttggttttccattcctgagttacttcacttagaataatggcctccagctccatccaagttactgcaaaagatattatttcacttatttttatggctgagtagaattccatggtgtatgtacaccacgttttctttatccacctgttggttgatgggtacttaggcttgttccatatctttgcaattgagaattgcactgctataagcatgcgtgcgcatgttagacattgtatgtttgcttatgggaactgtttttaaaaatttttggctcatgcctgtaatcccagcactttgggaggctgaggcaggcggatcacaaggtcaagagatcgagaccatctggccaacatggtgaaactccatctctactaaaaatacaaaaattagctgggcatagtggcggacacctgtagtcccagctactcaggaggctgaggcaggagaatggcgtgaacccaggaggcggaggttgcagtgagccgcgatagcaccactgcactccagcctggcaacagagcgagactccatctcaaaaaaaaaaaaattaacttttcagcatgccatgacataatgtagattttactctgattaacttaataaaataagagtcaattaacacaggacagtggccacttctcctaatttccccctggaaatcctggtgtatgcctgtcatcttggtataattaagacaactttctgcttttattctcaataataccttgatgtggacaataagttaccatatgtccatagtattccatttgttttcaaggtgcatgaatcaacagtgagcaaaataggcagaaatcctcgtcttcatggagtttatatcctactggagggaggcacagcagaaaataaaataaaataaataaataatatggcatattagaaggtggctgtaaataagaaaaaacacgagagtaaagaattctggggtgggactgccatttcaaataaaatgttcaggcacgcctcattgaggttactgtgagttccataaaattgggggctggatacaagaaaaatattaattaaaaaaaatataggaagttactttgagcaaaggtatgagggaggttggaaatgaagtaggtgtatatttgagataagaacactttaagtagagaaaatagccatgcaaatagaatgtaaatgtccaatattacatatgcttagttatttaatcaaaaacctaccagcagcacaggaaaatataattctgtagacgtgcactacttaccccactaggactctacatagagtagacactatacaaatgtgatctcttttgatactagcttaccttttaaatacattcaatacagtgactattttaactaggcacaataattgaacttaattgcattgtcttataggtggaaaaggcatggggggctgggaaggtggaatccgcgtcccaggaattgtccgatggcctggaaaggtaccagctggacggttgattaaggaacctacaagtttaatggatattttaccaactgtcgcatcagtgtcaggaggaagtctccctcaggacaggtgatgtcatataaactgttaacaagagcttattttcacccttcttccttctcagaagattcagaacaaggagactgactctatcctggcagacccactttttccctagtatctacacagttttaccttcctatatgactgtgtctattcagcatttttcagaagagaccagtcttttctttttttctattgaggtaaaatatacatatataatttaccatctttaccatttttcagtatacagttcagtggtaataaacatacttattttctttttttccccttcattttcctctcatctctcccctctggtcatcactattctactttctatcttcctaagattcactattatttatttttagctcccacactgagtgagaagatgtgatgtttgcctttctctgggcttggcttatttcacttaacataatggccaccagttccattcatgttgctgcaaatgacaggaattccttcttttttagggatgaatagtattcccttgtgcatatataacactttttaaaaagttaatttgtctgccgataggtggttaggttgattctatagcttggctattgtgaagagtgctgcgataaacatggaaatgcagctattcctttgatctgttgatttcttttcttttgggtgtataccaagtagttggatttctggatcacatggtagctctatttttggttttctgaggaacacctcaccacgcaaaacagataaagcaaattacaaccgaaaatagagatggacagatttataaccagaggtcctgaacaagtatcagagaccagtcttagatactaatctaatgcggaccatcttagatactttaacattttcaattgagagaaagatggagacaggaagctttggagatgaagacatggtaggtaaaactcactcatctctataagaaagggaaaaataatcctagtctctggtgtgaaagatctggaagactgagaagaaggtaagatatttgaggatgctttgaactctatcatgaatactttgaatttcttcaagaggagatcgttcatactacattgctccattccctggcagcaaccagcctaggtaggtttgctgctgattgacagttcattgatcacagctctgcaagggaatccagatgggttagaaccgcagctatgtctctcctccaagcccacagagttcttgtaatatttctttcttcacgtaacaaagctaatctatttctgaagaaataggttctgttggcactaatacagaaaagaaaaatattttagaagtcatggttaacttactgaaaaacaaactatcaagaactaatcaagacacatccccaagtttgcctttctaatatttaaaaatttatgtttgatgctagcagatatctctatcaacacactaaggctggaatttattttataattttcgggactgaactttagatgaagacatttttattttctgcctggaaagaagttagtcattgatgatgctaacacaggaaagaaaaaatattttattctttatttttatttattttatttttgagacagagtttcgttctgttgcccaggctggagtgcagtggcacgatctcagctcactgcaacctctgcctcccgggttcaagtaattctcctgcctcagcctctccagtagctgggactacaggcaccggccaccacgcctgggtaatttttgtatgtcttgtagagatgggttttcgccatgttggccaggctggtcttgaactcctgacctcaagtgatcctccctcctcaacctcccaaagtgttgggatttacaggtgtgagccatcatgaccagcccagaaaaaatatttaaaaaaccactgtgaagttattgcaaaaagaacctatcaaaaaactatggagaagcccagctttcctgttctaccatttagaaatagttgttttaagaagtctgtcgttccacatagcccaacagcctgttagggagacggcaaatgtccaggcacaatattgttacgttgcatgagggtggaaggcaactgctgccaagttccagccgttgtcctcacgttaaaaagaagaacgagttgattggagtcactcatcactccagtgcattcggcgccatgagattacatgctcatttggtcaggggtttagggttatgagtttggtgtccttgataagatgtatagtacagctgtcctttcctgcctgcaaccatgactccactagccataggctaagtcttcagaggacgcaccatctttgtagttcaacgggaagtggaagaatatcgcgaagatgactaaggcactgtggtgggagacctaacctcagcttcacgtacaggtcggcgtgccgggtactactcatcaggttgattttttggttattcctatgcttggttctcccaagcctctttatttgaattcatgacttctttggcatgtgcattgaccagttaaatatgtccttgctaatagagaatagctgtactacgtagaagggaacaaacagcaaattcacagtatcaggctcactgtctatgacaccagcatcatgagggcctgtggatacctctctcctgtctgcttcaatccccaacacaatgaaatcaacaagaagaactcaaaagcggctctcacctgtacagaaatgaaggctgctaatactgtaaaagccaaatagttatttatttttagaattaacacaatttgtttcaccacctcatcacacaaaacagataaagcaaattacaaccaaaaatagagatggacagatttataaccagagatcctgaacaagagtgtagaatagacaaaaaagaaaagtaaagataaaacagaggacaccattaatgtgtagaaacacgggaatctgaggatgcaatggtttatcaaagtgttgggaaaaaatgacttatcaggtatgtggtttaccaatacagctgtcccttggtatccatggggggttggtctcaagacctcacgtggataccaaaatacccagatgctcccgtccctgatgtaaaatactgtagtatttgcatattacctacacacatccttttgtatatattaaatcatctctagattactcataatacctaatacaatgtatgtaaatgccacataaaatagttgttatattgtaccctttagggaataatgacgagaaaaagtctgtacatattcagtacaaacaagaccgtccctaaaaggaccataagcctaaatgtaaacccaaaattataacacttctaaataaaacataggagaaaatcattgtaatattcagataagaaaataatttttttagatttatcaaaaaagttgcaagctataaaagaaaaaagtgatagattagtcattatcaaaatttaaaatttctgcttttcaaatgtcaatatcaagtaaataaacatgtgacctcagtccattagtggagaaaaaaagaaaagaaagaaaaaattaaaatattaaatatgaacttaaaagaaagtttaaaagaaaagaaaaagacaagccgtggagtagaagcaaatagtcatccctctgaactcagaggttctgcatctgcgaattcaatcaactgcagatcaaaagtatttcataagattttctagaataaagaatctagaatagcctaaaattttttgaagaagaaaatcatttgaagactcactacataattccaaaatttactataaagctagagtaatcaagtttaaaagagtaatcaggatggtgttctaatgctctaaatttttaaaattgatatttaatattttaatttttttctttttttctttttccccactaatggagtgaggtcacatgtttattttcttgacattgccatttgaaaagcagaagttttacattttgataatggctaatttatctttttttcttttataacttgtgatttttgtgataaaacttaaaaaaaattttcttatcaaaagatcacagtgattttctcctatgttttcacttagaagttttatagttttgggtttacatttaggcttatggtccacattgagttaattttttaatgtggcttgaggtataggctgagatttattttccttgcatttggatatccaatttgtctactgtcatttattgaaagacagtcctatctctactgaattattttgagcatttgttgaaaagcagtatacgtgttggtcaattcctggactctcctatttcattgatccattgaaacccttatttcaacactacactgtctcaattagtctagctttatagtaaatctgggagttatgtagtgagtcttcaaactattttcttcttcaaaaaattttaaaccattctaggatctttattttcccatgtaaattttggaataagtttcttcctttcaacataaacctttctgaaattgtgattgagattgctttaaatctatagatcaatttgcagaaaattgatgtcttaaaaaactttgaattttccaatcaataaatatagttcatttctccatttatttctcttatttggtgctttgtggcttttctcatacaaatttttcacataaaaatgctatccctaaatacttcatgctttctcatgttatagtacatgatactttaaaaagctattcccagctattcattgcaaatatatagacatttttaaaagttgttattgtattgtgtgatcttgctagtcttactcattatttccggcagttttttcagtgataattaacataggaaatcattgtatctgatagtaaatatagttttatttcttttaagatcctttttaggcatggcacggtggctcacacctgtattcccagcactttgggaggccaaggcagataggtcacctgaggtcaggagtttgagaccagcctgaccaacatggtgaaaccccgtctctactgaaaatacaaaattagccaggcatggtggcacacgcctgtaatcgcagctactcaggaggctgaggcaggagaattgcttgaacctgggagatggaggttgcattgagccgagatcgtgccgttgcactccagcctgggcaacaagagcaaaactctgtctccaagaaagaaaaaaaaatcctggctgggcgcggtggctcacgcttataatcccagcactttgagaggccgaggtgggtggatcccctgaggttgggagttcaagaccagcctgactgacatggagaaaccccatctctactaaaaatacaaaattagctgggtgtggcggcacatgcttgtaatcccagctacttggaaggctgagacaggagaatcccttgaacccgggaagcagaggttgcggtgagcagagatcacaccactgcccctcagcctgggaaacaagagtgaaactccatctcaaaaaaaataaaagagaaaaatccttatctgggatgtattattatgtgtcccattacaaagcaggttttattattattgctttctaatacaaggcataagatatattttctaatataaatttttaaaattcattttagtttagattcagggtcccatgtgcaggtttgttatttggatatattgtgtgatgctgaggtttctattaaattcatcacccaagcagtgaacatagcgcccaacgggtagtttttcaacccttccctcctccctccctcctgcttttcggagccccccagtgtctaatgttcccatcttcatgttcatgtgtacccagtgtttagctcccatttgtaagtgagaacatggtgattggttttctgtttgtgcgttcatttactccatttctcatataaaattagaagtatatgactttttagtgattacataaaattttttcaaagggtagcaatataattgcaaatgaagttcagatttatgaaattgccataaattgctgagctgtggagagctctgtgtcgcagccaaggctgtctgatcttttcgcctttggggcatgcattgtcacattcctcggcctcatcatttcaggatcagaacttagctttcttctcttgtccactggagtgtaatctcccagagagcatgcatgagttttcctaaagactcagtacgctgtcctctggacctgaggcatgacgcagtcttcaccaagtacccttcaggtagcttgggacccaacgtcccttctcctcattttccttatctgcactgtctgtgtctctgcagggtcattgacggccgagacctcatgcccttgctgcagggcaacgtcaggcactcggagcatgaatttcttttccactactgtggctcctacctgcacgccgtgcggtggatccccaaggacgacagtgagtgctcaacccgttgcttcctgttccctgccaggagcagggtcactcaggtgtatcctgaacgcattcttcctttcctctctagaccggtcctttcattccagggctcactgaacacatggttttggagaagtttctcagaattgctcttctgcagaaaggcaggtgggggtaatggagatgctaattggcttcacttaattatctcagcagtcgcacatacattaaaacatcacattgtgcatggaaaatctatgcaatttttacttatcgattacactttaataaagaaaacagatgtatgaacataagatttgcctataaagttagagagacacttttacgaaacatacatttttagtcaggtgtggtggatcacgcctgtaatcccagaactttgggaggccgaggcgggcagatcacttgaggtcaggaatttgagaccagcctggcaaacatggcaaagccctgtctctactaagaaatacaaaaattagccaggcatggtggtgcacacctgtagtcccagctacttgggaggctgaggcggtagaatcacttgaacccaggaggcagaggttgcagtgagctgagatcacaccattgcactccagcctggaagacagagtgagactccatctcaaacaaaaacaaaaccaaaaaatatatatacatttttagaaacaggactgatatctgctggaaaatgtgtatatcatttcaccagggaactctaatgttctcgttttgttgtaaggattgcataatatttagcattgacgtgtgggcaaaaagaagcccaagaaccagccttgagaagacggaagaagacaagagaagccagcaccttgggtgcatgcctctgatgtgctttctttctttcttttttttttttttggagataaaaaaatatgtattgaatatcttctatgggcaggttattttgtaggcataagtggtcatggctaaactttcatttataaaaatcaattctaggcagactaaagataaaatgtaagattaaaagtgttagaagaaaatgagtttatgacccagaaattggaagttttttaaatttttaaaaagtggcacacatataataatatgcacacattgcacatgaaaattggggatatctagtgatattttgagataggcaatgcatagtgatcagattagaataattggcacatccatcatctcaaacatgcataatttctttgtgttgggaacattgaatatcctccttctagctatttgtaactatgtaacatattattgttaactatagttattctacagtgtttagaacaggagtccccaacttttttggcaccagggaccagttttgtaaaagataatttttctgcagactggggtgggggatggttttgggatgattcaaatgcatgacatttattgtgcactttatttctatcattattatattgtattacataatgaaataattctacaactcatcatcatgtagaatcagtgggagccctgagcttgctttcctgcaactagatggtcccatctgggggtgatgggagacagtgacagatcatcaggcattagattctcatacgtagcctgcaacccagatccctcgcatgcacagttcacaataggtctcgtgctcttatgagaatctgatgcagccactgatatctgacaggaggaagagctcaggcaataatgccaacgatagggaatggctgtaaatacagagataaagcttcgctctctcccccaaccactcacctcctgtgtgtgaccaggttcttaacaggccacgaacaggtaccagtttgtggcctggggactggggacccctgctatagaacactaggacttcttcctttgatctggctgaagtgcgcatcatttgacgagtctctcttttctcctccaggtgggtcagtttggaaggctcactatgtgaccccggtattccagccaccagcttctggtggctgctatgtcacctcattatgcagatgtttcggagaacaggttacctaccacaacccccctctgctcttcgatctctccagggacccctcagagtccacacccctgacacctgccacagagcccctccatgattttgtgattaaaaaggtggccaacgccctgaaggaacaccaggaaaccatcgtgcctgtgacctaccaactctcagaactgaatcagggcaggacgtggctgaagccttgctgtggggtgttcccattttgtctgtgtgacaaggaagaggaagtctctcagcctcggggtcctaacgagaagagataattacaatcaggctaccagaggaagcctttggtcctaacgagaagagataattacaatcaggctaccaaaggaagcactaactttggtgctttcaagttggcaaggagtgcatttaatagtcaataaattcatctaccattccagattattaaaggcccactggttgttccact

SEQ ID NO: 851 - DNA, 72497 bp, Homo sapiens
tcagaaaagactcagaatccttgacgcagttgcccgaacccggagctaagttacccgcagggccattggaagccctccctggctttaggtttctcctccagtggaaccggtgagtcctctgcagctctggaccttccatttggttgatggtccttggttcattctgagctgtttttctacctcctttttatttttctcctaggaagttgttgtataggatcctactttaggtttggtggtgcattctaaatggtcttctccactgcccttttccccccaaattaatgtcgattggcctgtgagtacatttgcgtgagagactgaactgccacttttgtggcataattttgaattgccaaacgagaggctgacctcctcagcttggaaaagaaagggagttttgctcctcctagccaaaaaccacccctgggtggtaggggttgagtgggagtctctgggggattgactcctgccatgatgtgcagtgaccctacagggaaccacacaacaaaattaattttaagaggctcatccaggagacaggtgtaagagctgatcacttgctatgttgagccctgtcagaggtctagacctctggagagagaaactcagacacgtgaaagggtagaaagactcagtggtgacacacagtgtagtccctctcacagccagcacacttcaatccaccctactaaaacccaggccacagtttagttcctcattttaaaataaaagtgggagacatagcatgtaaggatgaggaaaggcggagagagcgacccccatttgggcaccccttttggttctctggttcctctacttgcaagtatttgtgtaagcgggaaaagcttgagggcatgccaggtcaaacaagaagcttcctgttacatattatgtctgtgcttgttcacactttaaactgctgcacacattacaccagagaaaattccagcccaaaggtcaacctgcaaccaatcagttcctaagtcctctattttgctattttcttttctgcctactttaaatcttctgtttactttttgttcttttcttttcttttctttttctttttttttttttttgagacagagtcttgctctgtcacccaggctggagtgcaatggcgctatctactgcagcctctgccttccaggttcaagcgattctcctgcctcagcctccccagtagctgggattacagacgtgcgccaccacgtctacgtaatttttgtatttttagtggagacaggctctcaccatgttgaccaggctggtctcgaactcccgacctcaagtgatccgccggcctcggcctcccaaagtgctgggattacaggcgtgaaccaccactcctggcccttctgttacttttccactgctgttgagatagaagtcactgttgggatccaacctttttgtttgtataaactggtgagtttgtgttgatatctcttgctagagttctgaagtaaaagctataggatctttgtgtgagtgtgcatgcgtatttagatgtgtttatgtacatgcacatatgtgtgcacatatacattttttacgtgctttagccctgaagtgtcaaattggcttcaagtcaaagagtactcataaattaaataataagccaaaacgcttttcaagttcacgtgacttacataaatctttaataaataagctggctttaaaattattggtacgatagtattagaaatatcttaaaaattgtcagcatacatgtttgtttgcatttactgatcaagcagtttcatatttacctctgacagatattataaggtgtcaaaatttggcataaggcttacaaaactataaacccagcaacccagcatgaaacacaataatctttgtttctgtactttttgagaaataagacgtttaatgttattagtgtagtaaaaagagctaaatcccaagttatcagtaaaatatatatatatttaaaatttttgcttaggcaaacacagaaaattcatagactataaaaatggttaacagggaaataactttaaatgatgactatcagagttttcacagataatctaggtaaaagattttataaaattaattaggtaaatgtaatgaaacaaatgcctgtaaataaatataatttagaatctaaagttaaataatagatattcactaaatgtctgggccattttcaatttaaataaattgtattatagaaaaacttttctaaaaaatatgttcttattcaaagctaagttattttcatctaattccatgtttatttatttatattttttgagatggagcctcgctctgtctcccaggctggagtgcaatggtgcagtctcagctcactgcaacctctgcctcccaggttcaagcgattctcctgcctcagcctcccttgtagctgggattacaggtgcccaccaccatgcctggctaatttttgtaattttagtagagataggggtcttgccatgttggccaggctggtctcgaactcctaacctcaggtgatccacccacctaagcctcccaaagtgctgggataacaggtgcaagccaccgcacccggccagattctaggtttatttaagggttatttatgaaatatggtaaaaggaaccaagaaacaagagatgtaaagaaagttaggctgcgtgcattgggtcacacctgtaatcccagcactttgggaggctgaggcaggcggatcatgaggtcaggagtttgagaccagcctgaccaacacagtgaaaccccacctctactaaaaatataaaaattagtcaggcatggtggcatgtgcctgtaatcccagctactcaggaggctgaggtaggagaattgcttgcacccgggaggcagaggttgcagtgagccaagatcgtgccactgcactccaggctgggtgacagagcgagactactccatctcaaaaaaaaagaagaagaaagttacaaggaggtatttttggtaagaaatgttaaaagaaaaataattttgtatgagaaagaatcttgttgtttaagagagatgtttaggacagaacagaaaatccaagcaggttgtatatggtctgtgcaagtcataatacagtctgtaaaaaaggaattcaaaaaaatttttatgtaattaagtttgctataactaaaaggaaattataatcattctaggtattggacttcaataataaaaatacagtaatgcaaaaggagatcattggttagaacaagattttcttaaaatactgatgtactcagtgaaattgcaagaagttttttatttttgaattccataatctcttcttgaaattcttcagatggacatcctaggggttccacttctgctgcatcctgcttgcctcagagctttccctcttttgaaaaggcctgggatggtaactctctccttcaacttttgctggctcccgtaattttttaaaaattaatagtctaaaggaagagagagaatttttgaaaacaggcaagtgaaaaatgttataggatgtgcctctatctgtgtgtctgtctataagtttatttattgtctgtttgtttgattgatttgtttattttggagacagggtctcactctgtcacccaggctggagcgcagtggtgtgatcttggttcactgttcccttgagcactgggctcaagggatcctcctgcctcacctcagccatccatgtagctggaaccacaggtgcatactatctcgcccagctaattttttgtattttttatgtagagatggggttttgccatgttggccaggctggtctcagtcctgagctcaagcgatccacccgtcttggcctcctaaagtgctaggattacaggcgtgtggcaccatgcctggccttgtctgtaagtttctatctgtcatgaggaagtaatatttcagtaccaaattatatgaaagagctctaatcaaatggcttaaagaaaagtaagtgcttatcagacaaccaaaagctagctcagatgcttttaattgacattcctttagtaatctttggtaagactaatttggtaaatttaatttcaaaatcctgtccagtggtttaaaatcttagagtcacgttagatgggactgttcccctgaccttgacccccttcgtgggcaggaactggagtggctcatgttactcagcctgcagtttgtggacagctatgtgttaacagctcagtgaagggtcaaggtgacagccttctgcatctgtccttttggacaccgacttcttgtttggtgtccaagaatcatcaggtcacacaaactgaaagatgatgaatgtggaggactttattgagcagtggaagtggctcttggtggaagaggagctggaaaggggatggtgtgtgaagaaggtgatgtttctctgaagcctagccttctctggctgggctcccctccaaaaccacaccgtctgaagttagtcatgtttatctgtagtctccaatgctcagttacttctctgctcgccactcagtagcttgtatccctgccggtcagctgcttgtgttgcttttttctttttctttttcgtttttcttcctgccagctggtctggtccttatgggcacaggatagggggcagggcaggccaaaaaggcaatcatctgggcagagaaacgaggtcagctgctttcactagggccgagcttccagacttgaggttgtagtttagccgggagcccagccatcctgtatcaatgttagattaaattaggcaatcctaggttttgcactggaaattagggttactgggagttggaatagtaggagagtaagatgtatttttggtgaggtttataaaaacacaaagatgtggtttttgccaaagaaaatgtaatgtttagaggctatttaaaggtcactttaaaataaatggaaaattatgtagataaaactcattggagaaagagaaaaataaagaggtggggaatgagaaacctttgacttttgggtggccacgtggtcacacatggtaatgaagtggcatcattttctggggtaaatacccgagattcattgtctcatggccacagaaatcgaggacgtggacacacagaatgaggttgagagcagaagtttagtaggcaaaagaaagagaagagctctctgcagcagagcggggtcctggagaagtgggttgctgcttctttgctgaaatgcagcaagttttatagatgagcttgaggaggcagtgtatgatttacataggacgcaaaagattggttggaccaggtgtaccattttcatagggcatgtaaagctggttaggactagatgtgtcatttgcatagggcatgaaaagctgggctaatcttttttttttttttttttgagatagaattttgctcttgttgcccaggctggagtgcaatggcgccatctcggctcactgcaacctccacctcccgggttcaagtgattctcctgcctcagcctcctgagtagctgggattacaggtgcctgccaccacacctggctgatttcgtacttttagtacagatggggtttctccatgttggtcaggctggtctcaaactcctgacctcaggtgatctgcccacctcggtgcctaatcttttattatgcagatggactctttacctggctagtgccatgtcgcctgttttttttgtttgttttgttttgttttgttttttgagacggagtttcactcattttgcccaggctggggtgcagtggcgtgatcttggcctaatgcaacctctgcctcccgagttcaagcaattctcctgcctcagcctcctgagtagctgggattacaggcatgtgccaccacgcctggctaatttttgtatttttttaagtagagacggggtttcaccatgttggccaggctggtctcgaactcctaacctcagatgatccgcccgcctcggcctcccagagtgctgagattacaggcgtgagccactgcgcctggcctctggttttttactgtacacgtggtgacaaagaaaagggaagacggagcctccatgttgaacatacctggcttccaggtagccctttcccattggcacagctgccagcatttacccattcaagcttccagcttgcttattatctatgcctgcagctctattttccaggctgctctttgttaaaaagaaatgatttgggggctcctttttaaaaagggaaattctgccaaggactcttttaccctcactatctgcctgaataatttctttctagttcctctatcagtaaggagatgcagctggcttgtcttcagtcactaaaggtcaaagccaccagaggaatttagagatggatcctactcatagtcccagggaatttcgttcactggatatatagcaaatgcaaattaataaggaaaaagtgaactattcaatcccttgcttactgcctctgtagttgctaaaatgaaagtaaaagagtgctgccttgggcgtgaaggcagcaccaagctcagatgtgggtctgtctcagatcaggccagtgacctcaaagcttcctacacaaggaaaaattaagccacgtcaaccaaaagttacctctgagacctgtgattaccaagaagatagacatgtggaggaagggcaaaaccaagtaactattaaacccagagggtatttacagggctgttcaatcttttggcttccctgggccacactggaagaaaaattgtcttgggccatgcataaaatacacaaacactaatgatagctgatgagaaaaaaaaaaggcaagaaaatgtcgtaacattttcagaaagtttacacatttgtgttgggccacattcaaagctgtcctaagccacgtgcggcccgcgggccgtggattggacaagcttgaaaaggaattggttcatcttctagattggtatcgtcagcttcctgagttcccttttctaaaatgggttgtaagaatgactactttaagaacagtatgtttaatttttttttttttgagaaagggtctcattctgtcacccagactggagtgcagtggcatgatctcagctcatcgcaacctccacctcctgggttcaagtaattctcccacctcagcctcctgagaagctgggattacaggcacacgccaccatgcccggctaatttttctattttttggtagagatggaatttcaccatgttggccagactactcttgaactcctgacctcaggtgatctgcccaccttggcctcccaaagtgctgggattacaggcgtgatccactctgcccaccgatatgcttaatttttaaatgccacagaaagaaagagcatgtttgggctggtgcagggcccgcagctcactcactattaaacacttgctgatgagtgtatgggacccagatgcacaggaagtttttcctgaggaaatggccagcctggtggactaggtaaacaccactacaaggtctgtttatcctgaaaaggggactgcccagccctccctataaaatgccaagtggagcaccctagataaagcagctgatgtgcttcatatgcaagccatgtgggattggcttaatgatgaccgggatattcaccagctgaatatgcccattacccaatgtattagtccgttttcatgctgctgataaagacatacccgagattgggcaatttacaaaagaaagaggggtaattagacttacagttccacgtggtgggggaagcctcacgatcatggtggagggcagggaggaacaagtcacatcttacatggatggtggcaggcaaagaaagagagccaagcgaaaggagtttctccttgtaaaaccatcagatctcgtgagactcattcactaccacaagaataatatggaggaaactgccaccagaattcaattatctcccaccaggtccctcccacaacaatgggaattatgggagatacaattcaagatgagctttgggtgtggacacagtcaaactatatcaccgaggtcatagtgtgaaaggaaaataaatctcaggaccccaaaatcactaagccaagggaaaagtcaagctgggaactgtgtcaggcaagcctgcctcccatttgattcttaaataagacagctacaaagataagaagctacatacccccctcacaatttgtgcttaaggaaattccttgtggacaaaggacagacggaactcaaagtcatccttccaaggctcccctgagacaaatgcttatctgataacttcctctgcctcattgcttatgtaaaagtacagattcacggagccagcctaaattgtgtattcagtggaaagctgatcaaggactcaaaagaatgtaaccttttgtctcgtgtctacttctaatctgaaagctcccacttcaagttgtcctgaattactgaactgagcccatgtatgtcttacacatattgattgatgtctcatgtctccctaaaatatataaaagcaagctgtgccctgaacaccttgggcacatgtcgtcaggacttcctgaggctgtgtcacaggtgcacgttctcaaccttggtaaaataaactttctaaattgactgagacctgtctcagatattttgggttcgcaatagattctcagtgtattaatgatgttaggtgaagaactgtgaagctcataaatttggaaaggaaaggtttatttctataaatgttgtggttcaagggtccccttctacaagagcaccccaggtgacattactcttgcagaatcaaacaatggtttgagaaaccttatcaaatttgcagttgtagctttccctcatgggtcttacagatgctaccaaaagactagggtgtcaacgagaagagacaaactgtaaatttttttaagaggtttattctgagccaaatatgagtgaccatggccgcccgtgacgcagacttcaggagatcctgagaacatgcgcccaatgtggtctgcgtacagcttggttttctacattttagggagacatgagatatcgatcaatacatgtaagacgtacattgtttccattcaaaaaaggtgagataactcaaagtgggggattccagctcatggatggacaagacacagaaggttgcattcttttcggtctttgatcagaatacacaatttacatgtgacggaggttggggggtgggggtggtgggtagaggaatagtgactgatgcctgttcagtgaatctgcaagtttgcgtaaacaatagggcaggggaatctatcagatatgcatttgtctcaggtgagcagagagggctgactttcacttctgtctctcctttgacccacacctgtgaagataagccaaggtgaaattgaacagaactgttttagggtaaagatcttgaggtccacaaaaaatttctttgtgggcaaattatgaaagaggtatgtagctttttgttttgttttgtttgtttgtttgtttgtttttgtctccatagctgtcttatttaggagaaaatgggaggcaggtttttctgatgcagttcccagcttgccttttccccttggcttggggattttggtttcctttcactaattaacaaacaaaattaataaattaacaaacaaaaacagggaagggaaaagtgagtcaaagggctcatgccagaagggtggaaatctttagataattattttgttattattattaatttttctttttttgagatggagtttcgctcttgttgcccaggctgacatgcaatggtgccatcttggctcactgcaaccccacctcccaggttcaagtgattctcctgcctcaacctcctgagtagctgggattacaggcacctgccaccacgcccagctaatttttttgtatttttagtagagacgaagtttcacaatgttgggcaggctggaatctttagataattgttaagaaataaaagaaaaggaaaattgatggagttaaaacaaaagactttacaacatgatcaaaggttgggtgggccacagggagccccaactggtcccccaacatgaaggggccccatgccagttttcttcatttgcctcagattggagaagtttaagaaaaattgaggctgggcatggtggctcaagcctgtaatcccagaactttgggaggccaaggcaggcggatcatctgaggtcaggagttcgagaccaggctggccaacatggtgaaaccccgtctctactaaaaatacagaaaaatttgctgggcgtcgtggcacgcacctgtaatcccagctactcaggaggctgaggcaggagaatcgcttgaacccaggaggcagaggttgcagtgagcagagatcatgccattgcactccagcctgggcaacaagagcgaaactctgtctcaaaaaaaaaaaaaaaaagttttagagcaggaatgaaaagaaggaaagtacacttggaagatggccaagtagctgacctaagagatcaagtgtatggttgacctttagacttggggttttataggttggcatgcttctggagtcttgtgtcccttctccgctgagtcttcccttggggttgggctgtccacatgcacagtggcctgccagcacttgggaggggagcatgcgcagtgtgtttactggagttggacgcatgctcacttgaggcgttcttcccttaccagctgaatgttcctagaaggttatagaccagttaaactccaccgttttgcttctcagtgtgcatgcttgagcccactcactcacctcctgagatcgtattgggaaactgctgaccaccagttttaggtgttttctatttactgggagacggcctttccctggtgctgactgtgaccaattattattttagagagacagtttaataaccgcctgatgctcgcctgacattcctggtggggctggggagagcctttcctgccttgctcatgcctgactagctacctactgtaacaataactgaactctttctaccgatttccagtgagaaaatctatgcatctatctatgacctgcaagcccccactttgaagtgtgtcacctttcctggctgaaccaatgtccatcttacatgtattgaggggtgtcttatgtctccctaaaatgcataaagccaatctgtaactcaacaaccctgagcacatgttctcaggatctcctgagggctgtgctatgggccagtagtcactcatatttggctcagaataaatatcttagaatagtttacagagtttgacccttttcatcagcagaggcatacactcttgctatgggatgttaaccgaagctaatggaaataatggtgtccaaaagagttccgtgatgaaacgtaaatggttcatgtaggacctgctacctggggaatgcaaagataatatacaaggagggagcttctttttcctcttcagactgactctgtaactgtgagaagatttttgccttccaaagttattagtgtgttcatttttatctcttaggaaaaaagtggcaaagttggagatggtgtacactttcctttattgcttgactgaggttaaaaatttggccaggcatggtggctcactcctgtaatcatagcattttgagagcccaaggccaaggatagcttgagccaagaagttcaagaccagcctgggcagcatagcgagaccttgtctctacaaaaaataaaaaaattagctgggtgtggtggtgaacacctgtaatcacatctacttggggggctgaggtgggaggattgcttgagctcaggagctggaggttgcagtgagccaagattataccactgcactccagcctgggcaaccaagcgagatgctgtctcaaaacaacaacaacaacaaaaagaacaacaaaaaacaaaaaaaaacttgtattctattgtctcccatcagattatttttaactaattttattttaatcacttactgttgagtcacctctgagattttctattccagtggcgtccttataaaatgaagcttccttgtcaactgcacttgttataacaccgagcttctgctaagaaaaagcaaatgcataactctgtataacctatctcccatgacagggtctatgcctcgctgtatttaagcattcattttagttttcagcaatgtagtactttcacctatattttgtcaaattcaaacacttgcaatacttcatttattttttctgcatgtccttcatattttggctttgctagtccactttggccaaaaagctttgattctttaagtataggcctaaatatcctatcttaagcatgggtgtaattttcttctattaccaacagaggttcttttatagtttttgaaatcactgattaaaaagaaacagctcaaattatattctactgtaaaaatgatacattcagcctgggcacggtcagtcacatctgtaatcacaatacgttgggaggctgaggcaggaggatcacttgagtccaggagttgaggctgcagtgagctgtgatcacaccactgcactctagtgtgggtgacagtgagaccctgtctcaaaaaaaaaaaaaaaaagatacattcaaagaagtcaaaataaaacagtataaaacctatctccctgattgcagctacctttttttatgcatacgcctgcaatccttttacacctatcacacactaaaaatgttttacagttattgttattgcacacagaaggcatctaggaatgttttaaagaacctgtctctctgaagttcatcctgcttatctaacttgtctatcaaggaaattattttcttgattattattgctgagaaagactgggtgaggttgctaccccagaattagcagatgcaaatcaggaggaagtgaacaggctgcaaattagcaagttctggcatggggtgaggcaatggcagaaaatcggtttcctgggaaccatgcccaggaactagcctgacattgtgagaaagctcccaacattcataatgagttgcatattaaattccagggaagggcactgtaggtaagatggaccacatttggaaatacactttttcagacgttttatttagggagaatttctgacatgtcctccgataatttgaacttccttgatttgcagttgtacattgagagatcatttcttggtcaaaataaatgttcagcaggtgtgaatgctgtatccacaacttttttttttttttttttttgagacagtctcactctgttgcccggggtgaagtacagtggtgtgatctcagctcactgcaaactctgcctcccaaattcaagcaattctagtgcctcagcctcccgagtagctgggattacaggcatgtgccaccatgcctggctaattacaacttaatttttaaatttgggcagatttacaaaactatcaagctattaccctgcagcatccttagccctaagcttgtcactacttgtaatgtatttttattttatttatttattttttgagacagagtttcactcttgtcgcccaggctggggtgcagtggcatgattgcggctcactgcaacctccacctcctgagttcaagcgattctcttgcctcagccttccggaccacaggtgcatgccaccacgcctgggtaattttttttttttttttttttgaggtggagtttcgttcttgtcattcaggctagagtgcaatggtgtgatcttggtttactgcaacctccacctcccaggttcaagcgattttcctgcctcagcctcccaagtagctgggattacaggtgcccaccaccacacccggctaatttttgtatttttagtagagacagggtttcaccatgttggccaggctggtcttgaactcctgacctcaggtgatccacctgcctcggccttccaaagtgctgggattacaggcatgagccactgcacccagcctacctactggactttttttcggagacacactgtagtttctcaagaaagaatgcctgttcctggtcccagctgcacactcactttacagtgtgtgctgtacttggtcaagtgtattgatattgaaacacaagccagactggatggaccttggtcataaatcatggggcagctctccttcactgtcagataaaatccaaattctctattactacctccaaggtcccagcattgacgatctgttcttttcttcctgaagggacatcacccccggttctcagggtgtctcctcacaggcttcttacaaatgcctttcctcaggaatgtggctccacaatgacttttttttaattaaaaaatttgcagcctacaatcagcctcctcaattattattattattattaattgttattatcattacttgaaacagggggagagtctcactatgtggtccagactggtttcaaactccttgtctcaaaccatcgtcttgccttgacctcccacagtactgggatgacaggtgtgagcccccgcacctaagtgtcctcttaaaacccatgaagtcttttagggctgtctacttttctctatggaattcaaatcgctaagcattcatgaaagtttagataaggtggaaataaatccaacctttaggatggatgcatgaaactgctctcttttttttttttttggtagagttttgctgttgttgcccaggctggagtgcaacggcacgatctcggctcactgcaatctccgcctcccaggttcaagcgattctcctgcctcagcctcccgagtagctaggattacaggcatgtgccactacgcctggctaatattttttgtatttagtagagacagggtttcaccatattggtgggctggtcttgaactcctgacctcaggcgatctacccacttcagcctcccaaaagtgctgggattacaggcatgagccaccacatccagccaaaactgcacttaaaatccaatctttggccgggcgcagtgactcatgcctgtaatcccagcactttgggaggccaagacgggcagatcacctgaggtcaggagttcgagaccagcctgaacaacatggagaaaccccgtctctactaaaaatacataattagccgagcatggtggcacatgcctgtaatcccagctactcggaaggctgaggcaagagtatcacttgaacctgggaggcggaggttgcagtgagcccagatcgcgccactgcactccagcctgggcaacaagagcaaaactccatttcaaaaaaaaaaaaaaaaaaaaaaatctaatattgtccccaattcctacttttgggagtaaactatgcctatttcaaactattgctggacaagattgcctggtttctgcttccccttatccctcttgttcaagtcaaccagtcaggaaatataaagaatgatcaaggaaacctccaagttaacacagaaatacgtatatatggtgaatgctgtctgcagacagcttatggccccatggtactagccgtcatagcacatggcaaagttgtcctattgactctgctgtcagcccctgcgtggaagaccaaataaaggtgctgggacagaaggatgaaaaggaatcctaggataaatatctcatcttcatcgtccctgggttggataattctgagggtctgtcgttgaatctcagtgtttctgcacagcactcagcttcaatagcccagtggcaagctgcttcataagtacaacctctactggcttcctgcctttccctgtctctcttcctctttccctgaccaatgctccctcaattacctccctaataacctacttggatttaaggtttgaaaaagaaatgcggcatcattctttttgtcttaaatttttaattaaaaaaaatttttttcgagatgggatcttgctctgttgcccgggctgtagaacagtggtggaattacgatacggctcattgcagcctcaaaccctttagctgaagcaatcctcccacctcagcctcctgagtaactgggaccacaggtgtgtgccaccgtgcctggataatttttgtaaaatattttttgtagagacagggtctcactagttgcccaggctggtctcaaactcccaggctcaatcaatctgcctgtctcaacctctcaaggtgttgggattacaggcgtgagccactgcgccgggtcgcaccatcattcctattttttttttttttttttggaaatgaagttccctctgtcacccaggctggagcacagtggcgctatctcggctcactgcaacctctgcctcccgggttcaagtgattctcctgtctcagcctcctgagtagttgggattacagtcatgtgccaccacacctggctaatttttatatttttagtagagacggcgtttcgccctgttggccaggctggtctcgaactcctgggctcaagccatctgcttgcctcaactcccaaagtggtgagattccaggcatgagccaccactcctggacgaagcatcattcttaatttcaatgtctagtctagacatttaaaagaattgaacatattggatcgtatcaaaacaacatcttgttgaagagaatgaccctctccacccaacctgaaacagatggaggcagtgctgactttatctcaatcttaaacaaaatctgtttcactcaattttcttgtagacaggccgactgctttattagaaaacaggagaacattgacctttttctatgattctcttccgatcaccctaggtagaattcctttcactttctaacctgtgtctgtttcaacccaggatacattaagcttgttgtctgtgacactttattgaactttttaatagccacgactgacactgatcctctctgctgagagaggagctattctgattccattcattgtgactccaaagtctaccctggaagtcagatgctcaggtgggattttataaatattccatgaacaaatgaacttcggctttggggtaaaagagtcggttgcccatcatttgatagatccctggatattttttcataaaaaacaccctagcaggttgcttattgcaaaatgacatgtgtcatatcttctctggagctgaatattgttaagcaaaatttatattaatgagaagcaaaaaaaagtttgtttgttttgctttgcttcagcaagaattatctgttgcatcagaaatgcagggagcacttttgctctttattagcgtttttttccccagaaactctgacattactaggacacttggtcatctgtgatctgcttaaaagctctcttcagctcctggaagagtaggtggttctgattctctttcggtgagatggtttatggagccctcttcatcccataattctgaagagtaacaggcagaacgtcttattagggggcagctgaaatcgtctagggaatgtggctagggagtgtcgtcatctttacatcaaaggctatgcacagataacacgccaatcctgatttcacccatgagaaaagtgaactccaagaatttcaggaatgtagacgtgtcgatgataaacattgcatttattacaatttcactttatttcctagaagaggggacattatatttcctggccagatgctaccctttgaaagaaatgcaaactttgataaaatagacatgctatcaatttccttaggggagctttatcttcactgggtcactatacccagcatgacagtaaagtctgccatgtgtttcttgtcccactggaaaaaaatacatagaaaagctatgtacaaggactgtattaagattcatctatgtctttcagagatggcaggcaagtgccatttctgaacaatttgggtgaagtcagacacatgcaccttaccccgacaaccactcaatggacagcagaacattgcaaatcatgacctgtaataggactgtctttgacttacacagctcaggaaacaacacttggtttggtcaaaggtttgttccttttcatttcgtgttctagtgttttcttttcctgcccttatgacagttgtgtgcaatggcattattgcattaaatagacacgactgattaggtagcatgaaccatagtttagaatttggctaagtgtggctatgttactgtctgttttttctttttctttttttaggagatagggtcttgctgtgttgcccaggctggagtacagtggctattcagacatgtgattccaccactatcagcacgagagttttgacctgctgcatttgtgacttagggtggttcaccaggccttaggcagcctggtggtcttctgctcctgggaggtcaccaagctggtgctgaacgtagtgcagatacttgatcagcctagcgcaccatagcccagaacttctgggccgaagcgatcccccacctcagtctcctgagtagccgggaccacaggcaggctacttgctgtttttgtcaacataaaagggagtcagaaaaggcagaacatatcaagatcagtaaatctaggctgggcatgatggctcacacctataatcacagtgcttcatgaggccaaggcaggaggattctttgaggccaggagttcaaaaccagcctgggcaatatagggagaccttgtctctacaaaaaaatagaaaataaagaaattacccaggtgcagtggtgcatgcctgtagttccagccactccagaggctgagactggaggatctttcgagcttaggaggctgaggctgcagcgagctcttatcacaccagtgcactccaacttgggtgacagaatgagaccctgtctctaaaagaaaaagaaaaaaagagattagtaaattctttagaaaccaagattttaccatgagcagttgcatgaaggtggaaaacctttctgtgattataagtagggattctgaaagaagtcctcaaagtgaatacttattccatggagaaacagaatgaattgagagagtcctggaagctgggaggagaggaatctgtagaaagcagagtcacttaactaattcaccaatgagactgcaaaccgatggtcatggagctgccatgggaatctgaattacagtcacttttattctttgtattttattgtttggattgaaaatgcggccaggcacggtggctcatgcttgtaatcccagcactttgggaggctggggtgggtggatcacctgagatcaggagtttgagaccagcctgaccaacatggtgaaaccccgtctctactaaaaatacaaaaattgggattccattccaagatggccaaatagaaacagctccggtctacagctcccagcgtgatcaacacagaaaacgggtgatttctgcatttccaactgaggtatcttgttcatctaattgggactggttggacagtgggtgcagcccacagagggcaagccgaaacagggcagggcattgcctcacctgggaagtgtcagaggatttccctttcctagccaaggaagctgtgacagactgtacctggaaaactgggacactctcgcccacatactgcacttttccaatggtcttagcaaagagcacaccaggagattatatcctgcacctggctcggcagttcccactcccacagagccttgctcactgctagcacagcagtctgagattgaactgtgaggcagcagcctggctgggggggtgggcatccaacattgctgaggcttgagtaggtaaacaatgtggccagggaagctcgaactgggcagagcccactgcagctcagcaaggcctactgcctctgtagattccacctctgggggcagggtatagctgaacaaaaggcagcagaaacttctgcagacttaaacgtccctgtctgacagctctgaagagagcagtggtgctcccagcatggtgtttgaggtcttagaatggacagactgcctcctcaagtgggtccctgacccccttgtagcctaactgggagacacctcccagtaggggccaactgacaactcatacaggtggtgcccctctgggacaaagcttccagaggaaggatcaggcagcaatatttgctgttctgcaatatttgctgttctgcagcctccactggtgatatccaggcaaacagggtctggagtggacctccagcaaactccaacagacctgcaggtgagggatctgactgtcagaaggaaaactaacaaacagaaaggaatagcatcaacatcaacaaaaaggacatctacaccaaaactccatctgtaggtcaccagcatcaaagacaaaaggtaggtaaaaccacaaagatggagagaaaccagagcagaaaagctgaaaattctaaaaaccagagtgcctcttctcctccaaagggttgcagctcctcacgagcaacggaagaaagctggatggagaatgactttgacgagctgacagaagtaggcttcagaaggtcggtaataacaaacttctccgagctaaaggaaatgttcaaacccatcgcaaggacgctaaaaaccttgaaaaaagattagacgaacagctaactagaataaatagtgtagagaagaccttaaatgacctgacggagctgaaaaccacagcataagagctacgtgatgcatgcccaagcttcaatagccgattcaatcaagtggaagaaagggtatcagtgattgaagatcaaatgaatgaaataaagtgataagagaagtttagagaaaaaagagtaaaaagaaatgaacaaagcctccaagagatatgggactatgtgaaaagaccaaatctacatctgattggtgtacctgaaagtgacagggagaatggaaccaagttggaaaacactcatcaggatattatccaggagaacttccccaacctagcaaggcaggccaacattcaaattcaggaaatatagagaaagccacaaagatactcctcgagaagacacataattgtcagattcaccaaagttgaaatgaaggaaaaaatgttaagggcagccagagagaaaggtcgggttacccacaaagggaagcccatcagactaacagtggatctctcggcagaaactctacaagccagaagagagtgggggccaatgttcaacattcttaaagaaaagaattttcaatccagaatttcatatccagccatactaagcttcacaagtgaaggagaaataaaatcctttacagacaagcaaatgctgagagattttgtcaccaccaggcctgccctacgagagctcctggaggaagcactaaacatggaaaggaacaaccagtaccagccactgcaaaaacatgccaaattgtaaagaccatcgatgctaggaagaaactgcatcaactaacgagcaaaataaccagctaacatcataatgacaggatcaaattcacacctaacaatattaaccttaaatgtaaatgggttaactgccctgattaaaagacacagactggcaaattggatagagtcaagacccaacagtgtgctgtattcaggagacccatctcatgtgcagagacacatgtaggctcaaaataaagggatggaggaagatctaccaagcaaatggaaagcaaaaaaaaagcagaggttacaatcctagtctctgataaaacagactttaaaccaacagagatcaaaagagagaaagaaggccgttacataatggtaaagggatcaattcaacaagaagacctaactatcctaaatatatatgcacccaatacaggagcacccagattcataaagggagtccttagagacctacaaagagacttagacttccacacaataataatgggagactttaacaccccactgtcaatattagacagatcaacgagacagaaggttaacaaggatatccagtacttgaattcagctctgcaccaagtggacctaatagacatctacagaactctccaccccaaatcaacagaatatacattcttctcagcaccacatcacacttattcaaaaattgaccacatagttggaagtaaagcactcctcagcaaatgtaaaagaacagaaatcacaacaaactgtctctcagaccacagtgcaatcaaattagaactcaggattaagaaactcactcaaaactgctcaactacatggaaactgaacaacctgctcctgaatgactactgggtaaataacgaaatgaaggcagaaataaatatgttctttgaaaccaatgagaacaaagacacaacataccagaatctctgggacacatttaaaacagtgtgtagagggaaatttatagcactaaatgcccacagaagaaagcaggaaatatctaaaatcaacaccctaacatcacaatgaaaagaactagagaagcaagagcaaacacattcaaaagctagcagaaggcaagaaataactaagatcagggcagagctgaaggagatagagacacaaaaaacccttcaaaaaaatcaatgaatccaggagttggttttttgaaaagatcaacaaaattgataggccgctaacaacactaataaagaagaaaagagagaagaatcaaatagatgcaataaaaaatgataaaggggatatcaccaccaatcccacagaaatacaaactaccatgagagaatactataaacacctctatgcaaatgaactagaaaatctagaagaaatggataaatttctggacacatacaccctcccaagactaaaccaggaagaaattgaacctctgaatagaccaataacaggctctgaaattgaggcaataattaatagcctaccaaccaaaaaaagtccaggaccagatggattcacagccaaattctaccagaggtacaaagaggagctggtaccattacttctgaaactattccaatcaatagaaaaagagggaatcctccctaactcattttatgaggccaacatcatcctgataccaaagcctggcagagacacaacaaaaaaagagaattttagatcaatatccctgatgaacatcagtgcaaaaatcctcaataaaatactggcaaaccaaatccagcagcacatcgaaaagcttatccatcatggtcaagttggcttcatccctgggatgcaaggctggttcaacatatgcaaatcagtaaacataatccatcacataaacagaaccatcaacaaaaaccacatgattatctcaatagatgcagaaaaggcctttgataaaattcagcagcccttcatgctaaaaactctcaataaactaggtattgatgggacgtatctcaaaataataagagctatttatgacaaactcacagccaatatcatactgaatgggcaaaaactggaagcattccctttgaaaactggcacaagacagggatgctctctttcaccactcctattcaacatagtgttggaagttctggtcagggcaatcaggcaagagaaagaaagaaagggttttcaattaggaaaagaggaagtcgaattgtccctgtttgcagatgacatgattgtatatttagaaaaccccatcgtctcagcccaaaatctccttaagctgataagcaacttcagcaaagtctcaggatacaaaatcaatgtgcaaaaatcacaagcattcctgtacaccaataacagacaaacagacagccaaatcatgagtgaactcccattcacaattgctacaaagagaataaaatacctaggaatccaacttacaagggatgtgaaggacctcttcaaggagaactacaaaccactgctcaacgaaataaaatgacacaaacaaatggaagaacattccatgctcatggataggaagaatcaatattgtgaaaatggccatactgcccaaggtaatttatagattcaatgtcatctccatcaagctaccaatgactttcttcacagaattgggaaaaacgactttaaagttcatatggaaccaaaaaagagcccagattgccaggtcaatcctaagcaaaaagaacaaagccggaggcaccatgctacctgacttcaaactatactacaaggctacagtaaccaaaacagcatggtactcataccaaaacagagatatagaccaatggaacagaacagaggcctcagaaataacaccatacatctaccaccatctgatctttgacaaacctgacaaaaaccagaaatggggaaaagattccctatttaataaatggtgctgggaaaactggctagtcatatgtagaaagttgaaactggatcccttccttacactttatacaaaattaattcaagatggattaaagacttacatgttagacctaaaccataaaaaccctagaagaaaacctaggcaataccattcaggacataggcatgggcaaggacttcatgactaaaacaacaaaagcaatggcaacaaaagccaaaatagacaaatgggatctaattaaactaaagagcttctgcacagcaaaagaaactaccatcagagtgaacaggcaacctacagaatgggagaaaatttttgcagtgtacccatctgacaaagggctaatatccaaaatctacaaagaacataaacaaatttacaagaaaaaaacaaacaaccccatcaaaaagtgggcaaaggatatgaacagacacttctcaaaagaagacatttatgcagccaaaagacacatgaaaaaatgctcaccatcactggccatcagagaaatgcaaatcaaaaccacactgagataccatctcacaccagttagaatggcgatcattaaaaagtcaggaaacaacagatcctggagaggatgtggagaaataggaacacttttacactgttggcgggagtgtaaactagttcaaccattgtggaagacagtgtggcaattcctcaaggatctagagctagcaataccatttgacccagtaatcccattactgggtatatacccaaagcattataaatcatgctgctatcaagacatatgcacactattcacaatagcaaagacttggaaccaacccaaatgtccatcaatgatagactggattaagaaaacctggcacatagacaccatggaatactatgcagccataaaaaatgataagttaatgtcctttgcagggacatggatgaagctggaaaccatcattctgagcaaactatcacaaggacagaaaaccaaacactgcatgttctcactcataggtggtaattgaacaatgagaacacttggacacagggtgggggacatcacacaccgggcctgttgtggggtggggggttgggggagggatagcattgggagagatacctaatgtaaatgacgggttgatggatgcagcgggccagcatggcacatgtatacctatgtaacgagcctgcatgttgtgcacatgtaccctagaacttaaagtataataaaaataaataaataaataaataaataaataaaataaaatcaggagaaaaaaaattggccagtcatggtggcaggtgcctgtaattccagctactcaggaggccgagacaggaaaatcgtttaagaccaggaggcagagattttagtgagctgaaattgtgctgctgcactccagcttcggcaacagagtgagactctgtctcaaaaaaaaaaaaaaatgcacatgccctttatatgtaaattttcattttagggaataagttcacatcttcttaacatatattattttggtgtttttagacaattccagttcaaaattcctctccaggtacatttacctgaagaaatctgcatctctggtctaatgcaagatctggtttccaggctgggcgcagtgactctcgcctataatcccagcactttgggaggccgagatgggaggattgcttgagcccaggagtttgagaccagcctgggcaacatagtgagattatgtaaaaatacaaaaattatccatggactagtgggtgcctgtagtcccagctattcgggaggctgaagcaggaggatcactcgagcctggaagtcgaggctgcagtgagctgtgatcaccataattttactccagcctgggtaacagagagacaaccagtctcataaacaaaacaaaacaaaatctggtttctagagtttatagaatcatacaacagcatgtttcatggagcgttccatctcacaaggtggtgtttggtttagagagggttatgtatgccctctgatattctcaaatctttatttaaaatgctgggagagttgctatctggctttgcatcagtgtttaatataatagccatccttttggggtgggtgttgacgaacagcacacctgccatcttccaaattataccccacactttgtcttgttgaatattattaagatataaagacagggaagaccttccatttccctcccacgtccccaccacctttagttgggagcacagatgtccctgaggcactgctatagaccatgaggtcaccgcaacacaagggacatcaaatgggattgctctggctcaaaacagccagtcttaattctggtgcgatgaatggctttggtggtcgtcccagataagaacattcagcgtcagcaagaaaggctgtaggtatttggctgaatgtaatgttttgttgttgatgtgctgttgtttttcttttcctgggtgtgtagtaggagttgcaaatgcgggctgcagattagcaacgggaaccatctgggtgagcctagcagggaccagccctcccatgggagagagaggtgacacggagcagctgatgctttcgtaatgattcgaggcagctgccaaaagaggcagagcctttgcagaacagcctgtctgttctgctcctagacattagagagataatacggctgataggtgagttggggaaggcttgtttggacacattttctcagccttttttttttttttttaacctctggtagaaacgggcatagttgaaagatccattgacctattgtattctgaaactcaatggatcatcagcttaggcactgagaaatggattccaaaccaattttagtgtgagcaagtttctctcctttctgttactctcataccctttcttctttcttccctccctccctcccttcctttttctttcttaaccaagaacgtgtgtgtgtgtgtgtgtgagtgtgcgtgcgtgtgtgtctgtgtagtgtgtatagtatgtgtccagagtatacatgctttggaacaaaatgaatttaaggaggaatgcgtttgtattttgtccttagtgttattttaaggtacaaatatgggtaataacttgcagactacagatgggcttttctttcattgtaatgcatttggctgtcatatcccttagtcctaacccctctgccactgccaactaaatataaccattagtcattcagtggtttctgcattttgcagtcaaaaaagagggagctcattttgattaattgcctctttccttattcaggacacagaagctttctgagtttaaacttttaggcttggcaggacattgagacaatgctcttgggccagcatgtttcagggcaggttttgccactgagacaattcatccaagagccccaggacttggggcagcaggagttcttttaaaaatgggccaaaagacgggcagagcacttgaggtcagcagttcaggaccagcctggccaacatgctgaaaccccatctctactaaaaatacaagaattagccgggcgtggtggtgcacgcctgtagtccccactactcaggaggctgaggcaggagaatggcttgaacccgggaggcagaggttgcagtgagctgaggttgcaccactgcactccagcctgggtgacagcgagactccggctcaaaaaaaaaaaaaaggtcaaaagaatgaactcattgaaagttcaggatttgtgcagtagtggccttggaaaatcaatttaaaaatgtcggaattagggatatggctcacaagtctagtgtgaatttcatgctgggaactaatttaattgacacatgaatgatactttttttttttttttttggtcttttaaatcacgtctgtgtcttctgccaaagacaacaagaaggtattccaagctgcacaatgaggcccaggtaggtaaagccatatactgcattgtgagcacattgaatctaatgtataattctgtgtatttgtgaatccagccttataggtagaggcatttaatatcatctgcctttttttcttttttctttttcttttcttgtaacctactatgagtcaacatgctgtctttatatggctggccataagatgtctaagttcattctctcgacttagtaagtgtgtaagttttttaaaaaggtaggagttaggcaattgatagagatgtaaactgtaaatttccaacagatacatatgagtttatgtttatttttatttattttagagacagggtttcacagggttttgctctgtcacccagggtagacgacagtggtgcagtcatagctcactgcaacctccaactcctgggctcaagagatcctccagcctcagcctccagagtagctgggacctcaggtgcttatcgccacgcccagctaattttttatttttattttttgtagagacaggttctcattttgttgcccaggttggtcttgaactcctgggctcaaggaatccccccgcctcagcctctcaaagtgctgggattacaggtgtgagccaccattgtgcccagccgtatacatgattttaaagtgttgtaaaaacaggaggtgaaaaaattcaactaactttgcatagatgaaaagcatttctataacttcggggatttggcccacagtcctgagcatgtagcttttgcctgcaagacattctcaatcttcaaggagatgtttgcatacagcaaaaaaattgtactcttctgtggctgtcattgtttcagagtatttacaaaggactctgagagccaatagggatgaactcctgtttgtattttttctctcagaggagatatttgaagtgggttttgaaacatgtatagacatgagataggaattgaatcaataatccacatgtccaatattcattacctgataactgagtagggatatgctgagaagagcgtcatgtgtttccttaagaaaatatgacctcagctgggactgagcaaaactatgaagtggactcaggtggtcctcagagtccacgtttctttcttttcctcaattcagttctttccccaacttccacttttcctttacttggtaattccttattttattttatttatttatttttttgcttgtttttcttttctccagccaaagctgctattctcacactttttcttcttttgagggtctcgtcctgtagcccaggctagagtgcagtggcgcaatctcagctcactgcaggcttgaactcctgagctcaagcgatcctcccacctcagcctccagagtagctgggactacaggcatgcaccaccacacccagttcatttttacatttttttgtagggatggggtctcactatgttacccaggctggtgacgaactgattctcctgcctcagccccccaaagagctgggattacaggtgtgagccactgcaacctgactttttaaaaatttggagtaatgataaattgcatgtatttattctttttatattatgaatattttatttttatttattttttctttctttttaaattcatttttctttttatttttttcctttttaaatttctttttctttttttattgtcccttgagtcaaaaaagctgacatataaacattgcatagatttatggtgtacaacttgatgttttgaaatacgcctgcattttggaatagctcaattatgctaatgcatgttacctcatccacttacctatttgtgatgagaacactttgagtagattttatcagtaattttcaactctaaaatacattcttattaactacagtcagcacaagtacaatagattctttgaacttatttctcctgtcaaattgaaattttgtatccttcgaccaacatctccccaacccctccactggccccccagctcccagcaggcatcattctaccctttccttctatgagatcaactttttgagatttcacatagaagtgagatcatgtggtattggtgtttctgtgccaggcttattttccttagcataatgacctccaggttcatccacgttgttgtaaatgacagaatttcattcttttttaacgctgaataatattccacggtgtatatgtaccgcattttctttatccattcatgcaatgatggacactgaggttgatttcacagtttggccattgtgaatagtactgtaaggatcacacacacccacatgcccttaaattagaataaaaattctaattttagaatgaagttaaggttaaatcccttacctgtagagactcatttaagtcccttaaatgaggttaagtccctggaagagggagttaacctcaggagtcttatcgtctccgtcctctgcaatgatttgcccctgagtacgtgttttcagacttccctcctggaagggcatctactttagccttttaaaaaaaattcaatagtttttggggagcaggtgatgtttgattacatggataagttctttagtggtgatttgtgagattttgatgcacccatcccctgagcagtgtacactgcacacaatgtgcggtctttgatccctcactcccctcccaccctttccctgagtccccaaagtccattgcgtcattcttatgcctttgcagcctcatagcttagctcccacttatgagtgagaacatacaatgtttggttttccattcctgagttacttcacttagaataattgtctccaactccatccaggttgctgcaaatgacattattttgttcctttttatggctgagtagtattccatggtgtgtgtgtgtgtgtgtgtgtgtgtgtgtgtgtatgaatatgaaaatttgatatggatagatagatacctgcagatctatacagataaagaagatgtgttatatataggtatctacagatctatagatatcaagagtgtctcgctccaagcaccaagcactgctgctgaatggcagcagaagtgcccaaagaaatgcgctcttggcttctcactttgtatacaatctatagctatctatctctatatatcacattttctttatccactcattgattgatgggtatttgggctggttccacatttttgcaactgcaaattgtgctgctgtaaacatgcgtgtgcaagtgtcttttgttgttgttgttgttgttgttgttgtttttgatggaacctcggtccgtcacccaggctggagtgcagtggcacaatcttggctcactgcaacctccgcctcccgggttcaagtgattctcctgcctcagcccccctagcagctgggattacaggagtgtgccactacactcggctaatttttgtacttttagtagacacagagtttcaccatgttggccaggctggtctcgagctcctgacctcaggtgatccacctgcctcggcctcccaaagtgctgagattacaggtgtgagccaccacacccggccgcaagtgtcttttatatataatgccttcttttcctctgggtagatacccaggagtgggattgctggatcaaatagtagatctacttttagttctttaaggaatctccatactgttttccacagcgcttgtacattcccactaacagtataaaaggattcccttttcactgcatccatgttaacatctgttgttttagcctttattttatgcaaagtgagaagccaataacgcattacgttgggcacttccgctaccattcagcagcagtgctcggtgcttggagagagacactcttgagcttcaggagatgcctgggagatccacgtgatctccaaagacccctgttgtgttgtgttgggaggtggatcctgaatccacccagagaagcctgataccaataaaatccctgcttgctttccaggagacccttggtcttcatgtctttggtgtgtgcactcttgaacacatgccaggcacacagggtgcatgacgacaagcctaatattgtcctaatcatggttgatgacctgggtattggagatctgggctgctacggcaatgacaccatgaggtaaggcggtttcatggccagtcatacgttcgtcagtcgttcaggttcagcaggctggctgtacggctgcatctatgtgcaaaaccaaatgtatttgttgggacttttttttaagttactttaaactttttgatagttttaaattatttagattatgtaatagttttacaattacatttttaataattttaatttgaatctctttcagtttttaaacttaagaaataataattgtccatcttcacagggtacacagtgaggtttggatacatacaaagtatagtgatcagatcagggtaatcagcacatccagtgcctctagcattaaccaggatggtcatagtaaaagcatggctatctggacccgagtcctggctctgcatttactagctctgaagtcttagagaagtcgctgaacctctctgtgcctgttttcttatttgtcgaatgcagagaaggctttatatccctgagtttatgtgtgtaaagaacttagaatagtacctaacacacaactaccctctatcatacagcctattatgaagcatgatgattgtatgtacatgtacatatacagatatgaacatataaatgtcattatataaatatatgtgatatattcatatatgaatatattctataatatataaagtatatatcatacatttattatattacatatccatatattatgaatatatgaacatacattcaatgtataaacatatatgaatatatttataatatatgaatatataatattactaatatatatgaatatgttattcatatatacatgaacatatacatatttctatgtctatgaatatatattcacttttatataaatgtatttttaaaaattaaatataaatatatttaaataaatatataaacatatatttatatattttataaaagtacatttaaataaatatatgtaaatatatattcattttatataaataaatatttatataaaatgaatatatcttcatacatattgataatatataaaagtatatattatcaatatatattgataatatataaatatatatttatatatataatatataatattcataataggctgtatgatagagggtagttgtgtgttaggtactattctaagttctttacacacataaactcagggatataaaggcttctctgcatttgacaaataagaaaacaggcacagagaggttcagcgacttctccaagacttcagagctagtaaatgcagagccaggactcgggtccagatagccatgcttttactatgaccatcctggttaatgctagaggcactggatgtgctgattaccctgatctgatcactatactatatattaataaataaatatatattatttattaatatatatttaattatacatatataaatattttaatataaataaatataatataaatatttataaatatatttataaataaaattatatataattataaatatataattaaatatataattaataaatatatattataaatatagatttataatatataaatatatattaataaatatgtatgaatttatgaatatatattcaattatatatattcataaatatataaatgtgaatatgtatattcagcagaattcattctgtttcctaatttggtgagccaatagattctttaagatggtgagcttgtatttttaacaatgggcattctgaaagaagaaaaacagatatgaaacaaactcagtgctttgtggtggataatagaagctatctgtattagccattcttatactgagcttaggagtacatcgttatcagacgtacatcatacacttttaagatcattgcgttgtatgactaatagatgctgaaggtagtcatcacagttttcgacaacggagctaggagtcatgaaaaagtagtcgccaaaaattaaccattgcttatgagaaaagaagagaggactcaccgaaaagcgcagaaacatggtgtccataaatggcagatatttacagagagtatgttagcgtggggtatcggtgttttgctgaaaatactagcaatttgagaagtgagattataatgtgaaatctaaaaccaggcacatgtgccccaggaatgcagtttacaatttttttctttgcaaaataaataatgttttaaaagttggtaggtgacttccatatctgaaaaaaaaatcagatgcacaccttggtaaagctggaacttctccttgcaccagttacctgtcataatttctctcatgaataaatgtagaactcattatattttattttcatccaagaggagactgattctttttccagaagtctctccagcctccagaaatctcttgttaaattattttttaattgacgaattatagttctgtgtatttctggtgtacatcatgatgttttgattcatggatccattgtggaatagctaaatcaagctaattaacatgcacaaccacacatacttattatttatatgtggtgaaaatggtgaaaattatagcaatttcaagaatagaatacattgttattaactatagtcaccacaatctgcaacagatctcttaaatttattcctctatgtgaggaataaatcaaatagaggatttattcacgtttggctccgtgaaatgttgtatcctttaacctacctgttctcgaccctcaccccagcgcctgatacccaccattctactgtctacttctgagtttgctattttagattccacacataagtgagatcatgcggtatttgtctctctgtgcttggcttatttcatttaatctaatacccttccagttcatctgtgttgtcgaaaatggtgggatttccttcttttgaatatttaatcatatgacagttttgcaacctatgcagactgcagggaaatgtatctatcaaaccagtgagtgggtgggtctgtgagtagttaggcataagtaaggtctgtaagcaattagcctcgatgaatcagaccccaatcccttaagcattttattttgtaaggctgaagtacagtgaatggacaccatatagtggcacccaggtatatgaaccctgcagaacaacagctgcctggaatctcagtcatacttcaccttgacacgggcaaaaaagaaaaatgaactccgtgtgcagttacctgctctgggtacctggaaatcataataaacagagatgttgtttatcttcagatctctctgtctctctctctgtctctctctctcctctttctgtctctacatctctttctatgcctatgcgtgtctctgtcacccctctctgtctgcttgtctctttctatctctctctctgtctctctctgtctccctctctttgtctgcctgtctctctatctctctctctgattgtctctctctgtctccctctctttgtctatctcattctatccatttctttctatctctttctgtctctctctctccctctctctgtccttctgtttccatctgtctctccatctctttctatgtctgtctctgtcttccccctttctctgtctgcttgtctctctatgtctctctgattgtctgtctctgtctctgtctctctctttgtctatctcactctatccatttctttctgtgtctttctctctttccttctctctccctctgtctgtatctttccatctctctctgtctctctcttcctctcttcttctctctctccatctctctctctgtatctctctctgtgtctctttctctcttttcatctctccctgtttgtctctctctgtttttctttctgtctccctccatctgtctctttttccacctctctttctgtttctctctgtctccctccctctgtttatctctctttccatttctttctgtctctctcttaatctctgcatgtctctttccatctctctctttctgtttctctctctctgtctttctctctctctcttgtcttctctctgtccctctctgtctttctctgtctccctctttctgtctttctctctccttttttctgtttgtctctctctttccatctctctctgtttctctctgtgtgtcttaccctttgtctctttctctgtctcttttcatctctctctttctgtttttctctttctatccttttctgttgctctctttctcgtttgtctctctctctctttcatcctttctttctgtctgtctctctctctgcctcgctttctgggtctctccctctctccctgtctgtctctcctctctctttccacctgtgcctttctgtttgtccttctctgtcttcctctcgctcttcctctctgcttcccccgccccccaccttttccttctctccaatacaccttccctctcccccttcaggacgcctcacatcgaccgccttgccagggaaggcgtgcgactgactcagcacatctctgccgcctccctctgcagcccaagccggtccgcgttcttgacgggaagataccccatccgatcaggtgcgcaaactggcgggctctgctgggctctgccctcatgttaggatgtgaggaaacaaaaatgtggcttgaccacgttaacaagtaaaaaagggctgggcacgatggctcacgcctgtaatcccagaacttcgggaggccaaggtgggaggattgcttgagcccaggagtttcaaaccagcctgggcaacagagcaagaccccatctccacaaaatttttttaaaataagttgagcatggtggcatgtgtctgtggtcccagctacttgggaggctgaagtgggaggatcgcctgagcccgggagtttgaggctgcagtgagtgtgatcacagcattgcactctagcctcgttgatagagcatgtgttagaaagaaaaaaaaagatacaaaggaaagaaaagaaaaagcacacatgtgcataggtgcactggcacacacagctagcactggtcacatcaaaatggctgcgcttctcagagatgcaagatcaccctgtgtgcttcagttgtcttttgatgcaatgagagttttttatctgaattccaagtcacaaggtgtacatttgagtttcccaggtcaacaaagataagctgtcttggaatgaagtaattaatacaacatgtgtttacacattcagtctgtcaccaaaaaatatctttttttttctttcaaaccacaaagtcatggccgggcatggtggctcatgcctgtaatcccagcactttgggaggccaaggcaggtggatcacttgaggtcaggagttcgagcccagcctggccaacacggtgaaagctcatctctactaaaaatacaaaaattagccggacatgggggcatgcacctgtagtcccagctactcaggaggctgaggcaggagaatcgcttgaacccgggaggcagaggttgcagtgagccaagattgtgccactgcattccagcctgggtgacagagcgagactctgtctcaaaacaaacaaacagcaacaacaaccaaaaacccacaaagtcataaaccaagaaatagctatcagatttttggacaactttcatcacagcattttacccatggagacagtagtattatccccttgctcaatttatatcaattttattttatttattattattattattattattattatttttgaaatggagtctcgctctgttacccaggctggagttcagtggtgcaatctcggctcattgcaacctctgcctcctgggttcaagtgattctactgcctcagcctcctgggtaactgggattacaggcacgtgccaccaggcctgtctaatttttgtatttttagtagagatggagtttcgccatgttggccaggctggtcttgaactcctgaccttaggtgatccacccacctcagcctcccagagtgcggggattataggtgtgagccaccgcacccggccatatatcaattttagataaaacaaaaatgaaatgagaagaacgaaattatcgtaagctctagttgtcatgttctcattactttttaatttattactattattttgagacaaggtcttgctctgttgaccgggatggagtgcagtggtatgatcacagctcactgcaacctcaaccttccaggctcaggtgatcctcccacctcagcttcctaagtaactggaaccacaagtgtgcaccactatgcctggctaattttttaactacttagggtattgctgtgttccccaggctggtctcgagctcctgaactcaagccatcttccctctttggcctccaaaagttctgggattacaggcatgagcaactgcacccaacctggtgactttttttgtttgtttggttttttgcttttgagatagggtctccctttgttgcccaggctgaagtgcagtgtcacaatctcagctcatcacagcctcaaactccagggctcaagcgattctccctcctcagcctcctgagtagctgagattacaggtacccgccaccatgcccagctaatttttgtatttttggtagagatggggtctcaccatgttaaccaggctggtcttgaattcctgagctcaagtgatcggcccacctcggcctcccaaagtgctgggattttaggcatgagccaccgtgcctggccaaaagtagctatttttaaatgtgctattcagtagcatgtagctctttcccaatattgtacaaccatcacctctatcgaattctagaacatttccatcacccacaaaggagatcttgtccccatgaagcaatcactccccattcccccttctcgcagcccccggtcaccaagaatccactttccgtctctacaaacatgtctgtcctggacatttcacataaaaggaatcatacagtatgtgacagtctgtgactggcgtctgtcaccaagcataatgttttatggtagcctgggtcagagtttcatttatttttatgttgaatactattccctcgcatggattcactacagtttctccatccattcatcaattgatgggcagtcaagatgtttctattgtttagtgattgtgaggaatacaactatgaacatacatgtacaagtttttctttgaataccagttttcaatccttttgggttcctcaggaacctcaattcttttgacattccccaggagtgaaattgttgggttgcatggttctattttttttttttttttttttcagatggagtttcactcttgttgcccaggctggagtgcaatggcgcaatctcggctcactgcaacctctgcccctgggttcaagcgattctcctgcctcagcctcctgagtagctgggattacaggcatgtaccaccacgcccagctgattttgtatttttagtagagacggggtttccccatattggtcaggctggtctcgaactcctgacttcaggtaatccccctgccttgtcctcccaaagtgctgggattacaggtgcgagtcaccacatccagtcatatagttctatttttaaaggtgagggaagtgggcttggggcatggtggctcacacctgtaatcccagcactttgggaagctgaggagggcagatcagttgaggccaggaattcaagaacagcctggccaacatggtgaaaccccatctctactaaaaatacaaaattagctgggcatggtggtacatacctgtaatcccagctactcgggaggctgagacaggagaattgcttgaactcaggaggcagaggttgcagtgagctgagatcatgccactgcactctagcctgggcagcagagtgagatttcatgtcaacaacaacaacaaaaaaaaaaaaaaaaaaaaaagagagagagagaaaaaaaaaaaagaaaaaaaaatggtgagggaagtagtcttcgcttgtgggtacagatgccgcagtttaatgccaaattatgtggattccagatagcggttcttggaggcagaataaaatcgcacgtatcaaccctactgccagtctgctgacactgactttggacgagaagaaagaaaaggtcttttttggctgagtgcagtggctcatgcctgtaatcccagcactttgggaggccaaggcgggcagatcatgaggtccggagatgcagaccatcctggccaacatgatgaaactccgtctgtactaaaaatacaaaaattagctgggtgtggtggcgtgcacccatagttccagctacttgggaggctgaggcaggagaatcacttgaacctgggaggtggaggttgcagtgagctgagatggcactgctgcactccagcctggtgacaaagcgagacttcatctcaaaaaaaaaaaaagatcttttcttagtctgtttgggctgctataacaaaaataccatagactgggaggcttatctacaacagacatttactgctcacagttctggaggctggaagtccaagatcaaggcatgccagattcagtgtctgctggggacctgcttcctggttcatacacggcgccctcttgctgtgtcctcacatggtggaaggggtgagggagctctctggggtcccttttgtaagggcactgattccattcttgaggctccaccctcctgacctcatcccctcctaaaagccctacctcctaaccattaccttgcagatgaggatttcaatgtgcaaattttgtagtgacaaaaatattccctctgtagcaacacctactcattgtacttttttccacactacatctaggtatggtttctagtggtaatagacgtgtcatccaaaatcttgcagtccccgcaggcctccctcttaatgagacaacacttgcagccttgctaaagaagcaaggatacagcacggggcttataggtaagacacaagaattggtgttagtcattgatcataaggtaatcatgtcctttgttctacccttgatttatgactttcttggaaacgctgtattttacaatgtcttatgtaaaggcgcagtggcccatgcctacaatcccagtactttgggaggccaaggtgggaggatcgctggaaaccaggagtttcagaccagcctgggcaacatagaaagaccccgtctctaaaaatataaaattagctaggcattgtggcatgtgcctatggtcccagctactccagaggctgaggtgggaggattacttgtggcaggacttcttttctttattattatttttaaaacagaggagtctcactgtgtcacccaggctggagcacagtggcacaatctcggctcactgcaacctccatctcctgggttcaagggattcttgtgcctcagcctctcaagtagctgggactacaggcgcgtgccaccacgactggctaatttttgtatttttagtagagatggggtttcatcatgttggccaggctggtcttgaactcctggcctccagtggtctgcctgccttggcctcccaaagtgctgggattatggatgtgagccaccacacctagtctgattcttcacacagctcagtgataggagatgttttaaaatgaatatattacaagaacataaaatttttctggctctgcctgcccgcatagtctctcaccgtgtatcctgtcatctgcctctttatttcactaaaaatggaccacacagattttcttctcactgccaaggatgatagaagtcctcagccacccagtagttggaactccaactactattcctgtttgggaagcctgggtttcagctggtgtgagaataacatgctgttttaaatcccttcaatttttgtaatacatctgctgttgataagagaaggcaatctccgtggggttgcaggacaggaagcctaagccagtagcactgcctctcctctacctatccccacaggcactcagaggttgatggaagcacaggcattcttgatggggccctcaccacatacaggaagctgttaatattcctagtagatacacattatcgcagcctctgagggtttgctgatcatccacatgctagcaggactcacaggcaccctttggtgatcattcaaggtgtggtacgttttactgaataagtcccttacttcgatcagttttaatgagagcccctaggatttgcagtcagccagctattcatccatccatgctggtccatcctccatgatttatctatagctatcatcggtcatctctctctctttctccatccatccatcaacccatatatctctatgcatctatccatccatctacctgtctatctatctacctgtttgtctattgatcaatccatcatctatcatttatctatcatctatgaatctatctacccatcatctatctatcatctataatctattcatccactcattcatctatcatgtatctatctatccatcatctatatctgtctatttatctagccattcattcatctatttagacatctctctatccattcacccatccacccatatatctctatccctgtctatttatctatctgtctactcacccatctatcctttcatccacctacatatacaaatatgctccatctgtcctccatcatttatttgtacgtgtcatatttattacatctatgtctctattgatatatacatacacatatgtatacatagatgcatactccataatttatttttatccatatcttacctgtctattcatccacccacaacacagatctattcatgcatctctctatctaatcacccactcatccaggtatccatctgtccacctacacacacatatatacatgctccatctatcctccatcatttatttgaatctgtcctatcctatcttatctatttatctatctatccatctatccaactactcactctatctctatcatctatttatctatctatccattcatctatcaatccatctatccatcatatctatctatctatctattcatctatcctatctatctatccacccatagatctccatccacctatctactcacctactcagccacccacctatctatccatgcatccacttacacatacatacatgccccatctatccatccatcatttatttgtatctatcatatttatcacatctatctctctattgatatatacatacacatatgtatacatagatgtatacaccataatttatttttatctatcatatcccatctgtctattcatccacccacaacacagatctatttgtgcatctatctaattagctagtcatctatcgatccatccatccacctacacacacatctatacatgctccatctatcctccgtcatttatttgaatctgtcctatcctctcctctcctctatcctatctatctatctatctatctatctatctatctatctatctatctatccatccatccatccatccaaccactcactctatctctatcatctatctgcctatctttctgtctacatattatctatcatctatctttctttctatcatctctatttatctagctagctatatctacatatgcatctgttcatctgtctatctacctatctttctgtctacatattatctatctatatatctacctacctatcatctctagctagctagctagctctatctatgtatacatctattcttccatcaactataacctgccttgtctctgtgatgtatctattcttccatcatctgtaacctgccttgtctctgcggtgtatctattcttccatcatctgtaacctgccttgcctctgtgatgtctctatctttgtggctatgactttgtcttctcagtgaatgagaaaatttctagttcacgtcattgacagaaactcacaattctatttttctcccttattgtttatcctatcctgttgctcacaaccggatctgaatacaaacttcctctgtaaactaaagaagaacaaaaaaaatgtggctaagtggcactcggattttttagaggaaggagaatatctctgctactttatttttgtgtattagctgattgtttcacgtgaagaatgctcacatggtttttgcaatgtgctggcatatgttgacatattgatgcgtagatgtgtttgtgtgtttggttttaggcaaatggcaccaaggcttgaactgcgactcccgaagtgaccagtgccaccatccatataattatgggtttgactactactatggcatgccgttcactctcgttgacagctgctggccggacccctctcgtaacacggaattagcctttgagagtcagctctggctctgtgtgcagctagttgccattgccatcctcaccctaacctttgggaagctgagcggctgggtctctgttccctggctcctgatcttctccatgattctgtttattttcctcttgggctatgcttggttctccagccacacgtcccctttatactgggactgcctcctcatgcgggggcacgagatcacggagcagcccatgaaggctgaacgagctggatccattatggtgaaggaagcgatttcctttttagaaaggtaagcggaataattacaaattcatgtaataatgataatgatctcttttttaaaaggacctagatagatctgtagggtgattgtagtttataataatctattgtacacttctaaatagctaaaagagaataagtcaaatggctctagaataaagaaaagacaaatatttaaggtgatggacaccccaattacactgatttgaaaaaataaatcatttgtaataattctttacaaattatatgaatgtattaaattgtaacgtgtactcttaaactatgcacatctataatgcattaataaaaataataggggatgatggtattaaaaatattgagttaggaaatggaatattgctaaatggtgtaatagggttagataaaaatatgaagtgtattgaagaccagttggactcttcagttggtacctaaagcggtggtaccttgtttgggctcctgttattaaaatcatggcctctctattggctctgaaatttatatgttgtcagaccatggacgcagaccctagtaacttaaactcacaaattgtttacgttaatttacaatgcatcttgtcatcatgttaacttacaacagggaatatgtacatatacaatatgtatatactatactatatatgtatatatataatatattttataatattttttgtctggttccctgatacatatagataaatatatatatatatctggaaatcagatgaaaaaagtaagttttccattgcattatgttcctgttgttaaaaaacaaaaaaaaagctacttggggaaattaaaatcagaaggcttctctttgagcatgtgatacgtaagggctatttcatgaattggatgaggtaaatggtcaaaggtgattgttataaaaactttatgcatccagaacacaatgactggaaattttcaagggtatctatcctcttgttgttggaccttctttctttaaaaaaagcctgtaaacacattttttcatttgctttttccatattgattgaggcttaatctttaccaatagccattctaggatctggattttcaggatgtaaggtgtcttgtgtactctggtacatagctttgtcctcactctgtagcccaagtgaaggtgataaatatgtagtttggggctggcagcggtggctcagcactctgggaggccgaggagggtggatcatctgagaccagcctgaccaacatagtgaaacgccatctctactaaaaatacatattagctgggaggctgaggcaggagaatcgcttgaatccgggtggcggaggttgcagtgagctgagatcacgccattgcactccagcctgagcaacagagggagactctgtcttaaaaaaaaaaatgttgtctgggagtaataaagccatacttgctctgtagatgcaactgaatgcttggtgtcacttagagcaaatctttctgttccctggtacctttccaaatgtgcagagttctatgaatttttacagacagagcatcaatatgtgcaaattagcaccaaccactctgaaagtatatgataagcaatcctattctcttctgtctgccagttcgtcttcaaacattcccacacagttctccttaggaatttacatgagtacttgaagaacagatcctatggttgagatgtacattgttcaccaaaacctctgtcgagtttcaaaagttccatatgatccacaataacacaatattgaatggaaaaaacaatggtgaagaggaaatataaagacttggacgttgtgacaataagctcatggcttaggttcatgaatgctcaaaactatttttatctggattctcagtgtatgactctcctacagttgctataacaaatcactatagggctgagtccaatggctcatgcctgtaattccagcactttgggaggctgaggtaagcgatcacttaagttctggagattgagaccagccaaagcaacatatgggagccatatttctacaaaaaatacaaaaaaattagttggatatgatggcatgcatcagtagtcacagctactcaggaggctgaggtgggaggattagttgagcctgggaggttgaggctgcagtgagccgtgattgcaccactgcactccagtctgggcaacagagtgaggccctgtcttaaaaaataaaaaaaattaccacaaatgtagtggcctaatgcaacacaaagttattattctgctgttcttgaggtaagaaatccaaaattaaacttgtgggctaaaatcaagatgttggtggggctagttacttctaggggttctaggggagaatctgttttctctttcttctagtttcttgaagctgcctgcattctttagcttgtagggttttgttttctgactcagacccttctgcatctctcttataaaaggacatttctgattccactggacctacccagataacccaggataatcactttgtctcatgatccttaattcattcccatctgcaaaaaccttttaccatgtaatatcacatgttcacaggttttgagaatgaggatgtggatatctttggaatggggcattattcagctgatcactttgaccacgactctttattttggcagcttagtttgggatgcaaactatttaattttaaatatttaatgttcagagctgtgcttcctctgtaggctctaggggaggattcttcctgcccttccccactcctggtggcttcaggcatccctgggcttgtagccgcatcactccagtctctgcttcatctgcatatggccttcccctctgtgtttgtgtctcatcttctgtctcttataacgacaatagtcattggatttagtgcccatcctaattccaggatgagctcatcttcagatccttaattaattacctctgcaaaggtcttgatatccaaataaggtctcattccaggttctgggctttaaaatatatggacttatatttctgggggctactattcaaactactacaattgtatccagtttcttctggaggctctaggggaggatctcttctgcctcctctagctcctggtggctccagatgccccttggctggtggttgcattactccatttccacatggcctcttcttctgtgcttgtgtctcctcttctcctatagggacaacattattggattggggactcatcctaatccagaatgatcacatcttaagtaattaaatctccagaggccccatttccaaataaggtcccattctgaggtttcaagtgaacgtgaattttgaggggtcactgttcaagacaccatgacataagtcttgtttttaaaattcattttttttatttctttatattttgatatctcaccagagcagaaatttcccaacgaatggcatttgtgctgtgtgttttcctgggtagctgaggacttatcattcatgcagatggattatcaaaattaacagcgggtcagcctagttccctgtatcctcatgtgagaacctacagggtgcaaatggcttgccaaggcattcctgtttgtactggcttatggctcgtgaaactcttgatctggctaagaaatgacttccataccactgtctcttgatgtatctcagggtgtgaccctagtttgaggcttcacgagcagtgagaacatccaccaaacagagctggatttgacttttcgcactcgcatgatatgggaggtccgtgttggcttgcagtatattctacagctgtcctggcatctgagaatcaaaggaactgtgatggtgtcacaggactaccaggttcatatgcctgctgcacagtaacataccaatacactgaggcagcagggtttatggcagagaaaggtttaataattgcagggcaattagtgcgaacatgagaggagacctcaaatccatctttttttttttttttgagactgagtatcactctgttgcccaggctggagcgcagtggtgcaatctcagctcactgcaacttctgcctcctgggttcagcgattctcccacctcagcttccccagtagctgggattacaggagcccatcatcatatctggctaatttttgtatttttagtagagataagatttcaccctgttggccaggctggtctcaaactcctaacctcaggtgatccgccatcttcagcctcccaaagtggtgtgattataggcgtgagccactgtgcctgtcctcaaacccatccttccaaggagttctgggctggattttttaggggaatcatggagggtcttggggtcactgatgggttggggtaagagggaatggaatcatcagaatatggaaatggtatgctttggtaagtcagcttctcatagggtccttcagagaagcagacatcagcagtttccctggtatgcacaacctgaaagattattgcaaatggaaaacttaacatttcatgatgttatgttatcatcctgtaacaggatctgtgcgattctagaacaaataggtaccaaacaagtaggaatacatagatgagagggcaagctgacctcaggatcaaagctgagtatgctgcaagcttagttcattttgtttctcccgctcccttcctctctgattgattttatgaagtttatagagatggtttcagtagcattaccaaaggggttagggagcagttgaggtgctgcaggatcatggagtccattctatgcaggatggggcccttgggtggacccactctatcttctgcagcttggagaagaaggaagcaggtcatgtctatgagaagccaaaacaatagttttcacattcatagatattgaaaactcacaagtagtttcattgatgtcttctcaggcacagtaaggaaactttccttctctttttctcctttcttcacgtgcacacacctctccccaccacggacgatttcactggcaccagcaagcatggcttgtatggggataatgtggaagagatggactccatggtgggtaagtcacaggacttaagtggacagaaactaacgtgttctgataggacaggacacctgaaaactgctcttggtcaacctgtagagtgaagagaattatgcctatgggacagagtggtctgagacattaatgaggtaatagttgctagcaattgagaaagtcagcaaaaaaactatatgcatttcctctcctttctttgcatgctgtccacttatcaacttgggtctttgtctacttgactgcgtctccagtgctggccagataacaaatcaaatcttcttttcaaaaatttcaactcttgttttagattcagggagtacatgtgcaggttttttacctgggtgtattacgtgatgctgaggtttaggatatgatcaaacccttcacccggacactaagcatagcacgcaatagttagttttcaacccttcccccactccttccttcacccctctagtagtccccagtatctattgtactgatctgtgtgtccacatatacttgatgttatgctcccacttattttgtttcatttttaaaaataaattttattgtgtattttaagattcacaacgtgacgttaaaagatacgtatagatagtaaaatgattactatagtgaagcaaatagtaatcattaagtaacataatatagtaatattaagtaatagtaatatagtaagcaaatgtatctatcatctcacactgttacttttttgtgacaagatcagctaaaatctatttaacaaaagtccagctgagcacagtggcttccatctgtaatcctggcactttgggaggctgaggcaggaggatcacttgagcctaggagtttgagaccagcctggacaacatagtgagaccctgtctctacaaaaatacaaaaattagctgagtgtggtggcatgtgcctgtagtcccagctacttaggagactgaagcgggaggattgcttgagcccataaattgaggctgtagtgagccatgattgcaccactgcactccatgcactccagtctgggtgacagtagctcccacttataagtgagaacatgcagtatttggttttctatgtctgcattaatttgcataggataatgtccaccaccggcatctatgttgctgcaaaggacatgatcttgttcttttttatggctgtgtaatattccatggtgtatacgtaccacattttctttatccaatccaccattgatgggtgcctaggttgatttatgtctttgctcttgtgaatagtgctgtgatgaacatatgagtgcacatgtctttttttttttttgagacaagatctcactctgtcactcaggcagaagtgcaatgacatgatctcagctcactgaaatctctgcctcctgagctaatgcgattctcctgcctcagcctcctgagtagctggggctatctataggcacatgctactgcgcccggctaatttttgtattttttgtagaggcaaggtttttccatgttacccaggctgctcttgaactcccaagctcaggtaatatgcctgcctcagcctctcaaagtgctgggatgacaggcatgagtcactgcacccagcccacatatctttttgatagaaagagaaatcatattttcagactctttagtgacatagccaaactttatttcaggtctgttgagcaccaatatcttagttggggattgggaattaactggtaagtcagaatccagtaccctcatgaactcatcctgtagagagaacaatgtaaatgggacgtcctaggacttacatggtaaatgtattgattagcaaaatggctttaattttccaacattaatgaaagaaaaccatgagtgaaactcacatatatgcaggacacaaatttaaagtataatattttccagacacagatattgtgaaatatatgtcactaaatagaaagacgctttggaaaattaagcctggaaaaagcaaagccaatttgcatagtcttaaacacataaaaaatatgaagtatttaaaaatataaataatattcaaaccaaatacatgaacatgaatagatgtttatgtaggtataagtgtgtgtgtctgtgtctgtagtgtttgtgtacatatgtatagaaacagatgattgacagagatagatgatggatagatagatgataggtaaatagatgatagatggatagatagatgatggactgatagttgatagatgataggtagatagatagatgatggatgatagatagatgataaatagacgatagatgatcgatagaaagatagatgattgagagatagatacatagataaacagatgatagatgacagagagacagatgatagattgatagattatagatggatacatgaatagaaagatgaataaacagatatatagatgatagatggatagatatatagataagtacatgatacatatgacagatgatagatgacagataagataggtgattgatagataagatagatagatgataggatagattgacagatacgtagatgataggtaggtagatagatgatagatagatacatacatacatacatacatacatacatacatagatacatagatagatagatagctatgcatacccctcttactttctgcctccaccagcactagtccttaaagtttagattcttaatattgcactcaatctcaaaaatcgtggcgatcctatttttgatttgatctttgaaaatcaatgaaataggtcattcaaactcaggctgtgataagtaaaagacattactatttgctttaaaaatttaaattaacaaagctcccaaagtatctaatttaataaacctgatgatgtgtcatagtgttcaaacaaggcactttgggtatgactttaatttcgatgggatttttctggtgacattcagataatattacgcaaacggatgggtgtgttgaatctggttggacaagctgtgatatctgaaaattatattttgaaaaagcgcaactgagatgtacatgatactggtgcccagaggttttgaatgttttgtccacacagccagaatcaagcctttaggaagaataaacatctgctttaatatataattttagcaattctcaagcaaacatatatttaccctgaaattatttatcccagaagctgtaacaataccccaagtcctaagaattgttgcttttcttattagaaaagttgatttgtggccattcctggtagagatatcaccttcctgccttttataattatcataggtggccgggcgcggtggctcacgcctgtaatcccagcactttgggaggccaaggcgggtggataacgagttcaggcaatcaaaaccatcctggttaacactgtgaaaccccgtctctactaaatatacaaacacatccgtggtggcgggcgtctgtagtcccagctactcgggaggctgaggcaggagaatggcgtgaacctgggaggcagagcttgcagtggccgagatcgcgccactgcactccagcctgggcaacggagcgagactccgtctcaaaagaaaaaaaaattatcatgggtttcccacagcagtgccctgaaataatggagtctactgatagaataaacatttattttcattttttaataatttccaccttttattttagattcagggagtacgcatgcaggtttgttacctgggtatattgcatgatgccaagatttgaagtacaatagctcctgtcacccagggagcgagcatggcaaccaatagatagattttcagcccttgtcccccaccttccttctccccttttggagtccccagtgtctattgttcccatctttatgtccatgagtacccaatgtttaactcccacttatgagaacatgtggtagttggttttctttttctgtgttaatttgcttaggacaatagcctccagctgtatccatgttactgcaaaggatgtgattttgttcttttttatggctgtgtagtattccatggtgcatctgtaccacattttctttatccatgtagattggttctatgtctttgctattgtgaatagtatgataatcatgcaagtgcctgtgtctatttggtagaatgatttatttccctttgggtagacacccagtaatggcattgctgggtcagagggtagttctgttttaagttatctgagaaatctccaaagtgctttccacagtggctgagccaatttatattccaaacaatagtatataagtgttgcatcttctctgcagcctcaccagcatctgttcctcttttatttttttgacttattgggttcgtgcaaaagtaactgaggtctttgtcattgaaagtaatgatagattgatagattatagatggatacattgaaagtaatgacaaagacctcaattacttttgcaccaacctaatagtagcctttccagctggtataataaacacttttaaaagtgatacttcctatgggccatgcactgttaccagtgtattctggatgaatccccacaacatccccggagacgagtatcatcttcatcatcatgtttatctccattcacagagaaggaggcaaaagtatgtggcctttggtggctgctcctggagataagccagggttgggctccaaagctcttactccctagctcagctacctcttatgcagggcaaagaagtcatgttgaatgatgaggaaggagagctacattcttctctgaagtctccagtagccccattagactcctacagaccgtcatttcacaggagtcagaaaaactccaaaaacttcccccaacctggcttcctgcttccttcgagcccagcgagaggctttcattggagataccacccttgccccacccaggggaaaatctctgatgccgaatgagtcatgcatttctgcatgggcaagagtccatcagcttggatctgaagagcaggtttctcaagaatgcagataagaaagtaaaatgtgcaaaaatgagtaggagaaatggccttatcagcaggagatgagacaaggatgagggtcttggctgagcctgttgtacagacagttgtgagtggtggaatcccagggcaggcctgtctgtggacagcaacacagcttgggcagcaaccctggacagggcagaactgcaaaggaggctgtaaacatgtatttctatgtcatatatatatataatttatatgaaatatttgagacacatatataaaatataacttaaccctttataatatatatatttatattatttgttatacatattagtattaataatttgaaagttatcatatatatgaatatatattatgtatttctgtagcatataatttctatatttatttatttatttcagttgatgttagaaaggtacgaatcatttccatggttgtaatccctgctactttggaggctgatgtggcaggatcatttaagcccaggagtttgaggctgcagtgagccacgattgcaccactgcactctagcctgggtgacagagcaaaatcctgtctcagaaataatcatttccatggccactatgtaatctctctaaattttaagatataaatagaataattgaatataattgaataatattaagaatacaaacaactcaaagtaatttaatattatttgtaaagaacagaattgcctatgttaaaaaccctagagtttaataaaacacatatcagcacatagatgacatatgatattataataaaattatattacatataatttatattatagttatattacttatatacatcattatattattatgttcatatataatataaacatatcattaatatacaattattagattttaatatattatatggttctatcttatatatatcacaattatgctatgcatattatatattatgtacatgtatacatcagtaccatagaggttttattaaactttctggggtttccaacataggtatgttcactacatttaatgttaagtttgtattttatgtgttaaagtatgtatttaactttaatgttaattgcattagtcaggttatgtacaaaaataagttacataatgacaaaaatattcttatttttctggtattaatgaaatagtttcaatttttacttttaagcataatgttgactgacgctttgaatattttaattcttaatattttgagagacttataagatgtgcattaattagatagtagccaggaaaattcttgcatgctttctagtattacctaactatatatatgtatatgtagttaactatatacatgttatatatcatgctgttgatattatctatattttatatatatctaacaatataacttataaaacatttttattatatacataaatacatatatactacatgttatgtagtatatgtgttctaaagattgatatataatataataaatacatttgtttttgtatagtatatgttagtatagtattagtccaatagtataattagttacatttatatattagctatacataaatatattagctatatataaaaatatattagttatacatatatatgaagtctacagtgtttctctgttgggtatatgcaccaaaattaagaccttttctttttgttaaaaataatgcatttcaagatacaatggatcaccagctactattcattatagctccaatgtcaataactaaaatatttagaaataatttttcaagcagtaaatgagtatctcgaagctgactcatgaaagaaaacttgaatacatggaaaggaagagtggattgtatacatgtattagttatttcaaagttaatattgaaggctaaggtagctctgattagagcattaattactgttctctggggagtggtcattatagaggtgatgatgaaatacacactgaataaactgataggaaataaactttccagaaacatctgatgagaaagtctttggtagaaaacatcaagaaacacttctgtgatcataagaaatgctatcaaaaagataactacaaaaattaaaacgcagaaatacaagatttgacttttagatcaatgaagcagaaaataatagccttagagcaggtctgggaaagagaaggacattacattcggtacaataaagtttttaaatcaaggtggcaggggtgaaaggtgttggggaaagtttgtgttatgagttgacttacatccccccaaaaaggtatgttcaagtcataatccaaggtatgtgagaatgggatcttatttggaaatagggtcgttgcaggtggaatcaagttaagatgaggtcattgggggtgggtcctaatccgatatggtgaattaggatgaggctgctacatgccaaggaaggctaaggactgatgccaactgtctgaagtgaggaagaggtaaggaaaggtcctcccctagaaacttcagagagagagagtgactctgccaacacattgattttgaacatctggcccccagaactgtgaaagaataaatgtttgttgttttaagccacctcatttgtactaatttgtttcagcagcccaaggaaattcacagagttagtttaggaaaaaccattaccaattcaattagcatgcttttccatacacattaaggacattgagtgaaacaaaacaaaaattggaagaagctatagttaaacagtaaatttacatctggatgaggtatagtgttagtaatagcaaaaggttatctgataagtagcatgactaaaggccctatgcaaactgaggaaatattagcaacaacatgacattgttttaactgcttgacaaataaagagttcttataaatcaataatggaaacacataattccttccaaaaatatcagcaaaattttaaacatcttttacagattaaaagtacaaatattagagtggacacaggaggaaactcatgatcattcataatgtaccataatcacctatcaaacattagatactgatgaggaattgagaaaatgaactattattaatgccaaaagttgttcattatggcattttaaattatggcaaagtatgaaaattaaccagaatagtgaacaacagtaaaatggttaaataatttatactacttaaaaataaagtatcataaattgtttaggccaggtgtggtggctcacgcctgtaatcccagcactttgggatgccgaggcaggcagatcacctgaggtcgggagttcgagaccagcctgaccaacatggagaaatcctgtctctactaaaaatacaaaattagctgggtgtggtggcgcatgcctgcagctgaggcaggagaaatgcttgaacctgcgaagcggaggttgcagtgagctgagatcgtgccattgcactccagcctgggtaacaaatgcaaaactccatctcaaaataaaatatatatatatacacatacacacacaacacacacacacacacacacacacacacacacacacacacaatggacacttttccagccattaaattgtacatataattttttaaatttatttttttaattgagacagggtctcactgtgttgacaagggtggtctcaaatacctgagctcaagggatccgccttccttgccctcccaaattgctgggattacaggtgtgagccatgatgcccagtcttgaataattttttaacacgaagattttccgagaaataatattggatgaagaaagcaagttgaaaaccgttcatacaatatcaacccaaatagagagagagagatgcatctacaagagtatgtgatatggtttggctgtgtccccacccaaatctcatcttgaattgtagctcccataattcccacatgttgtgggggggacctggtgggagataattgaatcatggaggcagtttcccccatagtgttctcatggtagtgaataagtctcatgagatctgatggttttataaggggaaactccttttgcttggctctcattctctcatgtctgccaccgtgtaagatgtgcctttcacctcccatcgtgattgtgtgtcctctccagccacgtagaactgtgattccattaaacctctttttctttataagttaccccgtctcaggtatgtctttattagcatcgtgaaaacagactaatacagtatgtaacaattttttttaaatagtcaaatggcaatggggcaggaaattggtggtctttattttcctccttataattttctttatttttttgtatttcccaagctattttgtatttttataatcagaaaaatattagctttgttgttttttcttgctacttttcactatttactgaaaagtagcaagaagagtaaaaacaactcccgtgtccccttcacccatctttcccaattgttagcaatttatcaaatatatcttctctcgcccctcttcctttctcctgatcatcctctttcttcctctctctctctttctctcttccacctccacatgtttcttatgcttctgaatatttgggaataagatgcagatatgatgttcattaaatttagaaactttagtgtgtattttctaaaacaaagacattctcctacatcatcactgcgaatcatcaaaatcgggaaattaacatgggtggattcttaggatttaattcacaaatcccagccaaacttctccagctgtcctcaaaagaaaatttatacacagcaagcaaaaccaatggacaaacaaaaaccaaccaacaaaacccctacttcctctaccctctttctgttctggtccatggattttcttgttgtatctgtttaaactcctctgatctggacaaagactgagcaatctttattctttcttgaattcaaagaccttgacattttctgagaataaagaccgggtatcatctagaatgtcccttgaattgggttggtttgacatttccttcaatggaagtggaagtgatggtgtgttctcaatccagtagacaagtaagtgaattagccccaacaatggttataaaattcttcatctcttgattaaatggtgtcttccagttttctccactgtaaagttacttattttgtcattacttaataatttgagatttttaactattttatgggagatactttgagatgaagccaatattttggttcttatcaaacatttaatgccaggtttagcatccattgatcattttctcttggatgaattttcagtgcgatttttgctaaaagtattgtggtaaatttttaaaagtattttaaaatataaattctttcttaacttgcccttacttgtgtgccttggctctagaagaaaatttctaaggtatagtactttaggaatgttaatgtaatgttatctgagataaccaacagtagaacacatagaattagacacgtttgagactaataagctttttcataattatgcataatacagactgggtttgggaactctaggaatttagctattttcctataaaaatgattggaaatgtggtttattttgaatacattcttcctcttttaacttgcccattgagtctaattctcccaacctagtcatcctattctctatttaaaatatcaaataagaagggaagggaaaatggttaaagaattacttatctaaatcatctgcaagaatatatcaaataaattatgtgaacccaacagtgggagtgtcttattcttgcctctgtctcctcaaattctgtaacaatgtctgccttctgtgagcagagaggttgcataaaccgtgactgccattctgtgcaacatcagtcagaataccactacagtccttcgtttcatatccagtgggaaaaactgtatttctctgtttaatgttttcattctgcatgaaggaaattatcaaggagaatttgtccttttaaatgataccagtagcaactgatgttcatttgtattgccataatatttttttcttaaagcaggtcatcttttatttcttaaaaattttggactctcagttttttgtttttttgttttttgtttttttgagatgagtctcactctgtcacccaggttggagtgcagtggcacgatctgagctctctgcaacctctgcctcccgggtgtaagcaattctctgcctcagccacctgagtagctgggattacaggcctgtgccaccatgcctggctaatttttgtgtttttagtagagacagggtttcatgatcttggccaggctgatcttgaactcctgaccttgtgatccacccacttcagcctcccaaagtgctgggattacaggcatgagccaccgcgcccggcctgactctcagtttttttctctttcaatggtttgtcaatttaaactgttaatgcacatttcttttcttttgtggcttttgacatagggtcacaccatccttgttttcctttagatagctcatgcccatttgacttaggggtgaaatacctcataatgtcattatttttacttgtctcttgtatattattttaggcaagattcttgatgctatcgatgattttggcctaaggaacaacacccttgtctactttacatcagatcacggagggcatttggaagctaggcgagggcatgcccaacttggtggatggaatggaatatacaaaggtgaggagaggaactcatgcaagtgatctggtggtgaataagcttttttgtggttcttataattaaagcccatgacacaaaggaatgaggcctgaaaaactgaacaagtttgtttaatttgactcttagtaaaatgaagtattggaccaaggtcaagaaaattggtcttacatttgttaacatttctgtggaaggaagccatttatgtagagggagcatctagaaatatgcctttctgacaaccctatcaaattatgaggagttagcacaagcagatgcttttatggggtctttaaagaaatatctactcattcattccatttatgagattattgagagattaaatgagggggagtgtgattcctagagaacagagatcagaaaccagggatccttcatcattaagaagtcttcgacactctcttccaaggatatagtacagcatagaaagtagacaagcctgtcttgggtttcatgattaaattcacatatactgattttatgtcctgctgtaacatttagtccacaaaataggtccataagctactacattggccagtctataatgtgtaacctgatgttagaatattatcttcatttgtgaaatgaggattaaaaaaagaaaaagaaaaaagataattatctggaaaatgtcgagtatattttatcatatgtcttgagagagattttaaagtattttctagaggaaaatacgttgttattcatgcaactacagattccacagtcttggattcggtaggaaattataatttctgtatgaatgaggtaaaggctctgcctccatcttgcagagggtatgaatgtgtactctttagagcgtgtagcactaaagtgtgcacttaggacccaaaacaaatccttagtggaaattgttattatagacattctattttaaaaaaaaaattcagtagttttggggttacaggtggtttttggttacacagataagttctttagtggtgatttctgagattttagtgcaccgtcatctgagcatgtactctgttcccaatatgtagtatttttttcctcagcctactcccaatcattccccaaagtcaccagagcccattatatgattcttatgcctttgcattcttgtagcttaactcccacttataagtgaaaacaggctgtttggttttccattcctgagttacttcacttagaataatggcctccagctccatccaagttactgcaaaagatattatttcacttatttttatggctgagtagaattccatggtgtatgtacaccacgttttctttatccacctgttggttgatgggtacttaggcttgttccatatctttgcaattgagaattgcactgctataagcatgcgtgcgcatgttagacattgtatgtttgcttatgggaactgtttttaaaaatttttggctcatgcctgtaatcccagcactttgggaggctgaggcaggcggatcacaaggtcaagagatcgagaccatctggccaacatggtgaaactccatctctactaaaaatacaaaaattagctgggcatagtggcggacacctgtagtcccagctactcaggaggctgaggcaggagaatggcgtgaacccaggaggcggaggttgcagtgagccgcgatagcaccactgcactccagcctggcaacagagcgagactccatctcaaaaaaaaaaaaattaacttttcagcatgccatgacataatgtagattttactctgattaacttaataaaataagagtcaattaacacaggacagtggccacttctcctaatttccccctggaaatcctggtgtatgcctgtcatcttggtataattaagacaactttctgcttttattctcaataataccttgatgtggacaataagttaccatatgtccatagtattccatttgttttcaaggtgcatgaatcaacagtgagcaaaataggcagaaatcctcgtcttcatggagtttatatcctactggagggaggcacagcagaaaataaaataaaataaataaataatatggcatattagaaggtggctgtaaataagaaaaaacacgagagtaaagaattctggggtgggactgccatttcaaataaaatgttcaggcacgcctcattgaggttactgtgagttccataaaattgggggctggatacaagaaaaatattaattaaaaaaaatataggaagttactttgagcaaaggtatgagggaggttggaaatgaagtaggtgtatatttgagataagaacactttaagtagagaaaatagccatgcaaatagaatgtaaatgtccaatattacatatgcttagttatttaatcaaaaacctaccagcagcacaggaaaatataattctgtagacgtgcactacttaccccactaggactctacatagagtagacactatacaaatgtgatctcttttgatactagcttaccttttaaatacattcaatacagtgactattttaactaggcacaataattgaacttaattgcattgtcttataggtggaaaaggcatggggggctgggaaggtggaatccgcgtcccaggaattgtccgatggcctggaaaggtaccagctggacggttgattaaggaacctacaagtttaatggatattttaccaactgtcgcatcagtgtcaggaggaagtctccctcaggacaggtgatgtcatataaactgttaacaagagcttattttcacccttcttccttctcagaagattcagaacaaggagactgactctatcctggcagacccactttttccctagtatctacacagttttaccttcctatatgactgtgtctattcagcatttttcagaagagaccagtcttttctttttttctattgaggtaaaatatacatatataatttaccatctttaccatttttcagtatacagttcagtggtaataaacatacttattttctttttttccccttcattttcctctcatctctcccctctggtcatcactattctactttctatcttcctaagattcactattatttatttttagctcccacactgagtgagaagatgtgatgtttgcctttctctgggcttggcttatttcacttaacataatggccaccagttccattcatgttgctgcaaatgacaggaattccttcttttttagggatgaatagtattcccttgtgcatatataacactttttaaaaagttaatttgtctgccgataggtggttaggttgattctatagcttggctattgtgaagagtgctgcgataaacatggaaatgcagctattcctttgatctgttgatttcttttcttttgggtgtataccaagtagttggatttctggatcacatggtagctctatttttggttttctgaggaacacctcaccacgcaaaacagataaagcaaattacaaccgaaaatagagatggacagatttataaccagaggtcctgaacaagtatcagagaccagtcttagatactaatctaatgcggaccatcttagatactttaacattttcaattgagagaaagatggagacaggaagctttggagatgaagacatggtaggtaaaactcactcatctctataagaaagggaaaaataatcctagtctctggtgtgaaagatctggaagactgagaagaaggtaagatatttgaggatgctttgaactctatcatgaatactttgaatttcttcaagaggagatcgttcatactacattgctccattccctggcagcaaccagcctaggtaggtttgctgctgattgacagttcattgatcacagctctgcaagggaatccagatgggttagaaccgcagctatgtctctcctccaagcccacagagttcttgtaatatttctttcttcacgtaacaaagctaatctatttctgaagaaataggttctgttggcactaatacagaaaagaaaaatattttagaagtcatggttaacttactgaaaaacaaactatcaagaactaatcaagacacatccccaagtttgcctttctaatatttaaaaatttatgtttgatgctagcagatatctctatcaacacactaaggctggaatttattttataattttcgggactgaactttagatgaagacatttttattttctgcctggaaagaagttagtcattgatgatgctaacacaggaaagaaaaaatattttattctttatttttatttattttatttttgagacagagtttcgttctgttgcccaggctggagtgcagtggcacgatctcagctcactgcaacctctgcctcccgggttcaagtaattctcctgcctcagcctctccagtagctgggactacaggcaccggccaccacgcctgggtaatttttgtatgtcttgtagagatgggttttcgccatgttggccaggctggtcttgaactcctgacctcaagtgatcctccctcctcaacctcccaaagtgttgggatttacaggtgtgagccatcatgaccagcccagaaaaaatatttaaaaaaccactgtgaagttattgcaaaaagaacctatcaaaaaactatggagaagcccagctttcctgttctaccatttagaaatagttgttttaagaagtctgtcgttccacatagcccaacagcctgttagggagacggcaaatgtccaggcacaatattgttacgttgcatgagggtggaaggcaactgctgccaagttccagccgttgtcctcacgttaaaaagaagaacgagttgattggagtcactcatcactccagtgcattcggcgccatgagattacatgctcatttggtcaggggtttagggttatgagtttggtgtccttgataagatgtatagtacagctgtcctttcctgcctgcaaccatgactccactagccataggctaagtcttcagaggacgcaccatctttgtagttcaacgggaagtggaagaatatcgcgaagatgactaaggcactgtggtgggagacctaacctcagcttcacgtacaggtcggcgtgccgggtactactcatcaggttgattttttggttattcctatgcttggttctcccaagcctctttatttgaattcatgacttctttggcatgtgcattgaccagttaaatatgtccttgctaatagagaatagctgtactacgtagaagggaacaaacagcaaattcacagtatcaggctcactgtctatgacaccagcatcatgagggcctgtggatacctctctcctgtctgcttcaatccccaacacaatgaaatcaacaagaagaactcaaaagcggctctcacctgtacagaaatgaaggctgctaatactgtaaaagccaaatagttatttatttttagaattaacacaatttgtttcaccacctcatcacacaaaacagataaagcaaattacaaccaaaaatagagatggacagatttataaccagagatcctgaacaagagtgtagaatagacaaaaaagaaaagtaaagataaaacagaggacaccattaatgtgtagaaacacgggaatctgaggatgcaatggtttatcaaagtgttgggaaaaaatgacttatcaggtatgtggtttaccaatacagctgtcccttggtatccatggggggttggtctcaagacctcacgtggataccaaaatacccagatgctcccgtccctgatgtaaaatactgtagtatttgcatattacctacacacatccttttgtatatattaaatcatctctagattactcataatacctaatacaatgtatgtaaatgccacataaaatagttgttatattgtaccctttagggaataatgacgagaaaaagtctgtacatattcagtacaaacaagaccgtccctaaaaggaccataagcctaaatgtaaacccaaaattataacacttctaaataaaacataggagaaaatcattgtaatattcagataagaaaataatttttttagatttatcaaaaaagttgcaagctataaaagaaaaaagtgatagattagtcattatcaaaatttaaaatttctgcttttcaaatgtcaatatcaagtaaataaacatgtgacctcagtccattagtggagaaaaaaagaaaagaaagaaaaaattaaaatattaaatatgaacttaaaagaaagtttaaaagaaaagaaaaagacaagccgtggagtagaagcaaatagtcatccctctgaactcagaggttctgcatctgcgaattcaatcaactgcagatcaaaagtatttcataagattttctagaataaagaatctagaatagcctaaaattttttgaagaagaaaatcatttgaagactcactacataattccaaaatttactataaagctagagtaatcaagtttaaaagagtaatcaggatggtgttctaatgctctaaatttttaaaattgatatttaatattttaatttttttctttttttctttttccccactaatggagtgaggtcacatgtttattttcttgacattgccatttgaaaagcagaagttttacattttgataatggctaatttatctttttttcttttataacttgtgatttttgtgataaaacttaaaaaaaattttcttatcaaaagatcacagtgattttctcctatgttttcacttagaagttttatagttttgggtttacatttaggcttatggtccacattgagttaattttttaatgtggcttgaggtataggctgagatttattttccttgcatttggatatccaatttgtctactgtcatttattgaaagacagtcctatctctactgaattattttgagcatttgttgaaaagcagtatacgtgttggtcaattcctggactctcctatttcattgatccattgaaacccttatttcaacactacactgtctcaattagtctagctttatagtaaatctgggagttatgtagtgagtcttcaaactattttcttcttcaaaaaattttaaaccattctaggatctttattttcccatgtaaattttggaataagtttcttcctttcaacataaacctttctgaaattgtgattgagattgctttaaatctatagatcaatttgcagaaaattgatgtcttaaaaaactttgaattttccaatcaataaatatagttcatttctccatttatttctcttatttggtgctttgtggcttttctcatacaaatttttcacataaaaatgctatccctaaatacttcatgctttctcatgttatagtacatgatactttaaaaagctattcccagctattcattgcaaatatatagacatttttaaaagttgttattgtattgtgtgatcttgctagtcttactcattatttccggcagttttttcagtgataattaacataggaaatcattgtatctgatagtaaatatagttttatttcttttaagatcctttttaggcatggcacggtggctcacacctgtattcccagcactttgggaggccaaggcagataggtcacctgaggtcaggagtttgagaccagcctgaccaacatggtgaaaccccgtctctactgaaaatacaaaattagccaggcatggtggcacacgcctgtaatcgcagctactcaggaggctgaggcaggagaattgcttgaacctgggagatggaggttgcattgagccgagatcgtgccgttgcactccagcctgggcaacaagagcaaaactctgtctccaagaaagaaaaaaaaatcctggctgggcgcggtggctcacgcttataatcccagcactttgagaggccgaggtgggtggatcccctgaggttgggagttcaagaccagcctgactgacatggagaaaccccatctctactaaaaatacaaaattagctgggtgtggcggcacatgcttgtaatcccagctacttggaaggctgagacaggagaatcccttgaacccgggaagcagaggttgcggtgagcagagatcacaccactgcccctcagcctgggaaacaagagtgaaactccatctcaaaaaaaataaaagagaaaaatccttatctgggatgtattattatgtgtcccattacaaagcaggttttattattattgctttctaatacaaggcataagatatattttctaatataaatttttaaaattcattttagtttagattcagggtcccatgtgcaggtttgttatttggatatattgtgtgatgctgaggtttctattaaattcatcacccaagcagtgaacatagcgcccaacgggtagtttttcaacccttccctcctccctccctcctgcttttcggagccccccagtgtctaatgttcccatcttcatgttcatgtgtacccagtgtttagctcccatttgtaagtgagaacatggtgattggttttctgtttgtgcgttcatttactccatttctcatataaaattagaagtatatgactttttagtgattacataaaattttttcaaagggtagcaatataattgcaaatgaagttcagatttatgaaattgccataaattgctgagctgtggagagctctgtgtcgcagccaaggctgtctgatcttttcgcctttggggcatgcattgtcacattcctcggcctcatcatttcaggatcagaacttagctttcttctcttgtccactggagtgtaatctcccagagagcatgcatgagttttcctaaagactcagtacgctgtcctctggacctgaggcatgacgcagtcttcaccaagtacccttcaggtagcttgggacccaacgtcccttctcctcattttccttatctgcactgtctgtgtctctgcagggtcattgacggccgagacctcatgcccttgctgcagggcaacgtcaggcactcggagcatgaatttcttttccactactgtggctcctacctgcacgccgtgcggtggatccccaaggacgacagtgagtgctcaacccgttgcttcctgttccctgccaggagcagggtcactcaggtgtatcctgaacgcattcttcctttcctctctagaccggtcctttcattccagggctcactgaacacatggttttggagaagtttctcagaattgctcttctgcagaaaggcaggtgggggtaatggagatgctaattggcttcacttaattatctcagcagtcgcacatacattaaaacatcacattgtgcatggaaaatctatgcaatttttacttatcgattacactttaataaagaaaacagatgtatgaacataagatttgcctataaagttagagagacacttttacgaaacatacatttttagtcaggtgtggtggatcacgcctgtaatcccagaactttgggaggccgaggcgggcagatcacttgaggtcaggaatttgagaccagcctggcaaacatggcaaagccctgtctctactaagaaatacaaaaattagccaggcatggtggtgcacacctgtagtcccagctacttgggaggctgaggcggtagaatcacttgaacccaggaggcagaggttgcagtgagctgagatcacaccattgcactccagcctggaagacagagtgagactccatctcaaacaaaaacaaaaccaaaaaatatatatacatttttagaaacaggactgatatctgctggaaaatgtgtatatcatttcaccagggaactctaatgttctcgttttgttgtaaggattgcataatatttagcattgacgtgtgggcaaaaagaagcccaagaaccagccttgagaagacggaagaagacaagagaagccagcaccttgggtgcatgcctctgatgtgctttctttctttcttttttttttttttggagataaaaaaatatgtattgaatatcttctatgggcaggttattttgtaggcataagtggtcatggctaaactttcatttataaaaatcaattctaggcagactaaagataaaatgtaagattaaaagtgttagaagaaaatgagtttatgacccagaaattggaagttttttaaatttttaaaaagtggcacacatataataatatgcacacattgcacatgaaaattggggatatctagtgatattttgagataggcaatgcatagtgatcagattagaataattggcacatccatcatctcaaacatgcataatttctttgtgttgggaacattgaatatcctccttctagctatttgtaactatgtaacatattattgttaactatagttattctacagtgtttagaacaggagtccccaacttttttggcaccagggaccagttttgtaaaagataatttttctgcagactggggtgggggatggttttgggatgattcaaatgcatgacatttattgtgcactttatttctatcattattatattgtattacataatgaaataattctacaactcatcatcatgtagaatcagtgggagccctgagcttgctttcctgcaactagatggtcccatctgggggtgatgggagacagtgacagatcatcaggcattagattctcatacgtagcctgcaacccagatccctcgcatgcacagttcacaataggtctcgtgctcttatgagaatctgatgcagccactgatatctgacaggaggaagagctcaggcaataatgccaacgatagggaatggctgtaaatacagagataaagcttcgctctctcccccaaccactcacctcctgtgtgtgaccaggttcttaacaggccacgaacaggtaccagtttgtggcctggggactggggacccctgctatagaacactaggacttcttcctttgatctggctgaagtgcgcatcatttgacgagtctctcttttctcctccaggtgggtcagtttggaaggctcactatgtgaccccggtattccagccaccagcttctggtggctgctatgtcacctcattatgcagatgtttcggagaacaggttacctaccacaacccccctctgctcttcgatctctccagggacccctcagagtccacacccctgacacctgccacagagcccctccatgattttgtgattaaaaaggtggccaacgccctgaaggaacaccaggaaaccatcgtgcctgtgacctaccaactctcagaactgaatcagggcaggacgtggctgaagccttgctgtggggtgttcccattttgtctgtgtgacaaggaagaggaagtctctcagcctcggggtcctaacgagaagagataattacaatcaggctaccagaggaagcctttggtcctaacgagaagagataattacaatcaggctaccaaaggaagcactaactttggtgctttcaagttggcaaggagtgcatttaatagtcaataaattcatctaccattccagattattaaaggcccactggttgttccact

SEQ ID NO: 852 - DNA, 25407 bp, Homo sapiens
atccagggagatttgtcacattttattcagtatttctgctgcactgccagcctagggatgcacttgattcccaagaaatgcaactgtcctattcgcagagccgtccacaggtacctaccccctggactgcagcaactttattaccttaactagcacagaacagaggttgatttaaactccttacactcacttctcagatcaatgaatgggcaaagaaacacctcatggctctgggaaggcatgctgagacccgtttttgcaagtcctgaggaatggaagaatatagctgccaggtatcccaagtctagggcagggagggtagtatcggcatcactttcactgcattctgttggtcaacgcaagtcagaggctcagcccagatccaagggcagggaagaggctccatcgtgtagttgggctcacttggaaggtaatgggaggagttggtggctgctttaagacacataccacatctagatttcaacctccagaaaagtccaaagatgcactcacaggagcccgttagtcaactgaagctggttcatggctctcttcttcaggtggagactaaccaactccctgacctccttcggttaagtgctccttcctttttcctgctgcctggaatgtctatgtgccatctggagctatggcagccttcttgcaaccatgaggcaaactctatgtgcaagagcaggtagctagaaagagcctgccagccctgggcttatatcctgcttcccagggagcttaaagatagcaaaacccacagccattttcatcaaatgccaggaaattcttaggctgggattgttgggattgtttgaatggttgagcgtgaaagacttgttataatgggcttgttgaatacggtgaaagatgagatggcttttagctgcctccactccccgtgtcccatgctccatagatgtttctttttttttttttttttaatcattttttggttatgccaggtgtctcctgtgtgtccctccagatccctctccagccctagaaacctgagctctataaatgttgcctctctccactcatcttctctttggcttcaggttgagttcagccaacagatgcccctgtaggatttggacacagggagccaggggagaggggcatcagctgcctggttagcagggctgtgatgattcttctacctatgactctcagtgctgttgcctcttcctctggatcttggaagcttccatgctgaggtctgaaggtggctccctgcctcccactgatgtccttagaatcccatcctcacctaatacctggtattgaacactgcctttcttagatgtcatttaggctctcgtttcaattcccagtatgcttcctgcaaagacctcgatagatggactgaggggaatagtgcaaggtcctcccatccccagtattgggatctaggggcagggggtcccagctgtgcagtaggttaggactacacttccatcatcaaagccacagagggaagaggtgaggatgaaacacactagaattgacttagaaaacacactggccaaatcttagctatttgaggaatgtagggagaaaagccaccttctctctctatgtctgaaggttcccatggctgtctctttgcccaaggggcaaactttccatcagggcatcttctgtgcctctgaggatcattttccaattataggcaatggtagtacgtgtttcagtgcagaatgagatagagttgtttaatttgacaataaagcgatgcgtcaaaaacctcagtcaacacagtaagtgttttcttgttttcctgctgaccaacctaattctggtttcatacagggcagccaggtgcccacctaaaagactgcacttctcaacttccagttgtttctatggataatggttggaagcagaaattgggttggggcttccagataatcccccctcacagggactgcttcaagagaaagggatgccctttggttctttctcctttccactgcctggaatgtgatgtctgacactgtggcagccatactggcataatgaggccaactctctgccatgctaagagtggcagagctgggaattgaaaagagcctgctagccttgggttgcttccccttgatcggctcattacttggaagagaacacacccttctcttattattttctttaaggcatttttttttttttttttttaaggcagggtcttactctgtctcccagcccggagtgcagtagtgcaatcttagctcattgcagttttgacctcccaggctcaaataatcctcccgcctcagcctcctaagtagctgagactacagctgtgcgccacgacatctagctaattatttgttttttgtagagatgaggtctcactgtgttgctcaggctgggtaggtgtctaactcctaggctcaagtgatcctcccaccttagcctcccaaagtgctgggattacaggtgtgagtcaccgtgcctggctttgtttaaggcattctttttccgcagcatctgttaccagcagcctgaagccatttctataacaatatcaggaagacacatggacagagaccctaatgtatgaaaaatgcatcaattatttgagattaatgagtcctcataaacagagactgagaggctctaactttcctccgctatgtgagagtaggaacagacactcctccctgtccttttgtaaggctgttatgtcatctaggtgatgaaattgcaacaatgctttaagacggaggggtgaaaacatcgggcattggcacaatgacgaaccctgagatttagaagaggaagaggaggcatcagtgggtgcctactgggacagtcttatttcacaaatcaggaaagggaaaccctacatgggcgcagtggctcgtgcctgtaatcccagcactttgggaggctgaggcaggtggatgacttgaggtcaggagtgcgagaccagcctgggcaacatggtgaaaccctgtctctactaaaactacaaaaattagctaggcatggtggcaggtgcctggtgcctgtaatcctgggtactcaggaggctgaggcaggaaaatcgcttgaacccgggaggcggaggttgcagtgagcagagatcgtgccattgcattccagcctgagggacagagcgacactctgtctcaaaaaagaaagaaagaaagaaagaaagtggggacccactctcagtccagggcatgttccttgcaaaaagggaagctgaagatagaaccaagcttggagaattttgtttgcaacgcagtcaggctctcctggatcctctctcacagtcctggcattcagggggtgccatccccatcctcgtggcatgaacagaacgggaaatgtccgcagcacggctgcagccacggcttccacaggatgttgctcatggaaaactgctggggcacaggactcagggtctgccgatgctccgacaccgcggcacctacccttgctatcacggcgtggtacaggggctcggagtcgggggtcaggggccgtgcctcggaggggtccctggagaggtcaaagagcaaagggggtctgtgatgggtcacgccctccccggagcatgggcagacgcctcggccgtagcaggcccccgctccctcggggtggaactgcggggtcgtgtaatgaaccttccagacgcttccacctggatgcagacaagaagggagtcagggtggcagaaatccacgcaggtgtgaacgcagaacgcaggtgtcggccctgtggtatcagcatgaacctccctattcagtgaaaaggaggagggacacgaggcagtccacacaatcacagccttcagcttgcaaagtcagagcatgtgtgtgtgcgcgcgtgcgcccatgtgtgtccgtttgtgtctctgcattgcatgccccaggcaaagggactcattgcagagcgctcactgtggctgctttcagaaatcagaatcatagaggttccttaattcttcccctttcccctgtgttgaaactgttcagcgtcgatctactacctttctacacagaaacaaccatgatattttaaacagcatgattgggtacttatctatctatcgctacctatttatctatttatctatcaatccatccatttatcttacccatcgatctcatctatctaccattatctatttatctatcgatcatctatctacctacctatcatctatctctgtttatctacctttcatccatctatctgtccatccatctattcatccatccatgaactgattctactttttatctatctatctatctatcatctatcttatctatccatcatctatcttatatatctatcatctatcttatctatccatcaatcatgtatcttatctatcatctatcctacatatctatatatttatccatccatcatgtatcttaaatatctatccatcatctatccattatctatcatctatccatccatcatctatcttatctatccattatctatcttatctatccatcatccatctcatctatctatctatccatcatctatccattatgtctctatcatctctctctctctctctctcccccccccatcatctatctataatctactcatcggtttatctatctctatttctatagctatctgtccatccacccatccatccatccatccattcatccatccatccatccatccatccacatatccacacatcctattggctgtttctctggacaaccctggctgtgggcagcaggtactcactgtccttctggtgccagcgtgctgcgtgaagatgctgcccacagtaatgaaacaggaactcatgtgccgagcgtgcctcagctccctgcagcaagggtaccaggctgtggccatcaatcaccctgatttcatgaagagaacacagagcagagtcagaccacgggttcccaggcagccttttgcacctgggaacacatctcccagaatgcaaggctccccagcaaatggagcagagatgagctgtctctccagtcgctgttcagattacaggttgctgagcaggatacatgtggttatttcaagacacagtgtctctaagtgttggggtcatttgttatgcagcactgcataagcagagtgcacacacacacacacacacacaccccaacacacagcactgtcaccttggaggtcaacacaaagccttcaaattccagctggacagcccacattcctaggttggcttttcttacttttttttttttatgaggcagagtcttgctctgtcacccaggctgcagtgcagtggcacaatctcagctcattgcaacctctgcctcctggtcaagtgattctcatgcctcagccccctgagtagctgggactacaggcacaagccaccacactcggccaatttttgtattttttgtagagatggggtttcaccacgttggccaggctggtctcgaattcctgacctaaggggatccgcccatctagcctcccaaagtgctaggattatcggcatgagccattgcatccgacctgtccttactttttaatcataacagaccccaagacacatggccacatgggtaaaggagatggtggcgcatgcctgtaatcccagctactcgggaggctgagacaggagaattgcttgaacccaggaggcggaggctgcagtgagccgagatcatgccattgcactccagcctgggcaagagtgtgagactctgtctcaaaaaaaaaaaaaaaaaaaagcttatttatgtaaccaaataccacctgttccccaaaatcctattgaaataaaaaaaaaaaactaaaaacaattaaaaaaaatcagggaacaggcagccttatctccacgtacctgtcctggggcacctcgccacccaccagctggaccacagtagggaacacgtccatcaggctcgtgggctctccaatcactcggccggccgggagcacccccggccagtggaagatcccgggcacgcggatcccaccttcccatcctcccatgcccttcccacctgtaagtagaagacatcgttaggattttgccggaaactgcccagtctgtacacacatctggatgtatttgtgcataggtatgtgaatacgcacagccacccggatgcacacatgcacactggggcagcctcagcttcccaaaaacagccacagcaatatttccagaatcatgctactccctggcctcttgaatatcggtgggtcgctgtggctgattcaactgttctagtcgatctatgctacctttatttagaataaaataatgtattaaaatattcattaaatttaataatttaaaaatgtttgttaactatcaataatttttaaaatatgtattattatgcatcaatattaattgatgcatttaaaatattaaaatagtaataaatttattaaatatttaaaaattaagactataataaaataaattttaattttatctgaattatttatttatacctctctgtattctactaaaatgtaaaccctttaaaggaaggggatgtgactttttatctgcctgtcctgctcatctaggtagaacttgtactacagtaggtgctcaatgcattctttttgaaatgagcaaactcattttcagttcaacttgttctgggaccctcagtggtggcagatatttggtcgaatgcatatgtgtccccgatgtccacaactcacctttgtaaattccgttccatccccctaactggctgtgtccatctcttgcctctaaatgtcctccatggtcagaggtgaaatacgtgaatgttgagttctttaaaccattgtcttcgatggcattaagaaccttacctttacagaaaatggaaagtttcaggaccaagaaaacaaagcagcatccactagttcaatgcgcttcttcctttctgcaggagacacctcttgccaggaagtcataagaagagaccacacttactcggaggccgtggttacaatgtgatcccaaagtgtaagacatagctaatcactgtgataccacaggactgtttacaatgcaaaccaacaataaaattcgaagccccccaaccgactgatggactctcccttcagccaaggccattccaaagttaacctgaaaaactaggtcaggccgggcctggcggctcacacctgtaatctcagcactttgggagcctgaggtgggtggatcacctgaggccaggagttcaagaccagcctggccattatggtgaaacctcatctctaccaaaaacacaaaaattaggcaggtgtggggggtgcacgcctgtaatcccagctacttgggaggctgaggcaggagaatcgcttgaacccaggaggcagaggttgcagtgaggtgagattacactactgcactccagcgagggtgacagagtgagactgtttcaaaaaaaacccaaaagagggccaggtgtggtggctcacgcctgtaatcccagcactttcggaggctgaggcgggtggattacgaggtcaggagattgagaccatcctggctaacaccgtgaagccccgtctctactaaaaacacaaaaaattagccaggcatggtggcgggagactgtagtcccagctacttgggaggctgaggcaggagaatggtgtgaacccaggaggcggagcttgcagtgagccgagatcgcaccactgcactccagcctgggcgacagggtgagactccatctcaaaaaaaaaaaaaaaagaaaaaaaaaaccaaaagaaacaaaaaacaaaaacaaggtcaggccatgttggaaagtagtgggggcggggggagtggtggacatgcgtcatgataccctcctccctttggaattcaggcacaactgaccagcattcacattgaaacagagacctatgactgagagaaggccaggcacagtggctcatgcctgtcatcccagcactttgggaggccgaggcaggaagatccattgagctcaggagttcaagaccagcctgggcaacatggtgaaaccctgtctctacaaaaaatacaaaaattagccaggtatggtggcacatgcttgtatgtagtcctagctactcgggaggccgaagtgggaggattgcctgagcctgggaggtcaaggctgcaatgagtcaagatcacaccatgcactccagcctgggcaacagagtgagaccctgtttaaaaaagaaaaaaaagactgatagaacagactctttaagtctgataagaaacatttaccatgtattctctctgaagcctgctacctggaggcttctttggcattatgaaaccttggcctccacaaccccttatcataacccagacattcccttctattgattctcagataataactcaaccacctgccaatcagaaaatctgtgaatccgcctttgacctggaagcccccctttcagtggtcttgcctttctgcactgaaccaaggtacgtcttacacgtgctgattgatgccgtatgtctccctaaatgtataaagctgagctgcatgccgaccaccttgagtacatgttctcaggacctcctgagggctgtgtcacaggccacttgtcactcatatttggctcagaataaatctctccaaatattttacggagtttgactctttcggtcgaccccaagataccaccaatacaaaacacagaatgaacacacaacgccaagaggttgccagtgagcacgcttttttaaacatagtgccgtgtgtgtgtgtcacataataaagacactggggagagggaaatggtgagactcagtgatgacagaaccctatgtaggaggaagcagggctgtaactagcatctatgggcattggcgtattggaggctgatggctcagcagcgcagaggacgccctgcaaaccaagcagttgctttatccctggaggccactggtcattgaaagcactgaaagtcaaaatgatataaaccacaaggtcatctgtagctctgaaaatgcagactttgaagcctgctgtaaactgaaaagtatctgaggcgggtctcaatccatttagaaagtttattttgccaaggttaagaatgacacagcctcaggaggccctgatgacatgtgcccaccgtggctggggcaaagcttggttttgtatactttagggagacatgagacatccatcgctacatgtaagatgtacattggttgagctggaaaggtggaacaactggaagtggggaatttaaacatattctcattggtaactgattgaaagagttatcaatagaaaggaatgtctgggttatgataaggagttgtggagaccaagcttttatcatgcagatgaagcctctaggtggcaggcttcagagaaaatagattgtaaatgtttcttatcagagttaaggtctgtgtggatgttcatgctgcggggggtagaatgaggcaagcccaaccccctcttcccgttatggcatgaaccagtctctcaggttaaattttagggtgccctggcaaaggagggaatccattcagatggttgtggggggccttcgaatttatttttggtttacactgtgaaccaatcccgccctatcactatgcttgtctcgggagatatgttcagattctgcaaggattttaatatctacactctcttaagaatctgcagcctcgttggtcctctccagggtttcttcaaggccatagaaggaaggtgacctctctgcattgtccgaactttattgctttagtttctgtaacttctaatgaggctgttaagtcattggctgtgtagaaggttgacaatatagtttggatgtgtgtccccgcccaaatctcatgtggaattgtcatcctcagaatcggcggtggggcctggggggaggtgactgaatgatggggacagagttctcatgaatggttgagcaccatcccccgcttggtgctgcggagggagtagcttctcacgagatctggttgtttaaaagtgtgcggctcttcctctcctctcttggtccttctcctgccacaagacgcctgctcccccttcgccttccaccatgagcaaaagctccccgaggtctccccagaagcagatgctgccatgcttcctgtgcagcctgcagaaccgtgagccaatccaacctcttttctttataaattacccagtctcaggtatttctttgcaagaatggactaatacagttgattttgtgcaaaattagactaagtaatcagaaatactgaaggaccaaataaatgatatgagagaagtttttctccctattcttcgtcttttatttctttttttttttggagacagggtcttgctatgtggcccaggctggagttcagtggtgcaataattatagctcattgcagcctcagcctcctgggctcaaatgatcttcccacctcagcctctggagtagctgggaccacaggtgcacaccaccatggctaattttttaaattttttgtagagatggggggggggggcgtctcactatgttgcccaggctggtcttgaactcctggtctcaagccatctccctgccttagcctcccaaaatgctgggattaaaggcatgagccaccttgccccacctgaaaatgcagacttttaagactgtgaactctatcacgatgcttgtctcaggagacacattcagattctgcaagaattttaatgtctatgctcttttaagaatctgcagcctcactggtcctctccagggtttcttgaaggccatagaaggaagacagcgtgtctgcattgtcctgaacattaactttatcgcttcactttcggtaacttctgatgatgacatgaagtcactggctgtgtagaaggttgattttgtgcagaattagaccaagtaattgggaatactgaagaagcaaataaatgatatgggagtgtgttctgcccccattctttgtactattattattattaaagagacagggtctcactctgttgcccagcctggagtacagcagtgcaatctcagttcactgcagccttgacttcccaggctcaagcgatcctcctgcctcagcctcccgagtacctgggactacaggcgtgtaccattatgcctggctaagcatttatttttgtagagatggggtctcactatgttgtgcaagctggttttgaattcctgacctcaagtgatctgtccatctgggcctcccaaagtgctaagagtaactcttattctttttctttttttttgagacggagtcttgatctttcacccaggctggagcacagtggtgcgatctcaactcactgcaacctctgcctcccgtgttaaagcgattcttgtaccttaacctcccgagtagctgggactacaggtgtgcaccaccacaccgggttagtttttgtatttttagtagagacagggtttcaccatgttgcccaggctggtctcaaactcctgacctcaggtgatccgcccgccttggcctcccaaagtgctgggattacaggcgtgagccaccgcccttattctttattgcaagttggttcatattcagatggccagtctgttacgccctatgttcaaacctgaggccgagggtggagtgaggctccatggtaccttgacttacctatgagccagtccatctcctccacattatcaccatataagccatgctgacttttccccaggaatgcactcgtggtcacaaggggaatgtgcacatgcagcaaagaaaggaagaggagaaatggcccatgcttgtgtctgaaagaagaaaacttccttgagaatacacagaatatacagtacaccaaagggacccctgcacccatacgttcactccagcactattcacaagagccaaggcaggggatcaccttctgagttcatcagtgggtgaacacagaaagaataaatggtgggccaggcgtggtggctcatgcttgtaatcccaacactttgggaggctgaggcgggaggatcacttgaggccaggagttcaaggccagcctgggcaacacggtgaaatgccatctctaccaaaaatagaaaaattagctgggcgtggtggcttgagtctgtggtcccagctacttgggaggccgaggtgggaggacggcttgagcccgggaggtggagcttgcagtcagccatgatcataccactgcactccagcatgggtgacagagccagaccctgtctcaaaaaaaaaaaaaaaaaaaaagaatatattgtatatgtccacaatggaatactattcagccataaaaaagaatggaggctgggcacagtggctcaagcctgtaatcccagcacttcgggaggctgagcctggcagctcagttgaggtcaggatttcaagaccagcctggccaacatggtgaaatggtgaaaccccatctctactaaaaataaaaaaattaacagggtggggtggcaggtgcctgtaatctcggccactcaagaggctgaggcacgagaattgcctgagccttggagacagaggttgcagtgagccatgatcacaccactgctctccagcatgggtgacagagccaacgctgtctcagaaaaaaaggttatatctggtatatgtacgtgatggaatactattcagccatcaaaaagaatgaaatcctgtcatttgcagcaatacagatgaaacaggaggtcactatgttaactaaaataagccaggcacagaatgaccaatactgcatgttgtcactcatatgggagagctaaaaaaaaatcgatcacatgaagatagagaatagaatgatagagaccagaggctgggaagggtgaaggacaaagagaagtggtttaaagagtacaaacatacagtaagcttaaaggagtacattcaacgtctgatagcagagtagggtgaccaaagctaacaaaatgtattgtactcaggagatggacactgtaagtatgctgtttgatcgttattcagtgtatacatgtaacaaaatttcacacataccccatacatttgtacaaattaaaaagtaagggccaggcacggtggctcacgcttataatcccagcactttggaaggcagaggtgggaggatggcttgagcccaggaattcaagaccagcttgggccatatagtgagacattgtctcaaaaaaaaaaaaaaaaaaaaatgagacattagaaaaaggccaggcacagtggctcacttctgtaatcttagccctttgggaggccaagatgggaggattgtttgagcccaggagtttgagaccagcctgggcaacatagtgagaccccatctctacaaagaatgcaaaaaaaaaagtttaaaaaactgtcaataaaaatgtacagaatccaatggcgtgtatgtcaatgctattcgagccatcacatgacatccacttcgagactctcatatgggaaacccagccacatgaaaaggttggcttctgcaaagccgtctcctccgagggttggtgtctgagatcccaaagattataaggggactctcagatgctctgagcagttaccgtgtcttttttttaaattaaactttatttttatttttttagcgacagagtctcactctgtcacccaggctgaagtacagtggtgtgatcattgcttactgcagcctcgacatccgaggctgaagcgaacctcccaccttagcctcctgagtagctggcattgcaggcacacaccactatgcccggctaatgattttatttattgtagaacctgtcttcctatgttgcccaagctagtctaaagcacctgggctaaaagatcctcccatcttggcctcccgaagtgctaggatgacaggcatgagccatcgcgtccggccccatctcctctttaagatgcgatggttgcttacctttcaatataggaaacagcttcctttagcataagactcgctgttttctccagaaccatgggttgctccgtgacgtcatggtttctcatcaggatacagttccagcgtcgcacaaacccgaaggaggagtaccaagagatgaaaaacaggcagcccacgccggccatgccggtgactgctctcgcggagacagagaagaaaccgcaggtctggccggcagccagggtgagaatccccagcgccaggaactgggtgtaaccccagagctgcgccctcagggcggcgtccacttcggggggcctgcctgggtcacagtcgtttgtgagcgtgaagggcatgccgtagaaatagtcaaatccgtggttcagggggtggtggcagtgatccccgcgggatgcacaattcacaccctggtgccattttcctaaaagaaacgcaaatgttcaacagagacccgctttgaagcagccctgtctgctgcaaagaacctcggaatcattccgcgtcggcaggaaaagaaaagtctgcaaagagcaaaactggaaatggaaaggcaatgaatggattggatacctgtgtttaaatgaacgcattctgatccgtgaagactaacgaatgcatccatgtcagaacccttggcaagtgattaaaggtttaagactttcggccgggcgcggtggctcacgcctgtaatcccagccctttgggaggccgaggcgggcggatcacgaggtcaggaaatcgagaccatcctggctaacacggtgaaaccccgtccctactaaaaaaatacaatacaggtggcgggcgcctgtagtcccagctactcgggaggctgaggcaggagaatggcgtgaacctgggaggcggagcttacagtgagccgagatcatgccactgcactccagcctgggcgacagagccagactccgtctcaaaaaacaaaaatgaaaataaaagtaaaaattaaaaaaagtgagagagaaagaaagaataaatccaccctcagagtaggagacacacagacttctacagtataaagcactggccctgtaatcccagcactctgggaggccaaggtaggtggatcacttgaggtcaggagttcgagaccagcctggccaacatgctgaaaccctggctctactaaaaatgcaaaaaaaattagccaggcatggtggcacatgtctgtggtcccagctactcaggaggctgaagcaggagaatcgcttgaacccaggaggtggaggctgcagtgagttgcaatcgtgccactgcactccagtgtaggggacagagcaacactccatctcaaaaaaataaaaataaataataaataaaagaagaaaaaactttaaaaaaattcaaaataaaaataaagtggcaggaaacttgaaaaggaggaacaatggttgtcctttagaaaaccacagcttcggacaagttagggtgttgcggctcctgtgaatgggacagtggctttgagtgtgagaaaagcacagaggggaactggggaccctgcacagagatcccaccaccaggtcggggcgggtggcctcaccactgcgctcccacgttctcatgtgtatgacggggacagcacctctaaacacacaggctgggtaaggaatgaaggaggtaaccagcagactgcctggtgcttggcggcataaaccaacatctccctcctttcctctccgtgcagaaaggagtttaaggggcaggcctgagctagtgccccttacaaaggctggcttgtaagattccccgtggctggtgtttgagatctggatttccaatggagaagtcacaccattaaaataataagctgactgtgcctaaactatatgcaaaagcaacgtggttcatgctaaacacctcctttggttctgggagtctggaattcgggtgggtgccaggcagtgagtgcctgcaggaccagcccccaacagaaacccctgggcactgattctcccgggagcttccctaatagacagcattccttgcgtgttgttgaaactcatttctggaggaatatggtgcatcctgtgtgatcccactgggggaggattcttgggagcttgtgtctggtttgccctgggcttcattccgtgtaattcccatcactgattctgcctcacctcctttgactgtcataaatcacccatgagcacaactgcatgccaaatcctcctagcaacttcctgaacttaagggtgctcttggagacccctgacatgctgtctgttataaagagggtgttctgcccctgccggggtttattgtctaaaggaaggcagtgtttgttaactctggggcttttgagatggtgagtggccatgtagagaaggataatgtctgaagaaggtcgtgataaatggggacaagctgaagactgataggtccagagaagaaaagagggcaatctcctaggattttgaatttaagaagaaaaaaaaactcatgaaaaactggggacaatccaataggcatgagatggaccaggcaccaacttctgattcagaggacacaggattgttttcctttgcaggaaaacgggatctttttttttttttttattctttgagacagagtctcgctttgtcacctagactggagtgcagtggtgtgatctcggctccctgcaacctccgcttcccgggttcaagcgattctcctgcctcagcctcctaagtagctgggactacaggcgtgcgccaccacgcctggcctgggatcttttttatcacgaatattcccaaccaccgtataatgtgaggctcccacatatccacacctatgaggccggttgcatagccatgctgctgcaagattcttgcaaaagtggtttcgttctcagggagtccacctgagcctgcgttccactgaagggcccggtatccattgctggcgtccatgcctgtggggcagagaagacaggaagaatttactttcctttctctagaggagcacttctcaaccagagggatttggtgtctgagatctggatttgtgcacccgagccaggctgctattatctatcatccatctatcatgtatggagctatcaattatctacccatctatcgtctgtcatctatctacctacctacatacctacctacctaccgacctatcacactattctcgaaataataagcatggccaatgtctggagatgtttgtggtgtcacagctcagaaagggtggtgtgtggtgctactcgtatcgggtgcgtggagccgagtgatgctgctcaagaccctacatacagtgcacagaacagccccaccacagagaatcatctagccccaaatgtccctcatgccaaaacagagacaccccaccttaggatgacagacgccatgtgatctatcatatgtctatctatctgtttacctagctatcacctgtcacctgtctatctcaatatggatccatcatctatcatctatatctatccatctatctatgtatctattatctgtcattatcattaatcatctagctatcaatcagctatcattatctatcatctgtctatcacttatctttctatcatcattatctatcatctatcattatctatcaatcatctcttatctagctatctagctatcaatcatctatcacgtcatgatcaatcatctatcattatgtatcatcatcatctagatatctagctatcaatcatccattatctatcattatcatccatctagcatgtatctagctgtcaatttatctatctatctatctatcatctatcatctatctatatcacaatgattctcaacttggggaaactttgctctctctaagagacacttggtcttgtgatcagtcatactggctcggaataaacctctttaaaatattccacagaccttggtttttctgttcacatcctaatgatcacaacttttatgtgtatgcacacaatacaatattccttacataaatacaaggaagacgatgaattgcaggtgatctttgtaccattgcccctgtatcttcaccatcagtactcaactgttacagatgacagaatgagtgcacacagatgtacccatttctccatcatctccgtgacaccaacctgatctgaaggaatgtctccctgtgaggaatgcagctcggcttggggtgcagagcggggcggccgccaggtgctgagtgagcctcacaccttcctctgcaagctggtcaatattcggcgttctgagcaaagcacacaaatgtcattgttggaagggagacatgcatttggcttaagcagatccctgctctgaaaggcacaggaatagctgcaaggacttcaccggatttcagaattagttgcattatggtctcctgcagcggtagattgaccccatcctaagtttggtgttgatgttgagatggatgacatctctctctctctctctctctctcacacacacacacacacacaaagtatatgagacaatttatgactcatataacgaggctttctggggagagcagggcaggccttccaagctcatgtgaaataaggaagcaaggaaaggagatttatgttttcaattgtggtgagggtgtggggccgagatgagggttcccatgcaagggtgggggcgtttatggtctgaatctgccatcagcaccaaaggagacagtccctgtgctttcttatctgcttgtccagatggggaacacagacagaagaggcttaaaagctttcatcatcagatatcaaaaaactgtgagggccgggcacggtggctcacgcccgtaatctcaactctttgggaggcctaggcgggcagatcacttgaggtcaggagttcaagacaaacctagccaacatggtaaaaccccgtctctactaaaaaaaatacaaaaattagtcaggcaaggtggtgcacacctgtaatcccagctactcgggaggctgagacaggagaatcgcttgagcccaggaggcggaggttgcagtaagccgagattgcaccactgcactccagcctgggtgaaagaacagagtgagaccgtgtctcaaaaaaaaaaaaaaaaaaaaaaaaaaaaagaaagaaaagaaaagaaagaaagaaagaaagaaagaaaaggagccaaaagaggtatccacatagaatggaatctatggaatatgactcagccactgcaaggcgtgaggcacggtactgtgaaagcctcctgacataaaagaccacaggttacataattccatctgtatgaaatgtccctaacaggggaatctatagagatggaaagtatattagtggctgccagaggctgagggttagggtgctgagagagttggaggagtgttagctggggctgccataacaaagtcctacacacctggccgcttcaacaccagatattggttgggcacggtggttcacgcctgtcatcccagcactttggggggctaaggtgggtggatcacttgaggccaggagttcgagacaagccttggcaacatagtgaaaacctgtctctacaaaaaatacaaaaattagctgggcgtggtggcatgtgcctgtagtctcagctactcaggaggctgaggtgagagcctaggagatggaggttgcagtgagctgtgatcatgccactgcattccagcctgggcaacagagtgagaccctgtctcaaaaaacaaaacaaaataaaacagaaaaacaaacccagtagacatttattctctcacatttctgggagctggaagtctgagatcaagcatgggcagggctggttcctcctgaggccaccaccctgggctcgtagacaccatcttctccctgtgtcctcaggtggtcattgctctgtgtgtgtctgtgtcctcatctcctcttcttataaggaccccagtcctattggatcagggcccaccctagtgacctcattttacctgaatcacgtctctaaagactcagtctccaaatagagtcacagtctgaggtcctgggggtcaggacttcgacgtaggcgtttaggggacacagattcgctcctcgctggaggtgatggctaaggggatgcagagtttctttgggggtatgcaaatgctctaacatggtttgtggtgacagatgcacagctccatgaatagaataaaagtccctgaactgtacactgtaaacagatgaaccgcatgttctgtgaattacaaccaggcctgctcagggtgttcgaaaggggatccctggacagggggcagattgattgattgattgacttagagacagggtcttgctctgtggcccaggctagaatgcagtggcgcaacctcagctcaccataacctccacctcccgggctcaagccatcctccactctcagcttcctgagtagctgggactacaggcatgcgccaccacacctggctaattttttgtatgtttcatagagacagggttttgccatgttgcccaagctggtctcaaactcctgggctcaagtgatccaccttccttggcctcccaaaatgctgggatgacaggcgggagccaccgtgcccggcccacacagggcagactgctgcaggtgctgcaatgttcactgcaaagaagggaggccctgctctgcggggaccgctcctgaggttggcagctattgaaaagcagatgcagcctgcattctggggcggtccttctaggagaaaagcccaccaaatggaataaggagctttctcaccttttctcctgttgcagaaagcacgtgagcaccactcaagcgctctgctggtaaggttggcatagaggctactactctgtgtttgcacatgccactgcagtgggctgaatgggggtctgcgaaccgatctgtccacgtgctgaccccccaaacctgtgtgtgagaccttgcttagaaaaactgtctttggagttgttattaggtatcccgagatgagatcatcctggtttagagagggccccagatgcaatggccagtgtccttctgagagacagaggaggagacacagacacaggggagaaggccgcatggggacggaggcacaaactggagtgatgtggccacaaagccagagatgcctggagcccccaggagctgggagaggcaggaagggtcctcccctacagcctctcagggagctctgttggtgtcttaatctcctcttttagtaatccatatcagattagggctcaccctaaggacctcagtttaacttaattacctcttcaaagaccccatctctgaaaacggtcacaccctgaagtaccggcggttagggcttcaacctacaaatttggaggaggccagaatttggcccacaacagacgttgtttgcaaacgtcatcaacagaagatgagatctttacagcgggcaggccttgctgcaatggccggtgtccttataggatgaggagattaggacacagacgcagaggagaaggccccgtggagacggaggcagagactggagtgatgtggccacaagctcagggacacctggagcccccaggagctgggaaagtccggaaggatcctcccatagggcccccagagggagcccggccctgcccacacctggatttaagatttctggtctccagacctgggagaacaaatttccgttgttttaagctacccattttgtggtagtaatacattcaccccctcaccgcagttccgcatggtttaaaagggcctttttacctgttggtagttttttgttgagttctgaggccctaaggagtttcctaatttctccaggcagattttaaatgcaccattccgtcaaactcacataacatcatcaccaatagcaacaaccaactgtacctcagtgtattgttcccgtagcaaccgagatccccagtgcctagatcatccgccatgatcagtaggatatttggtttaaaggcatttgcagttttaggttcacacgtcttcagaagcaagcataaaaacagtagcaccggcaaagagtccctggagagaaaagcgaaacacagaaatgactatctacaatttggcaagggaagtaggcatttcaaggcagctcgctgggaaggcgaaggtcttaccactaaattaagacgttcagctttatgggaggttattgtcttggcctgaattcctgcactggtgtccctgggccaaaccgagggtcagactgctatttcttgtgacccaatagcgagatgcagatgaattgggaaagaagagagtttttaattctgtaaccagttacaggaggaaggcctggaaattctctcccaaccaactcaaaattacaaagctttccagagcttatataccttcaaagctatatgtctaagtgtaagtgtgcatttatctaaagacataagtgattaacttcttctaatctgtaattaagatctgagtcctgaagaccttcctctggagcctcggtgaattgacttaatctagatgggtccaggtgctggggtgattacccttatcttgtctcctgctaaatcacagagttctggggagttcctttagtccccaacaaagcttgtttgtggaggtctggggagtttcttcagacccacaataaaacttgtttaatcctaaatgggtcctgttaagaattccttcgttatcttgtcatgcttcaaaggcccaggagaggcctgggcagaactcttggtgtgcttttgttacatcccagcctgtgcataaaggcgctggttgtttcagcttttagtatgtaacttcacactcagtcagtgctgaaacagttgttacggaggcctgcattagtgagacctggcctgccacactagaccatacaggtcagaacaaactggaatggagtcacttgtgttaactgccacatcgtcaagctgaacagggaaacaggtcagttttccaaaaaacagaagatttgagtaagcaagaagaagatgtgtagttcatctgagctaacaaagtctcccgtgctttaaccctgtaagaaaagtaactttgaaacaaccaatctgctttattattcttttttttcttttttttgagatggggtcttgctgtgctgcccaggctgtagtggcatgatggtggcttacagcaacctctgcctgattctgaggtgggaggattgattcaagcagtccttgaactgcagtggataggtggtgtcttagtgttgggggatcgtggctgtgctctccggggaggacgcgaacgaggggtgtgtctcagggtgtgtgaggggacacggctctactggggggcaggggaggaataaggccatggggagggatccggtgtggccagcagggcaatggccgcggaaggggacaggacggggcgtgtcttggagggtggcgagaggcacggcagtgctgctgaggcaggagaatagggtctggaggcagggaacctaaggctttccatgccgacttcctagaagtaaattgaaaggaaaatcctaactttccttttttttttaattttaatttttattattattttttgagatggagtttcactcttgtcgcccaggctgcagttcaatggcatgatccgggctcactgcaacctccacctccagggttcaagcgattctcctgtctcagcctcctgagtagctgggatcacaggtgcctgccaccacgcccggctaatttttttgtaattttagtagaggcccggcctaatttttgtatttttagtagagacgggatttcaccatattggccatgctggtctcaaactcctgacctcaggtgatccacccgtctcggcctcccaaagtgctgggattacaggcatgagccacctcgcctggcgggaaaatcctaactttccatgcctaagtaacaaaaggaccgaaggcttccctttgaccttttctattgggtagatagtagactggctgtctgcaaccaatcggactgatttcgggtctagtcttcgtgtgcaactttgtgacttcaccctagtctctgattagttgggttttgcaaccaatcagatgtttgcacaggagtgtgacctttgtaacttcaccctttggttggctgctgcctgcaaccaatcagactgatcgcgggccaccacttcagttacatgaggtgagcatgaagtggccaatgggaaacttctagggggtatttggacccaagaagattatgtacccgggcccttgagccgctgcttggtcggctcccacactgtgacgtgtccttttgttttcaataaatccctgctttccttcttttgttgcttcattctttctttgctgggcgttttgtccaattctttgttcaaaacgccaagaacctggacaacttgcagtcacgaccctctaccggtggcactggggcgcaaatgaagctgggaatgcaggacccggcgcatctgaggaagtgcagcggggcatggcggtgctagagggtggggacatggaggcggcacaaggccaaggcgccgggggatggccagagggaagtaacggccgcgcttgtggtggagatggggacgggacagagaagtcttggggggtgaccggggtaggcacggcggtgctggggggagggcgcccaatgaagcccacgggggggaaaggggcgtgtcttaccgagcgtgttgggggagtcacagccgtgcttgggaggatggggtctgggggaaggacggggcgcgtcttagtgggatgagggggagggcacagccgtgctgggaaggcaaagggccggggggcgggatggagcatgtcatggtggggccgaagaggcggggggcgggaaggggccttcttagaaatcgggagggcgtcacagctgtgctcgggaggacggggcgttggggagggacagggagcgtcttagtggacccggggaacacggccgtgctggaaggcatcgagctggggggttgggggcgggacggggtgcctcttaggaagtggggcgggcaaggctacgcttcgggggatggagccttggggcgggacggggcgcgtcttagtggggcagagcggggggcgcggttcggggcgggtcttagggagcctttgaaggccgaatccgggcagcggtgtagctgggcgtggaaggcggaggacccagcagggcgtgaccggcccagtttccgctccctccgggtcccggccagccttcctccgccctcccttcccttcctcctttgttctctttccctgcccttccgccttcccttcagttcggtctcctccacccgcccttcgtcccctcagtcgccccccatccctgggctctgctgtctggcgtctttcccgggcacagaacgcgcctccagctacattttggagactacaaggcgccggacacaaccacgccctttacaggggcccaggctcgcccggggcgcccctcgccgtgctcgcgaccccctccccaggcccccaccctaggccttagtatgggccgcgtcccggggtcccaggcacctggcggcgggcgcggcgcgtcccctccgcgcggcggatcgcatggccgagcgctggcccagagcgcaggaccttgccctgcgcactccgcgcccgggcgccgctagtgccaaggcttccgccctctcagctgcgggatctggg

SEQ ID NO: 853 - DNA, 26774 bp, Homo sapiens
tatgacaagaaacgccagacccaacattgtcctgctgatggcagatgaccttggagtgggggatttgtgctgctacggtaataactcagtgaggtaaagatggactctgaccccctccctgtatgtgggagtctcccttaccacagtgttcacgtctttgccgttgcagagaagggtttctggagagaagtcattgtctgatgttatcggcaggaatagcagaggtcactggggaaaattgcaaaatgtcaggagaccacttaacctcccagtttccttagattctagctgttggtggtggcgttttcattgttgggcaaaatttacatttaaaaattggccttttttgatcaggcatggcggctcaagcctataatcccagcactttggaaggccaaggtgggagcattgcttgagcccaggagtttgcgatcagcctgggcaacacagggagaccccgtctctacaaaaataataaaaaaaaaaatctactgggacatggtggcgtgtgtctgtggtctcagctactcaggaggctggggcaggaggattgcctgagcaagggagattgaggctgcagtgagctatgatcccaccactgcactccagcctgggtgacagagggagactctgtttaaaaaaaaaaaaaaaaatcaccttttaaccattttaaagtgaacaattcagtggcatttggtacattcacagtgttggacaaccgtcacccccacaaagaagacccccatttcccatcctatccccatgccctgttaaccacaaatgtaccctctgtctctatggatgtgtctcttcttagaatttcatatacaagtaatcatataaagtatttattttctcaggctgccgtgacaaaggtccacagactggttggcttagataacatcagcttattctctcacagtcctggaggctggaagttcaagatcaaagtgtgggcagggctggttcctcctgaggcctctctcctgtccttgtagatgccgtcttctccctgtgtcttcacagggtcgtccctctgtgtgggtctgtgtcctcatctcttcttcttatgaggtgtcttagtctatttcaggctgctataaaagaataccatagactgggtggcttagaaacaacagacattgattctcccacagtcctggaggctggaagtctgagatcaaggtgtctgcagggctggttcctcctgaggcctctctcctgggcttggagatgccgtcttctccctgtgtcctcacagggtcatccctctgtgtgtgtctgtgtcctcatttcctcttcttataaagaccccagtcctattggataagggtccactttaacgacctcatgctaccttaatcacctctataaagactccatcttcaaatacagtcacattctgaggtcctgggggttaggacttcagcacaggaatttgggagggacacaatttagctcataacatatggtaagtggtgtttggtgactggcttctttcacttagcgtgatgttttcaaggttcattcatattgtagcatgcgtcagcacttcattcctttccatggctgaatactttttcattatatacatacaccacattagtctacagttttaaaaatatcttccttgaattacttctaaagtctctggtacccggggctctttatttctctactctctatcgatagaccaatctggctcttgtaaaaatacatagcatcttttagtgtggatttaaataacattgtttcttcttggaatgcagatcacagtctagtcctatatcttaagcatatatttgttgattgaaaggcattggtcttcttcttcttattttctttctttctttctttctttctttctttctttctttctttctttctttctttctttctttcttccctttttcttttcctttctttcctctatctcttttttttccttttatttttaagacaggatctcattctgtcatccagactggagtgcagtggcatgatcttggctcactgcagccttgacctcccaggctcaagtgatcctccctcctcagcctcctgagtagctgggactataggcatgagcccccacacctgcctaatttttgtggtttttcttttgttttgttttttttttgttttttgtttttgtagaggtggggttttgccatattgcccaccctggtctgagctcaagtgttcagcccctcttggcctcccaaagtgctggggttacaggcgtgagccatcacactcagcctccattatcatctttctgtgggattatggaaaaaaaatgttgtacccatgggatcaagattggatatggtttagcttttaggagaacaggcacgtcttttttttaacctataagttttacaaaatttttgcaatgtattagacaaacaaaatgggaaataaattaaactccaaaatgtcacaatttggtcataaaataggtcaattttaccgtaagatatatattaatgggaggctgaagtgggaggatcatttgaagccaggagtttgagaccagcctgggcaaaatagcaagacatgtatctctgcataaaattttaaggccaggtgtggtggatcacacctgcaatcccagcagtttgggaggctggggaaagtggatcacttgaggtcaggagttcaagactagcttggccaacatggtgacacctcatctctactaaaaatataccactgggcgtggtggctcatgcctgtaatcccagctagtcaggaggctgaggcaggaggatcacttgaattgggaggcagaggttgcagtgagctgggatcgcaccactgtactccagcctgggtaatagagtgagaccacgtctcagaaaaaaaattaaattaaatacaaatttaaataaattagtagggcatggtagcgcacacctgtggacctagctacttgagaggctgaggtgggaggatcacttgagcccagggaatttaaggttgcagtgagctataactgcaccactacactccaccctgggcaacagagcaagagactgtctcttaaaaaaatatgaaacacattaaaattttacttaatctaaattacccattaattttaggtccttgataagaagaaattggctaatttttccattgaaatacatttttttctcagactcataaaactgtataccgagtgacctgtattcatttgtaatagttttgactaaagatatattttaaacttatgtttccatttgcttctaaccatcaatgcatataaggaaatagacagattaaagttttaaaaagatggattttaggtttaccagaaatagagtcaacttgacccaaaatagaatagctttgatccttgatcattgtattgagaatttttagaaactcacctgctgaattcttctttggtctgcagcacacctaatattgaccgcctggcaagtgaaggagtgaggcttacccagcatctcgcagctgcttccatgtgcaccccaagtcgggctgccttcctgaccggccggtaccccatcagatcaggtgaggcaataaaaaggcagcaacatttcagtctcaccagaatgcattctaatgattagtttttgcaaatctttataagaattctcaaaaggtcactcagagtattagggatctaaattcaaaggtggttgttatccctgggcagcttaaatatgtgtgcctctcaccaggtaccactgcacctgctcatctctgtgcatatagcgacagggtttaggcctcttgggggcaatttgccaacttatggtcaacactcccattttcaggtacttgtgctaagatttctcaagagacccctgatgtctttaagctagcagagaccatgcagtggttctgagataagtggatcaaatccacctctgtggatgagattggaaaactagacacagttgggaaaaaaggtataactgagaaaacaaaaaggaaatgaaacttttacatactcccttacttgaccccatcatttcaagatttagacttaccaagttgatataacgacaattaaatgtgttcctttgctgcttagcttaggatcaatacctacaaacatccactcaagatcaatattatgaacaacaatttttatacccagctaaaatatagtggtgcccttagacactattgaagtgttcatggttatcagactctatgtgaaatatcgtgtcatgctgttgcattttgtttaattctagtatttgcttgtcataattttagtatacctgccttcacagtttaatttttcagtgaaaaatttttctgtatgaattttcttcctcctaagtagtagattctcatccaatacattcaaggaatgaactaattaggttaatgagaattatactaaaattaagagtaaacattaaaagtttttgtcccataaatattgatttattattatctttttttgttgcctaatgaccttctttcataattcaaggttctccattttgttcaaaatagtttggtttctagataagcagtctctatataacacagtaccgtgtatgaagagggataaagatatgaatttgtatgagtttccaaaaaaaactacacttataatttcaggatttcaggattttttctttttttctttctttctttttttttttttttgagacagactcttgctctgtcatccaggctggagtgcaagggtctgatctcagctcactgcaatctctgcctccctggttcaagtgattctcctgcctcagttcctgaatagctgggattacagtcatgcaccaccacacccggctaatttttgtatttttagtagagatgggatttcaccatgttggccaggctggtcttgaattcctggcctcatgtgtgatccacctgccttggccacccaaagtgttgggattacaggagtgagccaccatgctctgcctaatttcagggaattttaagtattgattatggtgaaataaaatttatttttaaaaattaagaaaaaaattaggtgattggtggagagatttcaagtcattgccatgtgtatatttttaatcatttgacacaaacggttcagtttaattcattctacttatcaaaaatttcagcaaaacagttcaacagcaagataatggtctaatgcttcccttaataaaactgtttctctttcctatcaatgacactatctagagtctactttcttcttcttccaaggtaggatccttgaaatatacttttttcttttgagatggagtttccttcttgtcacccaggctggagtgcaatggcatgatctcagctcattgcaacctctgcctcccaggttcaagtgattctcctgcctcagcctcctgagtagctgggattacaggtgcctgccaccaagcccagctaatttttgtatttttagtagagacagggtttcaccatattagccaggccggtctcctgatctcaggtgatccaaccactttggcctcccaaaacactgggattacaggcgtaagccactgagcccggcctgaaattatcatttatttatttcttgctgatcttcacttgtggttttcttgtgaattccttttaaactataggtgtataatattgtccaccagtataaatctacataaaattatatggaggccaggcacggtggctcacatctttaatcccaacactttgggaggctgaggtgggtggatcacgtgaggtcaggagttagagaccagcccggccaacatagtgaaacctcgtctctactaaaaacacacacacaaaaaatagccaggtgtggtggcacacatctgtaattccagctagggaggcggaggcacgagaattgcttgaacctgggaggcggaggttgcagtgagccgagatgttgacactgcactccagcctgggtgacagagtgaaactccatctcaaaaaaaaaaaaaaaaaaaaaaaaaaaaatatatatatatatatatatatatatatataatatatatatgtatgtgtatatacacacacacacatatgaaaaagaaattgtcactcctacacttcttcatttcagattctcaaggatacttttaaaaatgtatttatacccagctaaaatgcagtagtgtcctcagatactattgaaacattgaaggttagcagcctctatatgaaaaactaacgaaggttatttgttgttagtctgaaattcaaatggatataactaagtgtcccgtatttattctggcaaccctaattccaagggaatgtttgcatttagcaagtgaaaaaaggagggtcaaggacgtacagccagaaagcaacagaaaacttggggaagaatggctttgaggaggtgcgggaggagaggactttaagcatgtcgggataaattcggtattagcaaagactatggtgctaacttattgacttctgtgaatttagggatggtgtctgcctacaacctgaaccgtgccttcacgtggcttggtgggtcaggtggtcttcccaccaatgaaacgacttttgccaagctgctgcagcaccgtggctaccgcacgggactcataggtatggcgccggaactctgcccgtggaaacgtgatcctgcagcctctctgtcatcgtgtctaaggtgtttccggggatgttggctttgtgcgcgccagtttgaccgacttctctttgagataagacacttggagaaggaaatgatcacacattgattgagcatgtgtagaatcgagggcatagtattggaaaaacaatgagaacagaaagcaaacaagtgtatccaaagttgccactaaaatggaatgttgtgttggagggatacgatgtttgtgacaccattattagcagaaaaaccagtaaatttgtagagaagtactgttgaaatgggaaacttacagcattaagagttgtcaaatggaggcaattgctggtcgacttagatcacttaatattctatgcccttttggcgggggtgggggtttggggcggggggacatgagcttgtgagggagcctttcaccgaaaaataagtttgtagaattccagtcctagaagatagtcctctaagaataacttgtgtgatcaaatccttttgggaaatgctactcaaaagcattgtacggtccactatttttgaggattcctaatgtgaattgtaagccacagctccgagatatccccagttaaaaaaaaggttaagaaattttctatcagtagggcatgtattcccatgcaactcccagcagcgtcctgtgagtgggaattctctagattagctttgagcagcgttcttacatcattagagcacgggattcagatctgactctgctattattcattaatgtgactcaggcttctgaataaatctagatagctgggcacagtggctcagacctgtaatcccagcactttgggaggctgaggcagaagaaggccaggagttcaagaccagcctaggccaccatagcaagaccctggatctacaaaaataaaatgttaaaattagctgggcatggtggcacgcacctatagtcccagctactcaggaggctgaggcaggagaattgcttgagccaaggagttcgaggctacagtgagctataatcatgccactgcgctccagcctgggcaacagagcaagactctgtctcttaaaaaaataatctagacaatgtgttttttattcataataaagggtctgggaagtgttgaatataataatgtgtgcggacaaatcagaacgtgacctggccccctagagtatgtgcttgataaaaggaattacttgcattatcagaatcgtttggttcttgatgaaattctttggctactttgtcatccctagcttgaggacctagaagaggtgttccatctatacataaaatctcggttacctttcagtgagatggaataagagggtcggaaggcactgctagataaaagcatgaatgtgcaaggtgcactgaaagtccttggtattgtccccaccaaacaaccaagacatcgattctgccctcctagcaagctccagatacctggaaagtttctcattgttcatgaggttgtttggtaccaagcaaaaggtttcttctgaatgaacactaggctcctctccttgtcgcaagcaaagaggctcctgctgcatggcttttgtctgaaagaggcatattgtagggagaaggctgttggtggcatgtctataccagggaggtatttggggatatcaagaaaaaaccatgatgacaacagaatgaaagttatatttgacttttccaaagggaagcccacattctagaaacagaccggcattgaatgctgccatgctgccatggtacgattttattttacttttaggcaaatggcacctgggtttgagctgcgcctctcggaatgatcactgttaccacccgctcaaccatggttttcactacttttacggggtgccttttggacttttaagcgactgccaggcatccaagacaccagaactgcaccgctggctcaggatcaaactgtggatctccacggtagcccttgccctggttccttttctgcttctcattcccaagttcgcccgctggttctcagtgccatggaaggtcatctttgtctttgctctcctcgcctttctgtttttcacttcctggtactctagttatggatttactcgacgttggaattgcatccttatgaggaaccatgaaattatccagcagccaatgaaagaggagaaagtagcttccctcatgctgaaggaggcacttgctttcattgaaaggtatttagccatttcttgcctgatttcctgcatggaaattttatttttatttcataggaggtcatcacaccttgataacatgggcctttaaaagtctcttggagagaatgtgcggcatttggctttctgttcctgtattaatttgcttagaataatggcctccagctgcatccatgttgctgcgaaagacatgatctcattctttttcatggctgtgtagtattttgtgggatataatgggagctaaacattgagcctccatggacataaacatggaaacaatagactgcaaacttctagaggagagagggagacagggagaccaggggcacatggttgcaagactacctattgggtgctctgcttaccccctgagtgcaatagacccacgtaacaaactggcacatggagaccctgtatcgaaaataaaagctgaggaaaaaaaaactttaggtgacatttgtgatagacttgagtctcctcttaggtagaattaaatagttaaatttcctgcaaattttgaatgctcaaaaggcaaaaaaacaaaaaccaaaacaaaaacaaaacataaaaacatattttgctcacctccccatttttaatgttttaattttttttttttttttttactttttgggacaggatctcactctgccacccaggctagagtgcagtggtgcaatcatggctcacagcagcctcgacttcccaagctcaagtgatcctcccacctcagcctccagagtagctgagactacaggcacctacaggatgcctggctaaattttgcattttttttttagaaatggggttttgtcatattgcccaggctggtctcaagttcctgggctcaagtgattcacccactttggcctcccaaagtactggggatacactacgcctggccacttacccctttttaaaaatgaaaactagagttgccatattttaatctatattgcttcagtgtggattgttatgtaaattgattaaacctggggggtaaaattttttttctctgtctcagacacagccggaagagctctctgtccataaactattggatagtggctctgtatttacagatacctagttttaagttttctgtgttcaacacaagctatgcaggcataactataatgagctctcatcatcccataccagctcactcctacgttacaaattattactattattatttggagacagggtctcactctgtcactcaggctggagtgcagtggtgcaatcatagttcactgaaacctcaaactcctgggcaccagtgatcctctcaccttggcctcctgagtagctgggactacaggtgcacatgaccacacccagttaattttataaaattatttttccatagagacaaggtcttgctatgttgcccaggctggtctcgaactcctgggttcaagcgatcctcctgccttgacctcccaaaatgctgggattacaggtgtgagccattgtgcccagcctgggttacaaatgaggggcacattaaagttgttggtgtggattctcattgacactgtttgtcaccttccttagtggggttggcagggagtggagaggggaggatatattgttactccaccaggctgaagggtatgcagtggaatatcattcactcatatgcccctgtgcccatcagattcattatttattccaacacaaccatgagaacagtgatcagccacccactcagctctccattcatcttacctgcccttcccgtcccaacccatttgcttgggctatctttttgggaatatattcaatctccatctccttcccttctttctatgctggttgtgaaaaatgtgtaaaggagtagctttagaatgactgcatgtgacattaaaatgcaaaacacaaggtcaggtgtggtggctcatgtctgtaatcccagcactttgggaggctgaggcaggaggattgcttcagcccaggagtttgacaccagactgggcaatatagtgagctcccatctctacaaaaaatgtacaaaattagccaggcttggtggcgtgtacctgtggtctcagctccttggaaggataaggtggaagaatcacttgagcccaggaggttgagccatgattgcaccactgcactccagcctgggcaacagagtgagactttgtctcaaaataaataaatacataaaatgcagaacacaaaaagcaagatgtaaatgaggggaatttatttctctcttggggtaggcaggctacagatacagtgaggttatcttgttctctgccatcctttgtgagcagcctcatggcccaaggtagatgccaaagctccagccatcagacttatgttccaggaaccatgaaggaggtggaagaaagaaagaagggaaaatggagagtaaggagcatcaaatccttactgtggcacatctgagtctgtccttaagatatgattcttctgaactcatacctaaaagaacactttgaaacaatagatgaggagaattcatactttttaacccattcaacaaagattaaaagatttattaagctgctactttatgtcagatgctaaactggacacaagagagtataaaatgaactgcgttaaacatttttgttgttgttgttaagacagggtctcactgcgttgcccaggctggagtgcagtggtgtgataatagctcacggcagcctccacctcccaggctcaagcgaaccccttgcctcagcctcctgagtagctgggatcacaggtgtgccattaagcacagctatatttttgtattttctgtagagacgaggtcttgccatgttgcctgggctggtctcacactcctgggctcatgcaatgctcctgcctcagcctcccaaagtgcaaagaatataggcatgagccactgtgcctggctacatgaaacattttactgggaacacaaatgttctgttatccttcattcctcctcatatcctttcaacataaatcttgtggtatttacgactcacaggagtggtattgtcatctaaagtacatagaaaacctccgccagctattatgagatcttttcatcagtgcagaatcgcatttaaatgatggaaatgacttcatatttgtgaaggtaattttggtaactttctaccccttaggtacaaaagggaaccttttctcctctttttttccttcctgcacgtacatactccactcatctccaaaaagaagtttgttgggcgcagtaaatatggcaggtatggggacaatgtagaagaaatggattggatggtgggtaagtattcagtaacagaactgtaaatatctgaagtacgggctacagaaaaacaaatctgtactaactgtctcaaattatgtccagccccttgcatagcatagatacctgaaaagtatctgtttcatcccttaattggattaaaagctggcttttaattgttcagcaataccagtgaaatatattccccaagataagtcacagtttgtaaatacaagttttcccatctttaaaataaagacagccacttttctgaaaaactcattggcaagataaagaaagctgcactgtaaagtatattgtaattcctggccgggcacgcagtggctcacacctgtaatcccagcactttgaaaggccaaggctggcagatcacttgaggtcaggagttctagaccagcctggccaacatggtgaaaccccatctctactgaaaatacaaaaattagccaggcatggttatgcgggcctgtagtcccagctgctcgggagggtgaggcaggagaatcacttggatccaggatgcagaggttgcagtcagccaagatgagaccactgcactccagcctgagtgacacagcgagattctgtttcaaaaaaaaaaaaaaaaaaaagaatattgtaatttcaattcccaattattttgatggatataaaagggaacgttattctgattagtcagttctacaggaaatacatagaaaattgggatggggatttaacacaactaaagcaacttatttcaaaggcatagtgttcactataaagaaatgctaaggataataaatgagcaggtgggaagagttactgtatgcattccagaataataaatagctgtgctagttgaattgcatttgcccacccccgcctctatgtacgtgacagagttgtccttcctctcagcgatggtgtttcattttggaatacagtacttttcttcttcttctgagtgcaaacttctgaaaacggtgctctgccgaaccattgaaacgaacaatctcccagttatcagccgcctctgttgacttatatggagtgcctttgaaagaaacagagctattttaatttaaatgcatttaaggggtgttaatcaatcacattttattataaataactttcttttctctgaaaaccaccatctaagtgagctataaaatactagttaaaattactgaagaactagtggtgtcggataggacaaagaggggaatcttgtcatgggataaatttctcttgtatatttccactatgtgtgtttacctctaattataggtaccattgtaacatttactgtctatatttaatcccaaagaggagatagaatacagagaggggccaggcgtggtggctcatgtctgtagccccagcacttttggaggttcaggcgggaggatcacttgatcccatgagtttgagaccagcctgggcaacataccaaggctccatctctacaaaaaaatacaaacattagccaggcatggtgtcacacgcacgccttgtagttccagctacctaggaggctgaggtgggtggatcacttgaacctgggaggtgggggtagcagtgagccgagattgcaccactgtactccaagaccccgtctcaaaaaaaaaaaaaaaaaaaaaaaaaaaaaaagaggccgagtgcggtggctcacgcctgtaatcccagcactttgggaggccgaggcgggcggatcacaaagtcaggagatcgagaccatcctggctaacacggtgaaaccccgtctctactaaaaatagaaaaaatgagccgggcgcggtggcgggcgcctgtagtcccagctactccggaggctgaggcaggagaatggcgtgaacctgggaggcggagcttgcagtgagccgagattgtgccactgcactccagcctgggcgacagagccagactcagtctcaaaaaaaaaaaaaaaaaaaaaaagaatacaaggaaagtcagtgctgccaggctgccagtaaggcatttaagcagaaatggggagaaaaaaggaatgtgttaaagggaaaaacttatgggcttagttaaagggaactaaccctgacatccaaacccttttgaagcttgctgaactaaagctaagctctgtatttcttaatttaatctttgctgtgggatgtgtatgtgtgtgtatatatatacacacccagctgcagttattttatttgcacggtataaattacaaatcacttttatgcataatactatagtcagatttaatatgaattaagctatatacacacacacaccatatgttatatacatatatatatacacacaccccatatggtttatatgtatacacaagttatgttttatacatatacacacatagcactgtatgttgcatatatacacatttattatatatagtttaattccttggtaacgaaatacaaacactgaaaggtgttacagttaaaaatagctataacactgtagcctttatggaattatataattgggattttttttttttctctgcttcttttgaaatcgcttactatagttgtacttagtcaaaggacagtttcccgtaaagggattttctgttaaagtctatatctgagtgtttatcactaagaaataattatgtttgttttacagtatatgtaaatacatgatgaagacgtgttacaaaagctagcaattgcattattaaatggctaatattatttgacacaggagaaatgatgagtagctatttttctgcgtaacatctcccaaatattctgagttttctccgtcatttcttataaaaattctaccaaaataaagacatattgaaagtcagacaggtatctctgtgggtattattttactatttaacaatatgagtataaaactcaaaggtttagtaacttattaactttactcaaaaataagccataacaatgctatactcatgcaaatgcaaatacaacgtgcaaaatgaacttaatgaatcttcgggaattcagtaacattttaaactttccaatgaaagaaacttgtgcctattaaaaaacacttttagtcctttttttttttttttttaagacacagggtctcactcttttgcccagtctggctggaatgcagtggtgcgatcacagctcaccacacacttgacctcctcggctcaggtgatcctcccacctcagcctcgtgagtagctgggactaaaaatgtgcaccaccatgtctggccaatttgtgtgtgtgtgtgtgtgtgtgtgtgtgtgtctctgtgtgttttgtagtggagttttgccatcttgcccaggctggtctcgaactcttgggctcaagcaaacttcccacctcggcctcccaaagtcctgggattacatgtgtgagccaccaggcccaaccttaatcacttttcattattggtttctttccaggtgtctttggtaggaggtcttataagtgacctattaccattagtatttatatattcatatgcatctgtgtgttttcactttagacactatacagacaattatttgcaaatatatttgttctggaacagaaaaagaatttgcagctactatatttgcacagtataaattacaaatcacttttatgatttttttatactatagccagatctaatgtgaattgataatttacatataattatgctgttcccagaaagcctttacaatctttcatcttacaaaccctgggctttaaaatatcttaatttctaattatagcatttctaaaaaatagtatatgtcacttctaaaacaaatcactgagtttacgtataaacagttttctgtgcagctagttaagctagttacattttcttttatctttgaatgggacaagagcatagcacagagatgatctagtgtaaactagaaatgcagtgtgacctcaggcccaggacgatgttatctgttgattagcaaatgctcaacagacatcagaaaggaaatgaatgttgtttggaattttgctagaacagctttctacttattattttaaaaaactgtcctcctgagggattgtcaacacattaaagacagtgtctgctgagtctagcgcagcattaattgtcattagatcttaaccataacccaaacagcaagaataacctgcaatttccatgtagacttcagatagcagccaggacagcaagtctctaagggaggtggtgctgtgccctggagtacggggatggctttgctcatatgttcctggaggtgtcattttgcaaactgtatttttttaaattaatgttcatcggtttatttaactgctgggccttcttggcactgtctatttgaatcgtttggggcaatgatgaccttatgtattattacacgatttgtataataaaatagattttattatatattcaataataaaataatgaacacattatacaataaaattgtataataaaccagtactttatatattgtatatgaactattctacattttaaattaatataattaatgtatctagtatatttaatataatttatataattacattaatataataaaattaattaaagtaatatgtgacacatatcattcaattatataaaataatatagtatatatttatataaagatataaatttatgataaaatttaatatattaattagacatatattataaaatttaatatgttcattatatattatacatttattacatatactcatattttatcttatagttaatatattttcctatgtcaataaacatatatttttacatattgcattgatatacaaaatactatataataaaataatagttacatgttattatataattacataacaatttttacacaatgataaactattatataatgatatgtttctagtattgtaaagtcatatggtataataatacatagtatgtattgattgtacatattacaatatattttgttctattccataattgattatattttaatatataacaattctttatgcatttttaatacatcatgttatatattaatatgtatttgtaagaaatatgtactatatatcatacaatatataataaatatataattagtaattcaaatgtataaaagtatgtattatagtaaatatagcatatattatacattattacattatatattaaatattttaactgctggatataatatatattatatacactatattacgtacagtttaaaatagtatgtattacaatattatatgattaattatacaatatcgtgtagtgcagaataacattgaaacgctatgtgtaataaatacatagtagcagatatgtaataaagcagtggtgatctgcatcaagaggtcaacgtctttgtgtctctgaccctctccaggtaaaatcctggatgccctggaccaggagcgcctggccaaccacaccttggtgtacttcacctctgacaacgggggccacctggagcccctggacggggctgttcagctgggtggctggaacgggatctacaaaggtgattgtgtgtagagaaccaacgcctgtccattttaaatcagtagtctctattggctttgtgtttgcttgaattcatttgccatgatgttcagatattttgatgtgagttagactcttattaagctagaccgaaaaaaaaaaaaagctgcaaattttggggcagtttccaagagcttcaaagtaaaatgtttgaagcaacgccaaccccaggagacagcacagcatctcaatgaccatctgtggcagatgtcccagcctccgcacgattgacatttgaggctggaggattctctggctgggggcatcctgtgccgttgtaggtgttgaacagcgtctgtgggctccacccacacatgccagtagcacccaccgcagagcagcaacaaccagaaatgtctcctgatattgcccagtgtcccctggggacaaggtcatttctaagtgagaagtgctcctttagattaatcctcacttggattctcagatgcaggtttttaattcaatcacaccaatgatgctattcattatgctttaactagtgttatgtggatcagaaaaaagagtttttcatttgactggggtgcctagctcctcatggccagcagattcttccagctcactttgatagacttcatgccgggttgttcaagaactccatggcacccactcttaggcatcaccaaaggcatgccaacagaaagaataatttaaaaaagaattctgcattcgctattttccccctacccgctaaccttccaagtaaaacaaaaaaactaaaagggtatcaaaatcgtcatcattataaaatcagaatgtttgaacttccttatatttcattaaaaagttctgtgtgtgtgtgtcttatatatgtattttcctggaggtataatcactatgtatataaattcaccgtattaattgtatgtaatataatatagaatcatatatattcatcatatgtgatatataatcctatatatagtcactatgtatatatagttactatattcattacacataacacatataatcctatatatattcgctatattcattatatataatacatgtaattttacatatttactacatataatatacataatcctgtacacattcactatgtatatatagtcattatattcattatatatacacacataattctatatatttactatatttattgtatagatcattatatataattttatatattcagtatatataatataatatataatactatatatatttactatgtctatagtcacatattaattatatatagtatatagaattctatatattcactgtatagagtatacataaccctacacatattcactatatgtactcactatattcattatatattacacataatcctatatatatattcactatattcattgtatatatataggattgtggatactggattatatattgtaaattaatagaagtgagctcctgaaagcattcacctcctctggcttgtcatgtggacttgctgtagtcataactgttaattagcaaagactaaattggtgctaaacctagtagaaaaagtgaggaacagatctgagtcaccatatatatgccatctaacgaagtgtgattattacagtcatgatgattctaacaactgtacctattatatattataataattattataattgcatgagtatgtgtgagtgtaaagcccctgtccttaaaaagcacacataaccctggaataggactggcaaaattgttgtgagcatttctcaggctttgggacaggatgcctgtttctcagggtgcttcctgtgaagcgatgaattcaatggatagagagatttagatctcctgggtaagcaatgggttttgttctagtctagttacacctcgcagctctgccccacaaagatacaggttattaaatacgatgaagaaaacatcaggatggctttatgattgtatgttaaaagcacatagatttggttcagtgagcttgtcgagtttttcttataataaagaatggtgctacttgggaggctcaggagggaggctcgcttgagcccaggagttggaagctgcagtgagctatgattgcgccactgcactccagtctgggtgacagaaggagacagtgtcttaattaaaaaaaataaaaataaaaaaagaatggtgccaagaagctgagctgcctttcaacactggttagactggttagatcagtgaatgtgtcagcagtgaattttacctcattttctgctagaggcttccggttttgtgtttctttgtaatgctgcctgtcagacaggtgcgcacgtagaagacattcaatgaaaatttcacataggaagagaccttttcctccagagaggttcctattttttcttaaagagtctagacatatggtcttgacactggcatttggcatagggccatttttctattctgtaacaaccgcctcagtctcatgattgatcttacggcaagggcttcatttttgttttgtgctcagaaacacccaaggggacttttgtctaagaagtgattctcaactctgcctctggccatttttctactcacactcctctctttcttcctctatatgggaaatcacggggtaaagttttttagcttgttcctcaaggatcattataatgtggataaaacctgtatttttcttttctttttctttttcttttttattttttggagacagagtctcaccctgtcaccgaggctggagtgcagtggcacaatctcagctcactgcaatctccacttcctcgtctctgatcccccgacttcagcctcccgagtaggtgggactacaggcatgcaccaccatggagtgcagtggcgtgatctcggctcaccacaaccttcgcctcctgggtttaagcgattctcctgcctcagcctcccacgtagcttggattacaggcgcccaccaccatgcccagctaatggttttgtatttttagcagagacggggtttcaccatgttggccaggctggtcttgaactcctgacctcaagtgatccgcccacctcggccccccaaagtgctgggattacaggcgtgagccaccgtgcccggccaatatggttgggttttaactcatctttggttgtgtcgtaatctttggttttaggtggcaaaggaatgggaggatgggaaggaggtatccgtgtgccagggatattccggtggccgtcagtcttggaggctgggagagtgatcaatgagcccaccagcttaatggacatctatccgacgctgtcttatataggcggagggatcttgtcccaggacaggtatggaaacagtgtttgctcctaacctagggtgatatatttgaacataagtggatatacttgataattctatgtgtgtgtgtatgtacatagtatattacttaattatcaatattctgcccatagggccagatgtctttctccccttggtgcgtggtggaatattttgttttcttcttagagtataccttaatatcctttgtcatattacacttatgcctgtgtgtgtttgactgttctcatggatgggatctgattctcatacatcatcacatccctcacagcttctagaccattatgcaattaagtgttaaatgattactgaataaaaacatgtatgcctagagcaggtgcggtggctcgtgcctgtaatcctagcactttgggaggtcaaggctggcggatcacttgaagtcaggagttcgagaccagcctggccaacatggtgaaacccccatctctactaaaaatacaaaaatcagtctggtgtggtggcacgtgcctgtaatcccagctacctgggaggctgaggtgggaggatcgcttgaacccaggaggtagagattgcagtgagccgagatctcgtcactgcactccagcctgggtgacagggtgatgccctgtttcaaacaaaaacaaaaacgaaaacaaaacacgtatgtgtaattgcatgtgtgctaaatgatattattctttctggtttgcactttgtctatgagcttatttttaatttaatttaaatttattttttttgagacagagtctcgtcctgtcagccaggctggaatgcagtggtgtgatctcggctcagtgcaatctctgcgtcccgggttcaagtgattcttctgcctcagcctcctgagtagctgggactacaggcgggcgccaccatgctcagctaatttttgtatttttagtagagatggggtttcagcatgttggccaggatggtctcgatctcttgacctcgtgatccacccacctcggcctcccaaagtgctgggattacaggcacgagccaccaggcctggctttgtctatgagctttaaaatgaacaaatacatcctgtgctttaacgatttaattccatgtatgtggggtgatatctattcattaaatgtgaagttttattggaatcaaaagggcgtaaatagcttaatttttccaatccacaacagtaactcatattgtcttgcaaggtatcaggataatagttctagctgttctcttcttccatgacctcagaaaatgaatgttttgtttctctttctttttgttataaaatgagggaaaaggagaaagttttaagaattccttcttccgccaggcgccgtggctcacgcctgtaatcctagcactttgggaggccgaggcaggcggatcatgaggtcaggagttcgagaccagcctggccaacatggtgaaaccccgtctgtactaaaaatacaaaaattagcagggcatggtggcgtgtgcctgtaatcccagctacttgggaagctgaggcaggagaattgcttgaacccgggaggcggaggttgcagtgagcagagatcgcaccattgcactccagcctgggtgacagagcaagactccatttcaaaaaaaaaaaaaaagaaaaaagaaattcttcctctttatctttcgcctccttctcttcctccccttccttttcctcctcctcctcctcctcctctttcttctgctataaaatgcgtgactgaaccatgcctctctcatcaccttctacacacccccttctctcccaagagtgattgacggccagaacctaatgcccctgctggaaggaagggcgtcccactccgaccacgagttcctcttccactactgtggggtctatctgcacacggtcaggtggcatcagaaggactgtaagtatgaaggctgtggacacgtggaaagacgataagggcccggttccggtctccttcgtctcctggcggaagctgcaccatgtgcagatattgcccagctatgatggttctttttcgctgagaaagccacataaacagtgcactgcagtaggattttattttattttattttattttgagatagggtctcactctgtcacccaggttggagtacagtggcgcaatctcggctcaccacaacctccacctcccaggttcaagtgagtctcctgcctcagcctcctgagtaactgggactacaggcacctaccaccatgactagttaatttttgtatttttagtagagatggggtttcaccatgttggccaggctggtctcgaactcctgacctcaggcgatctgcccacctcagcctcccaaagtgctgggattacaggcgtgagccaccgtgcctggcctgcagtaggattttagagagatgtgtttgtgagagagatttgtgcccaaagggttttattttaaatttttaaaatatttataaaatagagacaagatcttactatgtggcccaggctggtctcgaactgctgagctcaagtgatcctctctctttggcctcccacaggtgtgacccaccacagccgatccactcaaagcattttaacttagggaggtgagtgctgacacagacaaaccaatgccattgcaatattttcatgacttagatttcccgagagaaggggatatgccctaccacacaggttcacggtgggaagcaccagggcttggcttggaagcagaggcaggaaggaatgaggagcccaagcaacagcctttattattaggctttccaagggaaaggtcaggcagggcagggtgaacagcttcacactggtagtttgagtaattacagtaagtttggagcaacagagactgcccctagctgcctggtacccggtgctgggttgatttaggacagagaaaatatcagcttactgtgtgagagttagataaaggaggtggatgcttgcataggtagggtgtgttcctaagtgagttgttactatttgtattagtccattctcacgttgctaataaagacatactcaagactgggtaatttataaaggaaaaagtggtttaatggactcacagttccacatggctggggaggcctcacaatcatggtggaaggcacatcttacatggtggaaagcaagagagaatgagagccaagcgaaaagggaaatgccttataaaaccatcagatctcgtgagacttattccttaccatgggaacagtatggcagaaactgcccccatattcaattatctccacttggctctgcccttgacatatggggattattacaactcaaggtgagattagggtggggacagagccaaaccatatcgctatttttaggaatcagctagtcctgggaggagcagtctttccccaagtctatgaggcccctcaagctgtcaaaatactagcctggcacagtggctcacagttgtaatctcagcacttcaggaggccaaggtaggaggattatttgagcccaggagtttgatatcagcctgggcaacattgcaagaccctgtccctacaaagaaaaaaaaaagaattagccaggtatggtggcatacaactgtagtccagctactcaggaggctgagtgggaagtttgaggctgcagttggcaatgatcgtgccactgtactccagcctgggcaacaaagtgagacactgtctcaaaaaaaaaaaaaagtcaaaacattataggatacagaaaattaagacaacatgattaatgtgtgtgtgtaagtatgcattagcttgtgtgaatgtatacatgagagagagaacaagagagaaagagagactatgaatacccacagcttagggatgactgaagtaattattctagcaacgaggagtaaattcttcaacatgacctgccgggtggttgcttatctccaccttccttcctttctaacatcctagtgattgtttctgtcccacattcgtgctatggaagtcatgcaaacaaatataaattaacaaatagcatcgtttgccttagacctgtaaagaaaggtcttttggagtcattgcatgaaattccagaattcttacttggttggatttaactttatttgcaggaggaattttctctgatgggatcagtcacttgtggtgtgatgtatcttcattttgatgtggatagtcccacataaaacaattaaaaaaacaaaaataagtaaataaaaatctatgtttttaagattctatatgagtgcaggacatgatcaatgataaataaaacagccccgtaaacagcacaagcctcccaaatttaactatagaggattatacagtagaattttttgttattattttttctcatcataatttcagaagttgggagcatggggctgacacagtgctcagtgccacggtcatgggaccagggttctttttttctacttggccacctctgacatgctagctttcattcttgtgcatctcacctcatggttgcaaagtggctgcagttcctccaagcatcacacctgcactccatgcagtaaggagggaaaaaaccaaaggcggtaaagaatccagttagatgatttgatcctattttagtaggaaagcacagcttctctgcaagaccccaccagtagacttcggtataatcctcatttaccagaggctggggaatgcttatattttctatctaaaattgatctctgcagccaggcatggtggcacatgcctgtaaatccagctactcgggaggctgaggtgggagaatcacttgaacccaggaggcagaggttgcagtgagctgagatgttgccactgcactccagcctgggcgacagagtgagaccctgcctcaaaataaataaataagtaaataataaaaaatgaaaaataaaattgatctctgaaaatagatttggtaaccatttcatatcagaagaaagaagaaaggaagggagggagggaggaaggaaaggaaggaaggaaaggaaggaaggaaggaaggggaagggaagggaaggaagggaagtaaaggaaggaggaaaggagggagcgagggagggagagaaggaaggagggaaagaaagaaaagaagaaaacagaaatggaggaaaaaaggaaggaaagaagagagtgagaaagagggagggaggaagggaagaggagggagggagagacagaagagggagggagaaaaggataaagaatgattaactttgccaaattacttttgtcaatttcagatgtgaaagtggcatttagccttggatcatttttaattttgtttgtacctaatcagattgaggtagaattttaatttggtattcccagaattaccctattcccatctgggtcatcattattatctccaaatattctcatgacaagatttctaaaaatgtctgcaagtttgcagtgaaattgtgcattgttcttagagttgaagaaatgctactgttgctgtgtaatgctgtgcagaagagtattatcaatcactagaaaaagcttttgagaaaaacatctttaacgaaaagagtcctaaaatcaccacaaagatggtatcatacataatgcaacttgttttttaggtgcaactgtgtggaaagctcattatgtgactcctaaattctaccctgaaggaacaggtgcctgctatgggagtggaatatgttcatgttcgggggatgtaacctaccacgacccaccactcctctttgacatctcaagagacccttcagaagcccttccactgaaccctgacaatgagccattatttgactccgtgatcaaaaagatggaggcagccataagagagcatcgtaggacactaacacctgtcccacagcagttctctgtgttcaacacaatttggaaaccatggctgcagccttgctgtgggaccttccccttctgtgggtgtgacaaggaagatgacatccttcccatggctccctga

SEQ ID NO: 854 - DNA, 153538 bp, Homo sapiens
atatatttaaattttagaatattttaatgtccatttcttcagtgaatgcattttgaaattattagaattaacaatttaaaaagagcagataaaaggatatatggaaaatgcaaacagtcggttcttgctaattcaatttcagattctaggcatgatgtgattttccaaacaaccaattaaaaaaaactccttacctcgaaaatctagaaattcaaatgcagacgtgtctttggaaactacaaatgattacagcccatgtgacaggaagcacgcggccttcggctctccggatcgtgtgcaaatgtgcagggggagcccccgcgggtgacgtcagtgtggatgaagtcacgggtgtggcagagcctgtggggctctcaagctattcgagggttttgtaactgatgctctacatttgtttgcattggataaaattgtgtgtgcttgtttaccatatatatatatatatatatatatatatatatatatatatatatatggatatataattcgatctgagctgggactgagaagaaaatagcaattgcaactcaaagcaactatttacacacattcaatgctgaagtattgcttcctgccctaagttcctaagaggtattgccaccctgaagcacgacccatgccgtcagcagccctcgtgccagctgcttagaaactcgtgtctccagcacgatgtgctcgctgccaacagacaagagatgcacggcgtttccgctgcagagattctgtggttctgcactgaggtatgcatcggagcaggggacggggaggacccgaggggcttcgtggcccagagagaacgtctgcactggctgtttaggaaggctcagggtgtttgaaagacaacgttaagctctgggtgagtctgcacggggctgaaccagactccactttgcagctccttggtttcccggggtgaggaatcacaaacacctttgtggttggggaaggaaatgggcttgatggggaagaagtgtgtgcggagaactttgcggagcatgttctgagcgagacagcaaggtcgtgagcaaacgcccagcccctcaaagctacacagcctggaggggaaaggggaggggaggacattcaaatatacaccttaatactgatgcagaaagagcttcatgtgaccacaatccccacgaacaaggaaagcatcaggtagtgttttttaaggaaaaaaaaaaatctgcggtgttttataatacattctttagaagcaagaggtattgtcacaaccaccctttcttcggtattggaagaccagcaaactgacagtcacacctgacaggaaaccttacagctaatggggggaggtgccctggactctcaggacgccgggaccctggctctggctgtcctgatgggtggccatcccaggcaccgcccctggagaggtggcgggtcagaattgtgacttcttcatgccggggagggcaatctgtatgtctctggggaggagtagtgatgatggggactgatgcggtgtgaaaacgagacagtgagatttgacagcggaaagcaaaatgcacagggacaacgggcaagactgacaaggagtgcaccctgggcctcatcagcgtcccggggtcccctgaaagactggctacaactccgaccggacaactcgggcgagctcacttccacacaaacttcagactcaatatggcaaaacataatcagacaggaccagcagccaactgcccggacggagctcccccacaccaccctcgggattccgcccctaacaaaccccgcgtttgcatccagatgcctctgtccctagatacggtgtgagaactccatttcagagctggaatttgctccccagattaaatcctgccactgataggccctgtgccatctgagagcgggaggcagccaagaaacttctggaatttgtggaagccaagatggcaccggtgctgccggcacagacccccgtggttctgagctggaccccggcagggaggagcccccgtgggtggcaggggcagctggtgggcttctcctattcccctagcctcagaattgcactggccatgctttgaggtcccactcagacccctcttggggtggggaggttgggggcggccccaggtggccaaaacacaaaagagacatctggttaccttcctgggaactgccctcccctgtggctatgaccccccaccctgaggacccagcacccctcccgggagcgcacatgcttccgggtaaataaataaataaataaatgcaacctcggatgtttatttggtatttccctctccgatgagtcagcttccaggaccaacacctccactcccgatggggagacccctgggtggagggtcgggggtgagaggcggctctgagacccccgaggcctgggcacacgggcgtcgtgcccggctggcatttgctgtcttggcctgcatgcatgtgggcgagcccctaaacccgctcagtgcagggagcgcggctcacccacagcccacggggcgcggtgctcgggaaagtgcgggtgggcaatggggggtggcggagctgtcgtgacatgcccccttcgcaccccctcttggcggattactggcactttatatcagattcatgaatgcaagtgtgtgtgcgcatgtgtgcttacatagagaggtcgggtcgtagaggaacactgtgacatagacagaaacaaaataaactcaaaaacagggtattagccagagaaccgaaaatagtgtctcgtgggacgtgggaaaaagcaataaaaatgagatcttaaccacagcttttgttctaaaagtcaaataatacccaaagccatgatctccactggcggcctctgtcccgagactcgaggccgaggccagccctgaaggcacttgttctccaccacgtgctgaacggatgacccagaggcagcggggtttccagggaagggagcgaaagggaagaatggatgaaaatgaaccctgaataactgtgatccacacagaagttagggctgaaatgaccacataacaccacgtccggggagggcaactgtggcgcttggaaagcacaacagccaaatacaaatattactgtgtttcgacaaacagagcacctcgggcagcgggtgggcgccgcctcacacactctttgaaacgttgagcttggtgagttcgttggcttcttctattcctgtttcgtcacagtcgtctttctctatggctttgccaaatcgacccctttcttcggctttgacgggctccttccacggtctcttgggggacaggtgggcatccttggcctgcgtgctgctgtcagaacccagagatgtcttgtccacatactggacagaaggcaccaggttggcaatctcgtctgtgggagaccgtccgatgctgccatccacctggacgcggatgtctggggagatggacagctggtgctgtgggatgaccctgtgatccgtgcactttgggtacaggtaggtcttcatctggcctttccccttgacattcacggtccctctgtagtcgaagtcatagcccatcttgctcaagacgcggtagctctcttcgctcacctggatgcggcactccacgccggtggtgtccatcctgctggcgatgttgacggtgtctccccagatgtcgtacagcagcttggtggtgccgatgaccccggccgtgaggggcccatggttgaagccgacgcggagcttgaagttgaaccacagcatgttgttgttgaagtcgtccaccacgcgcatcatctccttggcgaactcgaacaggatctgcaggtgctcctgcgggtggctgccgtcctgggcctgcgcggtgttcagccctgacgccgccatgtacgtggctccgatggtcttgatcttctcgatgctgctgtagtccggcttgcttaggagctcgtcaaagtccccgatgagctcgttgaggacccggtagcactccttgccgccctcgtagttctcctcgtagaactcgctgaagttgacgatgctggcgaagatcacccctccgctgtcatggttcttggagtaggtctgggacaccttcagctgctcagccacgtggtaggggatgatgttcctcagcagccagtctgcctggtcccgcatgctctggatcttggtgcggtgaagatccgcttccacgtctccgtggtagtggaggcggtagctgacttcaaattcgcgattcaggaaccagaccaacaagagcaggagaaagaagacgagaaccacctcctggccgatgaggctggcgggccgccggaggtcacgcggcaccgaactattgcacgggttcctctcggaactggagagcaaagacacgggaaagggagaggttactgctcggcgcttccaagctcagaacagccccgctagctacgcaaagctttgttgagtccaggccttcaacaacctgaagctgtcaagctgcccattcctggtttgggctggctgaaggtatggagggataaagactaacttttgaaactgattgatttcattttgttaaatagaggtggggtctcactgtgttgcccaggctggtcttgcactcctgggctcaagcaattttcctgccttggcctcccaaagtgctggaattacaggcgtgagctgctgtgcccagccctgtaactaacatctttagtaagtgcttggtaatcgtttttcttttctttttctttttctttttttttagaagtctttagcttctttcaaaaatcttttcttttctctctctcctttgtttttttagagacatggttgttgtccaggctggagtgcaatggcacaatcatggctcactgcagccttaaactcctgggctcaaacgatcctcctgcccagcctcctaagtagctgggattacacgcatgtaccaccacacctagctaattaaaaaattttttttttgaagagacagggtcttgctggttgccaaggctggtcttaaactcgtaacttcaagccatcctcccaccttggccttccaaagtgctgggattacaggcttgaactgtgcttggcctaacatctttttttttttttttttttaagattgagtcttgctctgttgcccaggctagagtgcagtggtgcgatcttggctcactgcaccctctgcttcctgagttcaagtgatcctcctgcctcagcctcctgaatagctgggactataggtgtgtgccaccatgcctggctaatttttgtatttttagtagagacagggtttcatcatgttggccaggctggtctcaaactcctgatctcaaagtgatcagcttgccttaaagtgctgggattacaggtgtgagccactgcacccggctttttgctgaatgaactttttgaaagtaagttgctgacatggcacttcagctctaaatatttcagcatgtatctcctaagaataaggatatttccctatgtaactacaatatcatcatcatacccaagaaatttaacattctctgatatatttggttcttagatttctttttttttgagacggagttttgctcttgttgctggtgagatcttggctcactacaacctccgcctcccgggttcaagtgattctcctgcctcagcctccccagtagctgggttcacagacatgtgccaccacacccagctaattttgtatttttagtagagacggggtttctccatgttggtcaggcttgtctcaaactcccgacctcaggtgatccgcccacctcagcctcccaaagtgctgggattacaggtgtgagccaccgcgcctggccttggttcttagatttctaatccaataaacttatcattttacaaatagcttttatgagttctatactctctacctgtataaaaaagtttgacaagacgccatctcccctgattctgggttagttctttttgccgaaatcactcaggacaatgctaacatctgaaccagtgccattattttctcatggctgtgcagtgttccagcactcggaaattctgtaatttagccagattccccctgatggaactgggcccgagtctgtcttttcttaccacaaacagtgtcacagggaatattcccctacccctatctttgtgcgtatggaagtgctgagtcattttaaatattgcacatttagaatttccttagaaatttccaaattgcccttctaaacaaggctgaaccagtttctgcttttttttttcttttttttgagaaggagtctcgctttgttgcccaggttaaagtgcagtggcgtgatctcgcctcaccacaaactccgcctcctgggttcaagcaattctcctgcttcagccttctgtgtagctcggactacaggtgcacgccaccatgcccagattatttttgtacttttactagagacaggttggtctcaaactcgtgacctcgtgatccacccgcctcggcctcccaaagtgctgggatcacaggcgtgagccaccgcgcccagtctctgctccctttgataactgagcctgctttcagcggggctgtctccacttcagtggcactgatggagacagccatggtcagggggctgcagatgagtggtgagtagcacaatttctttttttctttttcttttttcttttttgagacagagtctcactctctagcccgggctggcatgcagtggtgtgatctcagctcactgcaacctccacctcctgggctcaacgattcttgcggcccagcctcctgagtagtgtgcgccaccaggcccagctaatttttgtattttttttttggtagaaacggggtttcaccatgttggctgggctggtctcaaactcctgacctaaagtgatctgcccgcctcgacctcccaaagtgctgggattacaggtgtgagccaccacacctggctgagtagcacaatttcttaaagtttgtttgaaatatatatatatatatatatatatatatatatatatatatgtatttttttttttttttaagaagagacagggtctgtctctgtcatccaagctggactgcagtggtgcgatcctagctcactgcagctttgacctcccaggctaaagcgatcctcccgcctcagcctccagattagctgggactacaggcacacaccaccacacctggctaattttttgaactttttgtagagatgaggtcttactatgttgcccaggctggtctcaaactcctgggttcaaactgttctgcttctgcctccccagtgtgctggaatacattttttcccatttaaaaatactacatactcatcatagaaaatgtagaaaaaaatagacaaaaaagatttgtccatcgtcctgccatccagaggcaatcactattaacatttgttgaactgcattctagtctttttcttttttacaacaccgtgactgttctgttcatgtaaatgctgtaccctgatgcattcctcccgcgcacagagtaggccagttgatttgatgcaataatgggcttggtcactatatacttatatatgcgactggcggatccacagtttagacagctccatcacactggaaagctcaattctttttcttttagagacagggtctcgccatcttgcccaggctggtcttgaactcctgagctcaaccaatctgcctgccttagcctccccaagtgctgggattacagggatgagccaccacgcctggccaaaactcaattcttcttttttctttcttgctctgttgccctggctggagtgcaatggcgcgaccttggctcactgcaacctccgcttccaggttcaagtgattctcttgcctcagcctcccgagtagctgggactacaggtgtgcgccaccatacttggctaatttttgtattttttagtagagacagggtttcaccatgttgaccaggttggtctggaactcctgacctcaggtgatccacccgccttggcctcccaaagtgctgggattacaggcacgagccaccatgcccggccaaaagctcagtcctttaatcaaagtgtctaataagtttcactaactgttcttgggatattaaaaaacaatgagcttgacctgtgtggccatcacggccctctgcgaagcacaaccgccaaaagccctggccgtgggtggaacagaacccctgggccccatcctggctggaccgcgggggagtttcagaatcttgggtaagccatgccatctttctgggtctcagtttcctcgcttgtaagctgtgaagatggactggagcatggctacgtcccttccagcctaaggttccgtgcaggaaaggcctgaggctgccatccttggaaagacctgcctgcaaaggtggtggctggcaccagggagctgggatttggggagggttcctgccattccttgataagagcggctcacactgcctacactgtctaaataaggaggtttacgctgaatacccgctttcctgctggaagtctggaatttaggcacgtgctgggcagaggcgggagacctgaacagcccctaatacaagcctggacaccgagactttaatgagcttccctggtaggcagcatgttacaagtgttgtcaccactcactgctggaggaattaagcccatcccgtgtgactctaccgggagaggactcttggaagctggtgccggcttcctccaaacgtcaactcacacacccttccctttgctgattctgccttatgtcttttcgctgtaatcacagcggtgagagagcagattgcggagtcctgagtccacctggggctggtcttgggagccctgatacgggctttgtgactcaacgcctatgaccaggaaccaagagtcctcagtgggaagacaccctgtgcttcactgactcatttcgtgaactgctattgaaacagatgacattacatatcctacatctcaagtactaagcaaaataaccatttgttacgatgatgactcaaacatatttctgtccagctccatgagccctctggttgattgtaaatagagcaggaagagaatatggactgggggaaggttttgtgagccccgctcgttgggttaggagttgacctttcttttggtttctcaaagtggtgacaccaagaacagtcccctttaggagcaggtgtcaccaaggtctaacatccccattatgtgcagggggtgtttccagtctctgtggtggaaatgggagactgtatctgggcttctcaatcagttatcgcttgtacagctcactctaatctgcgggagccggagccagcagcacagctgactcgagacgggcgcaggccaggcccctccaggcagaggagggacagcagcacatgggctagtgccagagggagaggaaggcagagcacagcgtttgctttccacctttgcttccaaggaagaaaagccatcacacacagcatgtgcactcagaaaccaagggggctgcctcgcaacagaaggcatctgtaagaaacaggtacgaggacagcttcccagctagaatgtgtgtttcctattttaataccaaaggaacaaaggagccgatcctattcctaaattcaaatagcaaagatccacttcaaaaagaagaatttctttttcttttctttttttttttttgagatggagtcttgctctgtcccccaggctggagtgcagtggtgcgatctaggctcactgcaacctctgcctcccgggttctagcaattctcctgcctcagcctcccgagtagctgggattacaggtgcccgccaccacgtccagctaatttttgtatttttagtagagatggggtttcacaaacatgttggtcaggctggtctcgaactcctgacctcaggtgatccacctgcctcagcctcccaaagtgttgggattacaggcgtgagccaccacacctggctcaaaaagaggcatttcatgtgactaaatgcaggagttaatttataagtcataaatggaagttagagtaaaatacagtgtaatccgttatcatggagaagagggattgaaaaactgaaaaaaatagaaagcaaacatcacttgcagtcctaaccagccaaacgtggcttcggttgacactttggtatatttcagtgccatttaaaatctgcccctagggaggtggtcaggtcgggggagagggggtcagcagcggtggggttggagggcttctggggtagtggtaatgctctacttcttggtctgggtggtagttaaatgggtgtgttctctggtgaaaatgcactgagctgtccttttatgatcaggtactcttctgtgcatactgacatacacatcaataaaaggttaaaaaaagatgctaggtgctttacttttaagtactaaagctgtaatcatcactcattcattatatcctaagtataaatcttgtacatatttttactatatataaatacctagttgtacctatagtacatatatagtttcacctagtaaatgaaaatcttaaatgttttccatatttactgcattttaacagttgtattatttgagtaaatgtataatcagttaatttatttattattgacaactacagttgctaatgaatcttttttttattttattttattttttgagacagagtctcactctgtcgcccaggctggagtgcagtggccgatcttggctcactgcaacctccgcttcccaggttcaagcaattctcctgcctcagcctcccaagtggctaggattacaggtgcccaccaccaccccagctaatttttgtatttttagtagagacggggttttgccatgttggccaggctggtcttgaactcctgatctcaggtgatccacctgccttggcctcccaaagtgctggaattacaggcatgagccaacgtgcctggccttttttttctgagacagagtcttgctgtgacaaccaggctggggtgcaaggacaccatcacagctcaatgcagcctcaaattcccggcctcaagcccaccttagcttcccgagtagctgggactacaggtgcataccaccatacctggctaatttttacaattttttgccaaaacaggatttcgctatgttgcccaggctggtctagaactccaggcctcaagtaatcttcctgccttggcctcccaaagtgctgggattacaggcgggagtcaccgagcccggtccttttctgtgtgctttgattttctctcccttcctctcaaatctgtccatcttttcgttgtggttctatttattatttgtaagcctggaaagttatctcagttttagaggcttgaaaactattgaattttactttttctagattttatatagtttaatttttatttccgactcttcaatttatttagaatttattctgctgtttatagtaaagcaagggtcaaacatttagtattttggatttcaagtcagttattttattactttttgagacacagtctcattctgtcacccaggctggagtgcagtggcacaatcttggctcactgcaagctccgcctcccgggttcacgccattctcccgcctcagcctcctgagtagctgggactacaggcgcccgccaccatgcccagctaattttttgtattttgtttagtagagacggggtttcaccgtgttagccaggatggtctccatctcctgacctcgtgatccgcccgcctcggcctcccaaaatgctgggattacaggcgtgagccaccgtgcctggctgatttcaagtcggttattttaaaatattttacaaaataacttttttctttgatttgcgagatttcctttgttgcatgcgaaagtcttacataaaattacatgactgtaatgtcttattaaaataataaaactaattttattttccccattagacattataactatgatacagttcaacgaggagatattttccactttctattctaagaatgcacgtattgttccttttattcaagatcccattgttttcaggaagcttcgaaatgggcagggtaatacagtcactctcgtttattcagacagaagtgcaatattaaaagcttacctgaaattctgtactgcgtcaaggggcgaagttaatacagaactgaaattaaaatgcagaaaaatattatcataaagagcaaagaaggcattccacaaggcaacctgagaagagcttgaacaaactatgttccttttttagacgtggttgtacatccacataaagccacctgctcccacctctttcttcacatctgtgtctcccaatgctgggggcagttcccttggtaaagctgagtttacgtctttgtttaccatcccgcatcctctctatcctgctgaggcttagcaaccgtgatgggattaggggctctgaggcctcaagtggatggaggagttctgggccgagtggaacttcaaccatcatccctaccccagatctgctatttgaactctgggcacaaaggcggcagaggggtcccccatcactgtggctctccagctccaggtagaaaagccccgcagccatgactaaaggccacggtgaatgcccgatgagggacctgtgatggatttaaaaggtaaaaagcagtttgctggatttcatactctcgagaaagagctcatcgtgaccatcgttctagatggccataccttcagaaaaatccaagtctgctttattttgcttaatctattcattaaagtttcctttcaagtactgaatgacagtcctattttaaattccctttttgatcttaatttgcagggaatttaaatgtcttttgtattgtgattcttttcttaagtaaactgaggacggatgctcacactgcccatggctggactgttgctttgctaataaccaaagacaccccgtgcctactccgtctgatactgacaatactgcggcaaatagaatcattttgtgcttttgaatgaattcaagcagaggtccttggcaacagcaatgccactccaacggggcatttcggaaatgccaggggtccctctggttctcttaataactcagggagccagaatgttagatctcctgcaaggacaaggaagaaatgtcccatgtgactttaaaacattctgcgcacctaaaccctctgtaattgtaaacaggcggttcttcaatacacactaatagtgaaacatttttataagcagttataggaaaagcccaatatttgggagaaatttattacatgaatggaagcttaatgggtttaagatatcacgaaatatttgaataaattgttcactgcttacattctgttatacaaggtattactgtatttccaacaacacatttagttgaaaaggcttaaaataccctgaaaccagtagcaaatgtgtaataggcaattttgagacttattttttatttttatttttggagactgagtcttgctctgtcacccaggctggagtgcagtggcgcgatctcggttcactgcaacctccgcctcccagggtcaaccaattctcctgcctcagcctcctgagtagctgggactacaggtgcacaccgccatgcctggctaattttttgtatttttagtagagacagggtttcaccgtgttgcccaggctgtcttgaactcctgagctcagacaatccacccgcttcagcctcccaaaagtggtaggattacaggcgtgagcaccaagaccggctgggacttatttttaacaaatcaagaattattcagttagtgcaacacatgaaagatagggatcttactggatgtcgctaatggcaaatattttaaatatagcacctatcactgccatcctgtaagtttttacattttttgtagtacaatgatgagaactgggcttgtccccagaggtctaccggcctccctgactcctgtttctgtgtctgcgccatcccattcctcagcacctaccagtgatacggttctgaaggccagcgtcctcctcagtatgcagaggatttcaaaataaaagacctatgttcagtgactggtcattaatcctacgtctcatgacatcatatggggaactgttttgacctatttattattttttgtttttgagatggaatctcactcttgtcacccaggctggagtgcaatggcacaatctcagctcactgcaacctccgcctcccgggtacaagcggttctcctacctcagcctcccaagtagctgcgattacaggtgcacgcccccatgcctgactaatttttgtatttttcgtagagacggggtttcaccatgttggccaggctggtcttgaactcctgacctcaggtgatctgcctgccttggcctcccaaagtgctgggattacaggcatgagccactgtgcccagcctgacataatattttgaaataagccccaggtgacttgcaagatcatcctacgtcttcacctcctccttccaggctgtgacctgtcccggttcatgaaccctaccccactcaaggaaagtcagcaccagcttcctctccaccttcacatccatctgcagctccgctctttcatggccttgaccatcttctatgaaatccttcaggtcctactttcttagattccagcccattcatcagaagtcacctcggtataatgcaatggcagcattatgttttccaggatgtctacattcaactacccagagtgctgttctaaatgatattctttttctttcttttgcatattactctgagggcatctcattagctctttggtatgatgtgtgctgacagctattttgggtcatgatgggaaatatctctatcggggcgtgagaagcaatgtgcaaatgcagccaggccctacgcaacctcgggcaaggtggccacgcaccctggtgcccgcaagcagtgctggccgcgtacctgtctgggcacagggagacgtagagcaggagcagcggcccggcccccacgacggtggcgagggaggacctcatccaggagctgagctggcagaagttacagtagtgcacgacggcaatcagcgcggccgagcctgtgaacactgggaactgcaagaggcgaagggttaggacagccgcccagggccaccccgccacccctgctatacccggccgccaaaacattcgccactaatccatgtttccttttttttttgactgagtctcactctgtcgcccaggctggagtgcagtggtgcaatctcagctcactgcaacctctgccttccgggttcaagtgattctcctacctcagcctcatgagtagctgggatgacaggctcccggcaccacacctcgctaatttttgtatttttagtaaagactgggtttcaccatgttggccaggctggtctcgaactcctgacctcaggtgatccacctgcctcggcctctcaaagtgcctgggattacaggtatgagccaccgctcccggcctaatccatgtttctgtgtaacctaaaaatatcaccgataccagctaattgctcactatctgcagtcagtcttacttttgctagtgggcagtgtcaaggacagatcaagcctctaggttccctacccggcgtgaggctccctgttcacatggcatcacactcttctgcaggtgtgggaaatggcacgtgtcttcgtggaaaggaaagggaggcctccctgtttgagaaacgctgtgtgatcagtttccttcaaaacacttttccttggggcccagtgagatgtgatttggggctaaagtgtcaaacaccatcagcccgcccggaagctcatgctcacttgcaccagaaggatcatctcccacggccgtgctggttccctctccacggagtttagcacagttcccttcctgatcagcagcagccgacccgggcacaagtcaattctgtgtgccaggtatgcttctcgcatggttaggaaaggtgggacagacgcttctttgtaaaatgtgaaggaaaataactgatttggaacttgatgaagaagaagccacactggcagggactcgtgcccaccggggactccccagcccggccactgcccgggcgtgagcatctgggcaggccaatgctaagtcggcttctaaaaaagctggctcaggagagtaaaagagttcgtgcctcttcaagggtttattttattttatttattttattttattttgtgacgcagtctcgctccatcacccaggctgcagtgtggtggtgcaacctcagctcactgcaacctctgcctcccaggttcaagcgattctcctgcctcagcctcccaagtagctgggattaaaggcgcctgccaccatgaccagctaattgtatttttagtagagacggggtttcaccatgttggccaggatggtctcgatctcttgaccttgtgatctgcccacctccacctcccacagtgctgggattacaggcgtgagccaccatgcctggccaaagggtttatttttaaattgctatcccaagtgatttaaagaaaagagagattagggagtccaggagagcgtggaaataaaacggctgagcctttacttacgtgtatgttggtctcatattcggaggtgacatgggagtagacggccagtgcgggaagcgacaccaggatggccccgatgcagtgacgtggtagccagccggcgatccactccagcaggcgcttggtgcaggccatgacgtcctccaggaagaacaccatcctgcgagaggcatgggggttagcaggagcgacggggcccggggtgggtcatcggccaggagacaggtgcgaggccgcagccagcgccgccctctgctctctcccgtgttgcccctgggatgggcgtgagagcaggcgtggggtgggagtctacctccctcacttttggtagaaggcaaggaagccaggcttagctcattgtacctgattctagggtcacatgttgcgttgtgataaaatatgcttgtgaaaagcacatgcttcgctcgcctaacagaacacgtgagagtatcacaggccctgaggagagtctcctgggggccaccacgttgccgtcaccggctcccatcagcttctgaggcaggaggtcttgacgggggcagctttggaggcgtcctggaattctgtggagcccgtgcagttgtcgcagcagaagaggcggtcctggcatctggtgggcaggcgccagggacagagctgtcctgcatgtgggcaggtgccacccagggaggttctgccctgcaccccacacagcagccaagcccctgggcacctgcaaaggcagaaggctgctgacagcatcttagcccagaggctgtgtcccagctacaaacagggtgctctgtggtggtgctgacacaccctggattttcttggagcgcagctcctgtggaaactgagtgacagtggtctctgctgtttggggcatcatcatcagtgtttcagaaaatcacaccacaggctgaacctggctcgtggcgcttagaccaccaaacccgcacacgcgtgccgtctgcatctgggctgtcatgttcatcgtgcatgttcacctctagctggcggcttcaggactctccagacagcggggctctgttgtacgtgaggtccagcaccacgtatttcattttaaaagactttgtccttctaagcagagcgactgtattcactgactccttttgcaggcgtgtgtctagcgggcttcgtttcaggagtgtgatgttgacacaataaaagtttctgtataaagaagcagctgagtgtgcgggccaagaaccactgtgaggaggaggaacaggtcttggctgagtccaaggacccctgggccatggtggggccacatggggaggtgaagagaaggtgtggggtcctcgtggggagacagtccttctctcaagcttgctgccagggagctggggataggcctgctgtccctgcctcaggagaggctgggcgggggccgctgttgtgactgaacagcaaaaaagcctctggcacagagccccccgcccccagccttcgggcctgaacacctaccatgcctctccctcttggctgcgtggtgtggccaggcgagggaacgctcactctccagccattccccacatggacgcaggcacagcctcacccttttagggtcctggacagccctggcttcctgatatttaaaggataatgaagactttggaatacttccaagaataaccacaaatatgcagaatacagaggccctaggaggggggacagagggaaccaagttcccagtcagcagcgggaaagatgtgaggttggagggggccttcatgctggtccctgagactgcagggatctgaaaatgagacctcacgcctgctggggcagagcagagagggtgatgcaggaagcctcctggaggcaacgggcggggcctgggccagtcactgaggaggcgcctggctttcctcctgtacaggaaagggatggggtgcccgtataccccacagcgcaggttcccgtcaacctggggtcctcaacacggccctcagaggggccagggaagcctttcagggtctgggcctctcccaggcttgacgattcctggtaaatggaaccaaatcccaccacaggcctgttcaggggtgcagcagccaccaccttcaccagatccttggggagtatgtctgtgcaggcagttccagcgcacctcaccccagccctcggcagtctacaccggggttgccctcaatgctttagaattgggtctgaaggagcagggaataatagctaaagggtgaaagtaaaaaggaatggagacaatgctggcctcagagccctcaagacgctacagctacccacattagaggaaaacctgggggtggaccagggaaggcagacctgggggagtgactgcccatgaggatgggtttctttttggggtgatggaggtgcccgatagttacatagtggtgatattcatacaattcttcaaatttgctaaaaatcactgagttgtccacttgaatgagtttattgtatataaatcatgtcacaataaagcagatcttcttttttttcttttttgagatggagttttgctcgtcacccagaatggagtgcaatggtgcgatctcagctcactgcaatctccacctcctgggttcaagttgattctcctgcctcagcctcccgagtagctggggttacacgtgcccacaaccaagaatggctatttttttttttttggtattttttagtagagatgaggtttcaccatgctgtccaggctggtctcgaactcccagcctcaggtgatccacctgccttggcctcccaaagtgctgggattacaggcatgagccaccatgcccagcctaaagctgatctttttaaagaggaaaaacaaaccaaccaggggcctgaggatgtctggtttgggttctggggaagtggaccctgaaagggtttgcaggcgacggctcctttgggaggggtccccagaagcacaggagggcactgaggcaggaggggaggctgtgccaggaagagggctgctcgctgggggtgatggggcatgagcccacagggagttctgggaaacactgagcacacgccacagacagcatggcccatggcggcctcggaggaagctgaaagggtcctgggtacagtgcaggtgggaaggagggggcaggaatcccagcctgcccaccccagatgggagaagccagcattccggcgcctcacgccagactcaaagccattcatttctgccctgggatgttggataagggcagcagacgctcaaggtcagggctgcctccccatgtctgtttgaagcccagctccggggcaccgttgctagtgggactctgctaggccggcagccatcctgttgagggtgacaggaccacccaaggggcttgtggtgcccaggacggggaccacacagggccaccttcctgctcaggaatacagagccgctgcgagccccctcagggagccaggctggtcccgagggcccagctttcccaagacgcacctgtggtctattcggagcctctgtcccctttaaaatgagctgtctttttattatcaggctatgtgtgctctttatccattctagatgttagaccttgtccgaggcctgatctgcaagtgttccctcccgttctgtgggttctttctctttcttgatggtgttctttgtagcgcaacagcttaacttctgaggaagttgggcttgtctattctttcttctgttggcgtcacatccaagagaccactgcctgaggcaagtgcgtggagatgctgtttggctccggtactctgaagaggcgcctgctgtcccaggcccactacccccgctcatgtcttttcctttccttcctccagattgtttcctatcttctcaccttctcctttgcagtctctgaacctggaaatctggggacaagctggcagcggttggggctgtggaggcaccgccccctccagcgaggtggtccccccgcatctgggccaacgtcagggagggaggatgctggggcacagggctcggggaggacacggggacccatctccagaaatcagccagcagggacagctggctggggaccagtccaaccgctcagccataagccatggagccagaagagggagctaacggctcagagctggagacccagtccacgcggcgcttacctgatggacaccgcgagggacagcacctccagcagcagggctgcactgaagaccgccagggcggcgggcgggggaggcacggtggccgcctcgtacttcaggaagcaggtggtggacagcgtcagaaacactgtggtcgacagaaacacatccaggagggagctgaaggtgggactagcaaacgtcttcacgggggagttctttatgacctgtgtggagcaggagtggagcagaatgactgggaggccatgggcggccaggagcgcagttcagatggagaaacaggcaacacgtgcggagcactgctgctctgggccaggcacagggcaggaaggctctcggagggctgtctccctctactaccccatttaacactggggagtccaaggcacagagaagttaaacttgcccagggggctgggcacggtggctcacgcctgtaatcccgacactttgggaggctgacgtaggagggtcgctggagcccaggagttcccggccagcgtaacacagtgagactccatctctacaaaaaactttaaaattagccaggcatggcagtgcgtgagtgtggtcccagctactcaggaggatgacgcaggaggattgtgtgagcccaggagtttcaggccgcagtgagctataatcatgccactgcactccagcctgggcaacatagcgagaccccgtctaccaaaaaataaaataattagctgggcatagtggtttgtgcctgtagtcccaggtacttgggatctgaggtgggaggattgcttgagcccaggagtttgaagccgcagtgaactatgatcacaccactgcagaattataccgtttccgaaaacaaaaaaacacaaaaaaaaccctgccagggtcacagagcaactgattatgacccagcacattctcatagacacattatatatttagctgcaagatgagttactgactggcgcaggtgaggtccctgcatctgtaaggcagttggacgagagcaatgtgcagggcggtcctgctgcatggcggagtcctaggttcagcaggtgcgaaagcggggcttcgtggcggaagtggccgacggggatttaagtggcacatcatcgcctgggaacctacggggcctggctctgtgctgggggccagtacactagagaggcacacactagtgttcggcaattgagggggagaaataacgatgctgacacgtccaagaggtgaccaggcccaggccctgcaaggctctggggaggtgcgatctccattgacgctcacggcaccccacaggcaggaactaccacccatctcggtgtacagattgggaggccaaggccaggggctacccctagggcacacagcgaacaaggagccaggccaggacttggcatggaccggttgactcctgagtgtgtccctaacctagaggaaggtgtaggatccaaaggcagaggctgtggttgggagaggaagggatgtagccagttcagctgctttccatttggccttgcaaccttctggcaacccctgagaggccatgggtgtccactcagcatcccggccaggctcggggctgagggcaggagctggagacgcacggagcggaaaggtctcctggcagccctgggtgcggtgtgcgttctttgggacaaaccagctccgggtgcctcgaccactcccaggaactaggtgggagggcaggaggggcacttggacggtgggagcaaggctgccagtcagccctgatgccaggctggaccctgccagggcaacctgggggttagggtttggttccaaattctctccaaggaagctggaggctctgtagtgcccaaaagggcaagtcaggtcccagccctggaatcccctcagaaggtgtgggaatttcttttttttcatttttcttttcttttccttttttttttttttttttttgagatgggatctggctgtcgccaggctggagtgcagtggcgcgatcttggctcactgcaacctccgcctcccaggttcaagcaattctcctgcctcagcctctggagtagctgggaggacaggcacccgccaccacgcccagctaatttttgtatgattagtagagatgggatttcaccaagttggctaggatggtctctatctcgacctcgtgatctgcctgcctcggcctcccaaagtgctgggattacaggcctgagccactgtacccggccaggtgtaggaatttcaggggcgacactgcccatgcccactcaccttggcagaggcccacgcacgtcccctttctgtggggctccatctagtgcccgtcaggggttcgagtcagggccgggtgcatgcatgtgatgtccctgagacatcactgccttgcccacatgtgaggccggaaggtttccacgtgggctgccgtccttctgagagcccacacctcccaccttccaagccaagggctcgggtacagggcctttcctgattggggctgccatctcctctgtagaactgccccatccatggacgctgccagaggccccgctcctccctccacctcccttgcagtctctcctgcctgccctgctacttgccagagacacctgtccctgccacagcctccccctctgggccacccctggccctgatgccagaggctcccaggcccatctgccccacccctgtgcatcccgggagtgccacctgtcccagtcccactgagaacgacgctcccccacatcatgacactctttcgccctctctccccatgggcgaaacccagggacagtgccactggctgccagggcaccgtgggccaggctccgccctgctcactacccacatcccagggcctccgggtgcggccgtcccaccatcatcagagcacaggctctgcagccgggctgtctgggctcaaggccactccaccatgattagctatgatacccacgcgtccatgcctcagtctctttatccaaaaccagggataaaccagtacttgcaccttgtgggcggtgggatgctcggctaagaacgcacccacgtggagcccccagcacaatgagtccccaaacgcgggccagctgggaggctcccttgtcctggcatctctcctttcctccccaccgggaccctgtggccacctgccctgagtttcggtaacagcctcccacctgtcatgtggcctcctgtcttgtccacactcttatcaccctccgaaactcagctgatacatgtttgttttttttctttttttgagacggagtttcactcttcttgcccaggccggagtgcaatagtgcaacggcatggtctcggctcactgcaacctccgcctcccgggttcaggcgattttcctgtctcagcttcccaagtagctgggattacaggcgcccgccaccatacctggctaagttttgtatttttagtagagacggggtttcactatgttggccaggctggtctcgaactcctgacctcaggtgatctgcccgcctcagcctcccaaagtgctgggattacaggcatgagccaccgcgcccggccatgtttttcttctttttgttggaagagacagggtctcactatgttgcccaggctggtctatctactggcctcaagtgatcctcctgcctcagcttcctgagtaattgggattacaggtgtgagctgtgtgatctttgtaacacaacctgttccagatccttcaacagctccccatggcctgtggcataaagtccatggcatgggagccgtgacctggcccctgccacgtcctgccactcctgccccaccctgccccggatgcgcctgcaactccctggacgaaccaggctctttggtatctctaacgtttgtgggtgctggccccactctccagaatgttccctcatcccacattccattaattcctagtccccccactgaggcaggctcaggagttccccccttggagcccccagcctgggcttggtgcctcgccgtgtgctgggagggcactcgcagacctccagctccggatgttgtttctaattcctgctccccatcaggccacgtctttcccccttccccagcaccaagaacagtccctggcagagcagaggctgagcgtacatttggtgcctggaggaaggcatggcaaaggtgtctgctgtttgggaggctcagcagtgcagggcgagaagcggcccggacgcctggtttggcagccagaccactcgtgtccgaccccggctatgggaccacagccacctgttcagccttgctcagcgtcagctctttggtaaaaggaggataatcatcagcttccctacagcattgctatgagcattaaatgagacgatattttgccttacgggccaccaaccagccaactgccaacttgcaagtccactccgggagccatgtctgggacattaacggatattcactgtcccttggaggctgacggaagggggcacctcccaccccacgaggcatgaactggctctactgggctcaccagggtctctctagagcccaagccaggacaccacggagtttaatgaagacctgctggaggaaccaagggaatcagagtgagaaatcccttttgttccgggtggggagggcatccactcttgacttgggaacactcagaggttaggtttgggcccagaggagagaatgcagtctggaagccgccaggattcaaaccaggctctaggttcttgtattattccttccagcaaccccctaaggagcacttgtgagcgctgggactctgctggaggctgtgaggaggggctggaggagagagatgggtgttgggactgtgctggaggctgtaaggaggggctggaggagagagacgggggtcctacctcacagagctgagcatctagggagggaggaacacgaatccagaaccacacacggaaagattccaaaatggggcacacacggagaaggaagtgtatgaagggaagtacaatccagtctgcagtcggggagagcttcttggaggaagtgggattgggtgatgggctgagaagtcaagtacaaggggttaaggcggtgggggcgggagagggaacatggagccggagttagagagagaggtgaaggcctcctgggcccttctcaggggaagaaagcagggagggcaacagagaagagtctcacccaagactccaggacaggtgggacgggggctcttccagggcaggtcggtggggagttcccttccagggcaggtggggggttcccttccagggcaggtgtgggggattcccttccagggcaggtgtggggggttcccttccagggcaggtgtcggggttcctttccagggcaggtggggaggggttcctttccagggcaggtgggggaccccttccatggcaggtggggggggttcctttaccagggcaggtgtgggggccccttccaaggcaggtgggggggtttccttccagggcaggttgggggtttcctttcaggacaggttgtggtgggggggccccttccaaggctggggatagcctggagatgccacggcagaggaaaggggctagtaatggcgaggctgcgctttaagacaaaggactaaagaaagggtttttttcctcctttgcaaagagacatttcatgtacagttgccacttagggtttacagagtgtgggaaatcaatgttcgccttcgtgttcccatcccttggtaaagcacaaaactaacagtgaatgaccatgtgagaacaacaaacacattctttagtaaaagcgcaaggagaaatgaacgcacctcttcctgatagctggtcctgtaggatcgctccagctcctgatccaggaagttcaggctgaactgattaatgggcggcttaaaaaagtaatctttcatcaggctagaagacacaacaaatgcagtcgatcaatacccagcaccataactgtgccaatgttttcagatcataattagctaccaaaacgctgctcattaggtatattacaacagctgcgtctaaaagcgcctgtggaacagacgccactcagctgccccttgttaaaacagatctgtggaaagtccttcgcacctcaaagcataatcatattttgtgtttcaccttcgttaaagaatgaccatccaccatgattatagcacacatcatcagaaccttggttttttggggttttttttttttgaggcaaggtctcactctgtcgcccaggctggagtgcaatggcgcagcgatcttggctcactgcaatctccgcctcccaggttcaagcaattctcctgcctcagcctcctgagtagctgggattacaggcgcctgccaccgcacccagctaatttttgtattttttagcagacgcggggtttcaccatgttggtcaggctggtctcgaactcctgggctcaagagatccacccatctcggcctcccaaagtgctgggatgacagcgtgagctgctgaggcttgtttttgaaaacacattcctaatgtctaggattaggagaagatgaaggcagcttttctgttctttgaaacaatcttttgtgaagaacacgcagatcactgtgctgagagtacttacatggatttggaggcttcaaacgaaaacataattcagaaccggcggtcctgtcattcagagcactgacagtaattgccaccgtaaaagctaacaggttgttatcacaaaattgtgtttatagttagcgtaattttggtgctattgtcacatatgcagattgcatgtgaaacctgcagaatgataaagctcagtgattttaatagcagggaaatcaaccccgctttccatgactctttcattcatttatgaattgccagcaaatagtaatatcctttctatactgcagaaaattactagaaactaagggaacgttaacatgatttcagaaagcaaatatagctgtgttagcctctctccctcatacagtgactatcagaagtaaattagacgaggctgggcgcggtggctcatccttgtaatccccagacctttgggaggccgaggcaagcggatcacctgaggtcaggagctcgggaccagcctggccaacatggtgaacccccgtttctacaaaaaatacaaaaattagccaggcctggtggcaggtgcctgtaatcccagctactcgggtggctaaggcaggagaatcacttgaacctgggagatggaggttgcaatgagccaagatggcgccactgcattacagcctgggtgacacagcaagactatgtctcaaaaaaaaaaaaaaagagtaaatcaggtgaaatatgtcaagtgcctcatgtgccccccacacaaagtacggctcatcacgtgtgttccttcctgtccttgcagcacggcggacactctcctttctgtgacaggtatccagtaacttccaacattctcagactcagaagagaaataattctgtcccaggacactgaccctctctcctcccctgactcagggagtgtggactgagggaagagcaaccacgcagctgcagagaggatgtgcacaaggccacattttagcagtcaagtggcagaagcgacactgctattagctgtgctgctccatttatttcttatttgttttttgagatggagactcgctctgttgcccaggctggagttgcagtgctgcgatctcagctcattgcagcctctgcctcctgggttcaagcgattctcctacctcagcctcctgagtagctgggatgacaggcacccgccaccacgcccagctaatttttgtacttttagtagagacggggtttcaccttgttggccaggctggtcttgaacccctgacttcaggtgatctacctgcctcggcctcccaaagtgttgggattataggcgtgagccacagcgcctggctgaaaatcaccctttgaggcattatagtgaagacagaggcaagaatcatcaatgaatgttaaatctagggaattctgatggggaatgaaatatgtacaagatcttcaagtattttctcacagattgcttattagtcataagaggaatataataaccctagatgagacaacccggcaccaccttgcctaattaatcaaaattagtatcactaatgaggaacagacgggcactgcgtgtccctggagaggacaccctgaggaggacacggcatcccttctgcagtctctgcctggccagagggagagcctgaatctaaccaatccaacttcaggaatatttgataaaaggactggacctgtatttttcaaaaatgttaccattaggccaggcacaggctcacacctgtaatcccagcactttaggaggccgaggcgggcagatcacctgaggccaagagttcgagacccgcctggccaacatgttaaaaacccatctctactaaaaacacaaaaattagctgggcatggttgtgtatgcctgtagtcccagctacttgagagacctaggcaggagaattacttgaacctgggaggtggaggttgcagtgagccgagattgagccactgcactccagcctgggcaacacagcaagacctagtccttataaaaaaaaaaaaaaaaaaaaaaaaagccaggcgtggtggctcacgcctataatcccagcactctgggagggtggggtaggtggatcacccgaggtcaggagtatggagaccagcctggccaacatgatgaaactccatctctactaaaaatacaaaacctagccaggcatggtggtgggtgccagtaaccccagctacttgggaggctgaggcaggagcatcgtttgaacctgggagatagaggctgcagtgagccaagatcgcgccactgcactgcagcctggatgacagagcgagactcagtcttaaagaaaagaaaagaaaaaggcagagaggcttctgcctgcaacctttgctttttcccagacagccccagtcgtacctgtcttctttgataacgtccacaaagtgggcgtccgttttctcccggatgttcttgaacctcagcggaaggagagccgactggtccaggctcacccctgcccaccttcccttctcctgcaagatctcacacagagaagtctgactgttggtgagcttctcctcttggggagggctgaggagcccgttctgagttttgggattaggtcctccagaagcctgcctcgagacaaagaggacgcagacacgggaagtgaagtggcaccgggcactgggcacacacgcctgtcccaccccgacctccgctgcggggcgctgctgcactgggcgtgggactttctgacctgcgaggaacccccacccccctgcgcctacagacctgctccaatcccagccctgactgcccgtctgctccttcctgttacccaacagtgcccagtggtaacgctgggtgttcaggctgccaggacattgagacatgggaagagtcggtgcggaggtggaggggaagggaggaaagtgaggagccgaggcccccagagtctgcttaggccagaaccacggttctgggagcagggtgcatgggtcgggggtccaggagaagtatgacgaggggtccagggctgtcagggcacaggcaaggtggatggaaacgggctcgtgtcgtgggtgtcccccgtggctgtgggaaggcatgggatgacctgcacctgcaatcctttggcagatggagagcagatggaggacgagagcccgcgccccaggtgagtcgcctgcatgagcccccgccgacaggctctcgcgggtgggctgagtcctggccctggtgtccaagtctggttttcctgaaagccttcctgccaccggccctaactcccaacctctctcttcacccagcctttctcgccgtgaagaccccctcttgtctctgcccgtctatattctctcataaactgagtccagcttccagtaccacaaatcccctcccggcactcgaatccacgcattttaaacccttattggcctttaaaggaatcccgcccagctcagcccctgagcgctggtttccacgtgggttgctgctgaccctccctcgagctccctgccggtctcttcaacacccggaggacccgcgggtgcggagtgctgttacccaagaggagttactctcagaactaagaagtcgacaagacaggaatgtcaccttgggtggatgcgccaggagaggaactgacaggaacaacagccatgagcttgttaccttggtgctgtttttatgctcgtcttggcagccgttttgaggtgctcctccctcggcgccggcttcagatttgggagcaaatgtgattccgcacgaagggcaggtctagaagaaaaacacagactgtggggacacacccagaaaccgcgactgccaccctgaattcaggcaggtccgctgttgccatctgccgtcacgcagcatggtggtgagcaaggggaaggcacacagaaccgctcggggatgagctgaaagccaacgggcaaagtgacagtggaaacacacagaaacccgggcacgaacgcaacaggacccaaaaatggaaccgggaatgttcactgactgaacaatggatcaacaaactgtggtctattcgaacaatgggatattactcagccacgaaaaagacggaagcactgacgcctgccacagcatggtgaacctcgaaaacattatgctcggggagggaagccagacacagcacagatattacgtgatcccgtctatgtgaaatattcagaaaaggtgaatccttggagggagaaggcagattcctggctgccaggcgggaccgggggcaggaagggggagtggctgctaaggggcgtggggtttgctacgattcgaatgtttgtgccccctcaaaagtcagacgctgaaatcctaattcccaaggggatggcattggggggcaaagccttgggaggtaattaggtcatgggggacaagccttcaaaataggattagtgccctcataaaagaggccccagaggaatccctcgtcccttcgccctgggagaaggcaccatctgtgaagcaggaacgggtcctcactggacactgaatcttccgggaccttgatctcggacttcccagcctccagaaccctgagaaatacatttctgttgtttaaaagccacctggtttgtggtatttcaacagggtttctctttgggatgataaaaatgttctgaaattgatcacggtgatggttgcacaaccttgctaaatatactaaaaaccactgaactgtacactttaaaaagatcgatttttaaatattttttgagatggagtttcactcttgtcacccaggctggagtacagtgtcacgatcttggctcactgcaacgtccacctcctgggttcaagcgattctcctgcctcagcctcctgagtagctgcgattacaggtgcctgccaccacgcccggctacttgttttgtgtttttagtagaaacggggtttcgccatgttggccaggctggtcttgaactcctgacctcaggtgatccacccgtcttggcctcccaaagtgctgggattacaagcatgagccactgtgcctggccaaaaagatcgattttatagtatgtgaattatatctcaacaaagctgttattaagtaaagaaactggccaccaactatgcgaggacacaaatccaaggttcttaagctccgtgtgatggtgagctagtctcataagatgggctgaataatcaaaggtacacgatttccagatctaggcgtacttaaaagtttataggaattaatggacctagaaaagagaaggcaagatttaatacaggtaccctaaaaagagcaaagcctttatttctcataaactaggattcaaaccctagtcaagtacttactagtttggagactctgttcaaatcactttacctcagttccctcatctataaacaaagagtgaagatatgttgctaagaattaaatgaaattggctgggtgtggcggctgtaatcccagcactttgggaagctggggtgggaggatggcttgagtccaggaatttgaggccagcctgggcaacatggcaaaaccctgcctcaacaaaaagcataaaaattagcctggcctggtggcatgtgcctgtagtcccagctacttgtggggctgaggtgggagggctgcttgagtctgggaggtcaaggccgcagtgagctttgatggtgccactgcactccagcctggggcaaaagagaaagaccctgtcttaaaaaaataataattaaatgaaataagtatatatatagcctagcacagttcctggcatacagtatacccgtaataaacttattattattattaatgtgaccaggtaacctaggaaccatctaagaaagcaactaacagcttccaatgaagaagacaaaccgtggcaagaaatatatttttttttttttttggactcaaaagcaatttccttgcagcaagaagtgtaaaacattgaaataaattatgggaggccagatattattttggaaatttaaagtaagtgtcactacctaagggcaaagatatgacccaggttgtatttaaagttagactgcagacctgtactatattaaataaaagaaacaaagattctacagggttgtatagtttgggaatctgatgtaacatacaagctaaatttgaacatttgtatgcattcaaaaaatgaaaatatacatgccaaaacagctagcgaaatcattaattaacatatctgagcaaataatggcatctagataacatttgcttacagctctttaaaaactgacattatcaacagaggtaaaatgttctagttatcaataacatacagtgagtctatttgaaagcacctcttggtattgactggcagagttaaacttctaaacattttgctggtgtgctggctcacacctgtaatcccagaactttgggaggccgaagcaggaggactgcttagggccaggagttcaagaccagcctgggcaacatagggagaccttgtctctactaaaaataaaaccaattagctgaccttgatggcacgtgcctgtggtcccagccactcgggaggctgaggcaggaggattgcttcagcgaaggaagtcaaggctgcagtgcactgtgattgtgccactgcactccagcgtgggtgacagagcaaacccattctcaaaatacatatatatatgtataaatatgtatatatttgccaatgagaccactgctcttattaaatgtaaaaaaatctaacaccaagagaagaataaaataggtgtgcctgatacccatgcctaaaagatgcctgagggaactctctggtgtggctaaggtggggggcttggtgcttgatggggcacaccagccatttcagggcccaaccggtagaccaggaaaggaagctggaggtgtggaagcgtctgctgcacttggctcagccaaagcccgaagtgcaagtgcgtgctcagtaaatgctggtagtgaatatgaaaacttctgttaactatgctctctggtcattaaagttcatctggtaattcaatgtccttgattacagacagaacagcccttggtatctattcttctgtagccatttagtcacaggaatctcctggcgtcagtctgtttcaggtatttttcttgcctcaagttcatctgctgtgcttttctctctttttttgtttgtttgtttttttgggactgagtctcgctctgtcacccaggctggagtgcagtggggagatcttggctcactgcaacctccacctcctgggttcaagcaattctgctgcctcaacctcctgagtagctgggattacaggcgcccaccaccacgcctggcttatttttgtattttcagtagagatggggtttcaccacgttggtcaggctggtctcgaactcctggcctcaagtgatctgcctgccttgccctcccaaagtgctgggattacaggcgtgagccaccgtgcccggccaaccctcctgtgctttaagacgaggccgcctgcttcttcagtgccccccacggcacactggctttatgagattttctaagcatttagagccatgaatgtgtcaccgtgacagtcaaaccaacttggcaccagagggcacactgaggacagggggctccatgccctccacaagggcttccctcagaggggctggaaggccggtgcagcccgggcatgcccactgggatgaggctgagctctgggggcctggggcagtggtctccacaggtggggaactcagtgctttgcttacatccccttgaacagaggccgaggcctgcaccctgcagtgataagaagttctgatacagaagtgaggtctggcagagccgcccacaaatggcaaatgaggctgcgcttgcagaaggaagggggctgtctgggtcacatggccagctgtagacacccacgctcgggcctcctgagggccgggacagtgctcactgcctattccattcccagcaggtttgtccgggaagtgggagtatgggaggtggggggagagccaggtgcagactccaggccgcgctgggtggcatggtcccacagacctgtgtcacccggacccagcagccatcattttactgcactttgaaaatgcggattttggctgggcgcagtggctcatccctgtaatcccagccctttgggaggctgaggcgggtggatcacctgaggtcaggagtttaagaccagcctggtcaacatggcaaaaccctgtctctattaaaaatacaaaaattagctgggtgtggtggcacacacctgtaatcccagctactggggagactgaggcaggagagtcgcttggacccgggaggcggaggttgcagtgagcccagattgtgccactgcactccagcctgggcgacagagcaagattcctcagctaccttccttttgagggataattttctagataaaaactttcaaacaaatgaaacaaaagaaatcttagagctgggtgtggtggcttgcttgagcccaggagtttgagatcaacctgggcaatgtatcaagaccccatctctacaaaagctttttaaaaattttagaaattagctgggcacagtggtgtgtgcttgtagtcccagctactcaggaggctgaagtgggagggtcgcttgagcccaggagggagaggctgccatgagctatggtcatgccactgtactgcagactgggtcatagagcaagaccttgtctctttaaaaaagaaaaaagaagccaggcgcagtggctcatgcctgtaatcccagcactttgggaggccaacatgggtggatcacaaggtcaggagattgagaccatcctggccaagatggtgaaagcccgtctctactaaaatacaaaaaattagcctggcgtggtggtgcacacctgtagtttcagctactagggaggctgaggcaggggaatctcttgaacccgggaggtggaggttccagtgagccgagatggtgccactgcactccagcccgggcaaaagagcaaaactctgtctcaaaaaaaaaaaaaaaaaaaaaaaaaaagaaaagaaagaaagaaagaaaagaaaagaaaagaaaagaaaagaaaagaaaagaaaagaaaagaaaaaaagagaaatccatctacccaatggagagattctcacatctcaacatccccttctgagctgtagttagaggccccttctgtaccaggagggtcccaccatgcaatggtgggtgggtttgtttccctcccctgacctcctaccccccaacccccatggcaattttccttgagcgattcattagcttaattttaatctggattaagacatttcacaacatgttttttgccaagtacagatgcctctgtgaaatgtttcccagccggctaaacagcgtctccccctgcacagctgcaggcatctccacccctgctgagaagccctccctgggaagagtatttctgactccaggaagctgcaggcatggaagcacctcactgccttgggagacaaccctagcagctggctcacagggagccacacgggcaggcacattagagaaaaagcagtgtcataatgacagtagctactatgacttaggaatgtctatgggccaagatcctacccgtgaacaagtcgggcccccatccacgcaatatctgcagtctcgactgtatgatctcgtcctttgcagccacactgtgaggcagcaatgatcattccgcagacggccacagactccagggccctgggacccggaccaccgtcatatggctctggccccctttcctggcacaaggaggacccaggaataatcctggcaccttgctctcctgggccttgtttccctagagtgacctgagcagctatgcctgtcctcctggttcttccaagcagcaccctgggccctccggcatcaagggaagtctcaagacttctaaggtcctcccagcagcacgcctggcgggccagggagtttgctggctgttgcctgggtaacctgagattccctggagaacgcccaagagcaaactctgcatttttccggattatctttgctccttcccccatgtggacgtgggctttggagggaagagtgtagccatttctctaacacacttgggcacatttgcatttgtttttaacacatttcaggacgtgcaccctacattccggtcaaaatatatggcacaaagctataaaatcgttttttcttcaaggttatttctcatcacaagataaatcatttctaagccaacagctgtcccttttcaaaactgtcaagggagggagtggggaaacctcttttctcagaaatgaggaggatacaccagtagaagagccctggctttgcctgcttcgtcttctcaacacgactgttttgcaagatgtcgtgttatcagaagcatcctttgctcccaaactcaaaatgatgttaacatggtgagcaggaatagtcatgatattgcaaccacaataaccacaaacacaatttcctgaggtgttctttgaaactccttgtatctgcttaaccctcgtaagcaaccacgatgcaggtactatgatcggttccattttacagatgaggacactgagacagagcaagcactggcccagagccacacggtacggtcggaaccgcgtaaagaggcggtgagcccaggcagcagagctcctggccccaacgatctccaggtgaacggggcagcctgtcagtgcggcagagccatggggctaactctatgtccctggcattgctgtttaagctaacaggttaggtacgggcataagtacaaaatagagtatttctgctaatgcaacattagagaaaaatagaagcagaatattagaagaaaagataagcagtaattatcacagaaaaagaaattttcttacatccccaaagcagtaagaacagacagcagatggcctgagaatactagacaagtcaccacatgaacacacacgtgtaaaactcacacacacaatctcagagccacacggggcggagtcgaaaagtccctggacctctcactcaatcccttagccctaaaggaccactgggctcaataaccaggctggtgatggcgatccgagtcaagaatagatgaaaatatactcagcagactgtcaggcaggaagactgttaccagctgtggaaacagtccatcatgaagtcaagataagaaaatatttggcatctggggaaatttcatggaaatgcaatatttcactctctggcaatgccagttcaatgattccgcacatacatttccatccctctctctacacacacacacacacacacacacacacacacacacacacatatataatttcttactttgaaataattttagacttgcagagagtgggaaagacagttcaaggactctgcatatatcctccgtacatactcaccgtacagttatcaaaaccaaagcaactcatgctggcgcgataccgttaactaagctgctggctttattctgatgtccccagtttccgcaccgtccctttgctgttcgggtctcctctaggtcccgtgttgcatttagccctcatgccccctgctcacccccagcctatgggggttcctctgtctttctctgtctcttctggccctgctgcgtttgaagtcccggccaggcattttgtcaaatgtccagatctggacctgcctggtgctttctcagagcagactgaggtttggggtttgcggaaagaatgccgcagaggtgacatgcccttctcagcacaccacactagggtaccggatggcagtgagcagggaggctcacctggatcatttggtgaaggtggcatctgcccggtttgtccactgtgaagttcctattcctaccccgccccccacctttcttttttgagatggggtctcattctagtgcccaggctagagtgcaatggtgcaatcttggctcactgcagcctctgcctcccagactcaagcgatcctcccacctcagcctcccaggtagctgggattacaggtggataccaacatgcctggctaacttttatagtttttgtagagatggttttttttttttattgttttttttttttgagatggaatctcactctgttgcccaggctagagggcagtgacatgatctcagctcactgcaacctccgcctccaggttcaagagattctcctgcctcagtctcccaagtagctgggactacaggcaccagccaccacacccggctaatttttaaatttttagtagacatggggtttcaccatgttggccaggctggtctcgaactcttgacctcaggtgatccatctgccttggcctcccaaagtgctggaattacaggtgtgaccacctcacctggcggagactaccctttagttttacaacagctttcttaagatgtcatttgcaaagcatataatgcacccatttaaagtatataactccagggtttatagcatattcacagggatgtgcaagcatcaccactatcaattcagactaccacttataataaatacctatttaatttctaagctatatatatttatatatgtatgtgtctataaaatatgaaatcattttttcaatttctataacgaatgaaaagccccttacttcctcaaattgggccaactgagcctactcataatgacttgacacatagaaaacaagtagataaaagaagttatcatttagggtcattttcaaaattcactgtcacaaaaggatggttcctgaggtgagtggccttaaaggggaaggagaaaccttttgaaagcaggacaggtcctctctgaatcatccccgtatgggtaaatctacatcactagcttcattactgactggtccatgtagaaacacccagtggccaagcagcccggggttctgaataatagatgaaggtaaactcaggaagaccagccacgcaggtgcgctccagggaggcctttcagagatgtactaagatgctttcacagctcaaatggttccctgatcagaagtaatgtgatacaagtaattcaattttgggttttcttttcttttcgagatggagtctcactctattgcccagtctgaagtgcagtggcgtggtctcagctcactgcaaccttcacctactaggttcaagggatcctcctgcctcagcctcctgagtggcttaggactacaggcatatgccaccacacctggctaatttttgtatttttagtagagatggggtttcaccatgttggccaggctggccttgaactcctgaccgcaggtgatctctctgcctcggcctcccaaagtgttgggattacaggcatgagccactgagcccagttgggttttctttttcttcatgaagatgttggaaaagctgtttttattgatatatggcatctagatccactcatcacccacagggttcatgagaaaatggaaagcaaatgcctgctggagcgctgacgtcacattcaacaggccaaggcacacatgctcccgtgtcatacaagtgacttggttacggccgagagcatccaacccacagcaatgctcagccgcaatcactgtgagaatctccctcgaatcggaaccgtggagaagatgggaccttccccagagagtcagtgacttcctgcaggcaagctgggaccgtctctcggcccctcccagtcctccatggctccgtctgtggtcactgtccctgctctgcgtggagtgaaggcgtgcgtgccgagtgtgagcgaggcttcttctcagccctggcgtccacaggcaccattccggctcatctcccagcaatcccgagaggtctcttccttatcaccaccgcactgaagaggaaaactctcacttagaggaattaagtgtgtgtttgctctttcttttctttttttttttttttttttgagacagtgtctcattctgtcaccctggttggagtgcagtggcatcatcacagctcactgcagcctctaactcctgggctcaagcgatcttcctgcctcagctgtctgagtggctaggactacaggcatgagccactgcacctggctgcagtttcttcacagtcgcaaagccaaggcttgagaagggtcttgcttcaagttgcgcccctgcccgccgtggtccgcctcccctccgcgacgctgacagtggcgtcctcatgtctaatgcttactccttggtttccttcttgacctctccttccttcactcgggcagtatctgtcccccacattatgcaatgtcagggcccttaggatgaggacctctcactgctggtcatttcaagaacccaaggccaggcacagtggctcatgactgtaatcccagcattttaagaggccaaggcaggaggatggtataaccccaggagttggcaaccatcctgggcaatatagcaaaaaaaaaaaaatttaaaaattagctaggcatagtggcacatgcctgtggtcctagctactcagcaggttgacttgggaggatcacttgagcctgagagtttcgagctgcagtgagctaagatcataccactggtactctagcctgggcaacagagcgagatcccatctctttaaaaaaaaaaaaaaaaaaaaaagaagccaacacttgggtgtagaaagggttccctttgagctatgacttcaggaccaaagccctggcctttgacatcactatcatttcctggtaggtcgttacagtacacaggttatgttacattagataagaattttccagctatgacctaggagatgacttaaggtcacagaggacacacatgctaagggcaggaaataaacccttcgtgggcgctgccctggttctacacagttctgctcgggcttctgacttcagtccttcgcctggctctgcagagctgcatcgctccatgtgtttaattaaagaattaaaaagccaaaaagaaactgttaattactacatgccaggcaccatgctcgacacttgggaaatatttaagttatttaacactcagtctctgaatgcaaagagctcccaggaagacgcataagaaacaaagatttaagatcgtgtatgttacagccaagtgggacagactgaagggactgagaatttggagacgagggaacagcgttatcagctgcggaggcacgggaaggcgtggtggagctgaacggtgaatgcagacaggagttcaggggaaagagaagccatgagtatctcaagtgagcagcagcaggaacaggacacacgtgaaaatctacgcatgctccttcagggaacgtttcctgaacaccttttctctaatgtattggtccttggcatgaaactccttttactacatgagcattcccccaaaaggtgtgaccacattagccctgcaaggtgcagcttgaaaaaaaacaattgtgctcaaagaggcctgagaatgctgtatataccgcgtcctcctctgaaggcctagctactgtctactagcctagtgaaggctccgagaagtcctgcagtaaagaaaccctttctgtgttgaatatcccaagcttcccgaatttactttaccactgagcaccctcctccctttttttggagacaggacaaggtctcactctgtggcctaagctggagtgcagtggcaaaatcatagctcatgcagcctaaattcctgggctcaagtgatcctcttggctcagcctcccaagtagctgggaccgcaggcacaggccaccaagcccagttaatttttaaaatttttttgtagagatgatgtcttgctacgatgaccaggctggtctggaaatcctagcctcaggcatccctcccacctcggccgcccacagcaccaggattacaggcgtgagccaccatgcccggccttctgtcaacttgatagatcacaagattctcagaaactttcaacaatatttggaaaatctccacatgccaagaagatacgctaaatggtttttgctcattccgaccaaaacaaatatatatgactagagtgcaatgtagtgtagaatcgccattgctaaaaccgtggtcactaaacccgtgagcatgtgatatggtgaactctgcgaccgcatcccctaacggacagaaacacacatatgtggaagctaaaatggcaaacacaacgaattatatatttttggctcggggctgtctttcacgacttaaatacagctcagtttgcaggctggaggaaacaattcttccccaaatagcaaaaccattcccgattccaccccacgccagcccctccctgcccgggtccgctgtctaggagcccagagctccattttctgactcctgcacaacgtcagcccaggcaaggcggctgtctctaaagtttgcaggcatccagggaatctcagatacatgagctttacacatgtgccaagagtacagggaagagagggtccaacaccactgtcccggtggttttcacccaggggtgactctgcacccccaggggacactgggccatgtctggagacatttttggttggcacagctggggagtagggtacgggtgggtatgctgccatctggcaggtggcggctagggatgctgccagccatctgacagtgcacaggacagccccacaacacatgactacctggtccaaaatgccagcggtgccaaggtgagaagccctgcattacactaacaaagcacccaacgaccgcgatccacgagcggagttgacagaacccgagtgcaatcattacgtgtaactgggcgacaggcactatgtattctgacccagtaagtaatctgcataccccagctgactgccacataatgaagactgttcctcgtaaataccaatagcggctttcaaacctgtgaatgaatgtggagaggcagggacgtattgggtgaagctgtaaccactggccgccatcctcacacataccccactgtgttatctgagaacacaaagcagcataggagagctgttttgattctctgtctcattttaagaatggagacagtagatgtttaaactataaaaataaacagaaggtaccagtggggaaactaaatcaaatgtgaaagcaaaggaacagctcataaactgaaatgatttcacacacccaaggtcgaccgcgccaattccctggtagtttatgatgacaggtcagtccagaaacgggcacttctaggcagctaccaggagatcccggttccaataatgaaatactacaatgttctcggcagcctgtcctctcagtgagctgtgtcctaggattcacccacaccaacatcatttcaagtaatcataaaatagtggatttcaagagacgtagaagtatttgagaaagtggtctctgaaatcagattatcaactagctctccacccaaggtgccaaggaaagccacctttactgtcatttatcaccagcttctagaaatcccaaaaggcaccacaggtcccaggaagagaaaataactaataattcaaatgagaagcatccttgtgcaatggaaaggcaatggaggtgcgtcatatgtcaaaaagcaaggatgttaaaaatgcagaatgctactaactttagactaaatattaaaatcgtgaaaaccaaatcgaaggtcattccaagttgtttgcctcagacctggaggctgcttattatttcacgtgctctactgcagaattaatagaaagttttagaagtaggaaaaaaaaaacaaaaaaactaaccttaaggttatcaaaggttttgacagtctgcgccaagtcactgacattccctgatgacgctgtcccctgtcccctagggcctgaggacacctgtgagccgtcaatgacctcaaagccagaaagcaaggcctctgcacagctgcagcgagactccttggctctctgacccgatatcaggtatgtcttcaaacctatgatggataaaagttacagtcagcacagattgaaagcaccgtctgttgaaacgcagctccgtcttgctctctggagaggactcactcctggaaagttgagagtaaagtgaaaatgtgaataggtcatagtttacgacggacgtccacgatctctccagagagatgcggcctcagggagaccgtgggcccccgagacacaccactcacccacgttacgttttcttggagtaatggctgcatgtttcatgttttaccttcagggttaaaataagcattaaaaagttcctccatgaaagggtcccaggacctccccgtgaaggcagcaaagcagattggttgaccctagacactgctttggtttatttccatctgtgaataccagtccagtgagtaccttcctaacggtcagtctagacgtcatggcagcttccggtactgaccatcttacctgtgtcagaggctgcaaaactaccccgaaaaacaagaccctaccagggaccaagaggccattaaaacctccccagactcagagctgttgagcatctatttcctgttggattcaaacactcaccccaggaacattcagcttttgttaagctgaggtccacatgcattttattgtctcacaaaatcccgcatatagaaaaaaaaaaaaaaggtggtcaaaaggacacttgacctgtatctttacaattctcctttgaggctgagctaacagccggacccacactgcgctggaaggagctgtgaacaggtgggtggatcctgccccgggaatctgctgggaagatggcaaaggagcagcttttctagaaagagcccaaggaatttttgaaaaagaagcaaactttatttaaagaaatccatcctttgacttcactggaatttaaccagatggcaaatgtatcggaaggagggacaatgtaatttaacatttaaataacatttatttcaggcctagtgtatgccacacaccgagaataaaatcatgaacaaagcagggtcccttcttttttttttttttaattgagatggagtctcactctctcacccaggatggagtgcaatggtgcgatctcagctcactgcagcctccacctcctgggttcaagcaattctcctgactcagcctgtgagcaggcaggtgtccaccaccacgcctggctaatttttgtatttttagtagagacagggtttctccatgtcggccagactggcctagaactcctagtgatctgcccaccttggcctcccaaagatgacaggtgtgagccactgcacccggtcgcagggacccttcttgaagggtttaagctccagcttcaggtcgtgaagggtgtggcatggaaagatgccatcgagaggcgacgtgtctacaacactgatcgactctggcttcttacgctgggtacatatttggtcagcgctttaaaattaattaatcagaaacctagggactacttcatcaataatcccgaatcattttataagtatggccccatctcatcacttcacctccctctctccttgtaaaaatactacgtggctaatctttttaagtcaactgttctgagaatttgccaagagtcctagaaacacgtaaagacagcctagaacgtagccaggtcatagctgagaatcaaaagacttagatatttttagatgccaactggccccaagaaactcttcatgttttgttttgttttgttttgttttgtttttcctttagagatagggtcttgctctgttgcccaggctggagcgcagtggtgcaaccatggctccctacagcccccacctcctatagcctcagcctcctgagtagctgggactacaaacgtccgccactatgtccaactatttctttctttcttttttgagatgggggtctcactgtgttggccaggctggtctcgaactcctagactcaagtgatccgcccatcttggcctcccaaagtgctgggattgcaggtgtgagccaccacacctggtccaatgaaaatctttcactcttacttagctcctgaacttttgtgcatttttttctccaacaaaaacccacatcccaatttatgcacaggatcaatcacgactgtaacatgtatacactgaaatggaaacgtgaactggaatacgacgcaggagtgaagccatctttatactaatttctcggacctgtcccaggcgacaccagactgactttgtaacttcactttgccagagttaaaaaatgcaacctatgtggactcaagagaggacaatgagctgccagggcttatacccgccttcatcaaagaagtacacgcaaggaggcctgtcctggggctgctctaagggtctccttcccatgactcctgagtgtggcccacaagtcaccaggtggcagggtggtgacaggagccactgacagccagtgtgactgtggatggccactctggagaccgcagtccccacatactgagagaggagggacatttttttgatgggaggtaggaaaagttgcggctgaaggatgaggttttccattatgtctgtggctggccctgcaaggtgctgttggctcagggtgcccctgcctgaggctacggctccccatgcacaagggctgccctgggagcatgaactgggctgcctctgaaacccaggaaggggccctcacccaggtgactgcgcacctgctccctgtgtggctccgggactgcaagagaaagtcaagatggcctctcctagaagtgcgtggcaactgaagctgagagaggctgagcagggaggcctgaagagctggagcacgacgggacagccagcacattcacagcgctcagcacggcagtccacggggagcacggagtggcagcggcggcctctgctcacaagctgggcacgtgcctcaagcacatctccaacgtctgctgttgcttttttgtactgggattactgagtcactcttaattcatcaaacatttattaagcacttcctgtttactacacactgatgggtgcagggacgatgtgtgactattttggccgagatcgtgacctgtgtggagcccattacctgaagaggggccaagaggacaagcaggtatgactatggtcaggcgtgccaagtcccaggacaaggaaggacgggtgctccaggaagcacaggagggggcatcttgagaagcctcaggaaggaaggggctgtggctcgaacgtgtcccctccaaagttcaggcgttgtggagtgagagtcttaaggaagcagggctttaagaggtgacgaggccaggagggctcctcccctgcgatgggatcaggcgcctgcataaaggggcttgctgtaaggggctctctcgcttgccctccagtttccttctcccttccagaagatgcagccctccccagacacctgaacctgctggtgccttgatcttggacttcccagcctcctgaagcatgaggacagaaatttccgtgctgtatagattacccagcctatgctgttctgttattgcttcacaagcagatggagacggacggatcagcaccctccacacggagaactgaaagacggggcgaggtcagcccggcaatagcaaaccaggccaggggcgggggtggctgacaccaggcaggggggttactagaacaggtcatgaaaggccctctacagaggtggcctgcagcaggcatagctaaaggatggcttggagctcagtgtggctggagcagagaacgtgtggagggaatggccagggctgagccacagcacctgtgcagggcactgtgtgggccatcctgggaagcctccattctggggccacgggcagcaggggggcgggaggagaaagaagagccacataggaggcatgaggcgtaggacaagccagggagccggtggaaatgccagccacagcgggtgggaagttgggaggcacgggagtcaggaaataacagtggaaacgggaaacctactccccacaaactgctggcgagaggcaaggctcccattacaagcaaccaagcgtgatgggcgagggcctggctgctggagggggcctcggagtcgggtccaggtccgccccctaatcccgtgatctaagtgagctgcttcatctctgcctctcagtttcctcatctctaaggggagggcaggagcagagctagtgagctgcttcatcgctgcctctcagtttcctcatctctaaggggaggacaggagcagggctagtgagctgtttcatcgctgcctctcagtttcctcatctctaaggggaggacaggagcagggctagtgagctgcttcatcgctgcctctcagtttcctcatctctaaggcgagggcaggaggagggcttaccacacagctcgcatgtgaggcttaaatgatcaacacgcacgcagcaagcactcgacattagctgtgattatcgacgcagtgtttgatctgcgtatcactggaatctttttcatgcaccttctacatacaaaagcatttgcaaaactgttaaatcaataattgctcctgatttgtttctgacttgagtttttctttaggaagcgctgaatgaccaacccatagtgataacatgatcctactagctttacgaaggtcaaacacacctccgtgtccacaacgagcaaaatcgggaagtaaattatctttttatttatgcttcaatatggaaagctaaatttaaagtgaaaccttttgtcagaaccagaagggttatcaccctgacaggtaaggcagagcccagctgcctaatcacaaacgcctgagaaatacatcaggacaggttactgagttcaagcccagcgaaagtcttaagtcaggagactctgcaggcgacatgatttaatgaataaccacacacatggaccctggggtccaagttcattagaatggctcttttgcagcagaaggtccaaaaaaaaaaaaaagacagctaaatgatttaagtgtagtgtaaacaggagaataattaatatgatttcttatattctttcctggttatccattgattttaaacctcaacaacagcgatgtcttttatcagcttaattttacaaaggctacagagaggggtgggcatttcctaatgggctcctgtctgacgggggaatttgtctatggctgtgtgcgtggaggttaacgcagttaacgttcttaagtattcttaagtatagtgtcacttctttgaaaactaaaactgcactttgcacatagtggtgatcaggtttggtgacccaagtataggaagagtgactgacaaagcccattttggaaaagagtgatgggcgaggcccatttctggcctcatttgtcccagtctctttctgtgggattcttgccttggactgagataccctcagccaccaagaatcaaggacctgactgccaactcaacagaaagagaacaacagcgaggcacggggatcacagctgtgaccccggcactctcggaggccgcggcaggaggatcacttgagcccaggagtttgagaccagcctggacaacatagcgagatcccatctctataaaaaatttaaaaatcagctgggtgtggtggcacctgtggtcccagctacccaggaggctaagatgggaggatcacttgagcccgggaggttgaggctgcagtgagctgtgagtgcgccgttgcactccagcctgggcaagagagtgagaccctgtctcaaaaaaaaaaagaaaaagaaaaacaagccaggcgtggcggcacacgcctgtaaatcccagctacttgggaggctgaggcaggagaatcgcttaaacttgagaggcggaggttgcagtgagctgagatcgtgccattgcacttcagcctgggcaacaagagtgaaactccgtctcaaaaaagaaaaaaaaattaaaagaaaaagaagaaaagaaaaacaagaaagagaagaataatcaggaaggaaagaatgttttaagacatgactttgggagccagccacatagcataacaaatgcctagaagcttacgtcacttatgacttaaaacaataaacagaaaagaggcaatcagcttgggctggttcagaaacattccaaaaacgtctttcactttgcattgcattcttcctcacgactaggtcggaaacgaccaagcggcatgagagttatttaaactaaactgtaatcagccaataagaaaaataaagataaaaatactcttaatctaccaaatagccaaagcctatggagtcatagatatattttataattatctattctttctgcgtaagaagaacaaaagttttggtacaaaagagagaatatctttcatatgttaacattaaaatgctctccggagggttgtaagtccttcctactcatatgcaccataaataatcataagaactgatttgttcttgttgtcccaatatttgatgataaatctcaagttcctactacaaatggctgctggtgaaacttaacctcttcttaacaaatgaagtcccaggtcaggcgcggtagctcactcctgtaatcccagcacttagggaggccgagacgggagcatcagttgtgctcaggagtttgagaccagcctggccaacatggcgaaatcccgtctctactaaaaatacaaaaattaactgggcgtggtggcacatgcctgtaatcccagctactcaggaggttgaggcaggagaattgcttgaacccaggaggcggaggttgcagtcagccgagatcgcaccattgcactccagcctgggtgacagagtgagactttgtctcaaaaaagaaaaaaaaaaaaaaagaagtcccaaataataaaatatgagatggatttatggaagaaagtgaaagaaacaaagggtaggcaccttgcctgtttaatttgatcttctgcttaaccaaaaaaaaatttttttgtttttttttgagacagagtcttgctctgttgcccaggctggagcgtagtggcgcgatctcagctcactgcaacctccgcctcccgggttcaaggaatactcctgcctcagcctcctgagtagctggaattacaggtgtgtgccaccatgcctggctaatttttgtgtttttagcagagagggggttttgccatgctggacaggctggtctcgaactcctgacctcaaatgatccgcctgcctctgtctcccaaagtgctgggattaaaggcgtgagccaccacacccagccagaaaataaaattttagagcatgtgcacgcattctctctctctctccctcccgcttccccacccctgcttctaaacaggtaccttctatacccagcttccctctctctcccagtaatggctaaacagctgccatcacagccaaatgggaatgacaggcatcccctgagtgaccacattcccctgttttggccttttttttttttttttttttgagacagagtctcgctgtgtggcccaggctggagtacagtggctccctcagctcactgcaagctctgcctcccgggttcacgccattctcctgcctcagcctcccgagcagctgggactacaggcacccaccactatgcctggctaattttttttgtatttttagtagagatggggtttcaccgtgttagccaggatggtctcgatctcctgacctcatgatccgcccacctcagcctcccaaagtgctgggattacaggcgtgagcgaccgtgcctggcttggcttcttatcttctgtattccgagttaataaatgccccactgctaaatgctacattccagaatgctaacatagggagagtccaggagtccacacacttcagagaccttcgcctcccacctctaagaaacctcttgaattagggtttactagcacgagccttcacaaagactgtagaaatgagtctctgagagacgacacccagcacacccagcacacccagcacaccagcgaacagcccaccaggtgctatcgctgtcattcatttgctcattcgctcgttcatgcacccagcagactaaatgtttactgagtacttaccgaaggttaggatctgggctaagggttgaaagaaataaataggttaaaaaagaaaaaaagccacctaggtgactttcactccaatgcttgacctcagttcccttgtctagataatggaaatgctggccggcgcggtgactcacgcctataatcccaggactttgagaggccgaggtgggcagatcacttgaggtcgggagttcaagaccagcttggccaacatggcaaaaccctgtctctactaaaactacaaaaattagccagctgtggtggcaggtgcctgtaagtcccagctactcgggaggctaaggcaggaaaatctctcgaacccgggaggcagaggttgcagatagccgagatcacgccactgcactctagcctgggtgacagaatgagaccctgtctcaaaaaaataaaagaaaaagaaaacgaaaatgctgtgatatgatggtcatatcatagcacagggctgttgtgaggattaaatgagttgattcaggtaaacagggacatccgaaaaagggaaagacggtgcttgtcctgagaacagctgtgaatgtgaggacagtcagtgagtgacgatctggacccacaagaagagagtcatatgcattcaagtccaagtgtctatgggctgttcagaagcaacaaatggcacttcaacaatgagttgcagacaacaaaatggaaatgaaggtctgcaataactattaagaatcctgtaacagagcagagtttaaataatgggaagaggctatgaaacaagagagctggggaaagataccagaactgaaacagaccaccagctgatcaccttttatttgtgaaatgacagcaccaaatgcaccagatgccacagacgggagggagggggataggtcacgtcggcagagggagggggtcaggtcacacctgcagcagggacgggggtcccagaccgtgttcttgtccctagagagctaacagctcatccgtaggtttctaagaggtgctgattcaagcacacagtgtagatgatgaaaaatagattatagaaagaagagaaaggaaaaactaaatttaaaatctgagactaggtagccactaaatacttgaaaacaaaaaaagggaatacactgaaaatggaaataaagctgtatgatgtttagttaaagaagccagtcccaaaaggccacgaactaggtgatcccctttatatgaaatgtctggcatagggagatctgtagacacagaaagcagatgagtggctgccatgggtttaggagagagagggtgtaactgctaacggatgcagggttactttttggggtgacgaaaatgtaaaattaggttgtggtgatggttgcacaacaccatgaatatactaaaaaccaccaaatcatacacttgagagggtgaattgcatcatatgtgaattatacgtcaataaagctgtttttttgaaaaagaaaaggaagctgggtgtggtggtgcatttctgtgatctcagctacttgggaggctgaggcaggaggactgcttgagcccaggaaatgaaggctgcagtgagctatgactgtgtcactatgctccagcctaggtgatagggtgagaccctgtctcaaatataataataatattaataatacaataaaataaactaaatacagtaatgtgaacatcaacaaggtgcaataattctgagatttagagaagaaataaaataaagctgggaagaaatacaccctccctgagaatacaaggtagagtgagcagtagcaggtaaatgaaaaatattaaaggcttagaaatagataatgtgggccaggcatggtggctcacacctgtaatcccagcactttgggaggccgaggcggggggttgcttgaggtcaggagttcaagaccagcctgaccaacatggtaaaaccctgtctctactgaaaatacgaaaattagccaggcgtggtgatgcacgcctgtaatcccagctacttgggaggctgaggcaggaggatcacttgaacccaggaggcagaggttgcagtgagccaagatcgcaccattgcactccagcctgggcagcagagtgaaactccttctcaaaaaaaaaaaaaaaaagataatgtggtagagctagggcagaaaaacatgcaagtcaagaataaggccaaataaccttgaagaactaaaaattcaacatagcaaaagttcagaagtctgggagagattaaataaaacaaaacaaaagaaaatttgaccttcatgaaatagctccaagaatcatccaatttgcagctctcactattgtagtccaacctaaaaacgccgggccgacacccacattgtcttcttcgagcacaaacacacttctcctgcagcaggtgtagcccgcacagcatggtgagcccagccacacccgcacgccagacgcttggccacagaaacgcagaagcggccactgtccttgcctggaacacagatgggccttttcatccaggaggagatttacttgcaaaggcattttcttctgacccacaggtggttatacctgcactgacacctcctgtgggcatcttcagctggaagaaaggccaccgaggctgcggagccacctcgcctgtaaacatcatatcatgcaaaggaaaagctctaagttgcggaatattcttctctttttttttttttttttgagatggagtctcgctctgttgcccaggcaggagtgcagtggcatgatctcggctcactgcaacctctgcctcccgggttcaagcaattctcttccacagcctcctgagtagctgggattacaggcacctgccaccatgcccggctaatttttgtgtttttagtacagttggggtttcaccatgttggccaggctggtcttgaactcctgacctcaagtgatccacccgcctcggcctcccaaagtgctggaattacaggcgtgagccaccgcgcccggctgatgctgaacatgcgtgactaaccttccgcgggagcagtcatgccgctgccttcaccacctgttgcttctgggaaatgtggatccaggctgctggctctctcccagatcgtatctgcagcacaggcacatgcttgctgtgaatttccacacttgtcagatcacccggttttcaacttgttttctagttttctctcttttgaagagtattttgcacactggctggggcagaggctgacagtttcccagactgtgttttcttgtttacagagcacatgcagacttgttcgagtcatctaacggagaaacccaaaaacctccattttctcctgagatatctctgctatctctaatttcacttcagcagcactggtggctgaaatactatggactatgtatttcggacttcctttttctgaacttttctggaagaatcgcagttgtgtgtgtgtgtgtgtgttttgttttgttttgtttttttaagagaaaaggtctttctctgtcacccaggctgcagtgcagtggcatgatcacggctcactgcagcctcgacgtcctgggctcaagtgatcctcccacctcatcttcccaagtagctgggatgacaggtgtgcaccaccaagcccaccttcttttaaaaaaaaatttttttttaaagatggaatctcactatgttgcccaggctgggcttgaactcctggcctgaagtgatcctccggcctcagcctgccaaagtgctggaattacaggcatgaaccaccatgcccagactcaggtatttattaataacctcaaggtgttgctgcacattccataagttgagagcaggtccactctgccacccagggatgtcccaggctgggcgatttgttctcccactgcacaccatgcaactgtcatttatgccttaagaaaatcccattgaagttgtggactcaatgcacaatcaaaactgaaagcaaaaccgaggcagtgagtagtgagtgcccaagcacgagaggaggggacaaaggctgggtccccggccatcaacaaacggagagctagctcataaaacagtgacctggagcttcagtcagcagccctcactcccaaaaggggtgaggagtcttcagaaactcccctgtcttatggcagaaagctgagctctgcacagaccctggaaaaaccactgttgtcaaaggagagatggaagtgggcagaaagcccaggaaggagggttccagactagtggaggtactagcctcaaacaagacagctgagtacttagagaagaagagatacatgccaggcatggtagctcatgcctataatcccagcactttgggaggccaaggtggaaggatcacgtgaggtcaagagtttgagaccagcctggccaacatggtgaaaccctgtctccactaaaaatacaaaaattaaccgggcgtggtggcgggagcctgtaatcccagctactcgggaggctgaggcataagaatcacttgaacccagtgggtgaaggctgcagtgagctgagatcgcgccactgcactccagcctgggcaacacagcagactccatctcaaaaaaagaaaaagaaaaagaaaaagaactttctatgaacttcccgtgatgatgggtacatcctgtagccgtccagttctgtggcctccaggcacatgtggctactgaccactcgaaatgtagctagtatgaacaaggaattaattttttaatgatttcaattataatttaaattttaaacagctacatgaggctggcagctatgtaggaagcagtgaagatccacatccttccttattggtgaaaggaatgaattggaaacagaaagttcttttttacctttattaaataaacgtgaagtcataagaactactaaaagaaaatgggtgggataaaagtaaaactaaatatgaaaccagtaagtattcactgttatttattatagatgacatttagacgcaaatacgagagggagagtaccctgtatattaatagcagggatagccaattacaaagtggaataagccaggcgtggtggctcacgtctgtaatcccagcactttgagaggctgaggcgggtggatcacttgaggccaggagttcgagaccagcctggccaacaaggtgaaaacccctctctactaaaaaatatacaaaaaattagctgggcttggtggcacacgtctgtagtcccagctgcttgggaggctgaggcaggagaatggcgtgaacccaggaggcggagcttgcagtgagctaagatcgcgccactgcactccagcctgggcgacagagcgagactccgtctcaaaaaaaaaaaaagaaagtggaatagaaacagttactctatcgaacaaaatagcagataatgttttagaataaagaaacaaaagagctggaaacatttgaacgttttcaaaaaaaaccctataagtgggatgagatactggttcacaactctaatttagagcctatataaacacattagcttgaccttgcttgacatacattatttctaaaaaatgttttaaatgtgaatatttagaagatacaccatattttctgctttttatatactataaattttactatgtgagtttaaaaagtggttggtaaaacacacacccaagctctctgatctttcacacccattaaaagcagcacatgtattaaacacactgctgcacaatgggcgtgccatgggtgctctccaaccgcattgggcttgaatgtttaactaggcctgaagccacagtgctaacaagatctggcagagacagacaaggccacgccggcagcaggtgtttcaggaaaggtattactccaccatcccttgcgctgaagccttagcctcaggcaaattcatgaaccaggtagaatctaattcaggtcactttggccaatctccactttctaccagcctcctccaggtccctactgcctcgggaggccccctacccacctgccaacctatcccctcaccatctaccggcaccaagtctgtgtgagcacactgtagatacacgagctccgtcccaactcagagctaggagagtatcagaggccaaacgcctgccccctgcttctgggctccaccagcagcctgggaggccaccccctgcagctgactcatctgcatactgagacttcctgacacaaatggaggtgacaatattcgttcccccatcatatcccagaaattcccttattgccgacatccattctgggtttttactgcgcttcacacgaggacaattccaggctgaagtggcaggtcccagcaccagactccacttcatcagaacacttctgttagagtctttgaaacgcatgaaatcccctttagggtccataataacgccttctggaaactcgacggcaagccactcaccctcagccctatcagaccccatggctccttacatttctgtgacatacttaatttgcaatgtcctcttttccatcatgaaataaaattaaattcatggacaacataacctttaatcactgagaccataaaggacacctccagcagctgactagccttccctcagccacctttgtgcccagcctaagggcagggtggcaccggagcctccatgcttcaaaggtggccaccagggcccatccccctttccatgcttctccctgcccagagagaaacagcctgaggacaggttaaagactaaatacaaccaggcatggtggctcatgcttgtaatcccagcaatttgggaggccgaggtgggaggatcacttgaggtcatgagtttgagaccagcctggccaacatggtgaaaccccatctctactaaaaacacaaaaattagccaggcctggtggcccatgctgtaatcacagttcctcaggaggctgaggcatgagaatggcgtgaacccgggaagcggagcttgcagtgagccgagattgcaccactgcactccagcctgggcaccagagcgagactccgtctcaaaaaaaaaaaaaaaaaaaaaaaagactaagactatgccacaattccgcatatgcatgtatttattatatacatatatgtataaggtacatatttgtatgtgtatatccgtgcatatgtgtatacctgcagcaattttttttaaaaggagaaaataggccagagccagtggctcatgcttgtaatccccgcaatttgggaggctgaagcagaaggattgcttgaacccaggaattcaaagcctcagtgagctgtgactgcaccattgcactccagcctgggtatcagagtaagaccctgtctctaaaatataaattaataaataaaaattaaacggagaaaatttcttaacaacttttatcctattcattctttcaacacataataagctcctgaaatccgttaagaatgagattagacctattctaaatcctactaacaccttacattgactctgtcttattaatctcagtactgtagtacctgggggaaggcgcagcaccgtggacactcagaaacgtcaagaatcaaatcacatctctacaacggtggtccatctgcaaacagcgtggagatcaaggaagggcagaacaaagtactgaaagtgctgtcatttctctggagggtgaattacacagaccaactttcttcacataataagaaacaagaagttgtttgtttatgggttctatgggagcacccgctgcaggccacgctagacgctggtgataaaactgtgaacatggcgtccatcacctgactcagtggtaggaaccagtggcagggagaatccacaagcaaggacccgagtcaccagctgtgattaagagccaggaagaaagcaaaagcttcctgcaatagagaatacccaacatgcggtttggacagagtcagggacgtcctttctgaagaaatgagactgaagtggagatatcacagtgagatggaggcaattgcggtggtgtaggtctggggaaggcacgagggatgcagggatcagcatggaaaggacggtcccagcatgctcacgtggctgaaaggtggcaactgttcccgatgcagactgagggaagaaagtgtggcatgagaggaggctggggaggtgggccaggccctgggagccattaagaggtttctgcctggccaggtgcagtgattcacacctgtaatcccagcactttgggaggccgaggtaggcggatcacttgaggtaaggagttcgagaccatcctggctagcatgatgaaaccccgtgtctactaaaaatacaaaaattagccaggcggggtacatgcctgtgatcccagctacttgggaggctgaggcacgagcatcgcttgaacccaggaggtggaggctgcagtgggccgagattacgccactgcactccagcctgggggacggtaggagactctgtctcaaaacgacaagaggcatctgacttacatgctaggcacacacaagagctctgcagtgttttaagtaagacagcacacagttcgattctttcttattttgcattttaattttttaactttttttttttctcttgagactgagtcttgctctgttgcccaggctggagtgcaatgacacaatctcggctcactgcaacctccgcctcctgggttcgagtgattctcctgcctcagcctcctgagtagctgggattacaggcaccaaccaccatgcctggctaatttttgtatttttagtagagacggggtttcaccatgttggtcaggctcgtctcaaagtcctgacctcatgatccggccacctcagcctcccaaagtgccgggattataggcataagccactgcacccatccaattttttaaaactttttaattcaaactaatgttaatcatataggaaagttacatatacggtacagggagttctcatatatccctcgctccacttctcctaacgtgaatgtcttattgtacgacgtcaagcacagcttgataatcaagaacaggaaattaactagacgatgaacttgatttgagtttcaccaatttttcacctgatttatgttccaggatcccatccaggatcccacgcggctggctggctctttttaaagcctacacagctctgggtggcgaatggctccggaggtgtcaggagtagaagcgggggctcactcctggccttttgctgtggtccaggcaaaagctggagtggccttaggtcaggttcatgatttaaggtctaggcagaaccgacaggatgtgaacaaagggaacaaggacacttcctgggttcctgggttctgccttcagtacgtggacggatgagtgagaccagaagaagtaaaagtttagggggcaaaatcaggagctcagttctggacctcccaagctgaagatgctggtgacacgctcaagcgatagggacaaggaggtggccataccatgaaatcagaagggagctcagggccagagatccactgtccataatatcaccagggagaagacagcaggtggggaggcctgggaagcagccttggagctgcaatgttttgaacggccagggaagtgggccagcagggctctgaggagggacaaaggggtagggaggggggctgggtgtgatggctaaagcctgtaatcccagcactttgagaggccgaggcgggtggatcacctgagctcaggagtttgagaccagcctggctaacatggtgaaacccccgtctctattaaaaaatatatatatacaaaaattagccaggcatggtggtgtatgactgtaatcccagctactcaggaggctgaggcaggagaattgccttgaacccgggaggtggaggttgcagtgagcggacattggtgccactgcactccagccagggcaacagagcaagactctgtctccaaaaaaaaaaaaaaagaagtggatcactgtgaacgctgcagagagaagatgaggccactagcaaagccagcctgggtttggccactggccacgcaaagactgtcagtgaccacaccagggagaggtgcgtttgggcggcgaagagcacaggccaggctggcaggttggtgtgcgagtgtgtgcaaggtggagaaggcacacgcggtcagtcctttggagaagtctggcacgaggcctgccgaggaaatggcccgggggtgtggcagggcggaggtcctgtgccatgtcctgcactgaccagggcagcccacgggaaggcagctgcagagaaggcagaacccgcagctccagaaggtttggggcatgaccagcagaggccaacttctattgtgaagaagaaaccgactcccagactttcagggaagggggtgtgtttggtctggtggcagtggggacagcaaagtaggacccttgggtgtggctacgattgagaggatgtcaggtagtgtgagattcaggctggtgtagaatcactcatgagaaagtatctaaaatcttccagatgacagtgctaccagctggacagctgacagtgggcgctggctctttcaaaacagtgctccaaaggcaaagaaatagcaaagacagaagtaaggcacttaactatttgttgggtgaatatagaaatgaatgaatgaatggatggatgagcagatacatcaagaagttaattcacaaattaaagcccattatgaaactaaagtagaggctgggcgcggtggatcacgcctataatcccagcactttgggaggtcaaggcaggtggatcacctgaggtcaggagtctgagaccagcgtaggcaacatggtgaaaccctgtctctactaaaaatacaaaaattagctgggcatggtggcgtcacctgtagtcccagctactcgggaggctgagacaggagaactacttgaacccgggaggcggacattgcagtgagctgagatcacgccattgcactccagcctgagccaacaacagcaagactccgtctcaaaaaaaaaaaaaaaaaaaaagttaatcctgcaatgaccatacacccagaaaccccaatcatggatatttaccctagagaaatcaaaccttatgtttacaaaaaacgctgtacgcaaatgtttgtagcggcactattcataattgccaaaacctggaaaccaacctaatgtccttcccaggatgaatggataaacacactgtggtccctccccacaatggggcactactcagcatcacaaggaatgaactagagacccatgcagcatccaggacgaatctcaatagctctagactaagtggaagaaaccagtcttcaaagggtacatgctgtgtggttccattttaatgacaggctcccaaaggcaaaactacagggaatggatagttgttgctgggtcggcaggggcctggaggcagggaacttaaggccgattcaccctgactttttagaactgaatcaaaaggaaaaccatacccaggtaacaaaaggatcagaggctactactccctttgcacctcgtggcagatgaaaaatggaaagtacctctgattggttccctcccgcaaccaaccagactggtcccaggccaggtcttcaggtgtaacgttgcaacttcacttcaacctctgattggtcgcctcctgcaaccaatcagactggtcacaggccactccttcacttacatagggtgtaaccaagtaaccaatggtaaacctctacagggtattaaggctccagaaaattctctaatcagccacttgctcctgctcgagcctgctcccactccgtggagtgtactttcatttcagtaaatctgtgcttcccttgcttcgttttctcgttgctttctttgtgcattttgtccaattctttgttcaaaatgccaagaatctggttaagaacccagacaacttgtagtcaagaccctccactggtaacacccataaagggtgtattagtctgttttcacactgttcataaagactttataattatccgagactgggtaattacgaaggaaaggtttaactggcttgcagttccccatggctagggaggcctcacaatcatggcagagggcaaggaggagcaagtcacgtcttccatgacggcagggaagagagagagtgtgtgcaggggaactcctctttataaaaccatcagatcaactggacgtggtggctcacgcctgtaatcccagcactgtgggaggccgaggtgggcatatcacctgagctcaagagttcgagaccagcctggccaacatggtgaaaccccatctctactagtaaaacaaaaattagctgggtgtggtggtccatgcctgtaatcccagctacttgggaggctgaggcaggagaatcgcttgaacccaggaggcagaggttgtggtgagccaagatcatgccattgcactccagcctgggtgacaagagcaaaattccgtttcaaaaaaaaaaaaaagaaaaaaaacccatcagatctcgtgagacttattcactatcacgagaacagcatgggaatgacctgcccccacgattcaattacctcccactgggtccctcccacaacatgtgggaattgtgggagtcacaattcaagatgagatttgggtggggacacagccaaatcatattaaaaggtcaacccttgggaaagatttttggggggtgattaaactgttctgtatcctgattgtactggtggctacaaaacctatacatgtgttatgatccttagaaccgtatagcaagagaaaaaagtcagttcacaaatgataattagcaaaataaaattatacgttaccatacaatcttgcaattccaatccaagcctctactcacgagaaatggaaacaactaagacttgcaagcgatgttcagagcagctctgtttattacagccaagacgtgggaataatccacgtgtccagcagctggtgaatggatggacacactgtgatatatccacaccaccgaatttaactcacgaaaaaggacctaaatacttgatctgtgctacaatacagaagaacctcaaaaacaataagctaattgagaagtcagctacaaaagactacaatagtgcatgattccaattatatgaaatgtctagaaaaagcaaatctatagacacagaaagtagatttgtggtttgggactggaagcaggtattgcctgaaaccagatatgatggacctcatgggatgatggaaatgttctaaaaccagatgataccctaaattttctaaaaataaaattgtatacttttcacagctgagcttcatagtgtgcaaatgataccttagtaaaactgtctttaataaaaagtgctcaattcgttatctattttctttttttcttttttttttctttgagatggagtcttgctctgtcacccaagctagagtgcagtggcgcgatctcggctcactgcaacctctgcctcccgggttcaagcaattctcctgcctcagtctcttgagtagctaggactacaggcacctgccactgcacgcggctaattttcgtatttttagtagagacggggtttcaccatcttggtcaggctggtctcgaactcctcacctcgtgatccaccctcctcggcctcccaaagtgctgggattacagacgtgagccactgcgcccggcctagctatatattttttaaagtaaaacttgatccctacctcatagtgtacacaaaaaatatcagttcacatttcacgtggattatagacataaatctgaaaagtgaaacaatagagtatctaggaaataatattatagtttcatgacctcagaagtagagaaataggacaaaaaaagtcctcacctaacaaagaaaaaaagtggatcaattttatggtaggctgaaccatatgccaattgccaatatttgaccatttcgatctacaaaaatggcaatttcgtagtaaaaaggcaaaactagagtgggagaaggtatttgcctcacatataactgacaaagggctggtagcctgaatataaagaactcctcaaaatcagtaagaggccaggcccgggggctcacacatgtaatctcagcactttaggaggccaaggttggtggaccacccgaggtcgggagttgaagagcagcctggccaacatggtgaaaccccatctctactaaaaatacaaaaattagctgggtgaggtggcacgtgcctgtaatcccagctactggggagactgaggcaaaagaatgttgaacccgggaggtggaggttgcaatgagccgagattgtgccactgcactccagcctgggcgacagagtgagactctgtctcaagacaatacaaaacaaaacaaaacaagcccaacaataagaaaacaaaaccagaccactcagtagaaaaatgtgtaagaaagctgaacaggcacttcactgaagagccaacccaggtggccagcagacatatgaaaagacactcagccagggaactgcaaatcaaatacagaatcacaaatgaaaattaccaaaagaaactgcacccacccaccagagtggctgcaattcaacagagtgacaagcgctggtgaggatgcagagccacccacaggaaccctcatactctgctgacgggtatgaggtgataacaatgttatcaccatttgttatcaccatttgtaaaacaagtcggtattaccgatggaagttgaagacactcacactctatggctcaataattccccttctagacattgatttcggccaaagaaatgcatgcaagtgtgcaccaggatacagtacgtaagtattcacagggattattgtaaaagtcaaagcccagaaacaacccatgtatccatcaagaggaggatcgatggatacgttgtgatatgaccgagaaggcacaacagcagtgacgatgaaggaaccccagcgtaagcaacaggcaacaggaatgaagctcacaaactttacactgagtgacagaggcagccacaaaagaatatatactgaccaggggcagtggctcaagtccgtaatcccagcactttgggaggcctaggcgggtggattacctgaggtcaggagtttgagaccaacctggccaacatggtgaaaccccgtctctactaaaaatacaaaaaatcagccaggcatggtggtgggtgcctgtagtcccagctcctcaggaagctgaggcaggagaatcacttgaacctgggaggtggaggttgcagtgagtcgaggtcatggcatcgcgctccagcctgggcaacaacagcaaaactcggtctcaaaaaaaaaaaaagaatacacactgcaggttccatttgtacgaaattcaaacacaggcaaacgcaatttatggtgccagaagtcaggacatggttacctttagaaggaggaagtgggtagcgttgggagggacacgagggaggcttctgggatattctgtttcatctgggtgctggtttagtggatgtgttccttttgtgataattcttcaaactgtacacttatgcattttatgtatgcatattacacttcaatgcaaaatttattttaagaaacaggaaaccaaactcttcaaaaatgccaatagcagtaaagaaaaaaaaatgtgcggaactgttctagatctagatcttgagtgtcctcttttaggaaaagatcatccctgattggatcctggatgaacaccataaaagctctaaaggatactgttagatgctggggaaatttgaacatgaactatatattttataagagtattctgtcaatgttatatttcttgagtaggataatttgttttgtctgtacaggagaatgtccttgttcataggagatacatgctgaagaatttaagggtgcagggccacaatgtctgcaatttagtcagttaacggttcaatggctcagcaaagaaaaaagaggacaaatatagatacacacacatacacatatgcacatacatatgtgtgtactgtattatatcccattcagggttcttgcacaaatgtgtgtataattatattcacacatacatatatacacacctacactgagacagccaaagaaatttggcaaaatgttaaccacgggtcaatcaggtgaagtgggatattagtgttcattatactattatttcaacttttctgtaggtttgaaatttatcaaaatgaaaagttgcgaaggccaggcacagtagctcacacctggaatcgcagcactttgggaggccgaggcgggtggattgtttgagcccaggagtttgagaccagcctgggtaacatggcgaaaccactggctaatacaaaaattaatcaggcatggtggtgcacacctgtagttccagttcctcagggggcagaggtgagaggatcatctgagcctgggaggtcgaggcagaggtgagccatcatcgtgccactacactccagcctgagtgacagactgagaccctgtctcaataaataaataaaattaattaattaaaattaaattaaaagttggagaaaaaagcaaaagcaagccaaaaaacagacaagccaaacacccgacgccaagtgttgaaggactcacagttggataagaaaaccaaaaagtccgggcgcagtggctcacacctccccagcactttgggaggccgagccgggcagatcacagggtcaggagttcgagaccagcctggccaacatggtgaaaccccatctctactaaaaatacaaaaattagccaggcatggtggcccgtgcctgtaatcccagctactcgggaggctgaggcaatagaattgcttgaacccagcaggtggaggttgtggtgagcagagatggcaccactgcactccagcctgggcaacagagcaagactccatctcaaaaaaaaaaagaaagaacgaaagaaagaaaaccaagaagagcagagacgggaccaccaggaatggcaagatctggccccctgcggcaggtggagggcaggacggctgctgggtggctggctgtgctctcctgcaacctgcctggtagatatgcaaaggcggtcaccttataacaatcagattgtacatttattttacgtggtcttccatctatatcacacaatttttttttttttttgagatggagttttgctcttgttgcccaggctggagtgcaatggtgagatctcggctcactgcaacctctgcctccctggttcaagagattctcgtgcctcagcctcccatgtagctgggattacaggtgcccaccaccatgcccggctaattttttgtatttttagtacaggtgaggtttcaccatgttggccaggctggtcttgaactcctgacctcaagtgatccacctgccttggcttcccaaagtgctcggattacaggcatgagccaccgtgcccagcctgtatcatatacttttttaaaaagagactttacagaaaaacagactgagcaaacagagctgcatgccggtgcatgagcaacaagttataatcgcacgctggaggaagaaagaggaagccgtcggccacacagctccgctctgccaaggctctgctgccgtccctcacccgccccaccacgtggcaacccaatcacaacaatgccgccgtcccccagctgctaaatgctctcaccatttggttgctgtgcaaacacacctaacttagacttcagactgatgtcctggaggtgctacaagatggccattctttatgagtaaggctgccttccagggtaaaaattatgattttcccataaatcacatataagcacttagcaaaaaatatttaaaactctcataagttttggtcctaaattcttttctcttgctgttactacaaaaatgacagagacaaaaaatttattatttataacggcttggaatctaattccaaatgagttgcttccgtagattcacgtaatactgcagaactaaatatgcaagattcccgattccaaatggaggccaaattccatccacacaggagacagaggaaccctcagcagtctctccttgaagtaattttttttttttttttttttgagacggagtcttgctctgtcgccaggccagagtgcagtggtgtaatcttggctcactgcaacttccaccaccgaggttcaagcgactcccctgcctcagcctcctgagtagctgggactacagacgctaattttttatgatttagtagagatagggtttcaccatggtggccaggatggtctcaatctcctgaccttgtgatccacccgcctcggcctcccaaagtgctgggattacaggcatgagccttgacaagctgacaacagttatctatgttcttcgtcagttcatggactcgacaccaaaatgcctgggttcagatcccaattcctgtgaaggcttaagcaattacttaacctctttgtgcctcagtttctgagtctgacagattatggcaacatcagtgactttacagggttttgaggattaaatgagtaaatactctaaagggctcagatctgtgcctggcacatattagcaccgatgctggcctgttcaaaaattctattattatttgctcaacaattgcctgaaaacatagaaaaactgtctgccacatacgcagatgaggggaacaacgaaagatttggtgggtttcagaagaggtacaggcctgatggctgccgtgcgccaacaaggtgagcctgcagatcagagaccacgtgcatgagccacagtgcatgtggctgctgtgtcccctctgccttctcggtcttacacaaatggtctcttgtggctcaagttacatacagagctccaacttagccaaggtgacgcaaaacgaactcactacacgtaccccttgtcaacttggtgtccatatctactcctcttttcaaccgtacttaacttccaaatcaagtaaatagcaactaggcttccatgccatataatgctactatccgtcttacaaccaaaaccatgctaaccctctccccagaagaggagccaaagtccttttatgaactttttttgagacaaggtctcactctgtcacccaggctggagtgcactggtacgatttcggctcactgcaacctccgcctcccaggttcaagagtttctcctgcctcagcctcctgagtagctgggattacaggcacctgccaccaggcccagctaatttttgtattattagtaggggtttattagatggggtttcaccatattggccaggctggtgtcaaactcctgacctcaagtgatctgcctacctcagcctcccaaagcgctgggattacaggcatgagccactgcacctggcccaaagtccttttacattctatctgagtggttatccgttggcaccccatggaatgaagaaggagactgaagtgataacataaggctggtagctgacagacccctgaagtgtaactatgaaggcgggctgtggaccttgccggctggaagcaagacccttctggtcatctttactaccaggtagagaaggagaagacactcaccgcataccaggtaccaggaaatgtgttgatttgttccagcaacaaaaacacatctggcacagcagctgtaactgcagtcaccgcctagtttaagtttatgacaacctgctgtcattctctaagatccatccgtcttctagacaagccaaatatggattaaacggagatgtgacacgatcaccacccttgcatctttcaagtccctgatggtggcactaatctctgccatcctcccaggaatgtgataattgctttgggttgactattttggtagacagaggcagttctggcagcttccacttggcctttgctaccacaacagccctcactccagggaaccagtgtcagaattctgccaggtgctaagtagatatatatttacttatgcattgcagaactgcagaaagaaccacaggacagctattatatcttaataattacttaatatataatacacaatgatatgtgggtattaaatattatgagtcattactctgaaatggattaaagttaatataagtgtaattgccatacagagtgattatgggtgcccactcaaaagtcagccatactcaattatacacaaaaacacaaaacacacgtgcacacatgcttagattgcctcgcaaagcctatatgcatgggaagccaatgacacacacgaggaaagatgggaacacagagctgcttcttggtttcagggaatcctcacttctttcttccttctcagggaaatttcgctttgtttcatgctcgacctccagcctcccaggtcttggccttaaagattccaagggggccgggcacggtggctcacacctggaatcccagcactttgggatgccgaggcaggcggatcacctgaggtcgggagttttgagaccagcctgaccaacatggaaaaaccccgtctctactaaaaatacaaaattagacaggcgtggtggcacatgattgtaatcccagctacttgggaggctgagggtggagaatcacttgaacccggaaggcggaggttgtggtgagcccaaatcgtgccattgcactccagcctgggcaaatgagtgaaactccatctcaaaaaaaaaaaaaaaaaaaaaaaaaaagattccaaggggccccagcccccctcccttcactaaagacaagccagctccttagatcccatgatgccagagctgtgatcttccagtacactggagaagctccttgtatcttcctatctcctagtaggctgatttcatccaccaacagccacagcaccttgaagcaacccaggagctgctgtttcccgtgatcatgtggtcaaccctggtccttcaaacttctttcagaactcacacacacaccacgtccccttatgagttttgagcagaatgctttttctttgaaagtctgtattcaacaccccctttttatttatacaaacttggagggtatgtgagaaattttatggcatgtatataatgcgcagtgatgaagtcagggcattcagggtgcccatcactcaaatacaatacattttggttttggggtttgtttgttttttttttttttttttttgagacaatctcgctctgtcacccaggctggagtgcagtggtgcaatctcggctcactgcaacctccgcctcccaggttcaagcaattctcctgcctcagcctccagagtagctgggattacaggcacccaccaaccacccggctaatttttgtatttttagtagagaaagggtttcgccatgttggccaggctggtctcgaactcctgacctcaggtgatctgcctgtcttggcctcccaaagtgctgggattataggcgggagccaccatgcccagccacaatacattttttgttaggtgagaatatatataatattagaataatattactctgctctcaagccttgaacttattccttctacgttactgcatgatggtaccctttaaccgacttctcttgacccttctcctccccgccactcacccttcccagcctctgttacccttcttgccactctctacctccatgtgatcaaaccttttagctcccacatataagaacatgcaatatgtcttttgtgtctggcttccttcacttaatgacttccaagctgggcatggtggctcatgcctgtaactccagaacttcgagaggccaaggtgggacaatcgcttgagccccaggagttcaagaccagcctgggcaacatagtgagaccccatgtctacaaaaaataaacaaaattagacaggcatggtggtacatgcctgtggtcccaactactcgtgtggctgaggtgggaggatcatttgagcccaggaggtcaaggctgcagtgagctatgattgtgccactgcactctaacctgggcaacagagcaagactcttctctaaaaaataaaaataaaaaataatcataataataatgaccttcagttccatccatgttattgtaaataacagggttttgttccccttgatggctggacagtatcccactgcatatacatataccacagtttctttacccatccattcgatgatggccacattgattccatacctttgctattgccaacattgctgtgatgaacatacaagtgcaggtatccctttgatagatcgatttcttttcctctgggtagatatctagtagtgggattaataatagccattgtgcccagtaagaccccacttcttaatattattctcatataattctaatagccattctgactggcataaggtgatatttccttctggttttgatttgcatttctctgtgatgagtgatgctgagcattttttattgtaatgctcttgactaactgtgccacgtttacaactgtctttgagcggagacctgtactacagagtcctacacagggttaaggaggagcatcagaaggcagtgaacagacgtgaggcctatcagctggtactagaaaagagacaatccatttaaggctttgactcatttttgaaacctatgtgctatggtctaaatgtcccccaaaattgacgtgtttaaacttcatcacgaagggatggtattaagtggggtcttactggcacagtggctcaacacctgtaatcccaacagtttgggaggctgaggtggaagaatcacttgagtccaggagtccaagaccagcctaggcaacacagcgaagactccgtctctacaaaaacaaaattgtttttaatgagccagacgtggtggcacacgcctgtggtctcagctacaagggaggctgaggtggggggatcgcctgagcccaggaggtccaggctgcagtgagccgtgattgcacccctgcactccagcttgggcgacagagtacgattctgtctcaaaaaaaaaaaaaaaggcagtggggtctttaggaggtaaggaagaagtcatgagtgctccaccttctcaaatgggatgaagaccctaatacgagagggcttaggggtgagcaaccgcatgaaaggcctgagggaacgagtccgtagcctttgctcttctgtcatgtgaggacatggcaccagacacccaatgccaaggcctcgatcctggacttctcggcctccagaactgcctccagaactgtaagaaataaatttctattgtttggaaatcacccagttgcaggtattttgttgcagcagtaaaacggactgagataccgtgtcgctgtacactctttgcagtatgaagtcagcatggtttcagttgagaaaagaggaacagagtagttgggtctcatcctcacaaccctgtttctctcctctcttctctcggggtcatcactccccaaccatccaaaccagaagcctccaggtcactttcttctccttcctttccctcaccatcaagccctgccaagtctcgctgtggaatccactactttccttccactcccactgcctgaaccctgaatgtctctcgggccccagcaaagagcttccaaaccattctccaggcttccagtttctcctcttccaattcatcctccattatattatcaccccataagccttgctctgaaactcgtaatgcttgcccttttataaaaataatagcaacaacatctcctacaactaagatttagagaatacggattatgtgtcaaacactgttctaagcaccttacacgcattaccctcacagttaacccgcaccagtctgtgaataggtactactacaaactcctgctaacagaacagagcagagactctaacgtggcatgcaaagtctttcactaccaggccccaagcccctttccacccccatctcccatgtcctccatctttgccgcttccccacgtacttgcggtgctgtttctcaaacacccacccctttctgtgttacacgccctcatgccgtttccttgccattttaggtgttctgctactgttttaattcttgtctttttaagtgttccaacgacactttaaaaatgctttaaatgcaggattgcaggccaggtgcggtggctcacgcctgtaatcccagcactttgggaggctgaggcaggcagatgttctgaggtcaggagttcgaggccagcctgaccaataagatgaaactccatctctactaaaaatacaaaaattagccaggcacggtggcatgtatctgtaatctcaactactcgggacgctgagataggagaatcacttgaacctgggaggcagaggttgcagtgagccgagatcgcaccatttcattccagcctgggcaacaagagtgaaactctgtctcaaaaaaaaaaaaaaaaaaaaaagcaggattgcacccttgaaagttaaaattttacttttgctgaaaggaacaattgaggtcaggtgcagggactcacgcctgtaatcccagccctttgggaggtcgaggcaggcggatcgtttgagctcgggtgttcaagaccagcctgggtaacatagtgagatcccatctctacgaaaaatgcaaaaattagctgggcatgatggtgcacacctgtagtcccagctacttgggaggctgaagtgggaggatcacctgagcccaggaggtaggggctgcggtgacccatgattgcaccactgcactccaggctgggtggcagagcaaaaccctgtctcaaatccaaaagaaaagaaaacaagagaagagaagagaagaccattgagcttaacacgccttttcatataaataactccaatggcggcattcatctaggctaaaattttggtttctgagaacaaatcattttgctaataattcagtggacatttatactcaaagataggcagagcccctaaatctgcaggtgcatgaaaaattcaggtgtagggacattacactacacaattacctcagactagggtagtttgttgcggtgaggttgggtttttctttccttccttttaaatttttacttaatcaagaaagcttcttttaagacaaacacttggtgaggtggccaagcactatcatatttcctggtttcctcttcttctttacttaacaaagaactgctcattaaaatgacatcttcttaattttttttttttttttgagatagagtctcgctctgtcacccaagctagagtgcagtggcgcaatctcggctcactgcaatctccacctcctgggttcatgcgatcctcccacttcggcctcccgagtagctaggattacaggcagccgccaccacacctggttaatttttgtatttttagtagagacgagatttcaccatgttggccagactggtctcgaactcctgacctcaggtgatccacccgccttggcctcccacagtgctggtattataggagtaatgacatctttaaactcacatctaaggagtgtctactgagtataagacattgattccaggttaaataaagtatctacacgagtcttttcacctattgactgaactgtctttaataatcacacttgtgtagtacttttcatttccattacctcatttgattttccaacgagacaggtgaaacaattctgcttccagtagacatgggagggtggaaacagcagggccactacttacctgtagtagtcagttttaagttgaaggtaaataccccttcaaaatttctggatggaaaagaccacaggagataaagcagagaatcaaagcccagggaggaaaatcatataggggacattaaagaccagcagggtcataagacttcccaagaaatggcatattctagaaatagagcaaggaagccactccacactcatccttctctgaatttctacccttattttttccttctaaagagctagacttgggctgggcatggtggctcacgcctgtaatcccagcactgtgggaggccaaggcaggtggatcacctgaggtcaggagtttgagaccagcctggccaatatggtgacacctccgtctctactaaaaacacaaaatgtagctgggcgtagtggtttacgcctgtcatcccagctacttgggagcctgaagcaggaggatcacttaaacccaggaggcagaagttgcagtgagctgagatcactgggcgatcgagcaagggcgacaaagcaaggccccgtattaaaaccaaaaaaaaaaaaaaaaaaaaaagaggctctttctaaacttttaaatctattgctaaattcaaggaagacttgattgcagtagcatttaactctggaatcacaaataaagtactagcaaattccatcttcatatactactgctttaatgccaagctaatacttaaaaaagaaaatgggcaaagaaaaagaaaaagttgatgattcatgagtctaaacaattttttgtttttatttatctgattttttttgttttttttttttttgagacaaggtttcaccgtgttgcccatgctggagtacggtggagtaatcacagctcactaaagcctcgatcacctgggcccaagccatcttcccacctcggcctcccaagtagctgggacctcagggatgtgccactgcccccagctaagttttttttttttttttttttttgagacggagtcttgctctgtcgcccaggctgaagtgtactggtgtgatttcgactcactgcaacctctgcctcccgggttcaagcagatctcctgcctcatcctcctgagtagctgggactacaggcgtccgccaccactcctggctaatttttgtttttttagcagagacgggggtttcaccatgttggccaggctggtctcaaactcctgaccttatgatccatccacctcagcctccgaaagtgctgggattacaagcgtgagccacggcgcccagctgactcagctgtttttaaattcttttgtagagacagggttttcctatgttgcacaggctggtctcaaactcttgggcttaagcaattctcccgcttggcctctcaaagtgctgggattacatgtgaaccagcatgtctggccttcaattcatttctaaaaagagaggaaaaatatatggcttcttccccgccccattgttatttgattcaattatttacaaaatgaattcttaggatattttgcatttttatttccttctgaaaaatcagtttttacaccatgaccttaatctagctaattctgttaaaataggatttaattttagataagttcccagaggacctgcattccattcaattgttggttgaactatatttcctagtgactaggatttataaatattaattatctgaaagagtggaaatgaacatatagttatttttagaatatactgtgataacaacaacaaaaaatcctgcaaaacggagctagaccagcgctgacatgaaaatccaacagccacctggcgaactctgtgttccaagaggtttttatttacagtgtaggatgtgactttacctataaaatgctttctggctgccactccgtttggacgattccggttttggtctgctaacttatcaactgtatgatttgggcaagttcctaaacttctctgtgcttcgtttctcccctttgtaaaacaggactaaaaatattaaaactcggccgggcgcagtggctcacgcctgtaatcccagcactttgggaggccgaggcgggcagatcacgaggtcaggagatcgagaccatcctgactaacatgctgaaacctcatctctactaaaaatacaaaaaattagccgggcgtggtggcgggcgactgaagtcccagctacttgggaggctgaggcaggagaatggcgtgaacccgggaggcggagcttgcagtgagcccagatggcgccactgcactccagcctgggcgacagagcaagactctgtctcaaaaacaaacaaacaaaaaattaaaactcttccctgtggggttgctttaaaaatcgtataatgtgttatatgtaaacataaagcattataacaagacagaggaatacaccactggagcaaaatcagaagcggttccctcgttttttcacaatgtggagtctggcccggcgcggtggctcacacctataatcccagcactttgggaagccgaggcaggaggatcacttgaggtcaggagttcgagaccagcctggccaacatggtgaaaccccatctctactaaaaatacaaaaattagccaggcatggtggcacgtgcctgtaatctcagctgcccgtaatctcatctacttgggaggccgaggcaggagactcacttgaacatgagaggcagaggttgcagtgaaccaagattccgccactgcattccaacctgagcaacagagcaagactacatctcaaaaataataataataaacaatgtggagtcttttattctttgcctagaattttctgtgcattgctggaatgagtatatccagaattcattccaaagttaattaagaaaagtacagttaggctttggtaaaacagtctgccaaaatttaacaaaaaagagaaggagaagaaaagttcattaaaaaataacatcactaggaactctgcaaccttgagtggggcacttaagtgccacagacctcagtttcttccttttttgttgtttttttatttttgttttctaggcagacattgaatgctagtttcttcctttttaaaaaaatgaaatagcttaactagaaccatctaaactacaaagaatctttttaaaattctaggccaggcacggtggctcatgcctgtaatcccagcactttgggagacccaggtgggcggatcacctgagatcaggagttcgacaccagtctagccaacatggtgcaaccccatctctactaaaaatacaaaaattagccaggtgtggtggtgtgtgcctgtaatcccagctactccggaggctgaagcaggagaatcgcttgaacccaggaggcggaggttgcagtgggctgagatcgcaccactgcactccatcctgagcaacagagtgagactccatctcaaaaaaaacaaaaaaacaaaaaaacaaaaaaaaaattctaaaacactaggtttatgaagtaaataataaaattctgtgataggacggagccattttcttccaggctatttaccaaacacagcaaaggaaatcaaaaaaaggcttcccatatagtaaaacttacattttggagatctggatttctccattataaacctatggaatcaaatcatttaaaatctagttaccagagaaacctcggtttaatattaacaaacatacttcctttaaccacgagccactttaatgtatatcagttttatctctggagcttcatagatcccaacagagaaggctgatctattttcagagaaacatagcaagagagtgtcacttctgaaccattatacatttaaacaatctctctacatgtagagcctgcatctaaatcccagcaatttttcaggacctagctctgaggccacatcagcactccaggcaggcggagggactctccaccccgcctcttttgcccccagaaaataaatctttccccagaccaacaatccacttcccggcctcacagcaacgggctcccggctcccgcacgtgactgccaactctttacgagatgaggctgtgctggctcggtatggttgataagacaagcatgcaagaaatatttattaatgcaaactcgtataaattcgtatcatctgagtttatgggaatgaggataaatcacaaaagcattataaagtgaggctttggacaaagtcctgaatggaagagtctagtaccatttttagagcctcttttgttttttaaactccttttactatcattcccagccttggtagacacttgacaaatatttgaggggaagctgaggacaaagagatgaaaataaagtgactgctatgaaaaaatgaaagcccaggtaacaataaacagtttaatctctgtttagttaggaaggagccaaacgcggctgggcacggtggttcacgcctgtaatcccagcactttcagaggccaagacgggcagatcacaaggtcaggagttcgcgaccagcctgactaacatggtgaaaccctgtctctactaaaaatacaaaaattagccaggtgtggtggcgtgtacctgtaatcccagctactcaggaggctgaggcaggagaattgcttgaatccaggaggctgaggttgcagtgagctgagatcggaccactgcactccagcctgggcaacagagcaagactctgccttaaaaaaaaaaaaaaaaaaaaaaaaagagccaaataattttgcctcccaatttgctgcatccatccaagaggggaagatggtctcaggcagtaactagctttgaaaacccttgtgaattttttgagatagggtctcactctgttgcccaggctgcagtacagtggcgcgatcttggctcactgcagcctcgacctccttggctcaagtgatcctttcacctcagccgcccgagtagctgggactacagacatgcaccaccatgctttttttctttctttttttttttttttttttttgtagagatgaggtttcatcatgttgcccaggctggtcttgaactcctaggctcaagcgatcctcccatttcagcctccccagtagctgggactacagttgcataccaccacacctggctaaactttttttcatattttttgtagagttgggggtcttcctatgtttcccgggctggcctccaaatcctgggctcaagtgatactcctgcctcggcctcccaaagtgctgggatcacaggtgtgagccacggcaccaggtctgaatttgtgattcgtgttaatgacgaacctgagctgagccttaagtatctgtccggagtcgcagaagcaatcagcacagtgcccagcactgaaccacggcacacagtgcccagcactgaaccacaacacccagtgcccagcactgaaccatagcacatgcgcattccccccacgcccccgaacttatattcgtcaccatatgttgtgcagatccacgaatgggcagagtcacaattctcacatgagctttgtaaataaggaaaaactgcatgggccagcacacgttgcttgtgtgtgtgtgtcctaagcactgatgacaaatgcagaaccaacaacattcccactcatccagaggaaatcgtgagttctcaatgagcaggctgggagtagcttagtagtcatttccaaagcactgtgaaacttgtctacttcatgaaaaagtactgaggctgttttacagccctttaacttaaatctagtaattgtgcctatcagagttctgaagaaaataagactcaataatctaagctactagttcacgcagatcatcttaaagcaagattttccacagacctcacatatcgaggtgacatgatccttttctaaaatgaaagagcttcgctagagcccagaagttcgagaccagcctgggcaacataagtgagaccccgtctcaacaaaacaacaaaaaaaaagttttttttttaaattatccaagtgtgctggcatgcacctgcagtcccagctacttgggaggctgaggtaggaggactgactgagctctggaggtcgaggctgcagtaagctataagtacgccactggactccagcctggtcaacagagcaagacccaatctaaaacaaaaaacaaaaaactacgaaaacatattccacaaaaaagatttgtacataaggactgtatataagattgtttctaggcagacattgaatgctaatttcttcgttttttaaaaaaaatgaaatagcttaactataaccatctaaactacaaagtatcttttttaagttctaaaatattaggatttataaagtaaataaaattctatgacagcatggagccattttcatccaggatgtttggacacccttctcctttttttgagactccatcaaagaaagaaagaaaagagagaaaggaagagataaaaagaaagagagagctagcttagcaaaaatcatctaaactacaaattatcttaattctaaaatattagaatttataaagtaaataaaattctgtgatgtggtttctctagttaagggcctgggggacttacacagctgttacgaagacattatttaaaaaaatcttcagttctccctggggggcaattggattgacaattgcaattcctttgtaaccaatgggcttctgtgtgagctgttagacgcacactggtattcgttcaagatggaaaaccaaacaacatggacacaacccatgacagccttcaaagttctgtctgcatgaccaatcaggtcctttggttgaaatccatgaccaatcaggtcctttggttgaaatccatgaccaatcaggtccttcggttgaaatctatgaccaagcaggtccttggttgaaatccacgttggccaggctgatctcgaactcctgacctcaggtgatccgcccgcctcggcctcccaaagtgctgggattacaggcgtgagccaccgcatccggccagagtgtgttgttttctcattgcagtccctaacttgccctgaaccctcccttacccaggtagccacgaagcatctggtgactgaggcctgggagtgagccctggaggttctggctgacgctctgccgtgacccacttggggcttctgtgacgtccccttcagcctgacaagaggacccagttctcctctgtgctcaccctgaacaaaacaggtcctagtctgggaagggcgccaaagagagatcttttcactggtttctgttccctgtcatttttgggggagggtgggctggggaacacaaacacccaataattggaaattgtcagacatacaaaaaagaaatgtaattagtcataaaccctattttaaggttatatttgcactgccattttaaaatgagaaaacactaataacattaaaatgaagtctttgttaaaagtaaccatgcattgttcaaatttccatttgttctttgtttgacaatgaaaaatcattctaaattagttccatacacttactgtgaaacacaacagtttattcctgggtcacattctcccccttctgtggtttatataacttctctttgttccgcaaatggcagtacaatggcaaacaaaataaaatggagtttattatgaaaatggatccattaagctacctaagaataacatagccctacaactcctgcacttgtagagggacacgggtgagatgaaacggacgtcagtacccctgcaagaatcacacagataggcccctcggtgcacctggagagggaggccacaatggcaaataataggagacacagcgatgccccactcccttctttcccaagagctgccatttctgcccttgctggataagctcagtgtctcacacagcgtgagcgtccactagatgctggcttggacaggcgatgctgagggttcccatagacggcactctagtagggctgctcaagtccctcctcacaatccagaggatctcacctaggcagggcccatggtcactccccaggagaagagccaggaatgtccccatcaagcaaaacccctggtctccagctcacaactcaaaacccaagcaaatgaaggaaaagctcctgggaccatcaggactcataacgaccaagggtcagtcatggtatcaggaaatcgtaatcctggctcagaaaggttttaaatacagggaagcagaaggctggggcagcaaaggacactactaagagcaagcgactcacagggctcacccggaaggcattacaaactggaattcctaaaagagtggttgccaagctcacccagaagaggaggtcccactggtccctgagtctgctccaaacggccacgcacagcgtgggcatcctctcccctgctttccattgctgtacagaacctgacctgggaccagagagaagagggtccagggaaatgctgctgaaggcttcgtctctgcagtggagagaaagtcggaaggggcagcacccacccctagctgcccatagatgaccaggcacaggcacccaccaccgacactggcacaatcccccaacatgttctcagaccagaccaagaccctagccgagcccaaggatgctggctaatcaaatagtaaacacctttggccagattatccttaaaaagtctctggaatgtcaccttcagtctctgtagtctactttctaacatacttctgagccgaaaccacgtgaaaagatttttcttctgactacaaggcagaacaataaaagtgaccctctgagtcaaaaacaccacatgaaactcacctcccgcctccaacccatcccttccgcatccttcatgtccaccgtccctttaccaacaaccagctgattcttccagacttcaaaatctttcagattaacccagaaatatcgataagggaggcctttttcttagcttatgttgtatatgtttttctgtttaggctactgctataaagaactatccaccagcctgggcaacaaggtaagaccgaccctgtttctacaaaaaatacaaaagtagacgggcatgatggtgtacacctgtagtccctgctactcaggaagctagggtgggaggactgcttgaacccaggagttagtggctgcagtgagccgagatcacaccactatactccagcctgggtgacagagtgagactgtgtctcaaaaaaaaaaaaagaactatcccgagagtccactgttgggggccgaagtgggggtggggacccttggctgccatgttcctgggccaggaacatggactggatggcctgcatgtcagaagactggtgacatacaagggtcaataaataaaaacagttaatatgataagagctgttactgttattgttagaaaagaggggcacagccaaggaaaggggagaaagctgaaacaaaccatttgacttggatggtatcatgatttttatatgagatgaatggatacatagatacgagcgggacagatggatacaaagaactacaaacgcatgtgtgcccgtgtgtgtatgtacaaacatatgtgtacgtgtagggaagtacatgcatatgtttaatttcctagctatgccaggcgcggtggctcatgcctgtaatcccagcactctgggaagccaagatggatgggtcacctgaggtcaggagtttgagacccagcctgaccaacatggtgaaaccccgtctctactaaaaatacaaaattagccggacgtggtggcgcatgcctgtaatcccagctactagggaggctgaggcaggagaactgcttgaaccgggaggcagaggttgcggtgagccaagttcctgccactgcatgccagtcttggcaacaagagtgaaactccgtctcaaaaaaaaaaaaaaaaaaaaaaaattcctaactacgctgcttgagaagtccttgtagccgtaatagcccagtagcgtgaacacacctaatacttagatcctggtttctaaaaaccactttctactaaaaggaaccagggcttattggagaaatggctgattccagggctggagcaaggaaagttccgggtgagcctagaaccaagaactaaacatgtggccgggagcagtggctcacacctgtcatcccagcactttgggaggacgaggcaggcagatcacctgaggttacaagttggagatcagcctggccaacatggtgaaaccccatctctactaaatatacaaaaattagctgggtgtggtggcgcacgcctgtaatcccagctacatgggaggctgaggcaggagaattgcatggacccaggaggcagaggtttcagtgagccatgatcacgccattgcactccagccggggcaacagagtgagattccatctcaaaaaaaacaaaaacaaaaacgaaaaaacctggccaggcatggtggctctcacctgtaatcccaacactttgggaggctgaggcaggcagatcacgaggtcaggggattgagaccatcctggttaacacagtgaaaccccgtctctactaaaaatacaaaaattagccgggcgtggtggcgggcgcctgtagtcccagctactcgggagactgaggcgggagaatggcgtgaacccgggaggcggagcttgcaatgagcagagatcacgccactgaactcccacctgggcaacagagcaagactccatctaaaaaaaaaaaaaaaagaagaagaagtaaagatgtgctcaaagaatgacatgaacacatcaaaagaacacaggggccagcttggaggcgctgcttttggccaaatctgggacaatctgggtatcgaagcaaatgataatggtaatgaattataacccaatgggtaaaataggagtctatgagtgtattgataggaaggagagaaagacagcaggcaagctccagcttgcagtggaatgccaactaatcaatgcaaaagaaacaatgcaactagaaacatcaccatttggcaatgctcatactaattccctcaggcaagaatcatcccaggatgctaaaacaaatgggcaaaaagcttaatgagaaacaggatattttccgagtccccaaaaaatctccccaccagaaacagtactttttaactgataattacaaaataccaacaaattaattttacagtggagaaacctggtagacaccacctcaaccaaatgataagttaacttctccagaaatgggactgatcagacctgtgtgcgttcctgtcgtgacaaccctgcagggactctcctgccaggaacctaccacctgattctcatcatgaaggaatatgagaccagcccaaaccgagggacattctacaaagtaactggcctgttctcttaaaaaaatgtcaaggtcgtgaaagacagagacgaaggaacagccccagattgaaggagactcgagagccattgacacagacggcgcctgtggtcctgggcgggctccggggcctctgcatttggtggcatggtgtgacagtgcccacgtcctgatttgggcaggtcggtgcaggctatccgggacagcgtccttgtttttaggaaacccacacaggagaatctagaggcactctctgcagtctattctcaaattattccggaaaaaagggatgtgtgtatgtggagagacagacagacaaacatgtcggaatgttaattcagggaatctgggtgaagagtatttgggaattctttatactgtttgggagcatctctgtaaatttaaacttacttcaaaattagaatataacgccaccaaaaccccctctatcactcactccgcattcctagataacaactagtgtggaattctgttctttgaatcactagatatcaactagcgtgtaactctgttgtttgaagccacctggtttgaggtactttggtacagtagccctaggaaataaatatgctactcaaagaatattgaatgtggctttttctacaatactaaaatctgacctaccatgttaacttagtaaggcaaactgctggggcggggtcccgtttcagccgaacgcatctgacaatgccttaagtcacacattgcataatcacaagttgcttcttgacatgagcggctcttcaagtgcacggggaacaacagattctttgtcagggactcacaagagtcacatgctgttattcttttctccttaagagacaaactgattttttaatcactgagagcctattacatgcgtggcatagttttaagatgttttgacatgtcacacgtaaacgatagtaaacatgtcttggaagaggggctaagatgtgggacgaacgtgattattcaatgggcatgcgcttccggccacgcatcacacgcacatacaccagcgcggttatccataactctaccatttcaagtgagccgcaagagactgtaaatcgcagtgaagtgggccgtcaggcaatgattactaaataagcatgggaaacatctaagattaacagtgaagagagaagatgcgtttggaatggaatcctggagacagttaagttaccaggtgctttcacagtcgttttttcaaattcagtcactgagacataaaataatattgatctttgagaagagctctcgacggaaacagcagttggcagtgtccccagagcacttgcccttcctctggagcgcttcacgtgcgagcccgccgtctatttataacagttgggcacttgtcgccacaatggctgattgtgtggcccagctgtctgtgtctatcaagaagggcaggagtggacagcctgcactttgatgtttcccttttttggagactgaaaataacatttttaaaaaactgccaaccggcaaggtcacaaaatatttttggatggcacggggacccgattgcaaagctgtggttcacatcagatgcggaggcctgggaagaagccagtgagccccattgcacaatatcctgctcatgccaacttcaaaagttatttgcctcggagagctcccagacgactctttctcggtaataaaacacagcattttagaaatttgcaagggtcttctggatagggcattacccagaggagcaaggatttccctggccactctggttacagttgcaaccagcagccccaggcctcttgccacccttgccccgccccaccccacatccctcacccccactccacaaactcctgcccttccctgatgagctctcaagcacttaccagcgacacgctacatatttttctaatgcatgtgtcaatttcttgactcgcccattctattatagatggctcacgaaagcaggattagcgtctgttttgttcactgatgcaaccacagagccgagaatagtgcctggctcacaatatttactgagtgcatacttgtggaattaattaatttaaatagcagagacaatgggatcaggaaacacatggaaataccgatgaccagtattagatgtcagggttctgtcgcccttccctccgcccccgacgaagatcccagctttgtttacatatttgtggtgcacaaaaatagaaatggactaaacaaaattcccgattttcccaaactgtggtggattgcagaaaccaagacttcgcagggctcggttctgaaatgattttcactcaaaccatcttcctgaaactcttcctattactctctgcccatttcgcaaaccttcttgctggaggtattagatacgggaagcacctgtagtaatcaacaagtatggctctgattaaatggatttttttctttttttttttttgagacggactctcgctctgtcacccaggctggagtgcagtggcacaatctcggctcactgcaagctacgcctcccgggttcaagcaattctcctgcttcagcctcccgagtagctgggactacaggtgcccgccaccatgcccggctaattttgtattgttagtagagacgggtttcactgtgttagccaggatggtctaaatctcctgacctcgtgatccacctgcctcgacctcccaaagtgctgggattacaggtgtgagccactgtgcccagccgaaatggatattttgaaaatcatcaagttatacaaaagaatcccacatgctgtacaacaccactcgagattttagggtttttgcgggttttacatcagtagatcatgaaaccctgactctttaattattatgtaaatgaaattcaacaacacactcacacctcaaaaactctggaaggtcagaaagaggcagagagcagggcccccgcggaaggggaggcacacaaggcagacagaggcagaggaggtgggagtacaggccccagcactgtggtagccaacagcagagccattcttccacaccgggaagggcccccaggcctcaggaagccagctctattcagcagatttcacaagtgaaaaagcctttttagatgtcttttggggtcaggcgtggtggcttacacctgtaatcccagtactttgggaggctgaggcgagcagatcacttgaggtcaggagttcaagaccaacctggccaacatggtgaaaccctgtctctactaaacatacaaaaaattagctgggcatagtggcacacacctataatcccagctactcgggaggctgagacaggagaattgcttgaacccaggaggtagaggttgcagtgagtcaagatcaggccattgtactccagcctgggcagcagagcaagactctgtctcaaaaaggaaaaaaaaaaaggccagacgcggtggctcacacctacaatcccagcactttgggaggccggggtggggggatcacgaggtcaggagatcgagaccatcccggctaacacggtgaaaccccgtctctactaaaaatacaaaaaaattagccaggcgtggcgccgggcgcctgtagtcccagctacttgggaggctgaggcaggagaacggcatgaacccagaaggcagagcttgcagtgagccgagatggtgccactgcactccagcgtgggcgacagagcgaggatccgtttcaaaaaaaaaaaaagataccttttgggaacaattccccagcagaacaaaggtgccacttctaagtatgaggaattccttatcaaagatgcctgagcctgcaagacagctcccacaagtacaagcgctgcaacgactgggtgactgcgcgtctctggcaagcggttttgaagccacttccttagctcccatagacaggcagtgctggaaacacacatgcagggagctcccagccggtgttgtgcgatacagaacccgaaagctgcgccctccccgcaaggaggttgtctatagaaaattctgtgacatcaggattcttcaataatctcttcaacatcagctctcaacatatttatagaagatctccaggcccagcagttttcctacctgtgcaaaatgctgtggcttcaaagtaatgttttgttgtgttttgttttgtttttgagacgagtctcactctgtcatccaggctggagtgcagtgatgcaatctcagctcactgtaacctccgctcccgggctccagggattctcctgcctcagcctcccaagtagctgggacgataggcgtgcaccaccacacttaggtaatttttgtatttttagtagagatggtgtttcaccatgttggccaggctggtctgaaaatgctgacctcaagtgatccacccacctcggcctcccagagtgctgggattacagccgtgagccaccacacccagccaaagtaaatttaaaaggggctttcgtcctcctaggagtcagaatcagtcctcactgtaagaagcagaattctaacctcaaaactggtctcctgggaacactggaaagcagtgcgtgatccgaaggggcagaaatgactgacactctcaaattcccctctgcatcatgggcactcagcactgtgcctagtgcatagtaagacttcaacaaatatgtgctgttgttataattcggcatgacgatggaggtgcagaggtttacctgtgtttttattatctctggttgacaaggcggccacacccaggttgcctgttctgaagctgtctcaagacagtgaccatcacccaggctgaggtccaggatgatgtgagtgcaaattgctaaagctctccttcaggtgccaggcctgccatgacacatggcgagtcctagcagaggtcagaccaacaactcagttctttcaggtaacctgtactgatgaaaccgccccccccccccccgccaatcttactcttctgttatttcatgtctatgaagggttttggcataaaaaaaacaaaaagcctcattttaaaaaaatctacaattgtttaggtttttgtttaaagagaagcgtctggttctgttgcctaggctggagtgccgtggtgcaatctcggctcactgcagcctccaacccctggcctcaagcaatactcctgcctcagcttcctgagtagctgggactgtccatcttttttttaataacagctttattgagatataattcacataccgtacaattcatctgtttccagggtacaattcagtggtgtctagcatattcacacagggctgtgcaaccatcaccaccatcaacctagaacactttcatcaccccagaaagaaactccgcacccggctgcagtgacaccatcatcctggcttattgtcgtttgtccgccggccaccgttctgtctctgtttctttcccaacaccagcctctcttttcacgcactatctccccgccagccctgctccctgcattctgtaggaaatgcttggctcctacagtggttgacgaataccaaagcttctgtgagcacgccagagggcccccacaaagctctctcctctgtctgaaacattactctgaaggagtgatttcttgttcattctgaataaggatgacgacaccaggaagcggaggcccggggagcatttacggcgtgttctcgatgtgtgagcactgtggccagcacgttccaacccagtgctgcaagagttgctcccagccccacttcagagatgagaaaaccaaggcccagggaacccaaggtcacaaaggactctaagaaggagagttgagtaatcccagcactttgggaggccaaggtgggcagatcgcttcaggtcaagagttcgagaccagcctggccaacatagtgaaaccccatctctactaaaaatacaaaaattagccaggcgtggtggtgggcacctgtaatcccagctacttgggaggtcgaggcagaagaatcgcttgaacccaggaggtggaggttgcagtgagccgagatcatgccactgcactccagcctgagtgacagagtgagactctgtctaaaaaaaaaaaaaaagagagttgaggctgggcgcagtggctcatgcctgtaatcccaacactttgggaggccaaggtggcaagatcacttgaggtcaggggttcaaaaccaccctggccaacacggtaaaacccccgtctctactaaaaatacaaaaattagccaggcatggtggcgtgcacctgtagtaccagctactcaggaggctgaggcaggagaatcacttgaacctgggaggcagaggttgcagtgagccaagatcgccccactgcactccagcctgggaaacagagaaactcttgtctccaagaaaaaaaaaaaaaaaagaagaagaattgaaatttgaactccaagcaatgtgacaccagagctcaggcccggaaccccatgctacactgactcttgttgagagaacactccaagatgtaatcatgcctacaatgacgttgcagggggaagtgactgatccactactttcctggagaacctgggaaggtatgtgtgatcaggaggataaaaggccagggaacaagaaaactgcagagaggagacccagcaggcaagatgctgcaaaaggtgcagcggaactgagtccaccgaggagctaaaaatccctccgtcttagaattctgtccttgccaggaaagggctcctcatctcctgattgctaattaactttatctccttgaatcaagggagctaaaggaagtctctgaattagaaacctttgtggtgaggggtaaaggaactttggtaagaggatataatcaaaaatatgatgattaaagaaagatgattaaagcttggaaagcaagtcactaacttattaacagtggctatctttaagggatgggattagtaaagattttcatttccattttatacatttctatattgccaaattttacaacaagcttatagtacttagaaagttggaagaaaaaccggccgtgcacgatggctcacgcctttaatcccagcactctgggaggccgaggtgggcagatcacctgaggtcaggagttcgagaccagcctggccaacatgatgaaactccatctctactaaaaaatacaaaaattagctggtggcgggtgcctgtaatcccagcaacctgggaggctgaggcaggagaagtgctagaacctggaaggcagaggctgcagtgagccgagatcatgccactgcactccagcctgggcgacacagcgagaatccatcgaaaaaaaaaaaaaaagaaaaaaaaagaaagaaagaaagttagaagaaaaaaccaaaaagatgacctggggagaggggaagaacttctggaataatgaagtgagaagcttggcaaaacctctcctcaaaaagtaacaacaaaactagacaagtcggtcaaaaacaaccaccacagggttggaaatcaaccaaagacatacaaaaaattgaaaaatgtttattcaagaaaaactacgcagctgggcatggtggctcccacctgcaattgtagcactttgggaggccgaggcaggaggattgcttgaggctgggagtcagagaccagcctgggcaacatatcaagaccccgtctcaacgaaaaacaaaaaagtcagcctggcgtggtgatgcacacctgtagtctcagccactcaggaggctgaggtgggaaaatctcttgagcctgggagcttgaggttacagtgaactatgattgtgccactgcacgccagcttgagtgacagaggaaggcctcatctcaagaattaaaaaataaaatgaagaagaaaaatgaccaaatcttgagttagagcggtggtgttctgtgatgctttggcttgaggggctcccctccttcccctcagctcacccatgctgctacatctaccagggtgggacgagctgtgaaaattggtggctccactgctggaggggttgacttgatttggaggagagcacatgcccaaaggcactgacataaaccacggtgatttcctgtaaacaacaggaaatgtacagaaggtcaacatctcagccaccctgagcctgcaatgccggttgtggcaaccaacagatcaggagaccagccaaaaacctagccggaagatacagagaataagggagctatcacgggcagtggtaaagtccctgaagtcccacacattcttcgtgctctggaaggctgcacacaggcaggaaagactgaagagggccctggttatccactcatccttggctaaagtgaggcctaccccacgcacaaaggaggccagaaaaggcctggcaaaaaggaaaaaccaagacaggctcgtataatatatgcctgaattctgaacatgtccctaaacgtacacacatatccaccgcaaactgtgaaaagcattagtagctcaaggtgtttcagcacacctctgaataatcattgcctgaccactaagctatgctgacctgggttaacccctgcaaagccaggcttaaacacattttaaaaataagaaaaaaaaaatgagcaggatcatcagcagctgctacagagacagacttcacagaattaatccaggcaagtcacaaacaaaaagaaataaacaacaaacctgcgttttgccaaaggtgatcataatccagagttgctacaacgtattaactaaaatacagagcttaaaaaaataaaatataagacatgcaaagaaacataaagtattgtgaattatactcaggcaagagtcataactggaaactctaagggggcccagatattggacttaacaaagatttcaaagttataagaaactactgtaagaatggaactgaaggaattcatgtttaaagaactaaaggaaagtatgtaacaatgactcatcaaatagagaatactaataaagagacagaaattataaaaagaaaccaaacagaaattctagagttcaaaagtataataactgtaatgaaaagttcactagaggggctcaacaacagagttgacatgggagaagaaagaatcagtgaacttaaaattatccaatctgaagaagaaataaaaaagcataaagaaaaataaaaagaacctcagaaacacagggataccatcaagcatgccaacatatatataaaggaagtttcaaaagaaaacgaagcaaaaggaagcagaaaaaattttttgaaaaactaatggcataaacttctcacatttgattttaaaaaattaatgttcacatccaacaaactcaaagtaagctcaaaaaactccaactcaataaagtgagccaccatgacacatcatagccaaactgctggaagccaaaaacaaagagaaaatcttgactgcatgaagacaaaatggttcttcatgaaaaggagcactaccataagattaacagctgacttcacgttagaaattaacagagaccagaaaacagtaaaatgacatattcaaagcactgaaagaaaaacttccaatcaagaattccatatccatcaaaaccataccccaaaactaacaagtagaaataaagatattcctagataaacaaagacagaaaatttgttactggcagaccctacttacaagaaatactaaaggaagcccttcaagatgaaagaaaaaaacaccagattatatcctgaatccacatgaagaaataaagaatgctagtaatactaattacataggcaaatatacagcagatttataaatagtctcttttttacacttaactgatttaaaagacaagtacatataacaataactacagacttttactactgggcttatgacatacaaagatatcatatacatgacataataccacagaggaggtagatagacatagacatttaatggaacaaagtttctatattttattgaaaatgaattagcattaatctacagtagactgtgagctctaggcacagtggctcatgcctgtaatcccagcactttgggaggctgagatggaaggatcacttgaatccaggagtttgaaaccagcctgggcaacatggcaaaaccccatctctactttttaaaagctatatatagatctttaaaaagtagactgtgatgagatgcatattgcaatccttagagtaaccactaaaaatataaccaaaaaatattaaaaacctcaccaaacagatgaaaacagaacactagaaaatatctatttaacacaaaagaaaacagtaaggagaaacagaacaaaaagatgtgagacagagaaaacatagcaaaatgttagatgtaatccaagcatatcaataattgcattaaatgtaaatggattaaacactccaataaaaggtgaagactgtcagattaaattttttagaagttctaaccatgtgctgtctgcaagagatgcagatggagaaaaatgtactatgcaaacaaaaccataagaaagttgcagtggctataataatatcaaagtaagtatgggaggctgtggcaggtggattgcttgagtacaggaattcaaggttatagtgagctatgattgtgccactgcactccagcctgggtgacagagtgataccctgtctcaaaacaaacaaacaaaaacacaaaaaaatcccacagactgaataaactttaagacaaaaaagttataagagaaaaagaaattttgtaacaataaaagggtcaactcatgaggaatatataaaaacataaatacataagcacttaatagcagagcacaaaatacaataaagcaaacactgactgaaccaaagggagaaataggcaattcacaataatgtttggagacttcaatatcccactctcaataattgacataatagttaaacagaaaatcagcaaggatatacagactttgaacagcattgtcaaccaacctgacgtaactaacatctgtagaccatgtcaagcaacaacaaatagaatatatattcttttcaagtgtacatatcgcattgtctagaatgaatcatgggctaggtcataaaacaagtatcaataaatttaaaagaattaaaatcatataaagcatgttctctaccaaaatgaaatttttaaaaatcaagaacagaaataaatttgtggactccccaactacttagaaattagaaaacatatctaaaggattcaaaggtcaaagaagaaatcacaagggaagtttaaaaatacttcaaactggatgaaaagaaaaacacagcagatcaaaatttaggatgcagctatgagaagtacttagggagaaatttataatgttaaaagcctgtatcaggaaaaaaaaaagaaaagtctcaagttaataaactgagcatcagcagggaacagtggctcacacctgtaatctcaacactttggaaggccaagctgggacgatcgctcaagcccaggagttgaagaagagccttggtaatatagtgagaccctgtgtctacaaaaaataaaaataaaaattagctggcccaatggtacacacctgtagcctcagctccttggggggctgaggtgagagaatctcttgagcctggaaggtggaagctgcagtgagccagtatcgcaccactgcactccagcctgggccacggggcgagatcatgtctcaaaaaaaaaaaacacaaacctgagtttccaccttaagaaactataaaaaggagagtaaactaaatcccaaaaaaagcagaaggaaggcaataataaatactagaccagaaatcaatgaattagggaaagtaatagagaaaactgatgaaaccaaaagttggttctttgttcagaaacaaaacaaggatgtctactctcaccatttctactcaacattgtactggaggtgctatccagaacaataaggcaggaaaaagaaatttaaaagacacagattggaaaacaagtaaaactcttcatattcactagctctatatatagaaaatcttcaggagtctacaaaaaactactagaactaataagcaagtttaacatgttcataagatacaaaatcaatatcaggaaatcaactgttttgtgtataccagcaatgaacaatccaaaaacaaaattaagaaataattccatttgtaatagcatcaaaattagtaagttaaaattacaaaactttgttgatacattaaataatatctaaataaatgtaaggagataccaggttcttggattgaaggactcagtattgttaagatggcatttcttcccaaattgatcaacagattcaacaagacccagcaagctttttgtagaaattaacaagaaaggttatgagtgggtaactgaagctgggtaacgtgtacctgagagttgattatactactctcttcacttttgtttatgtttgaaatcatccataataaagtgttgttttttgtttttgagagacagggtctcactctgtcactcgggctggagtacaatggcacaatcagagctcactgcagcctcagtttcctgggctcaagcaatcctcccacctcagtctccccattagctgggactccaggtgggtaccactatgcccagctaatttttttaatttatttgtttatagagacagggtctcaccatgttgcccaggctggtctcaaactcctggactcaagcaatcctcccacctggacctcccaaagtgctgggatcacaggcatgagccactacatttggccagcaacgtggtttttgtttgcttacaaaaaaaaaagaagactacacaaaagaaaaaaatgtacaactaattcaagggctgccttaattattcctcactctttaccctcggcccacatcatttccctacaggctgatccttgcccagtccactcctgattcatggctggtgaataggtgagggaggaaaatggagagagcgaatacacagagtgacagagggaggagaagtgaaaggtcataggcattcgctgcagccatgcctgtagtacgtccatcaccaggcttcaatttatagcagctacatgactgcgtgtgtcaatctctaactggctcatgtgccagaccagaagctactattggaaaatgcccctctctcgtcatgtcgtttgcacagtaattcacttagatctgaactgagtacaaatgagtggtgctctaagatcaaagcaccagggtctttaaaatgatcttcactctccccgcaacctgccccgaacacgtgcatgctcctttcactttcaattccaaactgcacccttctaacgctggccgaaagggaaagtaagccctgttttcgtttcctttcaaatacttgatgctttccaattttattcctattttccctaatggaataatacttactacttggaaagcatcattcatctcctctcaagatcctcacagcaacaccatgttgccagaagggcaggtgcgaaatctgaaataatggcagaagtcgaatgtcgcacgtcaatgtacagcctcccatcgaggcccatggctttatttttatgtatttatttatttattgagacggagtctcactctgtcacccaggctgcagggcaatggcgctattttggctcactgcaacctccacctcccggatttaagcaattctgcctcagcctcccgaacagctgggattacaggcatgagccaccacacctggctaatttttgtatttttagtagaggcggggtttcgccatgttggccaggctgatctcgaactcctgacctcaggtgatctgcccgcctcggcctcccaaagtcctgggattacaggcgcccactgccacacccggctcagttttgtatttttagtagagactgggtctcaccatgttggccaggctggtctcgaactcctgacctcaggtgatctgcccgccttggcctcccaaagtgctgggattacaggcgtgagcctccgcgcctggactaaggcccatgactttagcaagcgggatgttgttttccacctcctgctgctgcctcttaaggaacaggggcgcttcttcaccgcagaggagacggttctccattctaggaatgggtatgaacttgcctgaatagtctatgatgggcaatggggacgttccatctacatctcattatgaaaatccccaaaaaccttacaaaaccatataatcgtgaagttttaagaagtcttaaatagttctaatatataattctccacaaatcttttctctctaaaaaacacttatttttctcattttgatatgccacttcaaagcttttcccactccttgagtatatttacttttctctctcctctctctagtgactgagcagtgattttacctttacctatttatttagagatggaggtctcactctgttgcccaggctggagtgcaggggcacgatcagggctcactgcaggctccacctctcaggttcaaacaatcctcctacctcagcctccagagtagcttggaccaaagatgcatgtcaccacacccagctaatgtttttattatttgtagaaatgaggtctcgctgttgcccaggctggtctcaaatgcctgggctcaggtgatcctcccgcctcagcctcccaaagtgctggaattataagtgtgagccacagcttcccactaacaatttcactttttaaagagatgggtcatattgtccagtaacatttacatgagatccatgaaaaaaaagtgaatattattctttagaataataaacaattcatatcacaaaattagctttaaaagattcccgcttgtaggagctattagaatttcaaaactgcccagttaaacataacctggttcatcccaacgttttcatttacatataattcaaaaagatttacttttccataaatttcaaatgctcttcagatgaaggaaacattcatcattacatcaaagcaagtgcaacttcaatactaaatttcctgatcttttatacaattagactgcaagtgctcatctgagacagatttagagaaaattgcggctgatgcccagctctatgaaagagttttaagaactgaaataacttaaaaaaaattagaatcacagaatggggggagatgagaaaaaattcatcctaaattagaaatacgaactcctgcccaaagtgcagggtttttaaaaaatggaattgttaaacagattgaaataatatttagaaacaacaccagctcacaagggtagtaaaatactaattcttaaaatcgttaaacagattgaaataatgtttgtcaataacaccagctcacaaggatagtaaaatactaattcttaaaatcctccctcttgcgctatgcctgcttctgagttggctgagcaagttccttcccttccccaggcttctaacagtgaacatgatctggcagcattagacacaccacaactccactccagaccaagatgggtctgggtcaaacccaggacttctgcttcaaattaggagagttaccaaattaagacaattctgcctcaactgagtcaccctccagggacagctgagtccatttccagggtaagtactggggtagctctacccaccccagagagatgtattttatggtctgtcctaaacagaactggacccccagagaagttccgagatcagcacagcctgcagctgaccctcgggagagggtcaattcagggcatttgctgaccaaaaggatggatctccctcaccgggaggtggactgcaacctcccaaacactttgccactgtagctaatgtgtgcaaacatttactttgtgaatttgtatcttagtagcttcactaagtcagcaaaatccaatctctgaatctttttgtggtgactgaactaactctatgttgcacttttggtgaaaaactgcaacatagaatttaattaattctttaattaaatgggttaagggaaaaaccgtggcaataattttttttttcctctttcacttttgggatttgaggtcttcaaataagtttttctaattgtagggaaaacaaagtcttttaataattaccattaatgatttataatttaagcagtttaggaaataaaaaatgcatagaacatgatattctcatacccagacaagctcatatcccacctgcacccctttacagtcaaggatgattttgcatctcctttcctcacttaagtgccttttttgccaactaggataactcatataatgaatttttgccaactaggaaaactcatataatggctttttttaaatctggtttttctaataataaaatcatatctgttgcaaaaaaaaaacaaagcaaaaaaaatattagtacaagttcctctaatcccactgtaaagaacacgcgctatatataaatttgtatatatccttcaatgcatgtattattatctctctagacccacattattaaacacgctattttatggaaaatgagatcatgttttacatatggtacagttgcttgcttttttcaattcacagttcatggccgggcacggtggctcacacctgtaatcccggcactttgggaggcctagatgagcggatcatgaggtcaggagatcgagaccatcctggctaacacggtgaaaccccgtctctactaaaaatacaaaaaaaaattagctgggcatggtggcgggcgcctgtagtcccagctactcaggaggctgaggcaggagaatggtgtgaacccaggaggcggagcttgcagtgagccaagatcgagccactgcactccagcatgagtgacaaagcgagactccatctcaaaaaaaaaaaaaaacaattcacggtggctcttttgcacatatgggtacacgcagatctatctcattcttacaaatggttacaactattccaccataaggacagaccataatttccacctaatagatgttcaagtgatttcccactttctgctattacaagaaagacagtaaccaagattctcatacatacatttttgtacttgtgcaaatattgccatagggtaaatccctaaaagtgaaaggacttggtcaaatggcatgacatgtgaaattctgaagatatgcaaaatgtcctcaaaaaggtttctgcaattcgtagtcccaccaacagtgtttcagagggcctgcgttccctttcctctcaccaccaacaactagaatcaattttttcatctttacgaatcaaagagatttttcaaattttttttcttatttcaatatgctgttgttgtaagttattattattattattattattattattagggggattgtacatttagcccaccgcacactagctgcatgacctagagaagtaatttaatatcccggttccttggttgtaaaatgcagataatgaaagtaacatctacttctcgggggagccgtgaagatgtaatgagcgaaggcatctcagacacttggtgccgagtctgacagagtggggcttcaacaaaggttggaagaacaacgaataaatagaatatattctatgaacaatgaataaatggaatatattctatcagggtgacttaccagagttacctcactcatcaccaatttggctgctgttcaatttttgctattctcaattatattcgtatcattgagtaaattattctcttgtatctacaggaccatcttctaaggcgactctcccaggattcggacagtgttacagttcttacttctgttctttagaagaagtgaaccagcaacaacaggccacccatcaagttttagaaaattttctctgccttaaaaagtatataatgcggccaggcatggtggctcacacttgtaatcccagcactttgggaggctgaggcaggtggatcacttgagggcaggagtttgagaccagtctgcccaagatggtgaaaccctgtctctactaaaagtacaaaaaaattagccaggcgtggtggcacatgcctgtaatcccagccactcaggagggtgaggcacaagaattgcttgaacccgggaggcaaaggttgcagtgagttaagattgcgctactgcactccagcctcggcaacagagtgagactctgtctcaaaaaaatatgtatgtgtgtgtatgtgtgtgtgtgtgtgtgtgtgtgtacttttaaggcattctcttttgtacttttaaaattactagtaaggacatacatttccatatcactcactgtttgttgtatagaaaataagctttatcgttataattttcacgcatatatttttctccaaattatgacctggaaaaaaaacttgcagctagtaactggaaaactgggtaacatatatttataaaagacaaacacacatgtatttcttatatgtggcttttctctaccagtaaagaataggatgtggatgaaagtttcaaataatattatgttataaaccttatataattactgaactcaacaaaacttttgaaaaataaccaagtagaagttatttttagaaacctggaatgtcattccacctaacagaaattaaaactggctgggcctggtggctcacacctgtaatcccagtgctttcgaagaccaaggcaggaggatcgcttgagtccaggagttcaagtccagcctgggcaacatagagagatcctttctctttaaaaagaaaaaagcgaagtgcagtggctcacacctgtaatcctatcactttgggaggccgaggcaggaggactacttgaccccaggagttccagaccagcctgagtaacataagaccccatctacacacaaaaatacataaaaatgagctgggtgtgatgatgcatgcatgtagtcctagctactcaggagtctgagatgggaggattactttgagcccagaaggtcaaggcttcagtgagccatgatcagaccactgcactccagtcttggcaacagagagagtctccgtctcaaaaaataaaataataataataataaaaaccaagataaataatataaccacaacttttcttgacccatcaaagaggcggggttacaaagtaaccaagtagtagccaggcgtggtggctcacacctgtaatcccggcactttgggaggcccaggtgggcagatcacttgaggccaggagttcgaggccagcctggccaatatggtaatatcccatctctcctaaaaatacaaaaatcagccagccatggtgatccatgtctgtaatcctagctactcgggaggctgaggcgggagaatcaattgaacccgggaagcggaggttgcagtgagcagagatggtgctacttgcactccagcctgggcaacaaaagcgaaactcagtctccaaaaaaaaaaaaaaaaaaaaaaaaaaaaaaaatcaaaaaagttgaaaacagatcaatatctggcattgaggcttttaaaaagtcaaatccaaaattccttataaaggttcctgcaaagccaacttaaaaagggtccgtatggtggatcacaattcttgctacatttgatgcaaatcttcaggccaagtataaagcaactaaaatttgttttgcaaataaattggtcttactattatatatataatttatccctggtagaaatggggaaactggagaaagaaaaatttagattctagccttaaccattgtttgtgagtttttattatctgcctacaatttgggctaatcctgaaccatttcctggctgcaacaagtctctaaagaagaaccgagttttaattttcatcatgatgcattttagttggcttcttaacagaatacgttcttttttcattgttgttctggcccacgaattctgggtttttttgtttggtttttgagacagagtctcactgtcatccaggcgggagtgcggtggtgcggtctcggctccctgcaacctccacctcccgggttcaagcgattctcgcgcctcagcctcctgagtagctgggattacaggcgattctctttctattgcaatctctgtgtgcacagaattctactatccgagtgatcgatgttatatatctcacattgttttgcctattctgacagaaccaaagccactgcattctgaagactgaagacgatttaaaagcctgtgaatctcccttgtttggaatcccactgggcccgatctgttttccatgaccaaggcactgctgctaaagctatacagtatcaagcaccctccttaaaggctcagggaccatgaaggaagaagagggcatgtgagattacaagagctggattacaagagtggactgtggaggctgaagtagctccatcgtggatgctactccgccatgtggcttctgattaaccccagttccaggaaaccctctgagatttccagcttatgcgctgttcctcgtgtaagaccaagaacttaccataaagcctgaccttaggtcaaacaactttgatgttattgtactcacactgacctacacatccctctgaatcaccccttccctacggtatacaagccctgggaccaggggataatggtgcagggatccactgtctcttctcgctgcagccccagttcacagactaatgaacagaagcttgagaacagacatagcttctgtgcataagcccctattaaatgtttctaagaaaaaagaaaatgcttgaagaagaaagaaaggatagaaggaaatatttgaagagataatggccaataattttttaaacataataaaagacatcaaagcacagatccaagaagtttagaggactccaaaaaagagaaataccaaaacaacatcatgtccaaattgtcgaaaactaaaaataaagagaaaatcttaaaagctgccggggtgacagtgggaattgggaaacatattacattcagaggaacaaagaaaagaattatagcagacttctcaccaaaacaacaaaagccagaaggcagtggtgtgatatctttaaagtactaaaagaataagttgcaaaaaaaatttttcaacacaaaccttcatatcctaaaagaaaaaaaaaaaaaaaagaaacaaacaaaaccaaaaaaaagaaaaaaccgactcttaaaaatgagtgtctcttggatctccttggtatgaaatttttctttaaacattttcttttttttcagaaagagtctcactctattgcccaggctggaatgcagtgacgtgatctcagctctctgcaacctccgcctcctgggttcaagtaattctcctgcctcggcctcccaagtagctggaactacaggcatgcgccaccatgcccagctaatttttggtagagacggggtttcgccttgtcagccaggcaggtctccaactcctggcctcaagtgatcaactctcctcagcctcccaaagtgctggaattacaagcatgagtcaccgcacccagccctctttaaaaacttttttttttttttgagacaaaagtctcactcagttgcccagactggaatgcaatggcgcgatctcagctcactgcaacctccacctcctgggttcaaatgactctcctgcctcagcctcccaagtagctgggatgacaggctctcaccaccatatccagctaatttttgtatttttagtagagacagggttttgccatgttggccaggctggtcttgaactcctgactgcaggtgatccacctacctcggcttcccaaagtgctgggaataacaggcatgagccattgtgcccggcctaaaaacattttctaatgggagggaaataaaaactttttcagacagacaaaggctgagatcatttattcccagaagacctgtagcataaaaaatgttaaaggaagtttttcagtcgggagatgagacagaaacctatagatctacacaaagaaacgaagagttcctgaagtggcctaaaaagaagaaagattttcaaaataattttcaaaagtattttgaaaatcttccattgttctaaaactacactgtctatatggcagccgcttaaatttaaattacttaaattaaactagtttatttaaaattcagttgttttcaggtactcaatggtcacacatggatagtagctaccatattgtatagtctagatataaaacatttccatcattgcaggaagtttcatcaaacagcattgctctaaaaggtaattttctgtaaaaataacatgttatgaggtttataatatatataaaatacattattatgacactattagcatcataaacatttacaaggttctcatagaaccttgtagtaacttacagttatgaagaattcttacgaggttcttatataataaatggtataatatttggaggcagactgataaaaaatgtactttgtaaatttcgggcaatgacttaaaataagtgagaaaaaatatataagaaataaatcgatagaagagataaaaatagaatcatgacaaaaatctggctgggcacagtggctcatgcctgtaatcccagcactttgggaggtagaggtgggaggagcacttgaggccaggagttcaagaccacgctgggcaacatagtgaggatctgcctccgcaaaaaaaaaaaaacaaaatttaaattaaaaaaacaattagccgggcatggtggtgtacgcctatattcccagctacttgggcgacagaggcgggtgggtcgcttgagcccaggaggtcgaggcttcagtgagctacgatcatgccattgtaccccagtctggatgacagggcaatacccagtggcaaaaaaaaaaaaaaatagaaaacacactagcaaattgtctacaaagtggaaggttaaaaagtgatcgaggggaaaaaaaagcagttcggtatttctttacatagacaattcaaaaggttgttctgaatctcacaaagatttattgaaagttgttacacttttaagtactactttatggccgggtatagtggctcacacctgtaatcccaatacttttgagaggctgaggcaggaggatcgcttgagcccaggagttcaaggccagcctgggcaacatggtgagaccccgtctccacaaaaaaatagaaaaattagccagctatggtggtgcatgcctgtagtcccagctactcaggaagctgaggtaggaggatcacttcagcccaggaagctgaggctacagtgagctgtgatcatgccactccactccagcctgggtgacaaggtgagacctgttactatatatatatggagtgcagtggcaccatcttggctcactgcaacctccgcctcccgggttcaagcaattctcctgtcccagcctcccaagtagctgggattacaggcatgtgccaccacgcccagataatttttgtatttttagtagagatggggttttgccatgttggccaggctagtctcgaactcctgacctctggtgatctgtccacatcagcctcccaaagtgctgggattacaggcatgagccaccgtgcctggccagtgcctaattttaatctcttactaaattaaccactaaattaattttttaaaccccagaggaacattaatttacagcagaagaggtaagggaaaactggatgtactggcaagaaatgtacccggtcccatgtgtgcaatctgtcaacatgtaaatactgagcgtctgctaaacaccatacaccagggacacaaaaatgttgcaaaatgtgtcctggagagctcagtgaaggggagacacaactccaaagacccattaacgcaaaaggaggtaaaaagagacctggcaaggaatggcggctggggcagcgggggggccaggcgggagggctcaggaaaagctttccaacggagatgctactggatcttgtaaggtgggcaggggtccaacctgcacagatacctggctgagagtatctggcttatttgggaaaaatgcaggcagtgttttttggagaaacagataaattttaagtctggaagagttcataggggttctattatcctgaaatgcatcgctgttatttctttaagtgacagatatctagttaatgaggagaaaaggcaggcacaaaagcacaacgtgatgacagagcaaatgcaaaataacagctgggtggcgtagcacatgcctgtggtcccagctacttgggaggctgaggtgggaggatcacttgagcccacgagttcgaggctgcagtgcgctaccatcacacctgtgaacagccactgtactgcagcctgtgcaacacagcaagacccccgtcttacaaaacaaaaatgcaaaacaaaattagtgcccaatttctcaggtttatgcctagttgctaatctgtgacatctctgttagaaaagctaacaagagcctaaaagaaaaattcaagtcagctccaggactgatggtggcaaatctacaactccttccacttaaaaattcaacaaaataagagatttagatttttgcatttttgtgtgcccaaagaaaaaggctccagttttctgtttcgtgttccatcagcttacataacctaactcgtcccacacaaagacagacgaatgatttttcttgcagatgaaatattcccaagctctcacctctaaggtctaagtggatcttgtgataaccagcacaaagtgaggctggggatttgaaaagaaaataccagaaatggttaccaaaaactgacaagagcacccaaacagcatctgtgatcgctagaagatagacgcactgacaaattaaggagccattaattagtttcaaagagaaccaaatggcatcaataattttttttttagacaaggtcttgctctgttgcccaggctgcagtgcatcaataattaagaatcagcctcctggctgggggcggtggctcacgcctgtaatcccagcactttgggaggccaagggaggaggatcacctgaggtgaggagtccgagaccagcttggccaacatggtgaaaccccgtctctactaaaaatacaaaaattagccgggcatggtggcaggcacctgtaatcccagctactcagggggctgaagaaggagaatcgcttgaacctcagaggtggacgttgcagtgagccgagatcacgccattgcattccagcctgggggacaaggttgagacttcgtctcaaaaaaaaaaaaaaagaatcagcctcctttctgtacacgctttccacagctagcatgcggactcactggactacagggtgtaagatgaggccaactgtaagccctatacagggaagttacagttttgttcaaaactcactcacaattgggaacagcctgagaccatgcctgcatggaacagcacagccttgtccccccccgaggacacttcctgtgacatctggagagatgagcagattcacgaggcccaggagggttttcaggtggtctttctggctgtagagagatcaaacacacccttccccaacgtcctttaggagtaaatgaccaatttagcaacaatgagcactcaagaagtacgccagcattctctttattatgattatttcctgcacattacatcatgccttcttttcttacagcgggaaaacacccacacacacgcacacaggtatatgcacacacacacatcaaaagttactgtaactcctaagcagagaataggcatatttttggcctttacctttcagtccaattttttaaaatgagatataaaaactgaaaaggaggggattttaaatttatatgattttctgccaagaaaaatctaaggctatctgatttttaaaaatcagacacaggccaggcgcggtgactcacacctgtaatcccaacactttggaaggctgaggtgggtggattacttgaggtcaggagtttgagaccagcctggccagcatggcaaaacgccatctctactaaaaatacaaaagaaattagccaggcgtggtggtgcacacctgtaatcctagtacttgggagtcttcggcagaattgcttgaacccaggaggcagaggtggtagtgagccaagatggtgccactgcactccagcctgggcaataaagtgagactctgcttcagaaaaaaaaaaaaaattcagacacaataagcattcaattaagtgtccagttacaaagaaaaataacatgttcagcttcatagtttcttataaagttaaacacactcatcatacaacccagtcactccactcctatgcatttaaccgaaacaaataaaaatatacatccacggaagacttgtgaatgttcacagcaactctattcataatagccaagaactgcaagcaactcaaatattcatcaactgataaactgattttttaaaatggtggtatatccagtccaggcacaatggttcatgcttgttatcccaacactttgggaggccaaggtgggaggattgcttgaactcagaagtttgagaccagactgggcaatataatgagacctccatctctacaaaatacttaaaaattagccaggtgtggtggtgtacacctgtagtcccagctacttgggaggctgaggtgggaagatcacctaagcctaggaggtcaaagctgcagtgagatcacgccactgcactccagcctgcctagagtgagaccctgtctcaaaaaaagaaaaaaaaaaaagaaaacaaaaacataaaagtattagaagaaaatataggttaatattttacatagtcctcaggtggggaaggcttttctaaccatgatactaaaggtagaaaccataaacaatgattgatagataagaccaacataaagattttaaatttccacatatcaagaaatatcacgattgaaagacaaattagaaaatgggaggcattttacaacatatatggaagacaaagatttaagatacttacataaataaagaactttcacaaatcagtaaggaaaagacaaccaattcacaagcaactcatgaagaaatacaaaagggcaacacacatatgaaaaagagatttggccccactactaattatcgtgggcaaagacaacggcaaataaggatattcatcacactgttataattgacaatattatatttcatcgagtctaagatgccaatgatgatgtttcattactttttgttctattaaaatataatgcaaagtgctgccaattaaactatgacataccattaaattatacaatgcatcctgatgtgagggatggctggattattaacagtttcatattgtgatatacaatgattcaaagctggaaacaatctacatttccaacaagagatatttcctgaataaattatagtacatccccagaataaaatctaagtcatttaaaatgatgatacagatgtatgtacagacttggccaggcatggtggctcacgcatgtaatcccagcactttgggaggccaaggtgggtggatcacctgaggtcaggagttggagaccatcctggccaacatgttgaaaccccgtctctactaaaaatacaaaaattagctgggtgtggtggcggacgcctgtagtcccagctactggggagtctgaggcaggagaatctcttgaacccgggaggcagaggttgcagtgagccgagatcatgcccctgcacttcagcctggatgacagagcaagactctgtctcaaaaaaataaaataaaataaaataaacaaagatgtacatacagatttaagtggaaaggtattcatgatccatgaatggtgtttaatggtgttaatggtgtttaatggtgttaatggtgtttaatggtgttaatggtgtttcatatgacaccattatatctatatatatttatatgcattgatatatatttgattttgaataaatatttgatatatatcgtatatgcactgaaaaagtctaaaaacctcatgttgaaacattcaaaatggctatctctagttggtaaatgtttttttaatcttctttttgcttatctgtcttttctaaaacaccaaaaacatgttttacttttataataaaaaattaataaaaataagatggtcaccccctttgccatctgccaaaacagagagcttcaaaagtcacacattccttaaagctgcagtatttacaaaggaaagaaaaaccttcaagcaatctaaaaagctcaaacaggaaatgattaaactatggcatattaattcaaagaaatactatattatgtagatgcacaggaaaatccccatgaaatagcaacagaaaactcaaacacaaaatgaccaacatcaattttaacaaagaaaaaaattaccacctgtacctaagaatttaaagaagttaacagaggtaatttttcttttctttactttttttttgagacagtcttgctctgttgcccaggctctagtgcagtggcatgctcttggttcactgcaacctccatctcccaggctcaagtgattctcctgccttagcctcccgagtagctgagactacaggcgtgcgccaccacacccgattaatttttgtatatatatatacattttttgatagaaatggggttttgccacgttggccaggctagtctcaaactcttggcctcaagagtgatcctcccgcctcaacctcccaaagtgctgggatttcaggcatgacccaccgttcccagcccaacggaagaaatttttctaataggcttcagagaattatgtgttttgacctttccattaatgtcttatataaaattagtttgacagaaacaataaaaaatatatacaccttcagaatcatgacggcgttctccaggcctctaccagaaacatttttttcgtttttttttttttgtaaaaatatcaattttatgctccaaaaacattccacatggcaaccaaggtcccgtagagagcactttttcccccttgcctcttctttaaactcctaattcaaaattttggtttctgataacctgctcaggataaaaagaaaatctcacatagaaatgcctttactacagggaaatggagcaagaaatttcccttgtctctgggattgcttttttctgttttctggttaaggaaaacatttcaaagttcataaaaacaaggaactaaaattagagagatgagaactgaaccttgactcgaggtagggaaaacactatttttaaaccgagaaatatttctaggtctgtgctttatgagaaaggaagacgagcgtgctcatgtgtgtggatggtgtggcctggggagggacggtggcaggagaaaaccatctcccgcagcggggcattccctgcacctcacacacatctgctctcgtggaacacaaactggaactaatcagcaggcggcacctgggaattctagtcacttaacagcagggagaaggttgcacgttgctcacagcagatcatgaagccatctccacctcctgctgtcaccatcctcagaaccagcagtggctccatggctccctgactccagaggagctggccgcacaggagaccctctgtcattcctgcagaacagctaatgctttgcagagctccagatgtaagtttaagaaatacgtttgttataaggtttcttaacaagacacatcagtgatatctaagactcttaacaggtgactattaaagaaataaatctcttccacatattaaaaccacattcatcctgacagtcatagcccagctcgaaagccttcgagagtgcttttacctcccaccacatcaaatctagatttcttcctttcatcctgacacccacatgttcaacatcacagcacatgcggggagcccccagggtgcaggaggggaggagggcgctgtgtctgcaggggcgtgtgggtaaaagcaagagagggtgtaacggtgggtggggggagggtgctgtgtctgcaggggcgtgtgggtaagagcaagaggggggcagcaggggaggagggcgctgtgtctgcagtggcgtgtgggtaagagcaagaaagggggcggcgggggagtcttggagaagggaggggtgcggaggggcactgccttgtgaggtcactggtggtgatgtgggttccaagcagcaagaaaaagggattgaggccaagctggagaactgaaggcaagtcacgcacaggcagagttggttaaatgatccaatttcacaagtttctcctagaacaagcagctacattttcattttttaaaatgctgcatgaaggttgggcagtggctcacacctgtaatcccagcactttgggagactgaggcaagagtgtcacttgacaccaggagttaaagaccagcctcggcaacatagcgagaccctgtctctacaaaaaaaaaattgaaaattagccaggcatggtggtacacgactgtattcccagatactcaagaggctgaggcaggaggatggctagagcccaggagatcaaggctacagtgagccactattgccactgcacaccagccagggcaacagaacaggaccctgtctcaaaagaaaaaaaacaaacaaaattctatgttttaactaaagtcacagccactaatgcattgcatccctaagaatcattttctttcttcatgtcctccccgttcccacacacctaccttccttaccagcagaagcctgattctgcttggggtatctcccttctacctgcttaggaaggagatgcacacacgcacacacacacatgcatgcatgcacacaggcacacccatgcaagcacgcacacacacatgcaggcacacccacgcatgcacgcacacatatatgcacacccatgcacacccatgcatgcatgcacacatatatgcacacccacgcatgcacgcacacacatgcacacccacgcatggacgcacacgcacacacaccatgcatgcgcacacacagcccacccgcagtaagtagctggagcagggtaagttcaccccaatggggcttccctcccctttccagtaactaaggaggatgtggcacatggccccgccttggccaaagggagctgagagatgtctgcttagtttccatgccagtaaaataagacatgcaggattggaaaagcccctcttctttactagatatcactgtgtcattcggaatggctgcagccactttgtgccacaagggaagacatctcccacgtggcaaagacagcagagagcaaagatgaaaagcacctggggtcctggaaatgtcatcacacctctgaattaatcaaccctggaactgccatacttcttgttacatgagatagtaaatgcgtttttttgtttgtttgttttaggtaattttagttaggttttcgttaactcacaacaaaaaccatcttaaccaatataacatgcttattttatcaaaacataaagtcttttttttagaaaaatcacctatacataagttttctgtttgtgtgggatacaaaagtgtctttccactagtgtggctataataaaaaagacgaacagcagcaagtgtttatggagacgtggggaaatcagggcccgcacacactctggtgggaagagaaaatggcatagccactttaaaacaaactccagacattcctcaaaaagttaaacagagttaccatatgacccagcaattccactcctaggtacatacccaagagaaatgaaaacatatgtccacaggaaaacgtgtctgccaacattcatagaaacactattcatcatagtcaaaaagtgaaacaacccaaatatccatcaactgaggaatggataatcaacaaagataaacaaaacgcaatggaatattattcagccatgaaaaggaagaaagcactaatacatgctacaccatgggtgaacccagaaaacattaggctcagtgagagaagccagtcatgaagggccacatatgatgtgattccatttttatgaaatgtccagaacaggcaaatgcaaagagacagaaagcagcttaggggctgccaggggctgggagcactgggggtggcagctcgggtgtgccgggcttctctgtcgagtgaagaaaacgtccccaaattgtctgtagtgatggatgtcaaagtataggaactgtacacttaaactgctgaattgtgtgacatgtgaattacatctcaataaagctttcttttgtttgttttgtgtttttctttttgacacagggtctcaccctgtcacccaggctgggtgacaggtgaattacatctcaataaagctttcttttgtttgttttgttttgtttttgtttttgacacagggtctcaccctgtcacccaggctggaatgcagtggcacaatctcggctcacagcaacctccgcctcctgggttcaagtgattctcctgcctcagcctcccaagtagctgggattacaggcacccaccaccacgcccagctaatttttatatttttagtagagacagggttttaccatgttggccaggctggtctcgaactcctgacctcaagtgatctgcctgcctcagcctcccaaagtgctgggtttacaggcctgagccaccgggcccagcctcaataaagcattttttaaaaaatgaaatgttggctgggcacggtggctcacacctgtaatctcaacactctgggaggccaaggtgggggtattgcttgaggccaggagattgaaaccagactggacaacacagtgagaccccatctctacaaaaaattcagaaagtttaaaaattaggtggtgcacacctctagctccagctactcaggaggctgaggtggaaggatcacttgagcctgggtggtcgaggcttcagtgagccatgattgcaccactgcactccagcctggatgacagagtgagactgtctcaaaaacaaaaacaaaaacaaacaaacaggaaatgtgatagaatcagtggcaatctctgtgtttctgttattaacatagccaaactgagccgcctgctagttatcagaaacccaacaaggaacgacccatattcctgtgacttcttaagtaactacttaacttgcgcatttatgatactcatatcaacttcaactcccggccttctaactggtttagctacagccaaataaagtacacatttttaaaagtcttcagacgcctgtctctccatttacccattggtgccttaggtataaacagtgctgagtggtggcactggctggcaacacccagaggctgaaagggaggacactggaagctggacgcagtggctcacgcctgtaatcccagcactttgggaggtcaaggtgggcagatcgcttgaggtcaggagttcgagaccagcctggccaacatggccaaaccctgtctctactaaaaatacaaaaattagcggggcatggtggcgcatacctataatcccagctacttgggaagctgaggtggaagaatcacttaagcctgggacgcagagattgccatgagccgagatcgcaccactgcactccagcctgggcgacagagcaagactctgcctcaaaaatgaaggagagagagaaggcaccaggttccaaaagagagccgcaccaagtgtgtgcacccagcccccaggagccctccgtaaatgtgtgttaaatgaatgtgtgtgtgaacaccatcagctgaggtggtatagaaaaagcaactcctggtcagagcagggaggaactcatctaaaggggaggctcccaagagctgcagcagagggtcaccaaaggaggggaactccatgtgggattccaaccctgactggttacatggaagtgaacaggacctcgtcgaagagggagaggtctgcgttgcctccaagcagtgcttcttgaaatggtatccccccagcagccgcctcagtatcacctgggaacttgcaggaatgcacattcttgccccaccctggacccgctgagccagactctctagggtggggcccagacgtctgtgttttgactcagatgacatcggtgcaggctcgagagtgagctactcttccagggacaaccagtgtggtccttccacccatgcgtgtccagggatgaccagtgggtgctggtgttcagggtggtgtgcggacatccattcatttattgcataattattaaaaaaaaaacaacactcgctgagtatctactgtgccctaaaaaatgagaaagactccgctaatgtgtaggcagtcaaccagccctggtcagcgtactcacaggtaggcagacggccgcgcggagagcaccaaggggcagaaggatgctgcttgggggtggggaaggtggcgacgcaatgaaaacagatgaaggacaaggagaaaaaaaatcaagtgctgccagacactggcacaaagctggaagggaggtcacatctatcgagggggaggagggcaacacaggaggagaagagacagggaaaccgcctctccggtgccttccacagagggtccattgcaagcaagtggagaatcagccacatgccatgtactacgtggcaggggtggcagcccgagccctgagatcggagagcctatcccatgtgacgcatgtcagccacacatcacccaggcctgtgatgaaggacaagcgcacgctccgctctgatgacacgcgcagctggcacggacccaggagggatcatggacgtgaggagacgtcagtgtccaaagagggcccatcagcccagagaaagttgacacagaatcatgaaacataatctacttaggggacagctcactctcagcaccagtacaaaatgtagattttatccattaatacttccataattagctcaaaaaaattggactgtgttttttatttttattaatttttttaagacagggtcttactctgtcacccaggctgaagtgcaatggcatgatcttggctcactgcaacctctgcctcctgggttcaaacgatcctcctgcctcagcctctctagtagctggaattacaggcatgcgccaccacgcccggctaatttttgtatttttagtagagatggggtttcaccatgtttcccaagctgatctcaaacccctgacctcaggtgatccgcccacctaggcctcccagagtgctggaattacaggcgtgagccaccacgcccagccctccaaagcttcttcattctcccctaatcaaggtgctgctccttcttcaaatcctgccatcctaggagctcacctgaaccctattccattctgatactgcgccctacatcccaacaagttatgtcttttacctgcattctattaatgtgaaatccactctggctttcttggtgagcgtttctacatttacctgcacccctcatgaagcagggagtttcctcttttatggtgaggttttgttttgtatggagattcgtttgttctgtaacatctccttctttaagaacaaggaaggccgggcacggtggctcacgtctgtcatcccagcactttgggaggctgaggcaggcagactggttgagaccaggagttcgagaccagcctggccaacacagcaaaaccctgtctctattaaaaatacaaaaaattagccacatgtggtggcacatgcctgtaatcccagcttcttgggaggccgagacatgagaattgtttgaacccaagaggtggatgctgtagtgagctatgatcacattgctgcactccagcctgggcaacagagcgagattccatctcaaaaagataaaaaaaaaaaaaaaaaaaagaagaacaacaacagctaagagtttggcagagtttactctgcacagttcagggagggcactgagtctgtgggcataaacactcagtccctcgtgggatgtgctggatcaaatcagatcctttgctcagatactacagtcctgaagcaatcctgttactatttgctcggatactacagtcctgaagcaatcctgttactatttgctcggatactacagtcctgaagcaatcctgttactatttattttctttctttctctctctctcttccttccttccttctttctcttttctttgtttctctttgtttctgtctctctcgctctctccctctctttctccctttctttcgtttctttcttcctttcttcttctttttttttgtttttttgcgacagagtctcactctgtcacccaggctggtgtgcagcagtgtgagctcaagcaatgctcctgcctcaacctccccagtagctgagactacaggtatgtgccaccatgcccggctaacttgttactattaatgaggcctcacagataccttgatctcatggaggaactgccttgggaagtagatattaatattccagccactggaaaagtacatcatattccccaaagtaacttaatacactggcacctgctttatacatcggtctcatggtcagcatgaatcacaactcctaaactcacacagttctgaagactgatggaaatgaagattctggtttgtttttgtctttgttttagatagggtcttgctgtgctgcccaggctggagtgcagcagcatgatctcagctcactgtagcctcaacttcccaggctcaagcgaccctcccacctcagcctccagagtagttgggactacaggcacgtgccaccattcccatctagtttttgcattttgcagcgacaggatttcaccatgtgaaccaggctggtcttgaactcctgagctcaagcgatctgcccaccttggcctcccgaagtgctgggatgacaggcatgggattccaaaccaagattcttaatctcaaaattatgaacaagatcctgaagctcggtgatcacctcaggatctctgtccctcctaagaggctgtaacagcaccgtccacctcatccctctccgctccacaatctacaaaatctctatgtccaatcttatcttgccaatctacaactgtcttgtactacaatatactctaattgttaatgttggtctggtaggttcgcttttcataacagctttatatagagagaattcatatactgtgtaattctctcgtttatagtttataattcagggaggtttcgcacacagagttgtgcaaccatcaccatagcccattcgagaacattttcatcaccccgaaaggaaaccccatccatacccatcggcggtcacctcccatttcccttcagtttccccagccctggccatcactaatctactttgtgtgtatggatttgcctgtagttctagagttcctagaaatggaatcatataaaacgtggcatttgggtttttgttttgttttgttttgagacagagattgctctgtcacccaggcaatctcagctcactgcaacctccacctcctgggctcaggtgatcctcccgcctcagcctcccgaggggctgggaccacaggtgcatgccaccatgcctggctaatttttgagttgacaggattttgacatgttgcccaggctggtctcgaactcctgggctcaagcgatcgaaacgtggcctttgtggtctggcttttttcactgggcatgttttcagtattcgtccacgttgtcacatgtatcagaactccattcctttttaaggctgaatcgtatgctatcctacagaggtgctacgttttgttgatgtgttacttgttttgtttatgtgttcatcagcagacaggcatttgggctgtttccactttttggcaattgtggataatgttgctatgaacattcctataagtttttgtgtggatgtgtgtttttcacctcttaggcacaaacccaggagtggcatggctgggccctacggtagctccgtgcttaaccttttggggacctgccagactgtcttctgcagcaagtgaaccatttcacgttctcaccagccgtaaaggggaaagtctgggaggctcccgagacaagaccatggtttcttcgtgctcacatcttcaacctccagcaggtactccaaaattttccaccagtgcctgcgtgccaaggtggcttccaaagagagagcaaatcaagcctggccacaggggaccagggcacttcccagaacagtcctctccctggtgggatccttttgttccctggaaaagccaaccccccttaatcctgggtagttttacctacccacaggcttgaattacatcctaacaaacagtaaaccacacttgctgggactccgtgggcccgagggctgcttaacagcttggcaggcatccccggcagccactgtgacccagctgccctacaggccattccaagctcccccaacaagggcacttttcaggtgaactcatacaaatgtgtgccgagcgatacccctgacttggaggggactccagctgaggtcagccctggagcaggccccccacgccctatggatacttccaagcccaacttagcaaatacagctggaggcgtccaacctcacccagttgttcaaggagggaccttgccccttcctttgcctttaaggatgaacagattttttttctacttagaaactcaatgtgttcctcttctatcctaaacactactgatgttcggtaatgcagacatgtttacatgctatttcttgttttaacaacatgaaaacaaaataaaaatgaactatgaactgatgacagtgtttgggagttgagctttttctgtggccaacgctgcttttaaaaacgttctatattaaggaagtgctgtgggaacactgctggccgtggaaaccgtcccacctccctgtgctccgaagccagccagcaggcagagtcctggctgggcacgagacgctcagggctcactcgaccccacggaaaccagagggaagcctaattttatcacgctgtatttagacggtgtggattcatttgaacaaggaagttcctagagttgttgagattttttttttttggtcaatgtttaaatactacttttttttcaagcttgccctagataccaactgtttatctaacacacaattccagtgttgccaagcctcatgccaatttgaagggaacagccaaaacttatgcattcatataaaaagagtctctaggctcttatatctacattataatttttatcctaatcacaaaactattccgaatggtagtgaacaaagtaattatttcaatcaagaaacataatggccagccacatctatgaccaaattgacctaagctttcagatgttttccaaaacatcggactgccacaggtaactttttacagggtcttcatataagttcctattttattattttattttattttattattttttgagacagagtctcactctgtcacccaggctggagcgcagtggcatgacctcggctcactgcaacctctgccttccaggttcaagcgattctcctgcctcagcctcccgagtagctgggattataagcacgcgccatgatgcgcagctgatttttctatttttagtagacacggggtttcaccctgttggccaggctggtctcgaactcctgacctcaagtgatcctcctgcctcagcctcccaaagtgttgggattacaggcgtgagccactgcacccagcccaagttcctcattttaaaagtggcagaggtttgtcaaaaagttaaacagagttaccgcgtgacccagcaactccatgcccaggtatgtgccccaaagaactgagaaaacagatactcaaacaaaaacgtgtacacgagtgttcccagcagcaccatccacaatagccaagaggcagaaacaaccctaatgtccatcaatggaagaatggaaaaacaaaatgtggtttatccatacaatggaattttatgcacccataacaaaaaggaggtactactccatgccacaacatgaatgaaccttggaaacatgctgagcgagagaatccagacacacaaagccacgtatcctacgattccaagtataagaaacgcccagactcggtaaatcctgcagatgcaaagtgcagcacagcggctgccaggtgctagggcttgggagctgggaagtggctgcttagtgggtgtagggtttccttctaggggtgatgaaaacgcttcggaattagacccaggggatggttgcacaacactgtgaatgtgcgatatgccactgaactgttcaccttaaaaatcattaagttatgtgaatttagcttcaattaaaaataaagcaggctgggtactgtggctcacgcctgtaatcccagcactccgggaggccgaggcgggcagatcatctgaagccaggagtacaaggccagcctggccaacatggtgaaaccctgtctctactaaaaatacaaaaaattagacaggtgtggtggcgggtgcctgtaatcaccggtacttgggaggctgaggcacgagaattgcctgaatccaggaaacggaggttgcagtgagctgagatcgtgccactgcactccggtctaggcaacagagcaagaccctgtctcaaaaaacaaacaaacaaaagaaccaagtaggaagaaatgtggccagttcctcctgggcagtgttgtacagaacacaccaaatttctacagtgactcctaccagacgtttcttgggaaagtaagcaaagtcctttcctgaaattctggtaaattttcataaaaatcaatacttccctaatttaacattcacattttagcttacagtataactagttatagaattgttcattaattctaattgactttcgattatacaatctaatatctaatttccattttctatttctagtacataagcaaaagaaatgcccttttggtcttatggaaaacgtgtcctatttaataagacacaaatttgattcaaatttctctttctcctcctcccccttaataatacactaaaaataactgtaataacatcttacacatcctgaacgcctgtacctagcaacctcacttactcagactatagctgacaactaaaaacctgcacaaaggctgactccttagccctttccatcaaacgatatctgcaggctgaacgagcttaattacttgttggtttggttttttaatgtaacgaagtaaaaaccaggagcaaatgtgatacaggaaagcacaccaacagctacatacatggatagcaaaagaagccaaaaaaattattttttaaaatgtaagaactggaaaaacagaatgatctcagtttttttaaaaaagcaaagattcctatttttatagagaaattgctatattagtaaaagccaaataacaagaggcaaaaataactgagtcatcaagaaaattacctcttatttggcacagtccatttttatgaaagtgctttatctatttcagaaacataaaatcaaatgtttgaattggttaaaacagaaaattatctgattgattaaaagagaaaatcctctgctcttcagaaaactcaaccatccagaaagtgctatcactgacatttatatctaacaacatggcaaatgaggttggtttcatattcaaccatttgctgtccccgaagctctctattaaggatctggctgatcagaaaacttaatatttaatcaacctagagcaggcctagaaaagaggctactgtttaaaaacaaacaactgattatataaaacatttacatcaaattataattcagtattaaatctcatggaatcacgcctttcaggaaaacgtctggacactagtgaaaatgaaatggctaaatctcaatcaaagtatattattaagtaataaaagattttatcattcaactttttttttgtctctacataaaaaaagtatttttgtctctacaaaaaatacaaaaattagtcagtcgtgttggcatgcgcctgcagtcccagctactcaggaggctgaagctggagaatatcacttgagcccaggaggcggaggctgcaatgagctgagatcacgtcactgcactccagcctgggcgacagagccagacgctgtctcaaaataattaattaattaattgtttaaaaaatcaaagaatagcttaaaattattactaagctaagaaccttgctgctattacttgttcaggaaagctccacacaccataggcagtggtgctaaatgcaacagaagccttagtgcgaactggaacttctcccaggagtctatggaattggaaacttaatagctactaaatacagtaacatcatgactggagctatgaaagcaaacatttccatttgaacttcaagtggcagaagggacaaagttgataccttagactcatcagccctgaaagtgttcctaatcacaatttctttcaggagccagaaagaacacagcgttaattatgttaatccagctgagacgttcactatgaaatgtgtgttagagaaaagtcctttgaaatttcttatttgcatggtagttctgaaagtttttaacctcctgcagttcctggcacacggagtcagtcactcacttgtcctcaggaagcacaggacagcagcaggttcggaatcacactttctctgtgtgatttcacaactcgggtctttgtccaggtgagattctcactcgggtcagagggcaaaggtatccaatgacaaccctgtccttcagaaccaagtagtgttttcccatcagccgtgcaaatcacagcaaatgtcatgtggctttccagcagcctctttgctgtttgttgaggaaggataagaaaaccatggaggattaaaatcaccacattcaaattactataaagaaaaggaggccaggcgctgtggctcacgcccgtaatcctagcactttgggaggccaaagtgggacgatcgctcgaggccccgcaacacagcaagacccccatctctaataagaaaaaaaaaagggagaagaaagaaaaggaaaaatgcagacaagccagaaaataaaattgaggagattaatacaatataataatcaggcactgcagatcacacctggaacaccgcctcacccaggcaaaggaggaaaagctttcatgtgtgctcatcatttgagcaaaaaggaagaaaacacacacagaaactcaggagatccagaagagacactctgaacaaagaaaatggaaatgacagggaaccaaatgatccacatcagggattttaagagggaaattatgcttctgaatgaaaaaaataaaatcattcaaaactttttataaatctttgacaaaatccaagagtttcctttcaatgttgatgacatttaatttttttttttttttttttgagacagtctctgtcacctaggctggagtgcaatggcgcaatctcagctcactgcaacctctacttaccaggttcaagcgattctcctgtctcagcctctgagtaactgggattacaggtgcgcaccaccatgcccggctaatttttgtatttttagtagagacagggtttcggacgttggccaggctgatctcgaactcctgatctcaggtgatccacatgcctcagcctcccaaagtgctgcgattacaggcgtgagccaccgcgcccagccctctaatttctaattacaacatctaaggtagacactttccagatgcattaatgtgggggacaactagaggactaacacgtccccttgcacactcaatatagggccagtagatccagaagctcaccgtcaagagcaacaagagcaagcaagtccttcctcaacagaatcatcggtaagaacactgtcagtccaggattcactcagtcctacgagtgaaaaacttgccaacacagtgaaattcattttactggcaactaaccttccaatctctctctaaaataatgttcacatgggaactgaagcacattaaaaaaataataattattcacttcacattttctccaagccatttcaaaagtgtttctcagactttcaaaatcaaacaggattcccagaccaggcaccatgggtcacgcctgtaatcacagcactttaggaggccaaggcagctggattgcttgagctcaggagttcaagaccagcctgggcaacatgatgaaaccccatctctacaaaatacacaaaaattagacgggcatgatgttgcatgactatagtcccagctactcgagaggctgaggcacaagactcacttgaacccaggaggcggagtttgcagtgagctgagatcacgccactgcactctaccctgggtgacagagcaagactctatctcaaaaaaaaaaaaaaaaaaaaaatcaaatggggttcctctaacgataccctgctttattcaggaaacgtgatcctcaggaaaccatgtgtaaattatacttctagaactcaatcttacgtatttatatttaaaggaagtaaagaatcttttatgaagttacaaatctcacacacgccctgcaatttagtggctctataaatcggagcttccctatgctaaatgtgtctaaatgagagttcgtagttgaaacaagaggacaaagaaaaaaacacttttcaaattaagaatgagcactatgtcccaatcacgtgagaatctcagctatacttagacaatggtggagattttaagcatatctatctcaaactttatattttaccaatatgaaaaaagcagaaccagagagattaaattatttgcccaaaagtgcttgttagtggaggaaatgtattaagaccaaaagctaatttacaaaaacaaattaaattttcaaataagatcatgctataaaagtgcttccctttcagaaaccaccctcaccacacccagtttttaggcagctcattcacacacacaaaaatcacattaatgaacatcagaagcagtggcctttccttatgggaaaaagaactcatttatgaagttccagaatgcgatgcaatccacactttaaatagtaacacaatagggtacgaactaactgaatcaacatgcaataaacactttcacttaaagtgtcatagccttaatggtatattgcatttaatatccatacacaaggaaataaatcacacgcatgtggggtttcttcctttctccaggctagagtgttagaaaatgtagttaatatttcccaaacaactcaaacacgaaaataaatgattcaaaagctgctttttccccgctttggaagggggaaaaaaaaaagaacagattttaatagcattacataaaaatcctggaaattatgcacaaagactaccctggagctttgccagaaacaggcatgctggttttccatgtgtataaatggtaatcaaataagaattaccaggagctacaatattattaagataaatatacttcttgaaatctccatcttacaaagcttaaaaacaattgccagaactaggccgttcaaccccacatttcctgggcctcccctaagcactcagtcctctgtgtttctgccctgcgccccacgccctcagcgcagcacctcggagcccacagtcccaagctgtccacactctggcgcccctgggcccattcacattcccaggcaccatgcgctggtcagccctctcggccaccacctttgctagagcctatcaagaccctccggagcctctatttaatgaaccactcagtcattccagcaaagcggttactgcctttcctctacctggaggcttgttctgtgtagatgtttggggtgtggtttcacacataacagggtactcacatgtggagttacatatatatatatatatatatatatatatatatatacacacacacacactatatatatgtataaatacatatgtacatatatatatatatatatatatatattttttttttttttttttaagacagagtcttgctctgtcatccaggctggagtgcaggggcgcaatctcagcaacctccatctcctgggttcaagagattctcctgcctcagcttcccgagtagctgggattacaggtgcccaccaccatgcccagctgatttttgtatttttaatagagatggcatttctccacgttggccaggctgttcttgaactcctgacctcagctgatctgcctgccttggcctcccaaagtgctgggattacaggcatgagccaccataccaggcttatatttacttatttattcattcatttatcagcaaatattatcacacatatattatatgcctggctatattcccagcgctaggaacacagcaggaagtaaaacatggaaaattcctgctcttaagatgcattccagtggcgtggaaacagattataaacaaaattaagtcaaatacatatgatgcaagctggaaaagagagtggctggcccatagctccaggaggcactgttgaaagcaaggctcctactaagggaattcctggagttgggccttctggaatgttccacagcggtcctgagggatggggtttgctgggctgggggaggactcctcagtctgcaaacatgtcatctacgttttggtttgggattttttgttttgttttgtttttgtttttggtttttttttttgagacagaatctcactctgtcacccaggctggaatgtagtggtgcaatctcagcaacctctgcctcccgggttcaagtgattctcctgtctcaatttcccgagtagctgggactacaggtgcacgccaccaagcccggctaatttttgtatttttagtagagatggggtttcaccatgttggccaggttggtctcaaactcccgacctcaggtgatccgcccgcctcggccttccaaagtgctgggattacaggcatgagccactgtgtctggcctgtaatattcattcatttattcattcattcattcagccaatattatcaggcatgtattatatgcctggctatattcccagcactaggaacacagcaggaagtaaaacatggaaaattcctgctcttaagatacattccagtggcgtggaaacagattataaacaaaataagtcaaatacatatgatgcaagatggaaaagagagtggccggcccatcgttccaggaggcactgttgagagcaaggctcctactaagggatttcctagagttgggccttctagaacattccgcagctgtcctgggggatggagtttgctgcaggactcctcagtctgcaaacaggtcatctacattttggtttgggatttttttttattgttttggttttgttttgttttgctttgttttgtttttggagacagagttctcaccgtgtcacccaggctggagtgcagtggtgtgatctcagctcactgcaacctctgcctcccaggttgaaacaattctcctgcctcagtttcccgagtagctgggattacaggtgtgcgccacgacacccggctaatttttgtatttccagtacagacagggtttccccatgttggccaggctggtctcaaactcctgacctcaagtgatccacccgcctcagcttcccaaagtgctgggattacagacgtgaaccaccacgcccggcctttttattgtttttttatcacgatttacctacattcacagacacctgcccctcaacaggcattagtgggaagatacagaaagaaattctacattgctctcaattgtaggaatgcaaattaaagcttccaaggaactcgaagatgcacaaaccgtttcttgggtggcattatttcctcatagaaacatgcatatactattcattttcttttcaaaaaagatgagggtaaactttagctcagtctctctgaataaacatatcagacaaacagaattaatgagattttaatacctataatttctcaactctttaaaaaggttactaaaagggtatgaaagttatcaaagaccactggggttgcatgaagaggactcagcagccaacttaaaggggctcccatgggccccaaatgggacaatctgagcatcaaaaatcatgtatctgtaatggaatgaaatacatcaaataagctaaaatccaagagtttatattgattcttgaaaaaaatcacctttggaggacgttaagaaaccatctcagctgggtgccttggctcacgcctgtaatcccaacacttcgggaggccaaggcaggaggatggcttgagcccaggagtttgagaccagcctaggcaacatggcaagaccctgtctctctcaaaaatttgaaaaaatcagctgggcgtggtggtgcacatgtgcagtcacagggaggctgaggtacgaggagcacttgaccctgggaggttgatatagtttagctctgtgtccccacccaaatctcatcttgaattgtaatccccatgtgtcgagggagggacctggtgggaggggactagatcatgggggtggtttcccccatgctgttctcgtgagagtgagggagttctcacgagacctgatggtttaaaagtggcagttcccccttcgcatgctctctctctcactctctctctctcctgacaccatttaagatgcgccttgtttctccttcatcttctgccatgattgtaagtttcctgacgcctccccagccatgcagaactgtgccaattaaacctgctttctttataaattactcagtctcaggtagcatcttttttgtttgtttgtttctgagatggggtctcactctgttgcccaggctggagtacagtggcgcgatctgggctcactgcaacctccaccttctaggttccagcgattctcctgcctcagcctcccaagtagctgaaattagaggcgtatgccaccacgcctggctaattttttgtatttttagtagacacggggttttgccatgtcggacaggctggtctcgaactcctgagctcaagtgatccgcccgcctcagcctccgaaagtgctgggattacaggcgtgagccatgcacctggcctcaggtagcaactttatagcagtgttagaatggtctgatacaggtggaagctacagtgagccgagattatgccactgcactccaacctgggcaaaggagtgagactcttgtctcaaaaaaaaaaaaaaagaaaagaaaaaaacaaactcagtctgtaaatggtatagaaagggaaagaaccaagcaaataaaagcatctaaacacacacggctcccaggatcctaggatttcacagtggctgagacagcaggatacgtgagggcagggtacatgacagcagggtaaatgcagagagctaaagacaggtatcgttgttttggctgttgctgccactgctaagaaaattattccaactttcagtaacactagctcttctctactgacaggtattatgtgccaagaacttttctaagaacttgtattttctcatttaatcctcgcagcaattctgtgagatgggtactagtgttttctaatacagcctttgggtttaaatactggctccaccatttagtatccctttctggctgtgtgatcatcacaagttacctaacctctctgtgcttcagtcttctcatctataaaatagagatcatctcaaccctatctgtaatacagtcaggaagtctagtacaatatttgttcaggtgatttttttttttttttttgagacagagtcttgctctgtcacccaggctgagtacagtggtgcaatcacagctcactgcagcctcgaccacctgggctcaaacgatcctcccatctcagtctgccaagtagcttggaatacaggcacatgccaccatgcacggctaattatttattatttttagagacagggtctcactatgttgcccagactggtctcgagctcctggactcaagcgatcctcctaccttggccttccaaagtgctgggattatagacatgaccactgcacctggcctgtacagattatttgatcactgtctacttccctttctaggcgtcatgccccaagagggcaggggccacccctctatctccagaacctagtcctcgccttgccaatggtaggaacccattcaatatttaatgaataaacaaatgagtttacagtaggatacagtacagttgaaaaaaaccactctagttcaaaccacggccaatagctggagttgcacagctgaagatctgcttataattcctcaaccatcgaggggcccatcatcttaagaacctccaggctctggggaactgaagcagcctaggaacgagcctgctgaacccccgagggttttcagtaaagaggctgccaagttcggcagctagagtttaaccagggcgagctatcagtattttgtattttggacacttgccctttttattacgagaaactgacacaatcacagtccctagtgtgttctaggtttcggtactgaacgacacaagatgtgcgccagattgagcgcaggaagaaagaaacaccctttagtgcaatacgaaatgtgactcagccagcggggagcgttagttattgatggaatggctgtccaccatcgagtcactatgcaaataagtgcttttcttgcattatcccagttgattctcccaacgaccctctgacagagacaccatcattcctataaattgcagcgcccctaggtagcttgcccaaagtcccacagttaggaaaccatacaaccgagaattaagcccgaatgtatcagaaatcaaaatccaagcacccaaccattcaagggtgagcccttccaaaaaaaatttacagaaacaaagttgatggttgtttctttgtttgtttgtttgtttttgagatggagtttcgctcttgttgcccaggctagagagcagtggcatgatctcagctcaccgcaacctccgcctcctggattcaagcaattctcctacctcagccgcccgagtagctgggaccacaggcatgtgccaccatgcctggctaattttgtgtttttagtagagacggggtttctccatgttggtcaggctggtctcgaactcccgacctcaggtgatccgcccgcctcggcctcccaaagtactgggattacaggcgtgactcactgcgcccagccatgtgtttgttttttgaggcagagtctcgctctgtcgcccaggctggaatgcagtggtgccatctcggctcactgcagcctccgcctcccaggttcaagtgattctcctgcctcaacctcctgagtagctgggattacaggtgcccaccaccacgcctggctaattatagtatttttaggagagacggagcttcaccgtgttggccaggctggtctccaactcttgacctcaggtgatccacccacctcggcctcccaaagcgctggtattacaggcacgagccatggccagctcgaagttgatggtctttatcacacactttgaacatgagcaacaaagatttaccagaatcacaaaagatttttaaggattttgtaagaaaaggtcaatgtatgaactaaggtcacttgctatttccacaggcaatatgtaatgggtgtgacaactccaattggcgttgtttcacacacatgagaatgcgtgtttgggtggcacatacaaaaccctcagtcttcccatcttgcagcccagctagcgaagcagtactcaaagtgtgatccgcagatccctagaggtccttgaggcctttgcaaggcatctgtggagtctaaactatttgcacaatgacactaagacagcatttgccttcttcagtgttgacacttgcagtgacagtgcagaagaagccatgggtgaaactgctagtgcctgagcaggtcccgatgcagggaaaccaaactgcactagccctcagcttgtccttcactaccccacacttacgaaaggaaaggcagacagcttcacttaagaatgtccctgatgggccgggcatagtggctcacgcctgtaatcccagcattttgtgaggccgaggtagggagatcacctgaggtcaggagttcaagaccagcctggccaatatggcgaaaccccgtctctaccataaagacaaaaattagccgggcgtggtggcacacatctgtaaatcccagctacttgggaggctgaggcaggagaatcacttgaacccaggaggcggaggttgcagtgagccaagatcacaccactgcactccagcccgggcgacagagcgagactctgtcacaaaaacagaaaaaagaaaaaaaagaatgtcccagatgaagctgtcaacatgaatgattggttaaatcgcaagcttgagtaggtgtcttctgaatagtctgagtgatgaaatgagaagcacgcctacgacgacgctgctgcccatcaaagcacagcggtcctggagaaaagcagctgtgcagctgtttggattgcaagctgaactggccacctttttggtagcacattatttacacgtgacctacagacaaaccacggtcgttcaggcttgagtacgggcagaccattcctgggaatatgaatgagtctgtcgcttcaaggaaaataactgacagtatttgccgccaatgataaaaaattccagttttcaagtagagttttggaaaacttacatcagccactgtgatgaactcaacatcttcagactattagactttactgacgtcaacatgtggaagagctgcatcattcaagagaccaatattttccaaatgactagtgcatgacgttataaaatcacacctgggtaaaaacccaacagcatttaatataatagtgtacaaaaaaagataataaaatttcagattccatattgcaactaacatttaagaaactaccactcaaaataaaaaatcagcggggtgtggtggtgcatgcctgtagtcccagctacttggtaggccaaggcagaaggatcacttgagcccaggaggtcaaggctggagtgagctatggtagcaccactgcactccagcctgggtgacagagtaggaccccatctcagaaaaagaaaaagaaactactactcacttgttgaatgtttctacagaatcaaagaaaaatatccagaatcacataaaaaggctatgaaaatgctcttccaactaaagccagattttctacacatttttcaacatattgcaacaaattgaatgccaaagcggttaagaaaattcagcgaacacacttaaaagtgttttaacacggtagatttctgttgtgtacattttatcactcaaaaaacctcagccgtgggtcgggcgcagtggctaacatgctgaaaccctgtttctactaaaaatacaaaaaattagccgggtgtggtggtgcgtgcctgtaatcccagctactcgagaggctgaggcaggagaatcgcttgaacccaggaggcagaggttgcagtaagccgagatcgtgccactgcactccaatgtgggcaacaagagggaaaaaaatccaccaaaaaaaaaacaaaaaacttcaaccgtttattaatccagacattaaagagatttgcaaaaatgtatggcagtgccacccttctcatcaaattttttcattttacaaaatatagttacttttataaaaatgttacttacattaacatgcaatgggtgaaatgaattactattttgaaataaatttagaaaagatttttaagcttctcagtttgtttcaatttctaatactgtaaatatcaatagacaacctatataaataatgcacataagcctgggaaacatagggagacgtcatctctacaaataatttttaaaattaggccgggcatggtggctcacacctataatcccagcactttgagaggctgaggcgggcagatcacttgaggccaagattttgacaccagcctggccaacatggtcaaacaccatttctactaaaaatacaaaaaaaaaaaaattggccgggcatggtggcatgcatctgtaatcccagccacacgggagactgagacacgagaattccttgcacccaggaggcagaggttgcagtaagttaagatcacaccactgctctccagcctgggcaagagtgagactccgtctcaaaaaaaaaaaaaaaaaaaaattagttggatgtggtggcatgcgcctgtgtcctagctactgaagaggctgacatggaaggatcatctgagtgcaggaggtcgaggctgcagtgaactgtgactgcacactgtactccagcctgggcaacagaggaagaccctgtctcaaaaagaaaagaaaaaaaacctacagaaacaacaatttctactggattagaggaaggcatataagctaggtgcagctatccctgactgtcggggcccagcatttcaccctgtttcccagcttctgccctctaggtcacactactgccaccactactgctacaactcattctgcctccactgccaccagcagcctctagcgggtttgatgttcccacctatcccagaacattgagccttcccacttaactccgcagaaaggatgccaggaattttttacaagtgcaatgctagcaaaggctggggaaaatgagacaaaaaacctgatttccaagagcagacaagttttacaaggggcagtcttcttcgctgaagttgactaaaatttagccacgggttggcttggctggtgtggttcactgggtacatccacaagactacaagaatatcactgctgtctgcagtcttcccaggggaggaccaccctacccttggcccacaccacggatggcggccccacatccaccctctgatgcagcccagtcccttcccttctgttccgcggcagcaccggtgcctggccacttcccttgccagttcccttcctgtttcaaaaactctcatctcttcacaaaattccctccagggatgctagttcctgttggaaaaggtcttgaggtgtgtcacaggcaaagtacaaatgatatgcccagggccagatggatgacaggcccctaagctcagctagtccagagtcaggaggggacctgcagaattctaatggtgaatgattacactcttacagttttggaattccagcaaaaacaccaatactaaaatcaccaaccaagacaaagacgagacttacggcccacgcaggcttctgcacactctgtgcccagacatggacagattaatgtgggttggttggttggtttttttccaagattactattccacagcaaagtacataggcaacgctgaccaatatgcagaaacataattactatctcaccaagctggccagaagacaaaaatcttgaaacttcttgacttgctctaattgttccttctccatgtttcccttccttaggcattctacctgaaaagacagccctcccttccttcttcatcccattggcaattcagcaaaccttaaccttctcttgctttaccagaggttacttctactcgaaagcttgtcttcagaattaacagctgtgtccttgtcactgtaagccaggtctcaaagagcctgaacaaatggtcactgggggcagcttgagtgtcgactctactgctgttttctgtctcccaccccagctgtggaggggaactgtgtgcctcatctcatctctgccatttgctatctgagaggctgtatttccacgtgcataacagatcctgctcaagaatgcaggtcaaggctgggcgtggtggctcacgcctgtaatcccagccctttgggaggctgaggctggtggatcacctgaggtcaggagttcaagaccggcctggcctacatggtgaaaccccatctctactaaaaatacaaaaattagccgggcgtggtggcgcacacctgtaatcccagctatttgggaggctgaggcaggagaaccgcttgaacctgggaggcagaggttgcagtaagctgagatcacgccatggcattccagcctgggtgacacagccagactctgtctcaaaaaaaaaaaaaaaaaaaaaaaaaaaagaatgcagtgcaggtcaacacagaatttccaagcaaggagactgagctctgctaacgggttagcatcccagtggcaagggttgcaggcttaggtggggacaagctaacgggggaaggaaggggaacacctgagcatgcaactgaaccccaaaccaacacctggctagggttctgtcagctggcaggcccgtgctcagggttaatggggcgcccagatttccggcatgagacaggtgtttgtttgcagaggctaacgcatacagaatgcctccgtccactgtcggtctgtcggcccaccagacagggtctacataggaactcctctaaggcaaaggtctcgatcacagaggtggccaacaggtgacaatctgcccaaatgcataccagcgggtctcctccccaagttgctccacaagcataaagtttggctggggaaaaaagcttttttaatttctgcatctgacaatgtgatcactccctggtattcccctcttcagagatatgaccatgggtgtggatgagagcggaggagcatcttcattctgtcttcctaatatttacacgggaaaagaagatgcctgtagatattttctaacagtttcattttctgtctttgtgaccctgtatctatgacaggaaaagccaacagctcgagataacacgtctcaccattttttgcttgtggcccaaggcagaatacaacagccacggttccctcaggcctagcggtttcatcccaaatgctgtggaaggtccctcaccttaatcagaccgtttcttcattttttttttttttttttttttttttttttggcgacaaagtctcgccctatcgcccaggctggagtgcaatggcacgatctcggctcactgcaaactccacctcctgggttcgaacgattctcctgcctcagcttcccaagtggctgggactaaaggcgcctgcgaccacacccagccaatttttgcattttcagtagagacagggtttcaccatgttggtcaggctggtctcaaactcctgacctcctgatctgcccacctcggtctcccaaagtgctgggattacaggcatgagccaccacgcccggcccatttctccatatctttaataactgtccctcacacttttttttttttttttgagacagggtctcattcttgtcgcccaggctggagtgcaatggtgcaatcttggctcactgcaacctccgtctcccaggttcaagcaattctcctgcctcagcatcccgagtagctgggattacaggtacctgccaccacacctggttaatttttgtatttttagtaaatatggggtttcaccacgttggccaggctggtctcaaactcctgacctcaggtgatccgcctacctcggcctcccaaagtgttgagattacaggcatgagccaccatgcctggcccctcactttttagattatttccaaaatcctagcagtatgctaaaaattcctgcaaccttctcccagtgactggccaccctagataagatttctcacactcgtacaccccatctgctgtatccccttcctgctttatgtttgttcacaaaacactttttctattttacttatttatggtttgactcccctgttgtcccctctattagatctcccctatttgaaggcctggtttttgtttcttagagacagggtctcactctgtcgcccaggctggaatgcagtggtgcaatcacggctctctgcaacctcgacctcgtgggctccagcgatcctcctatattattgacttaaaaattcttgtcccctattacaagagcaggaattgttgtctgttttgtttacggctgtattgccagaacccagaaccgtgcctggcacggagtaaatgatttgctgaatgagtaagcaagccaggggttccgggcctctgtactctgcaagtccatcctgcattctccattcataccatagcaacttcaaaggcccctcacccattcctgactccacattgtcgccaagtcacttccagaaacttaaaatgccatttcccattcacatggtcaagcccttcccctcctgccagtcgtttgtttaaatctggcttgcagtcccatcaagctgctcttcctaatgccactcagatcccatcacctccatcactgctactgtaactttggattgggccaccatcacccctacctgggatttactcgacacctcattaatctctttccaacccacactcactagctctgaaagagtgaactttctaaaactgcaagtcagatcacctaagccccctgttgagtggttccctgacacctatggggtcaaatgcaaactccttcccacgctacccatggccttccttgtcctgatgaacaactaacaatcgtccgcccccacagagaagcacagggcccagccatacccacctctccgctctgccctggtgctcttctgtccacctggagagccacagcctgatctcaggacccagctccagcaggagccccctctaaagcgctccccactcccgaacatactccacaacatttttaactgtgagctcacggaggttgggaactattaacgcaggtcagacgcgccccaaagtggggccgagcccaagagggttcttggctttgcccaggaaataattcaagggtgagccggtggcaggaaagaaaacacctttattgaagaggcaggcagtgttatacggctccatgactgctcctgcagagctgggctttcccaaaggcggaaagtagcagctcagggcagttttgcaatcatacttatacctacttttttttttttttttttttttttttgagacgcagtctcgcctaggctgtcgcccaggctggagtgcagtggacatgatcacagctcactgcaacctccacctcctgggttcaagcgattcttctgcctcagcctcccgagcacctgggattacaggcgcacaccaccacaccaggctaatttttgtatttttagtagagacggggtttcactatattggccacactggtctccaactcatgaccacaggtgatccacccgccttggcctcccaaagtgctgggattacaggcatgagccactgcgcccagccttaccttatacctacttttaatttcctgtagagtaaaggtaggcttaggcagacacttctaggaaaagggtggtggcttttgggttgtcaggtcacggccatggaaagaggcagtaactccgggtgtggccatggcgacagtaaactaacaaggcacactggtgggcgtgccttgcagaacgctgcttctgccccatccctgtatcagctagtcctcaattcggtctggcatctgaaccccgcctctggagtcgagtcccacctcctacctcacgatcacggatcctgctccacgatcacggatcctgctccacatccacagtgccaggtgcacagtcagtgccaggggcacgacacagatttcagagtgaaggaatgtgcagaaatcatgaaactacccttctgcaaagcctgttcggataaatttgaatgagaggagcttccttctgtgctcccaggctagttctagaagccccttctcattctatggatgcccattcctgcagggccgctactggctgctttttaaccctgggatcagaaaagggggtaagagggaaaggctaatacacccagtattggggttttttttgtttttgttgttgttgttttttaagacagagttgctctgtcgcccaggctggtgtgcagtggcgcagcctcggctcactacaaccttctcttcccgggttcaaacaattctcctgcctcagcctcccgtaatacccaatattgtatagagaaaacatctgccaccagcccaaaggcagaggctaaaatcgatcttacatgtagataagcttaactatgtgtgtgaaagggtcttctacaaactgtgctgtcatctcaatttagctttgtaaggacagtttccaaaagggccaggaagttgtgtagacatactctattcctggagtcctatccacaaaggtttgtaaaatgagctcaagaaaacaaaatcgtggtctcagagaaagagctaaaggaaagaatatcacttttaaaaaatcagcagctaagctaagccttctatcttccctactccctacagtactaaaacttttataaatatacaatgtacacaaatgtcaagaaaagttaatttaccaaatttacactatttgaggtttaaaaaaaaaaaaacacaaactcactctagcattttttttttttggctctgtgtctgagacccctgatctacaaacttaaaaataaaactactcataaattcacaaaataggtattcaatgacttggcaatttccaaacatatttaataattacaccctcttcatttttgaaattcgagtaatacagcatacaaagtacagcttacaaaacgttctcattgtcctctgggccaacatatttaatttaacgtactgccgcccagctccaccgtcccacagtctccaaggacagagctcacaacacctgggccctaaaaatgccaaggtggcaagcagggggttacacccacagccccgtccactgacaccttcagactcaagagcgagtgccaccgccctaaacggaaagacactcatcacggcagcatctttcaagtgaacagaaagtgtagtttctgaccttgttaacatagtccttaaagtgctctaggttaggggaattctcgggtgaaaatagttttcgtctacatccataaaatcttcaacagcaaagttagtaaaataaagaaaaatcagaagaaagatgatgttcccttgccagagaacaaatacataaaagatacaggagctcagatcacaagccagagaaagagaatgccaactggacacataggatgatctcacaccaacgacctatgcaggccctacctcaaccactggacgtctctgactgacactattacttctgccgtctctgattgaaactattacttctgccatctctgattggaactattaattacttcttccgaggattccctttcctgaggcttttaactgtttaagtatgcagtgtgtggggaccacaaaatacaatacagcttcacaaaagcaggcttttaaaaaaaatcagtgttattttctctacatacttccacaacagatgttcccctcaatcctgaagattttagtaaaacataaggactgtttaaaaaggaggaagtgggggaagaaatgtagcagattacttaaaatctttctttttcgtcctacttattttaatatcattttccagatctcaaagacttttgtcctatattagaaaaaacaagcagcccagtaaaaacatcaagaatagcagtaaggagcttcaaaccagggaccaggcaccagatccaaacctgagaggatgagggaggggaataccagctctccggcaggtacgtttctcccttccaaatcacctggtggctggagaagctcaatatgaagctcttcacttaaggcaaatactatgataataaaatatccttaaacaaatgatggctgaaagctgaaaatgcaaactttttttaaaaaaaaaaaaagacctagataaaagacagtgtgtactcagaggtaagtaactccgtctaattctccagagacctgcaggactgcgccgacttcctatccctattttgaggataagcaaagtgaggcctagagaggagaaagattttattctccacgttttcgcaaaaagggcagagagaaacatttggatgggacttcagggtgaccaaatgaatgcaaaggcaatttccttaagtgctaaacagtgctgaatgctgaagggctccatacccttacattcaccggacgtgcccccacatttcagccaaccagtggttatgcacgttcaaagttctccttccttctaaaggtcgcgtctaggtcatctctgcacagcgtccctttctgcagtgtgaacagatctgtgatatttgacccgctgaaagaaaagtcacactgaccctgagatccccccatggtaaggcattctgagatacctgagctgtctgcagacactgaggctggaagcttttttttttaatttaatacaatcaggatcagggaggggggatgccgaggtaaagcagtgcacatacctttcaactggtcagcaaccacgctctggcccagccgttcaataactttcccatcttccatttcgtaccggtcatctaagtattttgcggtggcctcagaaatgtgaactttgccggccactcccagctgctccatgagattggccaggttcacatcgttggaccacacgtcaaatttaaacctcctcatgcccaggatgccgcaaaggacggtgcccgtgtgcaccccgactctcatgttcaccatctccttcttctcctggcagaactgctcgatggccttgatcatgcccaggcccatctcgatgcagcagtaggcatggtcggcccggggctcgggacagcccgccacgcagtagtaacagtctcccagggtgctgattttctcacacttggtctcctcacacaggcggtcgaagcgaccgaacagatcgttcaggagacccaccagggcgtgggcagacttgttggcactcatcttggtgaagcccacgatatctgcaaataaaatactgacttcttcgatctgctgcatcttaaaagggcggaaggctataggagctttttggatggaagactttttcttcctgttcttggggctcgaggtggcatgcctcttgacagaattctcactctcctcatctccctgcttcattaagtcatcggctatgattcttggcatcacggaatgaatcatcctctctttgagggctttttccacttccaggtccttcccgtgcataatggattgccccaccttgaggaaggtgctcctggacctcacctgggacatgacgaacaggtggaccccgatggcgtggatgcagccgtggagcagccccctgctcagcagctcccagtgcagggccccggctccgggcgaggggaagcaggcttcatcccggaaatggtagccaaaggtctcgaaaaggacagagtaggccacccccagacacaaactcaggtacaaaggtaagtgcatgacggtatagagcaaaaagagcacttcgatgcacatggagaagctccccacttgagataagcaagtatctgtgggccgggctgtggccgtaaggttggagctgtcgccgcgtcctgagacaggcgtcaagacctggaactgcgcagccagggtcagggcgaacaccagcagggtgagagccagcgaggtccacgcgtaatgccgggcgtacagcttggtgaaggtaaacagaaagaagcccacacacaccaggaggaagcacagcgcgggggcgaccatgacgatcagtctggatctcatgtggaccgcaaaatagatgctccacagaaggcaggcgaagccgatgtagaagagcgcataccggaaccggcgctgggtctgcgggaagcagcgctccaggcaggcctcctccaggttcaccgagtcgaacttggggtcccaccagcggctggaggccctctcgaacagctggggcagcttcttctgcctgcgcagccggcctccgccgcccactcgccgggggacgcccccggagtccccagagctgctgcagctagaggagatgctgtatttgcagtgcttggggtggctgttggaggacagctgcttggggttgatcttgacgcgcacgctgttgctgtccccgctggagtcgcagctcacctcggtgctgtggtgatgcagcagctgctggtggggtggggaagccatgttgtcgagtcccggggcctgccccggccggggtcaccagtacctgccagcaaaacggggagagttagcggcgctcccacctaggcatgcacgcctagaggcccgggacctgctcctgtcctaaggggcggctccagcacgcgacctggacaggcaccatctgttcctgtggttcccggctcagcggtgctcccaccgcccccaccgcccccaccttcgaggcgcacgagaaccgctcgggacggacctagaacgcccgggggtccccgccgcgtggccgccgtggctccgggaccgctttgctcgctcgccttccgcgcctctcgccccgagggtggcctccgcgccgcgcggcttctcctcctcgcgcgctcgcctcctccagctgcggctccggagggaagttcagaccttgagcgctcccagccccgcgagccgcctgcgcacaaacaactccgctggcggcgcggagccctccatcctgcaggagccgcgctccgatgcgtcaaaggcggcgcgcggccggccccgggcccggaccccgacccggagcagcgagcttcggcgggcgcccccggctcgcgctccccggccgccccccgcgctccgggccggccctgcccgcggcggcgggcgctgggggtgggggcgccccgggctgcgagtgcgcggagcccgtcggcgcggcccgtctagtggggcctgcttccccccgagtgcgccgccgctcccgccgcggccgc

SEQ ID NO: 855 - DNA, 59562 bp, Homo sapiens
ctcgggttaagaaatacctttaaatttaggtaaataaagctcaaggaggtggggctgtcatctgtggtgtcagtccttctggccccctggctgtcagtgtcgctccagggccttgacaagcagctcattcaagcggcccaccatggccctagggtcgtcaacaagtccagcagcaatcatggcgttctcgtatatctgaaaggcaagaggagaaacccattatgaggggcatggggcaccttttcatttttttttttttgagacagagtctcactgttgccgaggctggagtgcagaggcacgatctcggctcactgcaacctcaggtgatccccccgcctcccaaagtgctgggattacaggcgtgagccaccacgcctggccatttttccgtttttaaaacagaatttggctgggcacggtggctcacgaggtcaggagattgagaccatcctggccaagatggtgaaaaccccatctctactaaaatacaaaattagccaggcgcatgcctgtagtcccagctactcgggaggctgaggcaggggaattgcttgaacccgggaggcagaggttgtagtgagccaagatcgcgccactgcactccagcctggcaacagagcaacactccatctcaaaaaacaaacaaacaaacaaaaagacaggattttagaggaaaccgctgttccaccctgaaggcaggctggcagggctggtagcctgggtccctgcagtcatcctaagctgctgcactcacctgatccaccagcagctgagccaggccaggctcgcttgcgcgcagctgattcagcttcttgatgagcgcgtgcctgcaacacagaacccaccagaaaaagcagctcagtaccacgtgctgtgaccctcccttcatgttttgggattatcaggatatttaaagaagcacagtaagactgtctgtagttttttaaataaggtatgttaatgatcatttatagataatatcattatatacccagaaaacccaagagaatcaggagtgtcagtattagaaaatgctgtaaggtagccaaactccaagattaatatacactaaagggacaaaaggagcttagtacgtgaagacatgccttggttcctagataaataataaaagagaagggagtaagacccacatgttgaaacatattatagggctctagtaaataaaacagtttaggtctggaaagggggaaggcaaacaactccatgtaacgagggtggacactgagtgtctgatgaggacagtatttcacagaagagggaggagacagatcactccatccagcagcactgggatgactgggagccatgcagaaaaccatttagaccagagtaaattccagagggatcaaagatgacaagcacaattctagggaagaaatgtttcatcatctcagaaggggaaagcctttccaagcaaaaccacaaaccaaaaagtaaagaatgattgacatatttgacgtcagaacaatatttttttctgcataggaaaaagcatcatgtagtatttaaccttaacatgaatattataatttttcacttagaagtctgataaaaccgagggctctggggaactgtaaatttgtacaacctctccagaggacaactggagtcgggaaaaccacatgtggatgatatgctgagactcagccattccatttcctaactgcatccctttaaacacttttttttttagatagatagatagatagatagatagatagactctcactccttcacccaagctagagtgaaatggcatgatcttggctcaccgcagcctcctggtttcaagaggttctcttgcctcagcctcccaagtaactgggattacaggcacccaccaccacccccagctagtttttgtatttttagtagagatgaggtctcgaactcctgacctcaagtgatccacccgcctaggcctcccaaaatgttgggattacaggcgtgaggcaccgcacccaacctaacagaggaaacacttcaaatgcacatcctcacatttctagtctacgtagctggaaaaaaaggacattcttaatatgctaatgtggaggtcacctagttaccctaagggagaaaagcaaggcaaggacccactgcacagcaagttcccccttggaagcccacgggcgcagctgcccacaaatgcacataatctctgcagaaatacaaaagccctaatgctggctgcactggggacacaggtaggaggaaattttcccctgtaagcagttttgaattctgaactatgtggacagaacaccaaattttaaaacaaatgaaagtgaagctggctgggcacagtggctctcgcctgtaatcccaccactttgggaggccaaggctgcagtgagctctgatggcgccactggtacactccagcctaggtgacagagcaagaccctgtctccaaaagtgaagtggcaacagacagaaacgagcacttctgcagctatctcacaaaactagtttgccaccaaaactagttaaagtgacctggtgtccgcctcactgagctgctccagcagaggcacaggcattctgcatactggcgctgctgtgcactgacagccataagccaagtcagcctttccccaggagtgccatggctaggaagatgcatctccctcgcctccagtataattttaaaagttatggttgtaaaatgacaaaagaaaaaaactagacatgtactaaagaacaaaacaaaaactggctgggggtggtagcccacacttgtaatcccagcacttcgggaggctaaggcaggtggattgtttgaggccaggaggtagaagttgcagtgagctgagattgccccactgcactccaacctgggggacagagtgagaccctgtctcaaaaattaaaatactacttaggctacattgtggggggggtggtaagtctatggattttgatttcctttttgctgttttctatttttggtaacatgtttatgtaacttcattttttaaaaaattgctacattcaaaatttcccccaaaaaagaaacttcatatacaagttagttcatatacaagttagaaaatgaaattttaaaataccccataagacacatcaaagaataattctttaaaaatggtaccagaaccctacagagaatgtaaggtaccaaaggatgttaaagacctaaatagatcacattcatgggtgcaaagaagtgatactgtaaaaagaaagaaactcaaaagatacctaaaggcaggtgaaaagacatttacaacagataaagggcatataaagaacaacaggaagaaacgagggaaatcttacggctcagccactgtcagggctggggggttctcggtgcaccctggaagcagctcccaccaccggggccacagagaaacccacacaagccccagacacgtggacaagaatactcagagcagcctggctctccacaacttctgaccaagaaccaccggaggcccagcagagcagaacggagcagtctgctgtgccgaggtgggtttctgcagcggacattattcggctatgaaaatgaacttgtggcagcccctctgcatgggcaaccctcatgccaagtgagcaacgtgagacttcagcaaacaccaagatccacgtacaaagctcaaaacaggcaaaactgagcatgtccaggacacgcacaggtggcaaagccataaagcaaaacgaggacatggtcacaggctgggatgtggctaacctcccaggtgacacctggggatggtaaggggctggccaggttccatttcacatgggtgcagcctaaactgcatacagctccttatagttacccacatgtccacaggcctcacgcacttttcttctgtgtcacattccacaacaaaagaacaccacacacaggattctggggaatcccacaggctggaagagccaggagcgtggcctcacctggggttgatctccagcgtgggctgcaggagctgtgcgcgctcctcctgggtcttggccagctgctgcatgcgcaggaagtggcgggcagcccccatctccagcacggtgaccatggcagggtgggtgtccagtcggagggtcacctgtgagcaaagcccggggttgagggtgatagaggttcccaatgtgagagggctggcaggatcttaccaggggtgaaggtcacccagaccacgaggtagcaggcggggtctcaaggactcccctggaccagcgctgctccctccccattacccactaacttgtgggccctgagctgatgccccacgcaaagatactgtgcccgaggggctccaccaccctggtgccccgctgctgcctccaggagctgcccgaatccatcgtcctctgctccatgccagcccaccctgcatgaggccccttcctccaagtgaccatgcatgggacgctcatttctcactctgagctagacaggttggtggggggagtcttagctctctgaagcccacccaaaacccccgactaagcacccaagtgagcatgtgagctcctgagggctggggtagcatgtcccttgtttggaacccccacgtcctcagccattgcagctcccactcaggatgctggtttttcagttctcagttcacacctgctctggagcagggctgggagaaagacacggccttcctgcctcagcggcactcccgagcaacacgtgccgagcagggacccacagggtctccacctgacaccaagggcttctgctgctgctggaaggacacccaacgggccaggtactgggagccaccagctggccagcctgttagggacactgcggccaagtggtggtccatccccgggaaagcctcaccttcacgttggtgacacgcgaccccagcacatttctcatccaggccatgagctcctccgtctccttctctgataggcactcggcggctgcggaagagcaggcgacagggagctcaggcctgcatcccaactccccggcttccatgggggccacgcagcatgcttccagctcccacctcctctcccaccaggatggagacacaagctagcaagatgcttttcatctaaaagtaaaacctcaaaggatgcttcaggttgcctgaggcccatacaacttggttagggctttaaaaaaatacacagcctctcaagaagctgggccagctccagaagccaccgtggcaggagcactggacagacccctgatatctaaaccaggaggcaccttcctccagtcaccagggtgctcccacaaggctcttctcgggggtggctgagcccaggtcaactgacgaaaacccaaaggaagccctcgctgcggggcaggagaggcgtgcggggagtggaaaccagccccacgcctagagagcaggggatgccgacctggggacctgtcctcaaacttctcctccttgtagtgatccacgactatgtccgtctccacagagatcagcttcttcttgtcaaactcacgaaggtgcagcagggtgagctcatcaaactgctcaaagcagaagagaacctgcaggtggccaagagcagctccatcagaccccgggggcctccagccaccacagaagaaaggatgagggcggcaggagggctgggggagccaagcgggccacactggggaacaccggggcagttggggttcctaggcctgcatgacagttactacgacacctgggtctaaggaaggctctgactgccttcaaggcagaagcactccacgcataaagaaatccacatgtggctgagtgcagtggctcacgcctgtaatcccagcactttgggaggccaaagcaggcagatcatgaggtcaggagttcgagaccaacatggtgaaatgccgtctctattaaaaatacaaaaatttgctgggtgtggtggtgtgcacctgtagtcccagctactcaggaggctgaggcaggagaatgacctgaacccaggaggcggaagttgcagtgagccgagatcgcaccactgcactctagcctgggcgagagagcaagactccatctcaaaaaaacaaaaaacaaacaaaaaaaaccacatgtgacctccaagtgggaaacagccgtcacagtcggtccggcctctgtgcccgtgaccctgacccactgtgcagccctgcccggagtcttgggcaggttcacccagcacagagctgagaaggtcaagaccctccccaggttgcagcccccggagcccgccccacccaccgctcacccacctctgtgtctttcttcttcatggcctcatagtagggtgagtgctctgccaggtgacggttgggggcgcacaggtagtagatgttgcgggtgccggcccgcatgcggctggcgtattctgagaggctggttagctgcccggagggcagcgccgaggactcgtagcgcagcagctttgctatgtcctcctagaagggacggggcaggtcaccacttattccaggcccatgggctcaatgttgcccaactaactgggcgcaaaccctccgatgcccatggcctcctggcactccaggctggccctgacccgagggacggtagtggactcgggggttgtccgagagcaggccttgctctgcccatcaggccccttttgggagctctgggggcttaggaagcacctcctgccccaggtggcccaggggctctccagggagctacgcgcaccacgccctgggaggggaccccacccaacagcagagcccggcctggacccagcgtcttccctctgccctcagtgacagagtcagtctctggtgggcacacggacacgggtgaagtccacggttcccggccctcctcacagctggctatggcagagactggctttgcccagtgggtttcagtgggatttggagaagggcccttaggggaggggtttgccctcctccccatcagctgaacgcagctgtgacctctagagctcatgggagctgcagctggaaggacgcagggggaaaacagaaagagggaaaagcaaggagctggacacccaaccagcagggcccaggccacccctgcacacatggtgggtctgcattgataagacatgtcacacgtgcacacctacaaagacctagaaatgtctctgactcttacctgtgtgctgttaactcaaatgaagataaaggagaatgaagaggcctgtgtcagaagctgccgaagtcggcaaacaaccagaacacggcctccttgggaccccacacacgtggtcaccctcctcctgctgctggggagaagggacaccagcacgggatgggctcctgggatgaaatgttctggggttacagtggaggcagccacaccacactgtgaatgcactaaatgccactgaattttacgtgttaaaaggtgaattctgtgaatctgatgctatgtaagttgtatctcaataaaaaatggacaaaaaatgtttatggaacaaatgtttcgtttttcagccatccactattggattaactgaacgactggcccctgtagcatagtatttggagactgatatccagtacatgatgaatagtccctcaacagacactgagaccacccacttccccacccacgggatcggagtccttggcttgtcccacctgtctgtggctccccagcccccaacatcctctgaggggagacagtgtgtgcacgccctcttcctgccactccctgggctgcaccttcacacagcagtgaggctgagcccttcagagcacagcacagcactggtgggagggtaaggatgtgcctggaaggtgccagaggcccagaagcctggccttccatttcctgaccctggtggcagcagcagcagcagccagggtacccagctgcaccgtcgccacatcaggggacacctccaccagcttcctcagcagccccagggacaaggtggcccagaaaaaggcctggaacacagctcctataccttgacctcctgctcggtggcggtcacaatgccctcccgcatgaacaggccgtaatcttcaaaaaactttgcatacttctcagcatcttttttactctggtcaatgaagaatttgatcagcctctgctgtaaaacgtcccggagtttcctacagaaaagaaatgcatttaatacatacaagcagcctctatgaaatacaaatggccagagggtacgaaaaaatgttcagccccgctaagaatcaaagaagtgaaaacaacaaggtaccgttattggccaaactgaaaaagactgagcagaaagacagaaaccctgggcagtggccggacaggaggcagcagggtggagggcagacaccccctggaggcagtaggagaaccgatgcccccagagacaagatacccacgcccggaaaacccttccaacctttgagccagttgttccaattataggaactgcaccttaggaaacatgtgagcacaccaagatttatgtaccaggattttcactgtggcacataaaatataacaattatgaacaacctcatgttcaagaatataggctaaaattatgtaatgctaaatggccataaaaaaaaaaaactgcatcttttaataatcctcaatgacatgagaaagttagctgtgttgaaagaaaacccagaaaaatcccaatgtgggtaaattacagtacgtctatagatacaggcaaagaatgcacattctacatgtacataacaattttccatcattaggagcagcactgtatatactatatatgtacactgtaatttgggatttatactgaatatatgtatactctaatttttcaaaattgggattttagggatcaggatatttactgcagcattacataatggcctaaaattaggaacaactttatcactgggactagggatatttttattttcttcttaatatttagtctttcctttaagcaggtaaattacaatgtatttcaataatccagagcatgggaacaacactctctcgagttcatttagagcctttcctcccacactccatccccagtgactcagtccttcagccacagggcagaatgggacaggacatgccttcgtgcctgggagcggggggacagtagcccaggatgcggtgcagagcccagggaaggtgtctatgcagggccatggttgggaagagcctggtatgggtgtcagagcccaagaaccccagagaagggtgtccaggctgggggcgtgaccagcccaccgtgaagagtcagagcccaagtaggtgacagggacacccgcagaagagggcagtggcaatggtagattggttacatggagggggattggtcaaatgggtaaccgtgctaagaataatcaacggggcatggtggctcctgcctgtaatcgcaccactttgggaggctgaggcgggcggatcaccagaggtcaggagtttgagaccagcctggtcaacatggtaagcccccgtctctactaaaaatacaaaaaattaccagggcatggtggtgggtgactgtagtcccagctacttgaaaggctgaggcaggagaatcgcttgaatccgggaggcagaggtttcggtgagccaatacctcgccactgcactccagcctgagcaacagagtaagactccatctcaaaaataaataaataaataaataaataaaaataaaaaaattttattaatgatagcaagattataaactcttgaataaaacaggaaatcagcccatataaataaattataaatagtataaatataacacatcaatttttttttttttttccatccgacgaatcttgctcttgtcccccaggctggagtgcagtggcgtgatctcggctcactgcaacctctgcctcccgggttcaagcaattctcctgcctcagcctcccaagtagctgggattacaggcacctgccaccatacccggctgattttttttttttttttttttttgagatgagtctcgctctgtcgcccaggctggagtgcagtggcgtgattttggcgcactgcaatctccacctcccaggttcaagcaattctctgcctcagcctcccgagtggctgggattacacctgcctgccaccacgactggctaaaattttgtgtttttagtagagatggggtttcaccatcttggcaggctggtaactcctgacctcgtgatccacccgcctcggcctcccaaagtgctgggattacaggagtgagccattgcgcccagcctaatttttctattttttaagtagagacggggttttaccatgttggctaggctggtctcgaactcctgacctcaggtgatctgcctgcctcggcctcccaaagtgctgggattacaggcgtgagccaccgcgcccggccaacacataaatattttaagtaaataaatgaatgtattgagagtttcatgaagaatgtgacatttacatagcttcaaaatacctataacatctgttaattacaaagggaaggacatccttgtttgttggaaatgcaccccaaaggcatcgagaaggcaacttcctctcacaggattcgaggaaaaacatgttcttggtaccatgcttccaacttttaagcctgtgattctttcaaaagctctaatttcggctgactcttttctgatcgagatgagttctcagactgacaacgcaacctttgacaaccacaagctgggatgaggacccctgctctgcagcttcgggcactaccagtgggccagcatgcctgccacagccaggaatgcagctcccttactgagcaggaccacccctctgtgactcagtttccacaactatgagtgaggactcacggctcccctcacaggatgaaacacgtgtttatgcaggctcagcacagttctcagtggagaagaaatactcaggaaacacattcaggatggggagaggaacgcagccgcctcggcccgcagggacgccaggagctccctctccacagggcctggcccctgcctccacttcatccgtgagcttcccagatgaggccagacgtgtcctcagttcagtgggtgtcctttgccttatccagcccagggacattgtacctggaacctcccctcctgtggccactcctgggcagggtgatggggatggacaaggtggggacaactccagcaccagcaataataatccgggagtcagccccaagccctctcttcactgaagtgaactgaaacattgggcagatcaccagtaacccacaggcgcactcgaagtgcacagggtcagtacaccaaagagcacgactctaacgaccacagaacagtcgctgctgtggggcggggatgcatcctgttgaggtcagcacaactgctgccctgtggtcatgtcggcagcaagtcggggtcctgctgtcagaagccagcacggctgtgtggggaaacaagcactgaggcccccttttcattgattatataacatctctttagtcagcaaggaaaataccttttatatagttatatcttccgaccaagtaaccccacccctagtattctatcctaaggaaatacagctgcaggtaaagatttcagaacaggccaggcgcggtggctcacacctgtaatcccagaactttgggaggccgaggcaggcagatcacaaggtcaggagatcaagaccatcccggctaacacagtgaaaccctgtctctactaaatatacaaaaaattagctgggcgtggtggtgggtgcctgtatcccagctactcgggaggctgagacaggagaatggcatgaacccgggaggcggagcttgcagtgagccgagatcgtgccactgcactccagcctgggcaacagaccaagactccgtctcaaaaaaaaaaaaaaaaaaaaaaaaaaaagatttcagaacaaagataaacatgcactgcagtgtcataactgcagaaacactgagacagcccagctgtgcagccccgagggacgggatcagtaaactatggtacatccctgtgatgtcccatgatgtagcaattaaaagtgcttccaaaaaacaacatgggaagtggtgcaaataaactaggtagaaaaaaggaaacagtataagcaatatgaattcaattgcatgaaaaacaaaaacaggccgggcgcagtggctcaaacccgtaatcccagcactttgggaggccaaggcaggcggatcacgaagtcaggagatcgagaccatcctggctaacacggtgaaaccctgtctctactaaagatataaaaaatcagccgggcatggtggcaggcacctgtagtcccagctgagacgggaggctgagacaggagaatggcgtgaacctaggaggcgaaggttgcagtgagccgagactgcgccactgcactccagcctgggcgacagagcaagactccgtctcaaaaaaaaaaaaaaaaaaaaaaaaaaaaatctaagtggccaggtgcagtggctcatgcctggaatcccagcactttgggaggctgaggccaaaggatcgcttgagcccaggagttcaagatcagcctgggcaacatagtgagatcccaactctacaaaaaaatacaaaaaaattagccaggcatggtagctcacacttgtagtcccagctacttgggaggctgaggtggaaggattgcttgagcccaagaggttgaggctgcagtgagctgtgatcacaccactgcattccaacctggacaacaagaaagaccctatcagtcaaccaataaaacatcactgcggcttgcttggttgaaaaaagaaaaaaatctccatggctttctgcctctgaaggtgaggcaggaggatatcaccggcaggccatgtgacctcgcagggctgggcatggacccaccaggcaggaaaccacactgcccaccatctccccagacctgctcctgcccgcggcacaggacagaatctctgaggaccagtgcctctcggtgtgggcctctcgccatgcccacagcgcagccccaacacacaccaattacccagactcatcctttttccgaggatctgcttccatttcaacactggagagaaaccggtgggcagagaaacactgcaggcacgttgggggctccaacaaggcccgttccatggcatgctgcacgtggtgggctcttgagagacctccagggctccaaattccagctgaatcctcaccccacaggctccctctgaaacctgccctatgtggctgccaatctaccccaccctaaaccatcaacagcagtcatctctaggtgagagcacaggtcacttgaatgtgctctagtaaggaaatactacttgcattaggggaaaaaaagccagtaagcgaggttttgaataaagactatttggtgagcctggggccagagtggggaagtgatagctactgatggagaacctggagccagcacactggagtcccctccacacagggctggcctgctgcagggctgcagtcacaaccctggggcacaggtgggcaggtctggctctgcggcccctccccctatccagactccagcctcagccatgaccagccacccccaccttcttctggaccacaagcttcagaggccaggccagcacctggaaggctcctgagggcccccatgtgcaggccgggcttccccgaccacctctgctctcagctccatgggccacggctagggccctctgggggcaaaggagcaggtaggggccttgtccccagcagggtcctctccccgcggcccgaggctcacctgatgagtgcgctctcctgcagcagctcccggctgaggttcaggggaatgtcctcactgtccaccacacctgggagacacggcagtcagcttctcccggggctgcggccctccacaccacccaacattccccattaacctgccctttgtcttcaggcctggccttcaacccagcacgtgtgctaagagggaagcagggaggcggcactgccggagcttcctctacgtcctgccacctcccagaacagtgacctgggctgtgggtggccgggacagcctcggggtaacactcggaaaatgacagcctgggctttatgttaaaaatcacaactctggctgggcacagtgtctgacgcctgtaatcccagcgctttgggaggccgaggtgggcggatcatgaggtcaggagttcgagaccagcccggcaattatggtgaaaccccatctctactaaaaatacaaaaattagccgggtgtggtggcgggcgcctgtaatcccagctactcgggaggctaaggcaggagaatcacttaaggaggttgcagtgagccacgattgcaccaccgcactccagcctgggtgacagagcaagactcgtctcaaaaaacaaacaaacaaaactctatcagggatggttcgcacctctgtgtaccaaggcttaaatactgaagtctttcttaaactataatctcactcaaacgtaacacaactcacatatcaatctgaaactcagtatccctacatatggaaagacctcaatctgaacaccccagtgctccccccagatcagtcatgtgcgtagggaggtggggcagctcccggggtctgtaaacgcgactgacacacaggcagcgcaggccgacggcggtgctctcgctgcagagggctgctgagaatggaatcagcacggtccctcacagatgcagcgggcgacactgggccacgggggcactgctcacggactctgagcagcgtacctcggatgaagcgcagccacttgggcaggatgtccgtggccttggtctggatgaggactttgcggctgtacagtgcaacgctggagcccagctcccggctcacatcaaacatggacggtttctgggggtgaggagaacacgccatcatgcagcactgaccctccccaggcaggccctggctgggaggtgggggcggacacgatgaatccagagcccactcccgcctcgccctcccccagcgtctgctctgagttgaagcccagtgcaggggccccacgatgccccacactgtggctctgcaggggctgaaggccttctctggcagctgccgccctccccagcccaccccctaaggaggacacaagagagtgaaccttgcacgtacccctgaacacactgaacacagccaaaccttgctacaggtcagggatcagcaaagagccctccgaccagatccagctcactgcctacctctgtgtagcctaagagtggtttttacactttcaaacagttgaggaaagatttcaaaaaggatgatctcatgagacgtgaagatgaaactcaaatttcagtgtctacgcagctcatgggacccggccctgtgtgctcagagggcagcagggcagtgctgcttcctcacccggcagggttagtggctacgaaagacaccgggcccgaaacgctgggaccagctcctgtctggccctcgtggaacgtgcctgccaacacctgctccacactggtacttcccgaaccgggacccacacctcatcacgggatctggttaaaatgcggcgggtatctagttcaaatgttgggagacctggttaaaatgtggggcgacctggttaaaatgggggggatccggttaaaatgcggggagatcttattaaaatgtgggctcccacgcaggagccctgggtggggcctgagactctaacaagcccctggaggccacacctggctggctctttccaagatggatgccagctgtgcaggacattaggagagtttccaggcagccaaggacagaagagcctgggggcaggacgggctggctctcagccccgaataggtctccttacggcaggatttgcgggaacttcaatgtggtaaaggaaaccaggggaggtggagggtgtggaggaagcacacagagaggccaacggagaggcaagaccacaggcccttcccagagcgcctggcaggacagcatccactgatccacagcagatgatgtaggctctgagggccctccccaggcacaccccagtccacaagcctccaccccagcctgcactgagatgcccatcaatccttccctcgccatgtgtgacccctgagacagaggaaacctctgtggttacccacccagaggcatctgttctttttttcttttttttcagagatggggtctcactatgttggccagcctggtctgcaactcctgggctcaggtgatccaccctcctcagcctcccaaagtgctgggataacaggcgtgagccaccacacccagcactacctatgtttttcatgccctcacactgccatgttaatcatgtgacatctgcagagctgatgccacaggggacaacagagtcaccctgagggccgtgggactgccacagtgcctcaccatgtcgggcacgtagaagatgctgcggatgttgagcggtgcgtccgtcttatagtgcagggtgtagcggggcttgtcgtgagcctgcgcgacgtagcggtagaactcctcatgttgccactcacggacatccttggggtccatcatccagatggcctggaaacggagatcggcggggagggcgtcgtgttcaccacgcacgtcttctccaccaccgtgcaggcctgagccagtgcagcgcctggccctggacaggctcctgggacagacgggcggtggtctcaggcgtagacccctctccagccccaccgctgggctatgccgggtagtgcaggggagacacacaaggctctggggcaggagctcctcaggacaacatgtcaggaggaccagccgggacctgagggggcctgtgggagaggatgacgctgcccagcaggggcgagctgacgaatacagtgtgggccgtgagagcgatgacgacccacgctgcaccgcagctgagccgcgagggggaagtcagtcactgaggacagcatgccgtgtgactccatccaggagaaacgtctggaacaggcagcacaatggacagaaaggagaccgtggctgctgggactgggggaggggcagtggggaaagggctgctttttggggtgatgggatgttctggaattgatgcggggtggctgcacagctctgtggctgcactgaacaccatggctgcacactgatgtggtgagccagctgggatgggcgttacgcctcagtgaaccctgacccctgaccccggctgcccggtgcacaggggcagggctgtggtagagctgggcccctgtctcatccccacacccaggtctcatctccacagagcagctcgccctgtgactctgggccgcatcccctgggctcatctcttctccgctgccctgaaacgtacagatttgtctccatgtttgaccagtccctagaggaactcagggctcacctgcaaggtgttcatccgccttccattcaagtacaaggggaagctgacgaagttgctgtacttcgttaccacatctggaagggacaaaagaaaaaccacactgcatctacaatgcttgtggaaacgcaagctttgcagcagctccaggatgagcgccagcctgctgggaagggtcctccatgctgtgtacacttcacaggtacagaaacagggcacagtggggacacctgtcctccccccagtctcacgggggcagcagcggagcccacgtgagaaccagagctgtggaggccccggctgctgcgagactgcaatgtcagcttgtggctggaacatggctttctgggctgactcctgggggtactcagggcctccctgagtgtccagcaggacacaaagagggaaggccacgcccacatcctgggacaggactgcgccaaacccccaggtgcactaaaggccaagggccacgcagaggaaggaggaggaggtccgcctcagccaggccagcttcctcccagtcccagcaggagctcgatgctacgcagccctggcgggcagcccccctcccagtcccgcagcggctcggcccttcacggctctgcctgtgcaccctacgtgcaggtagaaccagggaaaatgcctgctgacctggtggcctccaggccacacatggatcccagagtgagcctgggcccgggctcccgctcacctcgcacccgggcctcgctggaaaactccttgcagtcggatttcaggtggatgatgatttttgtcccggttctaactcccgaagcttcggcgatttcaaacactccagaactaaggcaggcaaagaaaggaaaagccaggtggatgtgacactgggacataccctgcatgggactccagcggttcccgagggtttcataggcagagcccaaacaacacacaacacacctcaaatgccccatttctgaccccagcgcaccactcaggccatcacatgcccatcaggaacgatgagcctgtcgcaggcggcagagttctcctggttccctcgggcggggggcgggggggcgggggtcctccaccgaccctgggcttcgaagaagcttctgggcttaccccaaaagcaggcctggggcactgtgggggactggcccagctccaaatcgggtgccagatgcccaggggcaaaaacaaaggccagggggacaggcgccccctaagaagagcagaaaaccatctccgaagcacaggaggggggaatcccccggcagggccatgttgatgccttggcctaagtttactctgagccccgctcccatggaattaaacaggaatgttagttttgggagagtggggagtcaagctgagcacagtgcacacactgtggagcagaaatggcatcacggagggaggacgcctcggctggctggaagcggctcacctgctaaaaagccctcggagccaggcgtggtggctcacgtctataatcccagcactttgggaggccaagacgggcagatcacctgaggtcggggttcgagaccagtctgaccaacatggagaaaccctgtctctactaaaaatacaaaattagctgggcgtggtggcatgcgcctgtagtcccagctactcaggaggctgaggcaggccaattgcttgaacctgggaggcggaggtggcagtgagccaagattgtgccattgcactccagcctaggcaacaagagtaaaactccgtcccaaaggaaaaaaaaaaaaaaaaagcccccagcaggctcctcaccctatagaggcagaagtgggctggggagacaaagccaggaaatgccagggctgggaggaagcagaatgagctcttgcagaaggtcggtcacaggaggctgcatagtgtccaccaggcgacaggccagtcctgcagctcagccactgagaaaggagctcagcgcgggccggacctgccttcccgagcgcagtggtggtgaccaaccacatgggaccagacaggtgccataggccacctggagccacaaaagtcactaactccccaaaatgggagagtcagatttcatataaaaagcccagaaaatgcctgtgtacgttttctgagtccatccctttccaaactccatgctaagggctccagctcagctttgagctgcctgtcaggcgacattcgtcactcacccatctgaaagccactggtaacccaggctccccggggctgccgagcgggaatagacctccactctgtcagccaccatgaaagctgagtagaaacccactccaaactggccgatgatcttgctgctggcctcagcctggttctgcagagcatccaggaaggcctgtggggcagaggccagttagtgaggcagcctcccctccagagagcagacactcccaacaccgtggctcttctgcgagcaccgctaagaccccttcatcctgaaaacagccacaccgagtacttttccaccccattctacacgtgaagagctaagtcacagagaggtgacacattagccctaggacaaccagctggcagcagtgggacaagtgtgttttccatttgattcccaaagctcacagtcctgcctgtcccagacaggtggaggcctgtgggtcacacctgggggtggggaaagagcagcttgaataagctctttcccttgaataagctccttccataggaaggccaggagtgaggagaggctccaaactggcttccatattcaagtctcctggactctacactttgtgggaaaaagagtagaaatcacgcgcatgcgtctgtaagcaccgcacagcacttcatttttctactataatactgccaaaggtcctaaggccaaagtcaagtaaaatacacacgcccactgccctggcccacgttgtccgatggaactttctccaacaacaggaacgttctgccaggtgcaatgcgacagcctgccgagcacctgcaatgtggcctgtgcagctgaggagcacaatgtccccttttatttaatttgaatgcatttacatttaaactgccacatgcagctggtggccgctacacaggacagcagaccaacctcgagagaaatacaacaaaagacgtaacgtgggggtcaagtcacagttagggtgggttttttgtttgttgttgttgttgttgttgtttttgagatggagtgtcgctctgtcgcgcaggctggagcgcggtggcgtgatctcagctcactgcaacctctgcctcccgggttcaagtgattctcccgcctcagcctcccgagtagctgggatgacaggtaccaccaccacgcccagctaatttttgtatttttagtagagacggggtttcaccgtgttagccaggatggtctccatctcctgacctcgtgatccacctgcctcggcctcccaaagtactggggttacaggcgtgagccaccgcacccgacctagtgttttcatcttacagatgaggagactgaagtaagtgctttgcccagagctggaaaagggcgaccgctggaggttcccaggctgttggtctgagtccaaatgtgttgctctgcctcacagcacttttctgcaaagtcgattccctgagccttgtgggcttgacgcagagagggtcagagggatcagtcccctctcacacagcgccgtgatgagaacgggcttgggatgcggcgtctgtgggtttgatggttctggtcagaactgctctgtgggtctgggcatagtgacgtgcacctgtagtcacgcctcaggaggctgaggctggaggatagcccggccaacatggtgaaaccccgtctctactaaagatacaaaaaattggccaggcgtggtggctcgtgcctgtaatcccagctacttgggaggctgaggcaggagagttgcttgaaccgggaggcagaggttgcagtgagccaatacagttggtcctcctatctacgggttccacatttgcagattcaaccagccaaggatcgaaaatactcagaaaaaaaataaaaaacaacacaatgataaaaagtagtataaaaaacataactatgttatatctatatctagcatttacattctatcaggtattataactaacctagagaccatctaaagcatacaagaagatgtgtctacaatatacggcaccaatttaatccgggactggagcatctgcagactttgctatccaaggggggtcctgaaaccaacccctagatactgagggaccaacccccagatactgagggatggctgtcatgtcatgaggtgttcccacagtacccactgcgtggcatgcaactgacaacgttcttacttaatctggcacccagggccacccctactggagggatccttgcaccctgaggggaagggggaggctgtgtgggggccccacgcttacctttgaccccgatctggcaatcgtccccaggttggacaccagctcttcctgtgtcatcccgataccagtatcctgaggagagagacgcactaagtgccaagcccccagcacctggggagccgggtgagtgcaccagcagtcccagggactcaagtggtgtcaatgacattggccagacagggcccagccaggtagcaccagatgctcatcagaaaagactaattctaggggccgggagtgatggttcatgcctgtaatcccagcactatgggaggccaaggcaggcggatcacttgaggccaggagttcaagaccagcctggccaacatggtaaaaccccatctctactaaaaaagaaattagccaggcatgatggcgagcacctgtggttccagctactcggaggctgaggcaggaaaattgcttgagcccagtgaacccaggaggcagagactgcagtgaactgagattgcgccactgcactccagcctgggtgacagagtgagactccatctcaaaaaaaaaaaaagaaaaaacgaaaagactaattctagtcatagcagcttggcctcaccagagaaaacaggaagggacagcagaaagttgctttgtttgttaaaaaccattccgaaaagaaaatattacaccagcaattaggaaaagcacagctctcccaccatcaagatgtggcccccacgccttctccctggctgtggttctggggaacagtgatcccctctggtggctctctcaatccagcagaatgatctgactgaggacaccaggaagcaggtgttgggaacgcagctctgcacgcggcacctactcccaccctaccaccatgggaacagcgggcacagacgcctctcctgcgggaaggcagagcccttgcgttggagcctctatctggcctatcctgttgcagctgctctgctctgagtgccagtgtcacccaaatccatatattaagacctaagtcccaaggggatggcactgggaggggggccttggggaggtgatcaagtcacgacggctccactctcatgaatgggagtagggcccttagaaaacaggcttgagggagcttgcctgccccttccaccttctgtatgaagatgcaagaggcactgcctgagtcaaagggccctcgccagatgcccaatctgctggccccttgctcttggacctcccagcctctagaactgtaagcaatagggttctgttgtttataaattgcccagtctaaggtattcggctatagcagcctgaatcacaatacagaccaacgcgctggtgaacacacaaggccttactgaccatgggctcctccttcctcaaagcccagtcagactcccatctgcagatcctcgctcaacatgcccataatgtagccacagccccagcttgctctgctatgatgtgcagaccaccttaaataaaagagctcactccaagcctccacatctatgaattgggacaaaggccctcagaaacagttttctgaacttccttctaggaagttcctttctaaagacttcctctccaggacagcctgcaggagccatgggagcccactagcaccaggcgccagtgctgtctccattggcaaagcaagggtggtcagtgccactcagcaaataatccacagcaagcagcaggccagggagactggccagctgtcagccttcccattgtaggcagcacaggcagaatgggtgccaaaaccacatcaccaccagttactgcagtgcacacatgtgtgcatgtttcacgggccccagcagccaacaagaaacatggcaccaagaggcttctgggcaattatttctgaggtgccggtttgaatagtccaaaatccagcctgattcatttattgtagatcatgtaataattatgaataaaaaactacttaaaattagtatctagttgatatcagtcattaaatataagtttcatttaagtgtttaatacatcagaaacttaaatagagtccttaagggaaaggttaatgttagaccaaggtaaaggaaaaaatgcaactaatagctcctattttcaatttatttttattttttcccaaactgatctgcactgcaatcccagtctaaatcctcacaggttttgtagaaaatgacaagccgattctaaaatgtatatggaaatacaaagaacttagaaaattttcaaaatattttgaagaacgaagttggagaatttaaaatacctaattttaagacttcctataaagctacaataattaagacagtgcgatgtgggcatttaaggatcgacacatggatgaaagaaccaaacagagcacaggaacagagatgcacagagagtgtattacttgatttttgacaaagattccaaggtaattcaatgggggatgataggtctattaacagatagtactgaaacaactgtacacccataaacaaaacataaacctcaagccctacctcacaccatacacaaaaattaacttgaaatggatcatagatctaaatataagagctaaagctataaaacctctagaagaaaacatagggctggacacaacagctcacatctgtaatcccagcactttggaaggtcaaggtgggaaaattgcttgagcccaggagtttgacaccagcctgggccacaaagcaagaccctgcctctacaaaaaaaaaaaaaaaaaaatttctcgctctgtcacgcaggctagagtgctggagtgcagtggtgtgatctccgctcactgcaccttccgcctcccgagttcaagcaattctcctgcctcagcctcccgagtagctgggactaccggcacacgctgccacacccagctaatttcttttgtattttcagcagagacagggtttcaccacgttgcccaggctggtcttgaactcctgagctcagacaatctgcccgccacggcctcccaaagtgctaggattacaggcgtgagccaccatgcctggcaaaaaaaataatttttttaaagttagccaggcatggtggcatgtgcctgtggccctagctacagggggctgatgtggtagatcacttgagcccaggaggtcaaggctgcagcgaaccctgatagcaccaatgcaccccaacctggagacggaagaagatcctgactctaaacaaacataaaaaccttccaggtcaggctgggtgcggtagctcatgcctataatcccagcactttgggaggccgaggcaggcagatcacacgaggccgggagtttaagatcagcctgaccgacatggagaaactctgtctctattaaaaatacaaaattagccaggcatggtggcacatacctgtaatcccagctactcgagagactgaaggcaagagaattgcttgaacccgggaggcggaggttgcagtgagctgaaatcacaccactgcactccagcgtgggcaacaagagcaaaaccccatttcaaaaaaaaaaatcttcccggtcatcaaaaacaaggaaagtctgagaaactgtcacagccaagaggagctaaggggccaggacaactaaatgtcatgtgggatgctgggagagaaaaaggacatgaggtaaaaactaaggaaacctgaatagacttgtgttaagaataatatatccataccggttgattaactgtaaccaatgtaatatactaacatttctttttttttttttttgagacgagtttcactcttgttgcccaagctagagtgcaatggcgcgatctcagctcaccacaacctccgcctcccgggttcaagcaattctcctgcctcagcctcctgagcagctgggattacaggtgcacaccaccacatctggctaatttttgtatttttattagagatggggtttcaccgtgctggccaggctggtcttgaactcctgacctcaggtgatccgcccaccttggcctctcaaagtgctgggattacaagcgtgagccactgcacccggccataaggtttcaatcataagggaagctgggtgttggagtagatggcaacgctgtactatctttaaaatttttctgaaaattgaaatctgttctaaaatatttactaaaaaaaaaaaaaaactatagatttttcagatgtagacagaaatcatctgttgccaggcgacccgcacaatgtgattttaaaaggaaatggtgagactaggcgcggtggctcccgcctgtaatcccagcactttgggaggccaaggcagtcagatcacttgaggtcaggagtttgagaccagcctgaccaacatggtgaaaccccatctctactaaaaatacaaaaattagccgggtgtggtggcatgtgcctgtaaacccagctacttggggggctgaggcaggagaatcacttaaatccggggggcagaggcctcactgcagtgaggtgagatcataccactgcactccagcctaggcaataaaatgagactctgtctcaaacaaaaataaaaaggaatttgtgagggtttacaacaggtatatacataaaatatttgacatcaaaagaaaaagatgattttgccaccggaatgatactgttgtaagattcttacaatgaagtgttaaatatcaattcaagctagacagtgataaattaaggctgcatattttattccctagaaaatcccctaaaaataacaaaaagcaatgtagctgagatatcagtagatgagatggaatggcataatacctctgagaccccacaagaaagcttccttttctaaaactttaggtaagaataatctatcaatattagttaattaattgtaataaatgggctgggtatggtggctcatgcctgtaatctaacacttgggaggccaaggcgggcagatcacttgagggcaggagttcaagcccagcctggccaacgtggtgaaaccccatctctactaaaaatacaaaaattagttgggcatcatggcacacatccgtaatcccagctactcaggaagctgaggcacgagagttgcttggacctgggaggcggaggctgcagtgagctgagatcacactactgcactccagcctgggcgacacagccacactctgtctccaaaaaaaaggaaaaaagatgaaacaaatggaccatgacgctcccatcggctattgagaatagaaaaactgggtcccaaaggatataatggagctctaaattacctgctcaaattttctgtaaatctagaactgttctttaagaaaaaagaagacaaaagacaaaaccaaaaatcattattgtaacataaatggtcttagtaccaggaagtactggcacatgaggactggcccctctgctaaagaccaagaatcatgtccccatgaccccttgccccagcacatccattttcaatcatctgcaaggaacctctgtgctgaaaacaggaggaaagcacagggcgctgcagccctgcccacagggcccattccacagccaggccagctcagcaaaggcagggagagaagaaacccactccccacccaatccttatgaccaagggctatgacaaacagctggcacgtaccacggggctcagtctggattctctaaacccaagagggagtgcgtaaagctgacacctcacaaaagcccctcctttaattaaaacagccatcccttcacaagtccattcattcacgcgtgcctgcattcatttatgtggcatgaccttcagagcaagccagcaccctaaaagggaatactcagatcccaccgaggccagtctgtccacctctccacagagacagacacccccgcaatgacgccgtgaccctgggatgacaggtcctgaggcagctgtctttggatgcaatgtctctcagggcccctacctgatcctctttggcctaacttttcagccttaaaatttccacaaggctacagcagcagccacagcactgcttcgtcggcattttgaggggaaaacgcagttaaaaatatgaaaagagtacattaaaaataagatatgtttagatatgttaatacctgcatataccaaaaccctgtgtggccatatgctaagatgttaccagtagttattgctggatgatggggtgatttcaaattttcttcttttctgcttacctgcttttccaaaattttctataatgaatgagtgctactgtaacactaaattatagccagagttatcctggtggtacggacggccagtacgtccctgggacccgagacatcactagaaggcggatcctgtccttgctgcatggccgggcctgccacacgcctggacactgagggaggtacctggatggtgatggtgcctttctcggcattggtctgcaagtgaatctccatttctggcagtgcttggccgtcagacaccagtttgtgacgcagtttttccaaggcatcgctggcattggagatcagctcccgtataaacacctacaggaatagaaatgggaggcacagacaatgaaggacactcatcctgcaggatctatctggtcagctgcacttccaataactgttaaaaggtagaggagaatagtcaattctcaaagcataaagagtttctgctttagtcaaaggcagttcctctgggccggtcacaaagtgactgaaggtgctgactttcctttcaggatttctttgagagtctcactctgtcactcaggctggaggctgcaatcacggcttattgcagctttaacctcctggacccaagcaatcctcccacctcagcctcctaagtagctgggcccacaggcatgcaccacacccagctaattgttttaaaatttttatagacacagggtctcgctatgttgcccaggctggtcttgatctcccaggctcaagtgatcgttgtgcctccgcctcccaaagtgttgggattacagacgtgagccacggtgcctggcccttttcaggatttttaatcaagcctgaagttacgtgtccatctgttaattataactttaagaagagccctctggctggggttgggggctcatgcttgtaatccaggcactttgggaggctgaagcaggtggatcacttgaggtcaggagctcaagaccagcatggccaacatggcaaaacccagtctctactaaaaatattaaaattagctgggcgtgatggaacacacctgtaatcccagctactcaggaggctgaggcaggagaatcgcttcaacccacaaggcggaggttgcagtgagccgagatggcaccactgcactccagccccgacagagagagactctgtctcaaaaaaacaaacaaaagaggcctgcgaggaacaatttctttcccaactcctgcacagggatgacggcatatcactcaaacatccatttctccttgatatggtttggctgtgtccccacgaaaatctcaccttgaattgtactcccataattcccacgtgttgtgggaaggacctggtgggagataagtgaatcatgggggccgtttccccagtactgttctcgtggtagtgagtaagtctcatgagatctgacagttttttggggtttctgcttttgtgtcttgctcattctctctttgcctgctgtcatccatgtaagacgggacttgttcctccttgccttccaccatgactgtgagacttccccagccacatggaggtgtaagtccaattaaagctccttctttggtaaattgcccagtctcaggtatgtctttatcagcaacgtgaaaatggactaatacactcctactccacaaaaacaggttccctagcttcatctcatctagtggggaccaccaaacaccaggtctaccacacccggagaaaaacaggcctcagggcccagctgtccctcaggagctgaaaagcacactgacctcaaacagaccttccatttaaaatcagtgagagaggccgggtgtggtggctcacacctgtgatctcagcactttgggaggctgaaacaggcagatcacctcagcccaggagttcaagaccagcctgggcaacacggcaaaactccgtctctacaaaaaaatacaaatatcagccagaggctgaggaggaaggatggcttgagctcaggaggcggaggttgcagcgagccgagatcataccactgcactccagcctgggcgtcagacccagaccctgttccaaaaaattaaaaaaccaaaaaaaaaaaaaacaaaaacccacacaattaaaaatagaaaaattaagtccgcaagagcacataggtgaagaggaagcggtggctgatctgggcggaagctggaggtcactgggagtcaggaatgcagcactcatcagtacgaaacccggaaacagctcctagaaggccctctgagctttgaaatctgctgctttacaaactttcttcaggactctcctttgccttccagcaataatcagcatgtcaacgatggtggccttcatctttctttttccttgtcctgtcaccccaaatgagttttgcggggttttttttaatagagatggggtctcttcacgttgcctaggctggtctcagactcctggactcacacaatcctcctaccttggcctcctaaagtgccgggattacaggtgtgggtcaccgcacctggccccaaatgcgttttaatttcctcagtaactcctccctgctccatacacacaggactggggaaccttcttcctccggcagccaaagccgccaagacctgcaggtagtcccaccaggcaaaggggcctcagagcgtatccaaagctccacagagacggaattcagcagagctgcacgctaggatttgggggactttttttttggagagagggtcttactctgttgtgcaggtcagtgtagtaacacaatcatggctcactgcagccccaaagtctgccaggctcaagtcatcctcccaccccagcctcctgagtagctgggaccacaggtcagtgcccccatagctggctaattttttaaattttttgtagagacggagtcttgctgtgttgaccaggctggtctcaaactcctgggctcaagtgatcctcctgcctcgacctcccaaagcactgagttcccaggcatgagccaccacaccaggcctgtatttcgggaacttttaaaattattggcaaaattcaattaattcccagagttgatccagcccaaagaaccatctggatacacttatccaggaaaccaaaacagattctggtaaaactcctctcactggtagcttaagatgaggacctgtccaaagtttaatgctttctcacagctaatatattatctggcaattctccagaatggcataaaaaccagctttgtgaaaagaaactttgctagcatcgggcatggttagcagggaacgcacctctttttctgagtacagggaccgggcaacaatgtccaaaagcttctttgtctcggcctggaactcatgtttggaagtggaacctagtaatgaaacacagacacaaccaacaaagtttaacttctatttttgtgcaagaatacgctacgtcacattccaaagaaagcttaagtttatgagttttaaacttttttttttttttttttttgagacggagtctcgctctgtcacccaggctggagtacagtggcacgatctcggctcactgcaagctctgcctcccgggttcacgccattctcttgcctcagcctcccgagtagctgggactacaggtgcctgccaccacgcccggctaattttttgtagttttagtagagacggggttttaccatgttagccaggatagcctcgatctcctgacctcatgattggcccgcctcggcctcccacacatttaagatcatgaacaaaaagaaagaagcagacagaaacaaagtctggctgggcaccatggctcatgcctgtaatcccagcactttgggaggccaaggcaggagaatcacttaagcccaggagctcaagaccagcctgggcaacacagagggatcccgccatctctacaaaaaatacacaaagtagctgacggtggtggcacacacttgtggtcccagtgactcagggggctgaggtgggaggatcacttgagccagggaggtcgaggcttcagtgagccatgattgcactacagcactcggcctgggtgacagagaaagaccctgtctcaaaacaaaacaaaacaaaaagtctctcagaaaggaggtctcagggcaggacaaatcctcccactgctgaggccagacatgcctcgggctatgtcgagggaatgctgagcctggtttcccaatgtgcatggttacgagaactggactgcctctaagaaccagattatatgttctttcttttttttttagaggcaggatctggctctgttgcccaggctgctatgcagtggcaggatcgtgctcactgcagcctcaacttcctgggctcaaccgattctcctgcctcagcctctcaagtacctggaaccactggtgtgtgctaccatgcctggctaactttttaatttttttctgtagagaaagggtctatcttgcccaggttggtctcgaccacttggcctcaagcaatcctcctgcctcggcctcccaaagtgctgggattacaagtgtgagccactgtgcctggactatattcttcaaaaaagcggtttccaaattaattagttagaaatcaaaataacaagaaaacctcacttctctttttaacttcaaagattctactcttgtcgacccacttaaaagccagaaatggagccacttcaggactggctccaaagactgcttttttatacttcagagggaatgaaaagacagctccagaattcggtcctgcgcagactgggccaatgctgagtttcccctcccgcttccatgattattagcagatgtgccatgaatcaccactcaggggaggtgccggacggcaaactcacgggtggccaccagagggggcaagacacacccgacactggcagaagtccctcgctgggacagaaatggagggcgcagcactccctacagccaagaccttctgatttcacacctaaggcggtggctctaccaatcactgcctccaccctgaaaatgcccctttacgcacagcagtgaaccaaaaagccctcccagaccaaagcacgagccaaggctaccctgcacgctctctgtgctgctgataatcgagtgcaggggttcctccttgtcctcggcggtctgcgtgctgaacagtcgtcctgcctgcaagctccaggctgggtttcgcctggggcccaactgggctgtggtcctccgaggacacagaattggttttcctgaaaagacaaatatgcagaaagaatgagaattaggaagacacgagaaacaatatggtaattcgtcccatcaagggtgtctagcagaagctagcgtggacatctctaagtcgggctgttgctgaaagagaaatccacaggaccaaatgccacagtgtcagggtgtggttttggcaaggagccctcacagatgtcatcagtgtaagatactgtgtcttctcagaaccgcagaagcgaaactggagggggtgggctgctgccttcttttcagagggggtctcgctctgtcactgcgatcacagctcactgcagccccaacctcctggactcaggcaatgctcctgcctccgcctcacgagtagctgggaccacaggcacagaccaccatgcccccataattttttaaaaaattttttgtagaaatggggttttgctatgttgccaagactggtctcgaactcctgggctgaaaccatcttcccgccttggccttacaaagagctgggatgacaggcgtgagccaccatgcccagctggcagatgcctgctgacagcacttcccacattcgcctcacgggtgacacctcgcatcaacctaccaaactgaaacctgtctcgaccctcgcagcccctgcagaagcccccgatgggccacacttctttgctcttgacagtcaagcaaaaaaaaaatcctcccaaaagggatccaaatatttaaatgttaatattctgaaactgtctcatcttctaaaagttgattctttcccattgctttttcatccaaaacagattttttaaaaaaaatttgtgtactttaaaaactgaaaaacagctgacgatgggttctaccttctaactaagaaggagacttgtcttctgtaacttcctgctcagtccagtgggctgagaaagttgccggcagagcccagcgagggaggaaagcagccaatgtgtccccagccgcacgcagttcaccgacgcaggcccagaaaccagacactttcactccaacacaggactggaccgacccaacaccaacacccactgaccccagggaccacataccaggaccctgccttggtcagtagatttgcaatacgtgatggtgtcaaggatatgtggccagccagccacgccgtgtcaaagtctaagcctaaatgaaccgcatctaactgggagcctctcctgttcttcacaaatttgtaacaagtagaaaggaaagacaacagaatatccaggaatcaaggttttaaaaatcagcatatcagccaggggtgcggtggctcacgcccgtaaacccagcactttgggaggctgaggtaggcggatcacatgaggtcaggagttcgagaccagcctggccaacatggagaaaccccatctgtactaaaaatacaaaagttagccgggcatggtggcaggcacctgtaatcccagctactcgggagactgaggcaggggaatggcttgaacttgggaagtggaggttgcagtgagccgagatcgtgccgctgcactacaggctgggtgacagagcaacattctgtctcaaaaaaaaaaaaaaattaacatatcaactttcatactcctaaaaggtacaaaaacttgccttttttttttttttttttttgagatgaagtctcactcttgttgcccaggctgcagtgcaatggtgcaatctcggctcattgcaacctccacctcccgggttcaagcgattctcctgcctcagcctcccgagtagctgggtttacaggcgcctgccaccacacccagctaatttttgtagttttagtagagacagggtttcaccatgttggccaggctggtctcgaactcttgacctcaggcgatctgcccacctcagcctcccaaagtgctaggattacaggcatgagccaccgtgcccagccaaaacttgcctattctttaggcttattcctggacttacaaacagcacaaacctggccttttgtttttgtttttttttgagatggagtctcgctctgtcgcccaggctggagtgcagtgatctcggctcactgcaacctccatcttctgggttcaagcgattctcctgtctcagcctccaaagtagctgggactacaggcaccagccaccatgcctaatttttgtatttttagtagagacgaggtttcaccttattggtcaggctgctctcgaactattgacctcaggtgatccacccacctaggcctcccaaagtgctgggattacaggcgtgagccaccatgcccggccaaccctagcctgtctttatctctatgcagataccttaaaaacatctaccacaattcagaaagtattcaaattccaaaccatgtaaacatccagttatttgggcccatgtaattgcattgttcactttattcgtacagttaaaaaaaaaaaaaaaatcccgggacatttcttctggaattaaatggtatttggcattagaggagttcgcgaacagtctacatcaaaccagggtgctgaagtctctgtgcctccttccaaagcacagccagccctgggggcacaggagggaagtgtccaagtgccaacacctgcccacagagcatatcagtgtttctcaccatttgtgtaaaagaaacacaaaaaggataaaccagaaactgatgtgactgtgtattttgtttcctaggactactgaaacacagcaccacaaactaggcagtttcaaaaaggtccacagttctgagccaggcacacaacctcacacctgtaatcccagcactttgggaggccaaggcaggagaatcgcttgagcccaggggtttaagaccagcctgggcaagaaagtgagactccatctctgcaaaaaacacaaaaactagccaggtgtagtggtgtgcacctgtagtcccagctacttgtgaggctgaggtgggaagatcacttgagcccaggatgttgaggctgtagtgagccaagatcacactaccgcacttctgcacttcaggctgggtgagacagcgagactctgtctcaaaaaaaaaaaaaaaaaggtcccaggttctgggcagcggtgcttcccactggaggtgccgagggagagtccatcccgcacctctccccagcttctggcagtagccggcatccttggtgtttcatgctttgcagaccctccaggctctgtctcttgtcacatggcaagctcttctctatgtgagtcctggctgtgtccagatttccctcttcttatacggataccaggaatactggagttaggccccacccccatgcagtgtgacctcatcacaacctgatacatctgaaatgacccaaataagctcacactcacaagtaccagggatgaggacgcgaacgtatctttctctttttttttttgagacagagtctcgctctgtcatccaggctggagtgcaggggcatgatctcagctcactgcaacctctgcctcctgggttcaggcgattctcctgcctcagcctccctagtagctgggattacaggcacgcaccaccatgcctggcttttatttttaaaagagacatggtttcaccatgttggccaggctggtctccaactcctgacctcaagtgatctgcccaccttggcctcccaaagtgctgggattacagacgtgagccaccatacctggcctctttttaaaaaagaataaaaatagagacaaggtttctctttgttgcccagcctggtcttgaactcctggactcaagtaatcctcccactttggcctcttaaagcactaggatgacaggtatgagccactgtacccggccttcaaaccccacagcttggttacctacaggaggtgtgtattaaactccccgtggcacaaacccggtagcttacagtaacagacacttattctctcacagtcctggaagcaagaagtccaagatcaaggtgccactagggctggttcctcctgaggctgggagggagggtctgtttgcgcctcttccagcctctgcagcctctggcgttgcttggcttgtgggtggtcatcttctccctgtgtcttcccttcaggacgtctgcccttctccctctacacatgtctgtctgttcaaatgtccccattttataaggacacagtcatactggattagggcccacccaagtgaactcatcttaacttgatcacctgcaaagaccctatttccaaatatggtcacattcacaggtactgagagctgggacttcaacatctttcgtggggagacacaattcaacccccaaccagcatatgtacagagaatgcaaagaaagcgggaaggggagagggctggcagagctgagggaacatgacacttccacatacatcttttcgtatgtctctcttagaaccatggtcaggtttctcatactcaaaaaacaaaccattacttagccagacgtggtggcgcacttctagttatcagctactcgggaggccgaggtggaaggactgctcgaacacaggaggtggaggttgcagtgagccgaggtcgcaccactgtactccagacttggcgacagagtgagactctgtctcgaaaaaaaaaaaaaaagaaaagaaaaagaaaaagaaaaagaaaccgtgaaaacaaaacagggcgcacatgaacacaaaatgaaatacaaacagcaaatatgcagagctgtgacgatgacatcaccactctgaaagaagaactaacctaagagacttcagaaaatagcactttgactgttactgtaaaactaacctcagaggacagcacaccatcaccaggctcgggcaggagatgtgtcccctgcggagtcagcaggtctgagcccgatttacgcatgtgccaagatcaagcggaaaagctgattgtggctactgagttggggtcctcacagttgaagaaaagtcactgataaggaaggggcaggaataaaccctgcggggcggcactggaggtacaggcatcagtacaggctcacaacctttgccatgtgtacagactggatgcagaaatcaataccggaacatttacacacacacatttcccagctctgtccactgacgcgtgacagggcccaggcgcgatgaccccccacttaggctacagagagcaaagtccaaaagctgttccagtttcagcactctaaagtcccacgtcccagggaaagcctttgtcctggcaaactaggacggctggtcaccctacctggcagccagatcttggtttgtgaatacctctctccaaaaacaggaaccagagatccctgcggagcacacagaggagcctaggacacccagtggtgtgcagaaggacgagaaaggacggggtgtgtcaggagaacacacagcccagccagaagggctcccagtggcagaatctaggacaatctgtgcggcaaaataacgaacgacaataatggattgtaagctgtgacccggcaaatcaagcaaacatcggtgcacacttaaacagaggaggagcagcagctcttcatcacagcagaattccaatgaataaacacaaggaatggcagaaaacagaaagcacaccatcaggaaacaccacagcaataactggctggtgtaagttactactattttgagacagggtctcactctgttgcccaggctggatcacaatggcacaatcacagctcactgcagcctcgaccttcccgggctcaggtgatcctcccacctcagcctcctgagtagctgggactataggccgtgtattaccactcctagctaattttttttttctttttttttttgactgggtctcactctgtcgcccaggctgaagtgcagtagagtgatcttggctcacagcagcctcaaccctccggattcaagtgatcctcccacctcaaccttccgagtagctgagactacaggctcatgccaccatacccggctaatttttgtgttttctgtagagacagggattcaccatgttgcccaggctggtctcaaactcctgagctcaagtgatcccccggcctctgcctcccaagcgctgggattagagccgtaagacaccacgcccagcctaaggttatgtatttgaagcagtggtagatactgccaagtcacactccacagagatcctatcagtttacgttcccacagcaatgtactaaagtgcatatcatcctacattcctgccaagtcagtgttgagatgaaactcttggatctttgcctattggtcagataaaattttcactgcagttttcacttacatttctcttattataagcaaaactgagcactgtcccgtatttttaaatatttcctatttccttttttgttaagggactgttggtatcctctgataatttttctactacattttaaatcttcttcttattgatttgtaagagctttttatatattaaggaaattagtcgccaggagcggtggctcacacctgtaatcccagcactttgggaggccgaggcgggaggatcacgaggtcaggagattgagaccatcctggctaacacggtgaaaccccgtctctactaaaaatacaaaaaattagccaggcgtagtggtgggcgcctgtagtcccagctacttgggaggctgaggcaggagaatggcatgaacccgggagacggagtttgcagcgagctgagatggcgccactgcactccaccctgggcaacagagcaagactctgtctcaaaaaaaaaaaaaaaaggaaattagtcttttggttgtaaaagccttcctcactctaagattaaacatgatttccccatgtttcatttttctagtctttttggtttttccccaattaatatgcagaattttttttttttttcctcgagaaggtcttgctctgttgcccagagctggagtgaaatggcgtgatctcggctcactgcaacctctgcctcccaggttcaagcaattctcctgcctcagcctcccaagtagctgggattgcaggtgtgcaccaccatgcccggctaacttttgtgtttttttgtttttttgtttttcttttttaagtagagacagggtttcaccatgttggccaggatggtctcgaactcctgacctcgtgatccgtctgcctcagtctcccaaagtgctgggattacaggcacaaaccactacacccagcctatatttttgaaaggatttaatataatattcattatgggaggagtatatagaagtcctcacaattgggaaaaagaaaaaaataagaaatctatatttccagccagaattgcaagacttagtatcataacgccaagattacattaattgaattgacagcattcttaaaagcagatttgatttcaggttatgtaaactttccacaacaacttttttttttttttttagagtctcactctgttgcccaggctgcagtgcagggcgccatctcggctcactgcaagctccgcctcccggattcatgccattctcctgcctcagcctcccaagactacaggcgcccgccaccatgcccggctaattttttgtatttttagtagagatggggtttcaccgtgttagccaggatggtcttgatctcctgacctcgtgatctgcccgcctcagcctcccaaagtgctgggattacaggcgtgagccaccgcgcccggcttctacaacaacttttaatcactaactcaggtgcagtggctcatgcctgtaatcccagcactttgggaggccaaggccggggggtcgcttcagctcaggagtttgaaattagcctgggtaacatggcaaaaccccatctctacaaaaaaacagccaggtgtggtggtgcatgcctgtagtctcagctacttgggaggatcacttgagcctgcaaggcagaggttgcagtgagccaagatcacgccactgcatttcagggtgggagatgcagccaggccctgtctcaaaaaaaaaattaaaaattaaaaaaaaaataaaccattagaggaataaatctgcctgaaccagataccaaacacgctagctgtacaatttccgtctttgtgtttctcctacaccctaaaggaaaaaccacaaacctcaatgtcaggctacaagatcttactgttaaactatctggtggtttggggtcgcacaaaatgggaagcactgatagtttgaatgtgacaccacacacccctccccttccaccccccacatccctacccactactgccagtgcccatgcagctcctccactctgcagctgcagtctcagtagctgggactccttcccatccgagttgctgcagggcctggctgcaggccctctctcccattcaggcctccctggccccagcagttcacaataatctcttcctatgagttcactgcacttaactttttatgctgcccatttaaaaaaattttatactggccaggcgcagtggctcacaccataatcccagcactttgggaggccgaggcgggtggatcacctgaggtcaggagttcaagaccagcgtgaccaacagggtgaaaccccatctctactaaaaatacaaaattagcactgggtgcctgtaatccccgctactcgggaggctgaggcaggagaatcacttgaacccacgaggcagaggttgcggtgagccgagattgtgccattgcactccagcagcctgggtgacaagagtgaaactccgtctcaaaaaaaaaaaaaaaaaaaaaagatttattcatgtatttactatttctttctttcttagaaaagagattgctctgtcacccaggctggagtgcagtggtacagtcatggctcactgcagtcttgaactcctgggctcaagggaccttcctgctttactctcctgaacagctgggactgcaggtaagcaccatcacacaggactaaattcttttttttttttttttcctagagatagggtgtttccatgttgaccaggctggtcttaagctcctggtctcaagcaatcttcctaccttagcctcccaaagctgctgggattacaggtctgagccaccacgcccagcctgtgctgctcatttgaaactgctgctatatgccagcatatgacatttcccactgttaattttttggttaatgtataatttatctcaccaaattagggcaggaaaaagcttgtatttctcagtaacactctttgaagacaggaacatccatatttcttggtatgccaaagtatctatcacaaaagctactctttacaaacttttttttttgagatggagtttccctcttgttgcccaggctggagtgcaatggcgcgatctcagctcaccccatcctcctcctcccgggttcaagcgattctcctgcctcagcctcccgagtagctgagattacaggcatgtgccaccacgcctggctaattttgcattttttgtagagacggggtttctccatgttggtcaggctgctctctaactcctgacctcaggtgatccgcccacatcggcctcccaaagtgctaggattacaggtgtgagccaccacgcccagacttttttgtttgtttgtttgagatgcagtctcactctgttgcccaggctggagtgcactggcacaatctcggctcactgcaaactccgcctcccagttcaagccattctcgggcctcagccgcccgagtagctgggactacagatgcacatcaccacgccaggctaatttttatatttttagtagagatggggtttctccatgttgcccaggctggtctcaaactctggggctcaagggatcctcctgcctcagcctcccaaagtggtgggattacagaagtgagccaccgcacctggccaagggtgcatatttcaaacaccagagtaaccactaaaataataattcaaagaagaatagctttaaaaagcattagataaaccacaatggaaatctcaaatacatttcattgataaggaaaggaaaaacagggaaaaaatccaaaaggacaaataaaaggcaaataataaaatggtagcaataaatccagccacatcgatatttactcttacattaacagactgaactctaattataaggcaaggattgtcagaattggtaaaggaagacctaattacatgctatctacaagacactttaaacataaagaaaaagatacacttaagacaaatgaatggaaaaatacataccatccaaaaagtgtgtttaagaaagctggagtggctctattaatatcaagtaaaatacatttcaaaataaaaaatattattaggaaaaaagaaggatatttcagaatactacaacaaacaattcatcaggaaaatgtaatcacaagtgtgtatttgcctaataacagagcttcaacatatatgaagttaaaacggaaagaattaaagacaaaacaattccacaatcacagctggagatcttaacactcctctctcaataactgacagaatcaaaccaaaaaataaaacagaagccgggcacagtagctcacgcctgtaatcccagcactttgggaggctgaaacaggagaatcgcttgaacccgaggcagaggttgcagtgagctgagatcgcgcccctgcactccagtctgggtgacagagtaagaccctgtcccaaaaaaaaaaaaaaaaaatagccagacagtccagaagaaaaacctggggcaaaagatatgaacggcatttcacagtggctacagaaagcgaaggagcaccaaactatatatgaacacagcaagctctccacgagctatgtagtgagtaacagaacacagagaagggtgcgtccctgagggaatatgtacatctgcacttactacagtcatacaagtaagtagtggcaggacccacaggcaactaatagtggttatgaagacagcaggtgctctgaacagcagcaagacttctcaagctttacctgttcacatggttttggttaatcaaaccatatttatttattcaaaacagatattaaattattaaaaatatgaggctgcccggcacggtggctcacacctgttatcccagcactttgggaggccaaggcaggtggatcacaaagtcaggagttcgagaccagcgtggccaacatggtgaaccctgtctctactaaaaatacaaaaattagctgggtgtggtggcgtgcacctgtaatcccagcctgggcgacacagtgagactccatctcgggcgggggaaaatatgaggctgtcacaaaagtgctaatgttttccctgctgtcgatgttgaggtcacttgaaagctggtatggacacatcggatgaggaattcagtctaggggcctcttaggagccaaggcccaatgactagactaagtggacccagcaaacacagagggagggggcctgaggcacaaacacagacaaggtcctatgctcgaggcaaacaaggacgaggtacaaggtgagagccagaaggggccactgtgctgcttcacagacctgggaagaagttttttgagaaaagactttcatttttcaagaggcagatcattttaaagaataaggcctagggcagtggctcacacctgtaatcccagcactctaggaggctgaggcaggcagatcgcttgagcccaggagtttgagaccagcatgggcaaactggtgaaaccccgtccctaccaaaaatacaaaaacttaggtggacatggtgacacgcacctgtagttccagctacttggggtacttgaggcggaaggatcacttgagaccagagggtaaaggctgcagtgagccgagatcacaccactgcactctagcctgggtgacaaagtgagaccctgtctttaagagaaatttaaaaagctgggtgcggtggctcacacctgtaatcctggcactttgggaggctgtggtaggcggatcacctgaggttgggagtttgagaccagcctgaccaacatggagaaactccatctctactaaaaatacaaaattagccaggtgttgtcgtggatgcctgtaatcccagctacttgggaggccgaggtaggagaatcgcttgaacccaggaggtggaggttgtggtaagccaagatgctgccattgcactccagcctggagaacaagagtgaaactccgtcttgaaaaaaaaaaaaaaaaaaaaaaagcattcagtaagatggtagaatacaaaaatcaacacccggacgtcctatatacagaaaactagttagaaaatatgacataagagaccccaggaacaaaaactaaacaattaagaatgcatttaccaagaaagcaaaatctttccttttttttcttttttggcaagatcttttaagaaaactctgaaacactactagggccaaagactgtcattaaataacccacttaagactgttacatatgctacatactcacaagcggaggactaacaagtaaactacagacgtaaggtaacacttggaaagcatgggattatagagaaatgggacaatgctgtgtaatgtgtgctgatgctgaattacctctaacacaaagaaaaaacactagaggtagaacagcggtttgcacacactaccatggtgttcaaatgcatatacatgttatgtgatacatgcatgcatagctattctcatatgccacgcagatctctgcaaggacacccaaaaactggctaatggacttgccaccaggaggggtgttgtctgaggcatgtcagtgggagacgagtttttcatcagatatacctctgtatcgtttgcatattggactacatatatcaataatctacaaaataaataccctacttataaaactatttacaaaagttaggctgggcgcggtggcttacgcctgtaatcccagcactttgggaggccgaggcgggcagatcacgaggtcaggagatcaagatcatcctggctaacacggtgaaagccagtctctattgaaaatacaaaaaattagccgggcgtggtggcgggtgcctgtggtcccagctactcgggaggctgaggcaggagaatggagtgaacgcgggaggcggagcgtgcagtgagccgagatcgcgccactgcactccagcctgggcgacagagcgagaccccgtctcaaaaaaaaaaaatcaaaaaacaaaactatttacaaaagttacattacaggccaggtgaggtgcctcacgcctgtaatcccagcactttgagaagccaaggtaggcagatcagctgaggtcaggggtttgagaacagcctggccaaaatggtgaaaacccgtctctactaaaaatacaaaaattagctgggcatggggatgcacacctgtaatcttagctactcgcgagaccaacgcactagaatcgcttgaacctgggaggcagaggttcagtgagctgaaattgcatctctgcactcgagcctaggcgacagcacgactctgtctcaaaacaaacaaaacgttgcattataaaaaacacttaaaaacttacgagaaacataaacacatttacaaaatttcaaacacatttttaaactattctcattctaaaattcatgtggaaaagttagtgtacataaatagccaaagaaattttgaaaaaactgaggaaattcatcaaatattaaagaacattaatataaagctacaatattaaaataaatttccagaccaggcatggctgctcacacctgtaatcccagcactttgggagggagatccaggcaggaggaggctccctcgagctcaggagctcgaggccagcctaggtaacatagggagacccccccaactctcaaaaagtaaacacacacaaaaaaaggttaaattaatttccagcagggcacaggggctcatgtttgtaaccccagtgctttggaaggccaagttgggaggaacacttgaggccaggagttctagaccagcctgggcaacatagcaagaccaacctcttatttttttttttttaatttccgctgtcacttattaagtcaaaatgaattccagatggaccatagaagtaaaaataaaagctaaaagtactgaaagaaaacatgaaagatttagtaactttattgagatgtaacacatctgccatataattcacccaagtgcacaattcagtggttttagtatattcacaaagttgtacagccacgaccactaaccacagaacatttttttttttgagacggagtctcgctctgtcgcccaggctggagtgcagtggagccatctgggctcactgtaagctctgcgtcctgggttcatgccattctcctgcctcagcgtcccgagtagctgggactacaggcgcccgccaccacacccggctaattttttgtattttttttttagtagacacagggtttcaccatgttagccaggatggtctcgatctcctgacctcgtgatccgcccgcatcggcctcccaaagtgctgggattacaggcatgagccaccatgcccggacaactacagaacatttttatcaccccaaaagaagccctacagccactcatgttcactctcttttccctctcccaccagctcttggcaactactcatctatgtctgtctctatggatttgccttttctgggcacttcacagaaatgaaatcatacaatatatggttttttgtctggcttctttgacttagcataaagtctttggggttcatccacatatagcatgtatcagcacctcattcctttttataactgaagagcactccgctgtatagattatttttttccattcatcaaatgatgggcaactgggttgcttccaaattttttgtgagacagagtttcactctcgttgccaggctggagtgcaatgacatgatcttggctcactgcaacctctgcctcccgggttcaagtgattctcctgcctcagcctcccgagtagctgagattacaggcatgtgccaccacacccggctaattttatatatatatatatttttttttagtagagacggggtttctccatgttggtcaggctggtctcaaactcctgacctcaggtgatcggcccacctcggcctcccaaagtgctgggattacaggcgtgagccaccagtcccggccctttttttctttttttttttttgagacggagtctcactctgcagtggtgtaatctccgctcactgcaacctccaattcccagggtcaagtgattctcctgctgaggcacccgccaccacgcccagttaatttttgtatttttagtagagacgggttttgccatgttggccaggctagtctcaaactcctgacctcaagtaatccacccacgttagcctcccgaagtgctgagattgtagacatgagccactgcaccaggcccagcttccaactttttactgtaacttttgttttggggtggggtgggggtctcactatgttgcctggagtgcagtggctgtttacaggcactgtcatggtgcatggtagcctccaactggcaggcttaagcgatcctcccacctcagcctcccaagcaggtgggattagaagggcgcaccaccactcctggcctatttgcactcttttttttttttttttttttttgagataggttcttgctctttgaccaggctgaagtgcagtggcacaatcacagctcaatgtagcctcaaactcctgggctcgagcaattctcccacctcagcctcccaaatggctgggaccacaggcatgtgccaccacacccagcaatttttaaaaattttttttcgagatggagtctcactatgttgtccaggctggcattcaactcttggcctcaagcaatcctcctgccttggcctcctgaagtgctgcaattacaggcatgaccaaccgcacccagcctcgtttccaccttctgatggaccttcagattgttttcattttcgggttattatgaataatgctgctatgaacattcatgtgtaggctgttctgtggacatgttttcatgtctacaaggtatgtgcctcagggtagaactgtggggtcatatggtaattcggtttgactgtgtgaggagctgcaagaatgttttcctgcagaggtcgcaccgttttacattctcaccagcagtgtgggagggttctgatttttccacatcctagttatccattttgtatcacctgtttttttgttgttgtttctttaatttttaattatagccaccctagtgagtaggaagtgctaactcactgtagttttgctttgcagttcctaaactgccaggcatcttgagtttttaaaaaaaatgatttaagaggaaatctttttttttttttttttttgaggcggagtctcgctctgtcgcccaggctggagtgcagtggcgggatctcggctcactgcaagctccgcctcccgggttcacaccattctcctgcctcagcctcccaagtagctgggactacaggcgcccaccaccacacccggctaatgttttgtatttttagtagagacggggtttcaccatgttggccaggatggtctcaaactcctgaactcgtgatccacctgcctcagcctcccaaagtgctaggattacaagcgtgagccaccgcgcccggccttaagaggaaatgtttctaaacaaaatatataacccaaaaggccataaatataaggaccacataaaaatttaagtcaaaagacaaacacccgggtgaggtggctcatgcctgtaatcccagcactttgggaggctgaggtgggtggatcgcctgaggtcaggagttcgagaccagcctggccaacatggtgaaaccccgtctctaccaaaaatacaaaaattagctgggagtcgcagcgggcatctgtaatcccagctactccagaggctgaggcaggagacttgcttgcactcgggaagcgaaggctgcagtgagccaagatcgtgccactgcactccagcctgggcaacagacagagcgagactctaactcaaaaaaaaaaaaaaaaaagacaaacacattaagaaaaaaactgggggccaggcacgacggctcctgcgtgtaatcccagtactttggcaggcagaagtaggaggatcacttgagaccaggagttcaagacaagccggggcaatatagtgggaccccatctctaaaaaaaatgttttttaattagccaggcatggtggcacatgctccttgggaggaagaggtcacagccacttgggaggatgaggcaggagtatcacttgagtccaggaggtcaggcctgcagcgagccaggatcgcacaactgcactccagcccggatgacaaagcaagaccctgcctctaaaataaaatttagtgccgtggctcacgcctgtaatcacagcactttgggaggtgggggcgggcagatcccgaggtcaagagtttgagactagcctggccaacatggcaaaaccctgtctctactaaaaatacaaaaaaaaacaaaaattagccagaaagccaggagcagtggctcacacctgtaatgccaacactttgggaggctgaggcggatggatcatgaggtcaggagttcaagaccagcctgatcaacatggtgaaattccatctctactaaaaatacaaaaattagccgggcgtggtgacgggtgcctgtagtcccagctactagggaggctgaggcaggagaaatgcttcaacctgggagacggaggttgcagtgagccaagattgtaccactgcactccagcctgggcgacggagcgagactccatctcaaaataaataaataaataaataaaaataaatgagccgggcatggtggcgcgtgcctgtaatcccggctacttgtgaggctgaggcgagaggactgcttaacctcgggaggcggaggttacagtaaggtgagatggcgccactgcactccagcctgggcaacagagtcagactctgtctcaattttttttttttttttgagatggagttttgctctgttgccgaggctggagtgcagtggtgcgatcgcggctcactgcaagctccgcttcctgggttcacggcattctcctgcctcagcttcccaagtagctgggactacaggcgcccgccaccatgcccagataattttttgtatttttagtagagatggggtttcaccgtgttagccaggatggtctcgatctcctgacctcatgatccgcccgcctcggcctcccacagtgctgggattacaggcgtgagccaccgtgcctggcccgacactgtctcaatttttaaaagttatttaaaagggctagcgcagaggttacggtgagccaagatcacgccactgcactccagcctgggcaccaagtgcaaaactccatctcaaaaaaaaaaaaaaaaaaaagaaaaaggccattggttcaagagaaaaatggccattcacaaaaacaagaaacatcaatggctttacgtcctagtaaaagatgttttaccacactcataactaaggaaatgcactttaaaacgagatagcattttcactaccagattgacagatgttttaaatactgtcattctagcactggtgaaggtgtgagaaactgttggcaatgccgtctgttatcttggggaaactcagcaacaacctaaatgtccgccatgagagggttacataaattacaaaacatcctcgctatggaataccagagctctgtggcgacaggaaacaaaccccagaatataagtggaaaatgcaaggtacggaagattacacacggttccttcccagtttacctttgtttcccttttttttgtgtgtgtgtgtgagacggagttttcgctcttgttgccaggctggagtgcagtggcgccatctcggcacaccacaacctccacctcccagattcaagcgattctcctgcctcagcctcctaagtagctgggattacaggcatgcgccaccacgcccggctagttttgtatttttcgtagagacagggtttctccatgttggtcaggctggtctcaaactcctaacctcaggtgatccacccgcctcagcctgccaaagtgctgggattacaggcgtgagccaccgcgcctggcgagaagattcttaagtacatgaacattctgaacagaaagacctgtattccctcacaaatgtctgagttcttagctctggcattctcaacactcactgtttcttgaggtttcctgtgttccagaacctggtctaatcgttctctactatgatatactgatacttcattcatcaggaaacataactccttgaacataaagaaaaagaacaaaaagcgaaagggcacctcggaatagtcaaaatatgggcctgaagccctcaccctgagctttgctcatggaagactactggccccatatgaaatccatctcattctaacaatttgatgctaacaagtttcccagccacatctgcaaactaggaaaggagagaacagggctccagacagacctgcaagttaaggccacagtaagagaggccaaaaatataaacactcacaatgcagttttgatgtggggacacttcatagacgaaggattcttcacatttcaatggccctacgggagcctacatattaaaacagaagaccaaacattaacacccgtaataatgaccctgaaaacatccaagagaggttcagtcatgggccatcaaatgatggagtgttctagaaagacttctcatcataatggttaaaatgaaatgttttaaagtcagcctcgtggaaaattcgcttgaacattccattgcctgacaaatgctgaaatactggcaagtgtgaactaacatggcaatgtgctgtcttaatttctccttcgaggtgcatatcactaacccgacacacatagttacattagaaggacccacgtccttctgtcttcttctcagcagcattgctgaatagcctcctgctcttaatatggcatttaatttagctatctcaaaattaatttcttttatatgtgtgtgtgtatatatatatatatatatatatttttttttttgagacactgtcactctgtcacccagactgtagtgcagtggcgtgatcacagctcactgcagcctcgacttctcaaggcttaagggagcctcccacttcagcctcttgggtagctgggaccacaggcacacccagctaattggaaaaaaaaaaaaaagggttttttggtagagatgggggtctctctaggttgcccaggctggtctcaaactcctaaactcacaggatcctcccgccgcagcccccaaagtgctgggattacaagcatgagctaccaggcctggccaattttttaccttctagccacatttcttaattatatggctatgaagtaactgagccattccttttaaaaccaatgattcagctacatgtcctttcaatctacccaatctacaggaattcacctggttaaaaagccaatggcagggctgggaacggtggcgcacacctgtaatcccagcactttgggaggccgaggcaggcagatcacaaggtcagaagttcaagaccagcctggccaacatggtgaaactctacctcaactaaaaatacaaaaattagccgggcacggtagtgcatgcctgtagccccagctacttgggaggctgaggcaggagaactgcttgaacccgggaggtggagattgcagtgagccgagttcgtgccactgcactccagcctgggaaacagagcaagactccatcttgaaaaaaacaaaaaaaaaacaaaaaccaaaacaaaaacaaaaaaaacacaggtggcagtaatactcccgcaagtagatactgtttctccaagctacagcttttatggtaattcctagtggttttagcagaaataaccagccacaccacaaataaactccctgaaatctattttgttaaatgctgtggaactacagggaagccactttgtggactaagagcagcttcctagtagaaggcaggtcttcagtaggactaagcaggacggtggtaagaaaagttctagctggctacacttgaggcaccaaaaacgccatccatgaacattctctggctttgaacccaaaagcactttttacttcatttgagtatgaatggatacattttcaatcgctatcaagattctttgtcaggcccgacgtggtagctcatgtctgtaatcccagcactttgggaggccaaagcaggcagatcaaaaggtcaaaagattgagaccatcttgcccaacacggtgaaacctcgtctctactaaaaatacaaaaattggctggccatggtggcatgcacctgtagtcccagctactcaggaggctgaggcaggagaactgcctgaattcaggaggcggaagttgcagtgagctgaggtcatgccactgcacttcagcctggcgacagaaagaatctgtctcaaaaaaaaaaaaaaaaaaaaaaaaaaaaaaaaaagatatgtcagcattttgagacaagcaagtatcacaggcctcagtaacagcctctttcatggaactcacctttgtcacatggtatttactgacatggggggcaggagtaaatgtttattttcccacagttttcttatcaacctgacacccccatccccaccccgcaagctgcattccctctcttcctgccaaggggtagcaaaatacttggagattcctcttttgtcttagcttaggccaactactcacccagtaaccaataaacgctttgctaatctcttacattcggattgatgtgtttgtttccaagacagagtcttgcactgtcgcccaggagggagtgcagtggcacaatcttggctcactgcaacctccaacctccacctcccaggttcaagcaattctcgtgcctcagcctcccaagtatctgggattacaggcgcctgccaccaccctggctaatttctttgtatttttagtagagacggggtttcgccatgttggccaggttggtctcaaattcctgaactcaagtgatccacccacctcggcctcccaaagtgctgggattacagacgagagccaccgcgcccggcctgatgtgttctttttcaggcactcagataactcagttcccttggtcctaactaagctgaaggtcctcctggtggccttggacagctgggccacaccttcctctgccgtctaagtgccagcaccacagcttaatcagacgacaaacatgtcatggacgctacacctctagcgtcatctcagcaacacaaagagctgtttcacagacagagtcgcaactgaccagcaagtactactcccctccactctgaaaagaacagccggagagcaccagaaattcacctgaattctcctgaagggtgcagcacacaagacacggaaatcaaacagcacaggctccaaacaaagggagagcagagggaggaggcaaaacccgtcaacaaaacgaagtactgaaggggagggcgcagcaggcaggcaccacctacaggagcggggtccaggtgaggctctttttggaagatgaaacaaactagctagtacttgagccctgagcaaagtgaggaaaccagctctcccgaccttcctggtgctggcaggggacctactctcacaactctgatttccaagacaggaagttccagcaaaggctccagcttacagagaacaaaaaggcccaagatcttaacgcctgcaccaaccagtcctatcgtggttgcctcagtcatgttctggcaatttcacgaaaacaagagcatctggcatgaccaggagactggactcggcacccttggtgattgtggcagtcacctcgtcatgcaaaatgaccaacccgtcaccgtacctgcctgaccacagaatcacgtttgctttgggagactgcgtctgctgttgatctttccaggtcttccctctcctttaggaggcggcctcatccttctactggcacatctgacacttctgacagttggagctctgacgaaaagctctcatggtgggccacgtggctgggctccccacacaccaggcccagggctggctctgtgactgtcctgaggaatgcaggatgaggctcctacgcacaagcttatatctgacagaaaagacacaactgctagcctcattcaccatcactcctgcacactcccgcaagtctttcatcaaaccaattattcagagctatctccttacccttgcacctgcagctttccagacatggaacgttcctccctcccctccagtgaaaacagccttggacactcggcccaaatcgctcctcatctgtgaaacttaccctggggcaagcagctcttgtttctctaatgtgctgtccaggccaccaagatggccctggtacactgctcagcagccacctatgactccagacagcagggtcacattttctttgacgactcgggggcattggaaatgtatttgctgaataaactgttatgggcaaaaatgacaaatataaagtccacaagcggatatcctagcccacccctcacagaaatattctgagggtaggccaggcgcagtggctcacgcctgtaatcccagcattttgggaggccaaggctagtggatcatgaggtcaggagttcgagaccaccctggccagcatagtgaaaccccatctctattaaaaatacaaaacctagctgggtgtggtggcatgcgcctgtagtcccagctacgtgggaggcgaagtcaggagaatcactcgaacccaggaggcggagggtgtggtgagctgaggttgcaccactgcactccagcctgggcaacagagcaagactccggctcaaaaaaaatcaaataagatattctgagggcaagtgacagggctggcagtgtcaggggtcagtgaggtctgaaagggtaagagggctgagctcatgggtgactgaggcagcgtagcatgggcgagaggattccacagacataagacacgcacacctgaagccaggcacatgctacaacctggaaatactttcccaagaaaagaaaaaaatttcaagaggtctggattttctacataggtggatctgcctaaactattctttctcccctgttgcacaagacatgtattttcttagctaaattctctcatcgttcaatcaatccaaacaatttaccttcccattcatccacacaggtgacaatgacaagggcacctgccacgcagaaggctgccaagaacatgttccatttcttagactcaggcagaggaatgcttgaaccaccgcaccagaagatggaggacgagaggagagagacaatttttaagaaaaagagataaagggctgggcacagcggctcacgcttgtaatcccagcactttgggaggccgaagtgggcggatcacgaggtcaggagatcgagaccatcctggctaacagggtgaaaccccgtctctactaaaaatacaaaaaattagccaggcatggtggtgggcgcctaaagtcccagctactcgggaggctgaggcaggagaatggcctgaacccgggaggcggagcttgcagtgagccaagatcgcgccactgcactccagcctgggtgacagagcaagactccatctcaaaaaaaaagaaaaagaaaaagagataaagaaacagaattaaaatgtccctgggctgaaaactgacatattttccaaatggaagggacagtgcatgatacaaagcatgaatcacaaacacctgtggacgcgagaccacaaacgacaaagagaaaaaatcttaacctccaagggggaaaaaacccgagtcagctacaaaagaaacgagaaccaaattaacagaacagttggccaggcacggtgacacacgcctgcaatcccagcattttggagggcaaggcaggcagatcacttgaggtcaggcactggagaccagcctggccaacatagtgaaaccccacctcataaagacaaaaaaataaataaataattgatcagacactggtgctagaagagagcaacagcatcactttctgagggaaaattattattatttttgttgttgagatgaagtctcactctgtcgcccaggctggagtgcagtggtgcaatctcagctcactgcaatctctgcctcctgggttcaagcgattctcctgcctcagcctcccaagaagctgggattacaggcgcgcgccaccacacccagctaatttttgtatttttagtagagacagggtttcaccatgttggccaggctggtcttgaactcctgatctgcccacctcaggctcccaaagtgctaggattacaggcgtgagccaccgcgcccggccacaaggtatcttttatagaccactggttttgaaaagacataagattcagcgttgaagaaaatacctttggaataggcagtcttgatgcctgctaaaggggatataaattgataaggcctttttggacaatttggcagtatctgctaacatttcaaaaatgcataggctctgaaatatcaattctaaaattctaattatgtaaggctaaagaaataccgcacgtgaacaaatatttaagtactcacccattctatgcagcattgtaataaaaagtaaaacctgaaataacctttattgcgtccactaataggacaatgtttaaacaaatgacacgtccatcatacagaatactgtgtggtcactggaaggcacatggacctgtatacactgacatgaaaagatgtggaaagaatgctgggagcgttaaaattttctgaagtacaacgtagcacaatgcatacatggtttaggctttttagaataaaaaatacttatacgcagacatttatatttacacgtataacactgtgtacagccccgaagcaatgccgaaactttcactgttgttacctccgagtggggactgggaaagcagaggttagggtcgttctctctgttttacaaacatttattggcgcatccatcaattccaggccccgaggacacagctgcgtcaacgacatcgagtccacctgctctggggacccggatgactgctataggttttgttcactgtggcgtccccagaacctgcacggcgccgggcactgagcgggcgctcacatgtgcgtccaatgaacgaattaacaaatgaaccctcagtgcgctactgggaggcggggaggggtaaagcacgatccatggaactagcacgatcaccccgagtgagtccattccccgcaacatgcacccgcaaagactccgcgctccgcagcggctccacctgcacgtgcgctacctgactggaccgaagctccaggagggacgaccccgcagccgctccgcccgaccccgcgaccccccaagacccagcctccttcagggctcccatgggcgggtggcgaggggagtccagccgaggaaaaggcagccaagctggagctggcgaggagcggagcgaaagtaaacgcgtctgccgcgcttggcctcgccggacctcccacgcctgtgaagcaggtgccggcgcctcgctccccggagcacagggacgtccctgccgtctccgtggcccggcccgcccgctgcccgtccagccaggacgccctcacctcccggcacggccgccagcgccggcgcccgcagcaaaggccgcaggcggcggccccacagcagcagcgcccgcagctcgcgcgccatgtcgtactcccagagcgccgcgcgcagccacgcgggaccgtacacgatgggaaggggcgggacggggctgcgcggggcggggcttcctc

SEQ ID NO: 856 - DNA, 38358 bp, Homo sapiens
tttcaaatactcaatttttattggtagtagttatcaagaacaaagtcctcggacttctgatgggaaatctgaactgctgtttctcttttagcgtacaagaagaaatagatccctctcattagcactttaatatcagtgtcacgtgtctggaaggaaattgtattcatttaggtaagcaacacactacataaatatcatagctgttagacccaggggactctcaggtgccagaattggggactcctttaattggaagggagctaaagggtctacctcctacctagaagtcctttctatgtggatatgaattaaattctcttgtctgttttgctctgatggggtctgtgtgggctagctggctctggtgtgtgcctgacgacagactgaactccttaaccatttcagacagcttgaagatgtatgatcattatttgaaaagggagagagggaggactctttgttttctccaccagtttggctcctgaggtttcttcagcgttaggtttctgtagggcccagctttctccagtgtttggctactgcaactctgtgttctgccagtctcttaactcagacagaaacaatgcaaaccagcagacagagcatcaccttgaaagtactaaaacagctgtcaatctagaaatctctgccccgcaaaaactgtcataaatactgcaagacccatgttcagatttccccccttttacaaataatgttttgttttatttcccagctactacaagtgatccaaatgttctttatagcagactttttcctgcagtctaggatccagtcagagatcttgcattaaattatatctctgtaatctttaatttcacgctatctgcaatgttttgtgtttttcatgacattgatgtttttgatgaggtcaggccatttattctgcagaatatctgtcaatttggattttttctaattgttctttcatgattagaatcaggcaaacattttttgacaagaatacatcagagacgactccgtggtgcatcagactgggggcatgtgatgtctgtgtgtcccattattggcgatgttcaattctgtcacttctgttgaggctgcatttgccagatttcagattaaggtacctttttccctttgtaaattaggatatcacctttgtggggtgccgttttgagactgcaaggatatcatcttcccgagtaggccttcatccatggcctcagcatccatgatggttcctgtccggatgctcacttttgaagaaacatttcaaataatagtgattcctttccaattcaaaagtaatcattgctttatagtcttcataaatattttctgtggttatttagttgatgaaagctgttgatgtccatttggatttttttccctccaacacaaacagctgcaggaattggtgccacatagaggctcagcttgcctgtctccatggaagctgtggccacagcagtggctttggaagcctagtaaggaatgacatcactgccaggtgcagtggctcacacctgtaatcccagcactttgggaggctgaggtgggtggatcacttgaggtcaggagttaaagaccagcctgatcaacatggtgaaaccccatctctactaaaaatacaaaaattagctgggtgtggtggtgcgtgcctgtagacccaactacttgggaggccgaggcaggagaatcactggaacccatgaggtagagcctacagtgagctgagatcatgccactgcactccagcctgggtgacagattctgtctcaaaaataaataaagaatgacatcactgaatacactgaatgtgctattgataaccagtgtgccagactccagacaacatgtgccaggcatcacccatgtctttgattttgtaataaataaaaaatggggccaggtgtggtggctcatgcctgtaatcccagtactttgggaggcccaggctgatggatcacctgaggtcaggagttcgagaccagcctggccaacatgatgaaaccccgtctctactaaaactacaaaaattagccgggcatggtggcgggtgcctgtattcccagctactggggaggctgaggcaggagaatcacatgaacccgggaggcggaggttgcagggagctgagatcgtgccactgcactccagcctgggcgacaagagcgagactccatctcaaaaacaaacaaaaaaggcaaaatccttggagaactcttactgtctctgtttccagaatcctagaattaaaactttcatttatcttcacaattttcccatagctttttcatgtctgtaaggatgataccctgaaatcttcttcttgagaagataaagaagggtcccctctgttacccctaccaaacggatgctcctcacgggcttgaggtggcagctcatctcagagcatgggatgatttttaaccaggtgagtggaaaggggcagtaataaacatttttaaaggttggggacacatgaagtcctcagggtgtaaagctggaaccagcctcctgtactgctcagctttcaggcctttggcccctagtcccttgggggtggcccctcccttctctgtgccataacagagtacccgtcaccccctgcctggaccactcctgcagcagaagaggagctcacgacctcctccggcagcacctctccttcctccctgcagagcccggctctcgtgctgagcaagcagcgttcccagctcccagacaggccccccagaagtcggcctttctgttcaaaagcttccagctgagcatctgcccattctcctgatccgtccaccaggatcacatttcaacagtgcacgtgggagcatttgtcttgatggcctctgagatcatcctggccccggagtccccaatgtggtttccctggagactagaagagtagggttaaggcagggctcaaagcctgcaggttctctttagtagagcaggccatacaatagaaaatgcaggaccccatgcaaagcctttgtgcttctaggatcccctcgctacatggacaaggctcagggtacctccccttagaccaggtttccctataggcctgctgaagcgtctgggggtcagctggctctcagaactgggcaaaaggcagtgcgccacctggaagcagttctaagggtgagcaggaagggcaggtgcactcacttgatatgctggagcctgtggtttccagacagtgctgtggcaatgcatatcgccccgtccatccccagagaattctcttgaagactaagtggaaaagagatggagacacacggtgagccatcagggcagaaggaaaacacccggggaagcaacagtgcattgtctgggggcagtaacccaggcagatgtgtccacaggtgccatggcaactccaggtgggagttgaccctggagacaggtgtctacgagtggccagattgtcccacgcaagtgcgctggaggatgtaaggccataaatgcaagatgtgagtgacttctgactgaagctaagcacactcaacaaacccagctgcagtggaatgtggactataataagtctgattgtttatattcagaaggaaatagctacagaagaaatcaggagcattttattccatcagggaggacccagcagagaactctgctgctccaggatgcaggtaggtccctccagccacttacttgagtctccggagacttgagtttaccttcagagcatttgccagggctttggctccagccaccccaatggcatttcctcttaagctgttgggaaagacaggaagcctaaggcatgggtacaggctgagaggtgatactgacccctctgcgggtgggcttggggctgcttggtagaggaaacaaggacttcagcagtcacaggaggccagggctgtgccttcctcactccagggcaacagggcagagctggctctgggaagcagggcacacaggggcatggctggcctagccaggagggttgttggagccttcctcctcttccatttcaaacagaaaagcggggctgagacaggagaggcagccctccatctgggcaggtccccagtgctcccagcaagggcaggaattctgaggacatgcctgagcctcagagctgtaacctcaccccaggactttggatctgcccagagaacaagatcagcccccctgggacccataaaccaggcctctagacgtgttcagcctggcaaggccaacccggagaggagggcaaatgatagcgactcccagggaaaggcatgaagtggggctgggaaactggtatacttgcactgaaatgaagatcaccaggatgatttgtgagttgtctgtaaactttgtccccatatctattcattgagaattcattgatttctttgggctaaagaccatagatggagactggaatacttactcgagaatctccaaggttctgttcacagccaaggcttcccctagcacctgggcgcctgaagcaccaattgaggccacctggagactggggcggagagggtgccgtcagtgtgagccggctgggcccacctccctccgcatactccgttccctttcaccaccccttgactcaggatggaaagtggagaaacagcactgagaatggttggccagcgctgtgtctaggcactccatctcctacctacactgtctgttgcctaagacagagatctggatgctaaggagatgagaaatagaggctgtccctggaagggctcggggagaatgctccctgtacctcctcattactactctctaggtgtttgagcccccaactgctaatatcatatttcctatattaggaaaatcaaacacaccttccttgacttgtaaacaaaaataacgtccaggccaggtgtggtggctcacacctgtaatcccagcactttgggaggctgaggtgggcagatcacctgaagtcaggagtttgagaccagcctggccaatatggtgaaaccccgtctctactaaaaatacaaaaattaggctgggtgtggtggtgcacgcctgttatcccaactactgtatgggaggctgaggcttgagaatcacttgaacccaggaggtggaggttacagttagctgagattatgtcactgcactccagcctgggtggcagagcaagactcttgtctcgaggaaaaaaaaaaaaaaaaagacctctaacgtgaaaggatggcgaagggaccggtttcctgactgctgcgcacatctaggacttactagagagcagtgagggctgtgttgaccttcagtgcacgggccaccgcacacgctccgtcatccccgatggcgttctcctgtaaactagacacagagtatgacccctttgggtgcacggggcacagggagcattctagcaaggccctgccgcacttggacctgccaggtttaaccgactacacacaccatagacactcccagggtttcctggggataactgcccttcctccacaggccctgcagcccgccgcctcatactaagcacacagaggcgtctggggcctgcatgagtctgaaccgccagaggcaagcaggaaatgggacatatagagtgactgtcagcaggggcttgggacccaaaaggggatgcttttcacagccaaccagaaaatgaacttaaagccctcaatccctgagccattcttgtttgtcttgttttctcttgagacagggtctcactctgccacccaggctggaatgcagtggtgagatcacggctcactgcagcctcaacctcccaggctcaagcgatcctcccacctcagcctcccgaggagactaaagtacttaactagagacggggactacaggcacatgcccccatgcccggctaatgtttttattcttttatagagatggggtctcactatgttgctcaggctggtcctgaactcctgggctcaagcagtcctcccaccttggcatcccaaattgctggcattacaggcaggagccaccacgcccaacctccttggccattcttgctaattagggctttgtgtcattttttccccttctaagttggagggaactagcaggccctggtgcagtgagtgactgagtttagctcaagcgcacactggtatgttcaaggccaagagctgtttgcattcattattttaacagacatttgagtgtggccgggcgcagtggctcacacctttaatcccagcactttgggaggctgaggtgggtggatcacttgaggtcaggagttcgagaccagcctggccaacatggtgaaaccccgtctccactaaaaatacgaaaattaggctgggtgggtgtatttttagtagagacagggttctctgtctctactaaattagctgggagtggtggagggcacctgtagtcccagctactggggaggctgatgcaggagaatcacttgaacccaggaggtggaggttgcagtaagccgagatcccgccactgcactccagcctgggcgacagagttagactccgtctcaaaaaattaaaatgaaaaaaaaaataagaaagacaacatttgagtgtgtctcatgtgctaggtgttgtataaggcagcaggcctgagtccccctctcgaagctcaggtgggaagacatgattaaatgagcaggtacaacaggccaagtgcaggctgcagggaaaagcaagcagcatctcccaccccagggtgtcaacagaaggctcccagaagaaataggtcaaaacccgaacccaaagtggggagtgtgcctggctcagctaaggaacccaaacgaattgaattcctggggaagtgagaaatgagtccagggagggacaaaggaagcagattttaggggtcccagaagccaccctgaggggctgtgtgtactttactctgcaggccctgggcaaccattcaaggatggcacccaagatgggacagagctgctctggaaaggtctctggccagcagtgtgagaggatggactgaggtggaggctaccacagggatggaggtgagtggtgccgatggcctgggcaggggcagtggacgcagagggaatcgagtggatggcagggacacagaggggaccgacccaacaggacttgacaatgaataggaagcaggaggtgggtaggcacagtgcctcacacctgtaatcctaggactttgggaggccaaggtgggaggatcgcttgagcccaggagttcaagactagcctgggcaacatggtgaggccccatctctttaaaaaaaattgtaaatattactttaaaaaataagttatatgctggatgtggtggtttgcacctgtaatcccagcactttgggaggccaaggtggaaggatcacttaaaggtcaggagttcgagaccagcctgaccaacatagtgaaaccccgtctctattaaaaaaaaaaaaaaaagctgggcgtggtgttgggcacctgtaatcccagctactcgggaggctaaggcaggagaatcgcttggacctgggaggcagaggttgcagtgagccgagatcacgcctctgcactccagcctgggcaacagagcgagactccatctcaaaaataaaataaaagttatagaaaaggaagtgggaggtgagagtgaaggtcttgtttctagcttgcacagttggttccattcacaagatggggagccaagaagcaggttttcaggagagagaatgcagggaccctgcacccgagcaagatcccgaagggaggtacagagggggtgtggacgcgcaggtctagggttgaggagagagggctgggacacggacgtgggagtcgttgggactttgaagatcactggagcccagggaaaggaaaagagctccaggaaaagagacgccaggcaagcgaagatgacataggacgatccctgaggagccctgcgcagaagagccaaacagaagaaaagaggacgaggcccagacagaggggacatcctggaagctgaaggagaagaaatggtcagggagaaaggccgatgaggctccaagggttaaacctagagttccctcacgccccagcgactccactcccaggtatatccagccaggagaaggaaagctcacgtccacacagaaactggtgcacaaaggtccacagcagcaccgttcctaacagccaagtaggaacaacccaacgtccgtcagctgatgaatggagaaatgaaacctgtgtacccatacaatggatatcattcagccttacaaaggaactaagtattgagacaggctacaatgtggatgaaccttgaaaatctgacaccaaatgaaagacaccagccacaaaaggccacgtgtcgtatgattctatttttggccacgtatcgcacaattccatttatatgcggtgtccagggtaggaagatcatggagatggtagattagtggttgccagggttgggggaaagggagaatgggtagtgagtgctaacggggtgatggaaatgttgtaaaattgattgtgatgattgcatcaccgaatacactagaaaccagtgaattgtatactaagtgggtggatcttctggcgtgaagattatatctcaatcaagctgtcatatatctatgtatatatgtgtatgtacatatatgtatgtgtatatatgtatatgtgtatatatgtgtgtgtatatgtgtgtgtgtgtatgtatatatatgtgtgtatatatatatattttttaacagggtctcactctgtcgcccaggctggagtgcagtgacgcgatctctgctcactgcaacctgtgcctcctgagtttaagcgattctcctgcctcagcctcccgagtagctgggattacaggcatgtgccaccatgcccggctaatttttgtatttatagtagagatgggatttcgccatgttggccaggctcatcttgaactcctgacacctcagatgatccacatgcctcagcctcccaaagtgctgggattacaggcgtgagccaacgcacccggccaatatatttaaaaggcagacaaggactgaaacatgccagctggccttagggaagaggagtgccaggggtcactggattgagcctctgcctgatgggtaccaggttttcagattcccctgtcctcaacagcccccgccctgcagcccctgggcaggccaacttactctaagctggtgaggctcctgttgagctgtagtgcttgtcccagggcctgggcagcgccggcctggatgaagttccactgcaggctgggcagacacagacacatgtgactatgtgactatgtgactatgtggccctggggcagagccaaggaggctctgatggcaggaggtggaatccctgcaggatgtggcaggagaattcctgcaacccctgcccagacttagttctcagagggtcacatgtactccctggttagccgtggccagagggccggggaataagccagaaaagacacctccaaatggcctctgcctggaggcccagctgtgaccacctcttaacacatgtctgtctgtgggtcaggagagcacaggatggggcacagtctgctggcagcaggctagcccgggcagcccctgagacctttgcagggggtgtccccaaaccaggtgtggcctgtgcatcgttggtttgggtggagcccggcagctctgcagaaggggaacagagcagggtggagagctgcagactcactgaagggaggtgagggtgcggttttctctcactgccactgcgatggcccgggcaccctggtcgtggaggaggttggctgtcaggctaggaggaagggaacaggagcaagtgagccgggggccggctgtgaagcctccggtccttggtcaccagggattccagggcttgataccagatcacccagccagcacgagggggtgcttcctggggatacgttgcccaatggcatggtaacatcctcatccatccccaccaggtgaagcagacggcgtcacactagcctcaccctcgtgcagtttacactatgagagtgggggacttgccacccgatgtcaggtctcctggctgcaccctccccagccagctccttctccaaccctgtgacgtggcgagggtgcccgtcagcccaggctcggtgtgggtgtggtcatggcatgaacagcctgtggagtcacaggcccccaccacgtactccaggttcttcagggtgctgttggcgcagagggcatgagcgatggcctgggctccctcgggactgatggagttttctcgaaggctgaaaaaaaaggaaagacctgagcttctgaccgggcagatgaggtgtctggcaaagccaagcccaggtgtttaggcttcttgaagcccaagaaactgcaggcgggggacctagagttctgcatagtctgggctgaggtgtgaaggagccagtgctagtgagccagtgctgggccagccaggtgcccccactttaggaccatccgcagtacagggagaggacaggatgacagggccccagaggtgcgaggggacaggtggctcagcgtgcatctgggaagggagcggcagaatgggccactgcgggcagcagctatcccctgcaccccaagagagcaggaaaagggccaggctgccaggaaggcttccccagccatagatttccctgagacaggcttcccagtgccaagtccctgcagacaggtgcctcgtcaaagaaacgccctgtttggagagggtggccaggacttacctgaggctgaggagggtctggttggtgcagagggcccccatcagtgctgccactcctgcgtcactgatggaattgctctgcaggctgcggaaagaggaggcgccctgggtgtggctgtcccaggacccagagggagctgccctgtcccagtctgggacagcaggcactgggctcaacagggagttgggggctccagggacagtggtggccacactgcttctcttctcatctctctttcctctcccagccccccaccttctagcctctgccaggtcagggcaggtgggttcagcacaacaaacccccaaatgtagaccctgccttgatgtgggtggccccagacagcctcagagcagggtgtgttgggtctgcagcccccagagggagtggcgcagcaggctccccaagtgtgggtgtagcgctgagctctcctttcccctaccaaagctgctgcagctgactccctctccagccacccatgctggcttctcaaggacacttggagctcatcattccaaacactccagaccctaccccagcccccactgtctagggaaatggagctggtggggcaggggctactgaggacagtgtgtgcccagggttagtgttggcagggaaatggccctgggggacagccatttttcaggactgccggcccactatctactggaaagagaacccagggggaatcgtcaccctggcaggtggactcactccaggctctccaggccctggttcaccttcagggcctcagccagggccttggcacctccatcaccaatactattactggagaacctgcaagagaagggatatggatgagccagcctctgggagctgccaggcagggctgggcagagggatcagagtcagggaagccctcctgggagggctggctctgttgtctcaagggtggccagtgcacagtttgttctgcctgaggcctgttggctgtagtctctgcaagtgaccacctgttgtctgtaagaaatcaggatagcaaagtccctcttgactccctggcaagaagggtcaacccttcagtgataagtattttggggggtttttgtgaagatggtcaggaaatgttttcttctgccagctgggaagacagtaaatgtgagcccgagaaggttggggttcacccagtcctgggaatctgagtctccattctcctcggttagtgcttttggagtccaaagtcagctaaccagcactcacacttccatccatctatccatccactcacttattgatttatctacttacccacccactcattcataaatccatccattcgtccatccatccacctactcacctacccacttacccattcatccatccactcatccatccacctacccatcagtccacttagctatcatttcgtctgtccatccactcatccacccatccatccatttgtccatccatccatccactcacctattctccactaattcattcagccatgcctccatccactcatctacccacccatccattcatctatccattcatccatccatccacccacccacccactcactcattcattcactcattcattctaccatccatctatccactcacccatccatccatccatccactcatccatttatccatccactcatccattcaaccatccatccattcacgtacccatccacctatccacccatccctctctacccacccatccacccatctattcacccattcaaccatccatttatctactctactcattcattcattcatccacatacccacccatccatccatccctccatctacccactcacccattcatccactcatttattcaaccatccatccatccatccacccatccaccaatccacccatcaatgcatccattcatccactcatccacccatccatccatccatccatccatccattcattcaaccatccatccatccattcaaccgtccatctatccatccatccttccattcactcattcatccactcagtcattcatctactcgttcattcaaccatccatccatccatccattcaccagtcctctcacccatccatccatccatccatccactcattcatttatccattcattcacccatccatccatccatccatccacctgcctacccatccaccactacccacccaaccatccatccacccacccatatactcatttaaccatccatccatctatccactcattcatccatcagtccactcatccatccatccgtccactcatcagtgtatcccttcattcatccatccatccatccatccatccatccatccatccatccatttacctagccacccatccacctagtcacccatccatccatccacccacccatccatccattcacctatccatcaatccatccatccatcctcaggctcacaaatatttgtgctgggttgggcattgtgctgggcactgaggatactagtgtgggcctttcatatgtctcacatgagctctttcagactcctgttctgcttcaagggcatctgccatccgctgggctcccatgggcccgatgctgttcttctgcaggctgtgggagaaaagagaggggtcctttagaaaggctggtcacagccattcccaggccaaggacggttcaggttcaaggtcagggacaactagtgtgccctctacatttattggagcaggtggggagggcgttctccagatgggtctttggattgttgcctaagtgataatggaccaacattatgatgagggatagtaaggggtcagggcagctgagcctcccttgcaaggagctagaaagcagagatcagtaggtgctgataatgcccagcaacctcccgaatggggacctccatggacaagtctctctggtgccttacctgcagtctgcctcccatctagaccagcaggctgcctccaaccctaagaaacctccctaggggccaggtacggtggctcatgcctgtgatcccagcaccttgggaggccaaggtgggcggatcacgatgttaacagatcgagactatcctggccaacatggtgaaactccgtctctactaaaaataaaaaaattagcggggcgtggtggcatacacctgtaatcccagcaacttgggaggctgaggcagaagaatcacttgaaccagggaggcggaggttgcagtgagccgagattacgccactgcactccaggcgggcaatagagcgagactccgtctcaaataaaaaagaaaaaagaaacctccctaggaagaccctggcttaggttcctcttctgaaaaagctgcttcctcttgtcctaaatctggtggagggagacagcacgggagaaaccctgtcctcatcctacaaggacaggcaggcaggacgtctcctgtgtgaggctaaatacaaatcctaaaaaatgtaattttccctggttccaaaaaggaaagagactccttaccaccctcattttctcagagcacttcctgagaaaacttgaggttgcaaatgctgcctctgtccctttaagatgtatgtaaatctttttaaaagcaaaatcagcctctggccactttcacagcctgggaatgtctttcataagggtttggagccatctctttgaaatgtaaacattaaggaacaaagagtccctccttccctgccttcgggaattaggctaggtatctggcttgaagctctaaagtacctgcgtgtcatagagataaaagctttacttttcctttggataaaagcaattagggaccacaaatggccactccaattatctgctgtatttaggataaacggcaaatggtgctgcctggccctcttgcctgaggacgagggtcctgtctgcttggctctagaaaagtgagctttctgtctttacagtctcattggtgggttgccccgatgcaccgtgcagtcagtttaatgtttatccaataattgttgtattctttcctacatctgtgggttggtagaaggtattttattttatattttattattttattttatattttaattttattttatattttaattttatttttttttgacagagtctcgctgtcgcccaggctggagtgcaatggcacgatctcagctcactgcaccctccgcctcccaggttcaagcgattctctcaacttagcctcccaagtagctgggactacaggcttgcaccaccatgcctggttaattttttttttttttttttagtagagacggtgttttactattttggcccggctggtctcaaactcctgacttcaagtgatccgcctgccttggcctcccaaagtgctgggattacaggcatgagtccctgcgcccagccaggaggttttatttttaattatttccccaacagctgctctctcgaaaagtaatgggcatcaggggccatccagatgggtcagaaggcctcaggtcctagccccatccattcttcctagcaggtaataggcagagaggcccttggaggaggagggagaagggagagaagggggagagaggagatgtgttcactcactgcagcatggagagggtccggttggaggccaaggcctcagccatggacctggcaccatcatccctaacggtgttgccctggaggctgcagagacaagaagaggctcatcactgatggagcagaagctggaacccaggggtctgaactctctctgcagtgggggcacctctgtggagcaaggggttctgaccactacgtgccctcaccgcccaccatgcagggagagcagtggaccctttgcaccactgcctggggcttaggtttttctttgagttgctaagcatttgcctgctggctgggaacaaggtgcttctgctctctgaataaccacaacaaagtcatcaattgccctcattacagctgaaagacacaggatccaagtgttggtgagaatacagagaaactgcaaccctcacgctgctggtgggaatgcaaaatggtccgctgtctgtggaatatggtctggcaggtccttaaaaggttaaacatgggttgaccatgtgacccagcaattccattcctaggtatatcctcaaaagaattgaaaacaggcactggaagtcgtattcaccaatgttcacagcaacgatattcatataaccaaaaggtggaaacaacccaaatggctgtcattaggtgaatggatcaacatatcatggtctgtccatcccgtggaatatgattcagccttaaaacagagggaagaggctgggtacagtggctcacacctgtaatcccagcactttgggaggccgaggtgggtggatcacttgaggtcagcaatttgagaccagcctggccaacatggtgaaaccccatctctactaaaaatacaaaaattagctgggtgtggtggcacatgcctgtaatcccagctactcgggaggctgagacaggagaagtgcttgaacctggaaggcagaggttgcagtgagctaagatcacgccactgcactccagtctgggtgacagagtcagactccgtctcaaaaaaaaaaaaaaaaaaagttaaaataaaatggaaggaagcattgacacatggtaccacacggatgaagcttaaaaacatcatgctcaatgaggaaagccgcacaccaaaggcgagcctatataaatctatttacatgaaatgtccagaataggtaaatccttagagatgggaagcagattggtgattgtgaggggctggggaaaggggagaatgggaagtgactgtttatgggtatgaggtctccttcaggggtgatgaaaatattctggaactggacagatgtgatggtggcacaacattgtgaatttgctcaatgccactgaactgtacactttaaaacagtcagggttttttttagacagagtctcgctctgtcgcccaggctggagtgcagtggcgcgatcttggctcactgcaacctccgcctcccgggctcaactcaacctcagcctcctgagtagctaggaccacaggcacctgtcaccatgcctggctaactttttgtacttttcttttcttttttttttttagtagatatgaggttttaccatgttggccaggctggtctcgaactcccgacctcaagtgatccacctgccttggcctcccaaagtgctgggattacaggcatcagcctctgggacccgcctaaaacagtcaattttatggtacatgaatttcaccctaataaaaataaataaataaataaataaataaataaataaataaataaataaatgaaaacagaacagaaaagtggtacccactcagctaagtatagatataaccacaggcttttaaaagagacataactggctgggctcggtgactcacacttgtaatcccagcactttgggaggccaaggcaggcagatggcttgagtgcaggagctcgagaccagcctggtcaaaatggtgaaagctcgtctctactaaaaatacaaaaaaattagccaggcgtggtggcaggagcctgtaatcccagctacttggaaggctgaggcaggagaatcgcttaaacccaggaggcagaggttgcagtgagacaagatctccagcctgggtgacaaagaaagaatccgtctcaaaaaaaaaaaaaaaaaaaaaaaaaaaaaaaaaaaagagacgtaacaaaccacatcacaactctgtcccctgctcaggccacacacacaggctcaagtctagggaagagctggaccctggaaacttgcgtagggcataagatccccagtacccaatgggatgggagccagtatcccatgcctgccatctttgtttgcttgcttgttgagagagtttcactctgtcacccaggctggagtgtagtggcgcgatctcaacttactgcaacctctgcttcccagactcaagcgattctcctaccttagcctcccgagttgctgggattacaggcacctgccaccacgccagctaatttttgttttttagtagagatgccatttcgccatgttggccaggctgctctcgagctcctgacctcaagcgatccacctgtctcagcctcccaaagggttgggattacagatgtgagccactgtgcccggccccatgcctgccattgtgaatcacctcccattctcataggtggtgcctgaggagagggttttctgggccctctcttggggtcacaacacagggagcaggtgacacacacctcagggaggtcagggtgcggttgatcttcaaagcgtctgccagcgccttggccccttgtggtccaatggagttaccgcggaggctgaaggaagagagaaagagacacctccttcatctgtctcccagagagggaaggggaaacagaaactgcattgaccttgaaattcgtgatcctctaagggaatgtgtaagggcttaggatctcatgtttggtggaaccagggcagagatccttatataaacaaggaaggagtttccccacgactgtctcaggtgttgggggaaagaaagcagcacctgatggactagtgggcttgggccaaatgtggagatgagaatgatggccccagatgcagggcaaacatctggtgtgtccctggctgtagcccggcaactgaggagccatggttcagcccggctgtccttctgccccaccaggaaggcatgtgcgctaaggtgtggcctccctgtgtcttattcccacaggagtcttagaacctgctccaaatgaagtatggatattatgtccagatgctacccaggggctgaatcatgggaatcagggaagaacagacaggtaagacccaagtcatttcctaggagggaggggacttcacaagatgcctcacaactcttctggttccaatggcaaaagttcggccttggttgtccttacttactccagagaggtcagacttctgttgaccaagagggatctggccagagctttggcccctttgttactgatctggttctccgccaagctgcccaaggaaagggagaggagtggttattttaggcatgcacatctcatggcctcttcctcaacgctgtgcccgtgattaatcctctaggctcccccacatcatcagggtctggacataggtggagatgaggtgacccctggagcagaatgccaggcacagcagagcccctgagcctgggcagcgtagggccagagtgggaggacagaccctcatcatggcaaagggtctcaggaaaaagtttaaccagaatccagcacaacagcttctacacaaacagcacagcaaagaaaatggaaatctcggaagcctaacatgcagatggcagccagtggtgtactggtaaactggctcccaggaaaaacaaaatttcaaaaactgggctgtgcgtggtggctcatgcctatacaatcccagcactttgggaggccaaggcgggagcatcacttgaaaccaggcgtttgagactagcctgggaaacatagggagatcttgtctccacgaaaaacataaaaattagtcaggtggcgcacctgtagtccaagctacttgggaggctgaggagggaggatttagcctagaaggttgaggctgcaatgagccatgatgacatcactgcgctccagcctgagcgacagagtgagaccatgtctcaaaacaacaacaaaacaaaaaacaaatgctagcaaactgatttgtagtatctgccactttccatggtataaatactcccagcaacaccaagttcaagcacctccaccttgcaaaattcctgaaaatttaacaatcagctttcgtgaactggtacaaacaaatttaggcacactactgatcctagcctcttttctagtgcaaaatggcaaatggtagagttatttaaaattaactttaaaattaaaaaaaaaccacacacacacacacacacacacacatcttgatttgcctcaaaagcatggttctgggaatatggtggtggatcaactcaatgttacttcatgtatccagctgcagaaatagtagctgtccaggctctttgccgtttgtaggcattcagccccatgggatatagtagttcaattagaatccccaggctggtgctcttctttttcttttttcagacaggatctcattctgtcacccaggctggagtgcagtggcatgatcatggctcactgtaactcgaactctcgagctcaagaatcctcccacttcagcctcccaagtaactgggaccagaggtgcacgccaccacacctggctagttttttaattttttgcagagacagggttttactttgttgccgaggctggtctcaaactcctgggctcaaacgatcctcctgccttggcctcccaaagtgctggaattacaggcatgagccaccgtgcccagcctggtacttttcaagctatattgaagcaaactgttcactggaataaagtctcttttctctaaattccttttcagagaacttcaattcacagcattcgtccaggccacctctgtataaatgttctcaaattctagagtgcttccatccctctgggacttttatggcattttataagttgtatttaacttctaggtgaaatagggatgtggcactgaggatcaactacagagagaggtaaagaagagcatgtggccagagaagagatttttggcttcattcagaataatttacttttatttttatttttagtaaagatggcatcttgccatatgtttgccaggttggtcttgaactcctggccttaaagaatctccccaccttccagattgctaggattataggaaggagccactgtgcctggcccccgaataatttctgagcactacctagtctgctttaagcaaaactaaaagttggctattttgtcatgtgctaaaaatgcaggaggcgctcacagaggaaaaaatattaataatgagaattgtcattcttttacttttctttttttttttctttttttttttttgagacggggtcttgctctgtcacctcggctggagtgcagtggcgcaatcttggctcactgcaacttctgcctcccagactcaagcagttctcctgcttcagcctcctgagtagcagggattacacacacccaccaccaccacgactggctaatttttgtattttttagtagagacagggttttgccagtttgaccaggctggtctcgaactcctgacctcaagtgattcacgggcctcagtctcccaaagtgctgggattaaaggcatgagccaccgcccctggcctagatatccttttaagcccatttttaccctcttaaggcacagaaatgacttcttcaaactcacacagagcctacacctctaaacatactccccagtgccttatttttgttactgaattagtgtaaattgccattaactcagataaagattacttcagaacccagaggcttgtatgagaatgaagaattacccctggccacagtggctcacacctgtaatcccagcactttgggaggctgaggcggatggatcacctgaggtcaggagtttgagaccagcctggccaataaagtaatatagtgaaaccctgtatcgactaaaaatacaaaaattagctgggtgtggtggcatgcgcctgtagtcccagctactcaggaggctgaggcaggagaattgcttgaacccgggaggcggagtctgcagtgagccaagatcgtgccactgcactccagcctgcccaacacagggagactccgtctcaaaacaaaaaaaaaaacaaaattagcccttgggttctcttctccaaactcacctccctaggtctgcaacagccaccctcagaggatcagtcacatcgattcaaccacaaaccccgagtgtgtgtagtttctcagatccaggaatgttattccaggagacgtttcataagcacacattcaccatgtgaacttttgtctaattacaagatgaaggtttttttgtttgttttgttcttttttgagacggagtctcactctgtcacccagactggagtgcagtggcgctggagtgcagtggtgcgatctcggctcactgcaacctctgcctcctgggttcacgccattctcctgcctcagcctcctgagtagctgggactacaggcgcccaccaccacgcccggctaattttttgtatttttagtagagacagggtttcaccgtgttagtcaggatggtctcgatttcctgacctcgtgatccacctgcttcggcctcccaaagtgctgggattacaggggtgagccaccacacccggccacaagatgcaattttaattaaaaattgtttaaattgatttaaaattaaatttgaaattaaattttaattaaattaaatttgaaatttaaaattttaattaaaaatgcaattggctgggtgcagtagctcacgccagtaatcccagcactttgggaggccaaggctggcggatcacaaggtcaggagttcgaggccagcctggttaacatggtgaaaccctgtctctactaaaaatacaaaaattagccaggtgtggtgggcccctctaatcccagctactcaggaggctggggttagagaactgcttgagcctgggaggcagagattacaatgagccgagatcatgccactacactccagctggggtgacaaagcaagactgtctgggggggataattataatcctgtgcctagaatgctgttggacagcaaacttggagaggtgcttagagaacattgtgcctggcattatgtcagcacacgtagtgctgtggaaacacctgcctgtgcacagcggtgtctagtcccgccaggtcacctccctcttcctactgatgaggcacctgagcctctagcactttctggaattgggcagaaacaagcaggctgcatctggagccacatgctccaaagacacttctccgtggcagcgccgctggccagctgagcagaggatgatgggaagagggttccataccccacaagaccataggcaccctggaggtcccctgggtctgtgttacctgatcttctgaatgcgacagtccttcccactcagcacgctgcccagcagctccatcacggggtcctggaactggttggtgtccagcctggccaaggggagcagtgacagtgagtgtcccacccgcccacgggcagggtgggggccctggcccggggcctctgcctctctccatcccatgcagcgctatcaccgcagctctgagatctgcgctcagccccagtgctcagacctttcccgtgagagtgaacaggaggctgggtgcccacgagacctgcggttcctgtgcagaacggcatcttccacgggctgtcgtcctcaccaccccacataccgcctgcctctgcgggacacctggatgaccctcagcctgtgtcctttcctccctactcactaaggtccagagtggcgggcaggggacaggctgaaagcattcagcgggtgtgcagcttctatcagactggatggttctgagggggttatgaattgaattgtgtccccacaaaagatatgaagtcctaaccccctgtgccccaagtatgtggctttattgagaaatggggtcactgtggatgtactttgttaaggtggggccatgctgaagtggggtgagcctgtaatccagtgtgacagtgtctttttaagacaagaaagcactggccaggtgcagtggctcaggcctgtaatcccagcaatttgggaggctggggtgggcgggtcacctgaggtcaggagtttgagagcagcctggccaacatggtgaaaccccgtctctactaaaaacacaaaaattagccaggcatgatggcgggcacctgtaatcccagctactagggaggctgaggcaggagaatcgcttgaacccaggaggcagcgtttgcagtgagctgagatcgcgccactgtattccagcctgggcgacagagcaagactccatctcaaaaaaaaagagaggacagcaccatgtggagacagacacagggagaagatgaccaggcgacgggagagactgaagtaacgcagccttaagccaagggttcccatcaaacactggaagctagagaggaaggaaagaacctctcctatatgtttcagagagcgcatggccctcctggcaccttgatttgagacttctggcctccagaactgcgagaaaacacactttagttgttttaagccaccaagttcatggtcctctgttacggcagccctaggagactgacagagaagcttggtggtggggaggggacggcttctgctctctcctctgccccttccccagcccctgccccctgccctggtatccacctgagcttccggcagtagagcagctggggcagcaggctctgaaggacgccctggctgaggctcagggacaggttggcctcctgggcacaggcgtcggacacctgcaggaggtaggccagggcagcgcggtgcgcgggaccagtcagcctggccagggccccgctctccatggcctcctccacgctgcgggccagctcggtgtgctgcagctcatgcaggcagtgcaacacgttgatggcccgtgcacagactgcggcatcggggcgcaggcagccctgcaggagctcagccacctgggtccggtaggcctggtgctcgccttgggccagcagggagccggccaggagggcattgaccctcggagacaagaggccggagaggaagcgcaggaacacgtccagcctcccgtcctctgcctgcatggcccgctgggctgcgctcctgaaatgcgtgaggaagcccagcctgggccaggatacgccgctctcagtgaagaggtcgaagatggccctcctggatgcgccatagtaatacgcggctgccacaaactcctgcagggacaggtgggtgaagcagtaggccactgacgatgccaacgtctcctctctctgcaggaagcagctgcacggggcgccctgcagcagagcgaggtctacaccaaacgccttcatgtcttgctcgtaaaacacgtatttcttcttgagcagcccatggaaggccagacggcccaatgtccccaccatcttgcggccaccatgggccacctgctcgatgcgagggcttgccttgcccttctcctgcccctccccgctgagggccatcctaaagtaccatgagtagagctcgcacagggtcctcgggggccacagctctgcatcctggggccccgtcctgctgcgccacaggtggcctagcgccatccccgtgagcctgcagaaggctgggacggtgcacatcaggtacagggccctgtcagcctgcacttggctcagcatccagcccagaagggcctggtcctcggggaacatctgctccaaacacaccttgatctcctcctcgttaaagccccggatctccgtcatccggtccaccaggccccctgggatctggccagatgcactgggacgggaggtgatccagatggaaacttccggaaagaggttgccacggatgatgttggtgatcaggtggtccaccgggatctccttctttgggtccgtgcaggccacggtgttggagaagtccagaggcgtcctgcactcatccaagccgtccaggatcaggagggccctggctgggactgccaccgccaggctgggctccccgacgtgcgggaagaccgagcagatgagtcggtcggcacacagcttctcgtgggtgttgagatcccggaaggtcagaggcagcaccagcgagaagtccttgccgacctgcccatgggcccagaggcggacgaagtgcctcaccagggtggtcttgcccatgccggccaccccgatagtgatggagacccggggtgggacagacacccgggagagaggcaggaagagccggtccagggcgacggtcctggcggggtgcccgcccccgcgggtggcctccacctgtgtgaagtcgtgttccctcagctgcaggtccgtcaggccctccaccagcaggagggaggccagcctgtgccagggtccgcccagctccgggccacctcccaccttgctcagcagggccttgcggtgcctctgtatccttgagtctgcgggacagaggccagtggggaggtctggtaagggaagagtgggcacaatcagcccaggtgttccccaccccgcgtctgcctcccaagccggtcctaccattgctgcagggccccagcggggcatccggtgtcctatccagggcctgcggggcctgggagccttgactgcccttcccagccagcagatccatgagggctttcacctgctcggctggggagcccgtaccgtggccctggccggcctccctgcccgtccgcacctcttgcttcctcatggagtcggggatcacctccaggagctgtgaagagagggcctgaacctgctgcctgccgtgccccccatccagcagcctgggacaggtgagcaagtccccaggaacggggtcagggatcccctcttcctctttcctcagcctttgggtggcccactggcctggcctctgagaatggactggaagggccatttgttcctgggtggtagcaatgatcacacgaatgcaggggcccagtggatgataactggggccctgagcttgtaccccggccctgccacttaccagataggtgactgagggcaggctgagtcacctctctgcgccttggtgtcttcatttgtgacctggaaatgatgatgaggttacaagtaagtttgctcaaaaggagggaggaatgaaagaaggtactctgttggaacatgtgggaaaaagcaaaaaaaaaaaaaaaaaaaaaaaaaaaaggcagcagcagccactctggggacgctacactgtgtgattctgactaacattctggaaaaggcaaaagtatggagacaggaagacagtgaaagaaagggtcagtgggggccaagggttggggaggaggggtgaatcggtggaacacagacaattcctagggcagtaacatgactctgtagggtactacagtggtgggtccatgtcattatcattatacatttgtccagacccacagaacgtacaactccaagagtgagcccatggctgggcacagtgactcacacctttaatcccaacactttgggagcctgaggtgatggatcgcttgagcccaggagtttgagaccagcttgggcaacatagtgagaacccatctctaaaattttttaaaaattagcctggtatggggtgtgtgccagtagtcccagctacttgggaggccaaggcagcaggatcgcttgagcccaggaggtcaaagctgcagtgagccatgatcacaccacggcactccagcctgggtgacagagcaagaccccatctctaagaaaaacaaaataaaacaaaaaacttaactcttcttgctcctgagttagagcaaaaagcaaaaaaaaaaaaaaaaaaaaaaaaaaagaatgagccagagtatacactatggacattgggtgatggcgacatgtccgtgtaggtttactgattataatcaatggaccactgtggcaggggacggtgatagtgacagagtctgggtgggggcaggcatggggtgtatgggaagtctctgtactttcccatcaatttttctgtaaacctggccagacgcggtggctcatgtctgtaagcccagcactttgggaggtcgaggcgggcagatcacttgaggtcaggaatttgagaccagcctggccgatatggtgagaccctgtctctactgaaaatacaaaaattagccggggagggtggctcgcgcctgtaatcccagcactttgggaggacgaagtgggcagatcacctgaggtcaggagttcaagaccagcctgaccaacatggagaaaccccatctctattaaatatacaaaattagccaagtgtggcagcacatgcctgtaatcccagctactcaggaggctgaggcaggagaatcacttgaacccgggaggcagaggttgcagtaagctgagatcatgccattgcactgtagcctgggcaacaagaacgaaactccgtataaaaaaaaaaaaaaaaattagccaggcgtggtggctggtgcctgtaatcccagctactcaggaggctgaggcaggacaatcacttgaacctggaaggtagaggctgcaatgagctgagattgcgccactgcactccagtcggaggggaagagcgagactccgtaagcctaaaattgctttacaaggaaaagcttattaattaaaaaaaggaaataaaagatagaagaaggaggagtcaaaaaggagaaaacgctggttctcagagcggctgtttttcttactatgttcctggggtctcctgggagtgcaggagctcctgggctcccagcagtgctgtttgccctctgctcgtggggattgtgatgcagagatgctgagaggcaaagccaaggccccccactcccatttgcctccttgttgccaaggctggttgtccccccgcccccacagccctcccacacccaagctgtacactaaggccgggaactcgcccccacccaccctgctcgcctcctcaccgtgcaccctggccacagcagcccctccagtggggccccaggaactcaatggatggggctcagccttccgttgtccacagttctaggagaaaaaacacaatgtggccagcagaggtgatggctcactgctgctgatggcagccctgcattcaaaaataacaccaggtgttgtcactgcatagagaagcaggttggaccccacctgtccacagggcatttccctggttctcaatgtttagcttgctgttaggctgggcggtgtggctcacgcctgtaatcccagcattttgggaggctgaggcaggcggatcacctgaggttaggagttcaagaccagcctggccaacatggtgcaaccccatctctactaataatacaaatgagctgggcatggtggtgggcgcctgtaatcccaggtactcgagaggctgaggcaggagaattgcttgaccctggaaggcagaggttgcagtgagctgagatcacgccactgcactccagcctgggcaacagagcgagactccatctcaaaaaaaaaaaaaaaaaaaaaagcttgctgtctgcagccctgggattcagcaggctccctggccttggattagcagtggggagcctagctttttctttctttcttttttttttgagacggagtctgctgtgttgcccaggctggagtgcaatggcgtgatctcagctcactgaaacttctgcctcccaggttcaagcaattctcctgcctcagcctcccaagtatctgggattacaggcacatgccaccacacctggctaatttttgtaattttagtagaagcagggtttcaccttgctcaccgggctggtcttgaactcttgaccttgtgatctgcccacctcagccgagcctagcattttaacacaggtgatgctttttatctggaaaatgataaaagaagcttagcaataagtaaatagtaaagtaaaaataagtaaaacagtaaagtaaaaataagtaaaataccatttttcaggcattcaggtcatggtgttgaagaagtaaggagtgcgatcaatttgaggttgctggcacccaggccagctgaactaacctggaacattaggaacaggccagggcaaggccagtctccttatgctgccccaaagcctgttcttttattcttctaaatgtcaaaaccaagagggataaaaaatatgggattttgggctaggcacagtggctcatgcttgtcattccagcactttgggaggctgaggtaggaggatcacttgagcccaggagtttgagaccagcctgggcaaagtagtgagaccgtagctctacaaaataaaaattaaaaattagccaggcatggtggttcacgcctgtagtcccagctactcagtaggctgaggtgagaggactgcttgagcctgggaggttgaggctgcaatgagcagagattgcaccattgcactccagcctgggcaacagagtgagaccctgtcttaggagaaaaaaaaagatgggatttgaattgacattgcctcatgtgtatgggtccatgtgggtaatttgaggtccttctttagatccttctgtaaaactttatattttttctcatctcggtcttgccagttccttatttgtatctaggtatttttaaaaacagtttttgtcgtatgatgaatattgttggtataaaagatgattgatttttattttattgcatgtctcatcaacatattaaatattcacattggttttcatcattttccagttaattttcttcaggttttcaaattacttcagcaaggctgggcgtggtggctcacacctataatcccagcactttgggaggccaaggtgggcagatcacttgaggtcaggagttcgagaccagcctggccaacatggcggaaccccatctctactaaaaatacaaaagttagctgggtgtgatggcgtgtgcctgtaatcccagctattggggacactgaggttggagaatcgcttgaacccgagaggaggaggttgcagtgaggcgaaaacgcaccactgcactccagccggggtgacagagagagacaccatctcaaaaaaaaaaaaaaattcttcagcaagaagaatttttatctctttatttctgaaaaccatatatatatatatatatatatattattttttttttttttttttttttttgaggtggagtctcgcactgtcacccaggctggagtgcagtggcacgatctcactgtagcctctacctcccatgttcaagtgattctcctgccttagcctccccagtagctgggattacaggcacgcaccaccatgcctggctaatttttgtattttagtagagatggggtttcaccatgttgaccagactggtcttgaactcctgacctcaagtgatccacccgttttggcctcccaaagtgctcggattgtaggtgtgagccaccgtgcccagcccaaaaactataactcttattttgaacaattttaccacattggccaggcctaccccttccttggagcaataaggttgttgcaggccttcttgttttactctagactagaccaggagtggttcttgcccaaactgttaggtgtgatgtttgtgacagatttctagttttcttctccgatagagaaagatttattttgttctattaccattcaaatactattatgtaatatttactgaaggcatactgtgttctgcatattctgttaagcactgtatttccataatttatttctcataactctcaataccattatttctcccattttacagatgaagacactgaggctcagagaggttaagtgacttgtccaaggatacacagctgggaagtgggagttgggatagaaatcaattcctcactgacaccagtgcgtgtgctgtataatctactgcctcttaaggtagtttacactttttttttttgagacagagtctcaactcctgacctcaagtgatccacccacctcagcctcccaaagtgctgagattacaggtgtgagctgccgtgcctgggcaaaattttttaagataaggaatatctgttaaattagcaaattactttttagcatatattgatataaacatatgatttatttctcttcatttattcaaccagcaaatatttatggagagcctgttgtatgttctaggccctggggatgtgaaggtgaccaagttagatcaagtccttgacctgcggtttgacgggtaagggataatggcaatggaaaggaaaacaagtcaataagcaaggcagtttctgctggtggttagtgctgtgagtggaataaactgtgagtgacaaagaagcctggaattctagggggaggaggagcagaggtggtaattggcggctggggaaggctgctgtgagaggcctctgagaaaaagctacctaggagtagagagggtgagaaagagtcatgcagagagctaggggagggacatttcaggccaaggaaacagcaagtgcttagaggaaatgttgctggaacatggtaagtgagcaagtggcaccaccccctcagggctggaaaagccagtcaccgttgttgtaaggagtttggatttgttctaagtatggaggggagccactggggggagtgacatgagcaatggatatcagatctctcctggaatccatgagctacactaaatgattttctgatattgaaccaaccttgcattctagaatacagtcttccatttgtattattaaatagaagatgtatatattccatatatgtaaaaaatgtgtgggctagcacaagaatagatacataagtcaacagaataggatatagaggccaggaacaaatatatatttataatatctacacattaaggagtttggtaacatgacaaaaatagcatttcaaatcagtgaaaatggcattggggcaattgaccagcctatgaaaaatattttccagctgtaattcacattaaacacaaaatttattttcaggtcaattaaggagttaaaagttgtaaacacaaaaccataaaagcacaataagaaaatatgagataatattttaaaatattatttaggtaaaggttttttacagtgagacgtaaaactcagaagtgtcagcctgggcaacatagtgacacaccatctctacaaaaaaaaaaaaatagatggggctggtggtgggcacctgtggaactagctatggggaggctgaggtaggaggaccccttgagctcaggaggctgaggctgcagtgagctatgattgtgccactgcaatccagcttgggtgacagagcaagaccctggctttaaaaaaaaaaaaaaaaagcagaattcatgaagagggagactagtaaatttgtcttaattgaattaaaatattaaataattaaatatttagtttgatattaaataattaaaatatttgccaggcgtggtggctcacgcctgtaatcccagcactttgggaggctgaggcgggtggatcacaaggtcaagagatcaagaccagcctggccaacatggtgaaaccccatctctactaaaaatacaaaaattagctgggcgtggtggcacgtgcctgtagtcccggctactcgggaggctgaggcaggagaatcgcttgaacccgggaggcagaggttgcagtgagccaagatggcgccactgcactccagcctgggtgacagagcgagactccatctcaaaaaataataataataattaaaatatttataagtaataatagatgccataaagttgaaagaaaaactataagccaggagtcaacatttgcaacatacatggaaaaatatgaatatccttaatatataaagaacttataaatcaataataagtaaccaaacagaattatgaaccccaaatgaaatagaaaaaaggacacagataattcatagaagtataaatgaccaagatattgaaaagatgctcagtgtcactaaggatcaagaaaaaagcaaaagaataaactatcatttttcatacgtctcattggtgaatattataacataacagactgcattggtgagaacatggaggtagtgggaaattttttttttttttgagacaggatctcactgtgtcacccaggctggagtgcagtggcatgatcagggttcactgcagcctcaacttccctgggctcaagtgatcctccaaagtagctgggactacaggcgcatgctaccacatccagctaatttttgtattttttgtagagacagggtcttgccatgttgcctaggctggtctccaacttctggggtcaagcaatcttcccaccttggcctcccaaagtgctggaattattggcatgagccactgtgccaggcctgtagtgggaatcttaattcatagtgggtggaagtataaattagtataacaattctggattataataaccattatctgttgtcattaaatatcttttgtcctagaaattccacttctgggaatttatcctaaagaaatatgtgggccaggcgcggtgactcacacctgtaatcctagcactttgggaggccaaggcaggcagatcatctgaggtcaggggttcgagaccagtctggccaacatggtgaaaccccgtctctactaaaaatacaaaaattagctgggcatggtggtgggtgaccgtaatcccagctactcaggaggctgaggcagggaattgcttgaacccaggaggtggaggttgcagtgagccgagatggtgccactgcactctagcctgggcgatagagcaagactctatctcaaaaaaaaaaaaaaaaaaaaatcaaatatctaggaataaatctagcaaaatttgcaagacctctatactgaaaactataaaacattactgagagaaattaaaaaacatcaaaaggagggatggaggctgggcaccatggctcacccctgtaatcccagcactttaggaggccaaggtgggtggattgcttgagcccgggagtttgagaccagcctgagcaacatgggcaaaaccctgtctctataaaaagtacaaaaaaaaaaaaattagctgagcacggtggcgcatgcctgtaatcccagctactcaaggaagctgaggtgggaggatcgcttaactcccgccgtcaaggctgcagttagctgagatctcactactccactccagcctgagtgatagagcaagaccctgtctcacacacacacacaaaagctagcaattatctaaacattcaaaggtatgtcagcccaaatgaagcagtgctactgtctgcctgatatgccagaggccaggatacggggtcctctgtccttcactgtgtgacattagggtgtggcccaggtggacacagcctcctgttgttggatgtccatgtgcacccaccaggtgaccagccctgctgctgggggcgggagtggccaggaggatgagaggactgcgtggaagaagtctcagctctggtagggcatcatttggggtcttattgattgattgatttaaaattttggtaaaatacacataacacaaaatttaccattttaaccattttaaaaataattttccttaaaaaatagaggcagggtcttgctttgtcgctaaaaaataaagacagggtcctgctttgttgcccaggctggagtgcagtggtacgatcttggctcactgcagcctcgacctcctgggctcaagtgattctcccacctcagcctcccaagtagctgggattacaggtacaggtgaggaccaccatgcttggcccattgtaaccattttatctttttttttttttttttttttttttttttttttgagatagagtctcactctgttgcctaggctggagtgtcgtggcactatctcgtctcactgcaacctctgcctcctgggttcaagtgattctcccgcctcagggtcctcagtaactgggattataggcacccaccatcaataccatttgtatttttgtagagacagggtttcaccatgttggccaggctggtcttgaactcctgacctccaaaagtgctgggattacaggtgtgaaccactgcgcccggccttgtggagcacggcttttaaataaccaacgctcggcctgaccacccagagatttgattggtctggcaagggcccccacgtggatctagtttaagctcctccggtggttctaaccagagttgagaaccacgggacccgagcggggctgggagaggaatgagggagggacagtgctggcaggagtgaggggttggggcgaggcaggactcacaagcgcctgggaaggcggggacggggtgtagggggctggcaagcacccctgcctctgtggcctcattagtctctcagtattgggagtcagcactccctcctgatcagacacccatctttgtggccccatgaccttgggtccagggttgccagattcagcaaattaaaatacaagacaaacctgggcacagtggctcatgcctgtaatcctagcactttgggaggctgaggtgggcagatcaccttgaggtcaggagttcaagaccagcctgaccaacatggcgaaaccccatctctacgaaaaatacaaacattagctgggcgtggtggtggatgtctgtagtcccagctactctggaggctgaggcaggagaatcgcctgaactcaggaggtggaggctgcagtgagccaagatcacgccactgcactccagcctgggtgacagagcgagactgtctcaaaaaataatgataaaatatgagatatccacagataattaaatttcagataaacgacatataatttttagtataagcatagcttatgtcatactggagacataccaaagaaatggattatttgaaattcacatttgaccaagtgtcctgtatctgatctggcatccctgctcaggccccattcagacgaaacgtggctttcatcctggacactgtccctaagaaggacagaggagggggtgcaggtgaaccaacccccctgccattgccagcacctcccaggaccagccccaaaggctgatgggggctggttacctggctgccaccgctgccaggccctgcacgcagccctaacatccccctggcaggctggagccttccacagacctctcagccgagtgaggtcgcgaggccgcagacgccactatggatggtcaggcggcccctgtgagcgcagctgaaagacagagagactgaggacaggtgggactcgggttgctttgggggatctgaaggccagaggtcgctccacagctggtttgagctgctgcgagcagggcgaggccagagggacgagtaggtgccactgctgcctcctccccgggagcctcccaggtagcaccaggtttcacccctagagctttgtctgtgagcgaaggtgaacctgaggccttcctggtgtggtgtgggctcaagcccagttcctcaggctcagcaagtggcctgctgcctcattcctgagaagcctcagtcccgacggactagccgcctctgcccatcacccgcccacctgatctgtgcctcagtccttgccgggacctgctgggtccttccctgccacttggcgcccgggtgggacttcccagtgctggctgcctacctgggctgccagtatctcccaccacggctgcttggatgctcctctcttcccacatcctgcccctgccccctcccagggccttggaattcaggactcggttctctcgaggtggccccagcatcatcacttgagctcaaaagccttcccgaaggaagaaggaagtggcacctgcacctcagggccctaccctgctcactgcatggacccctggagtccaaggggtggagaggcccagccctggggagcccagcaccctgggacagaagaagaggggtgcagcctgcagcctgtgatggccaacagtgagccccaggctcagggtcacctccagggaggggtccagaaaaacaccagggcctctggagcctggccataggggaagaccctgcagccaacacccaggctggcccagggcagtggcacttcttccgagaaggcctctgcggttgccgtctctctcgacccttgtctcacccaaggctgtgggcaggagaggccctggggctgcccactcgcctgggggcggcgcctgcaccctccctgcccctcatgacctcgcccctcctgtgctgtcacctccatctacaggtggggtgctgaggcccagagaagtagcctcccatggggggtcccagtgccaggaagggtgcccaggtctgccgattccccaggccgtggctcagcatcaccactgcctgcccgcagcaccttcaagatgcttcctgcttctcctgggccatcactggtacctgggggagctgggttttgtccctgggacctgtcctgggccattcttagttacctgttttttcttttcttttttgttttgttttgttttgttttggagacagtctcgctttgtcacccaggattgagtgcagtggctcgatctcggctcactgcaacctacgcctcccgggttcaagcggttctcctgcctcagcctcccgactagctgggtgggattacaggcgtctgccaacatgcctggctaatttattttttatttttagtagagatggggtttcaccatgttggccaggctagtctcaaagtcctgacctcaagtgatccgcccaccttggcctcccaaagtgttgggattacaggcgtgagccaccgtgcctggccacatctcttttttctacagcatgagccagtcctgccccaggagacagcttcttggagtctcgtggagtctccccagtccccctccccagagtagctcaggccttaaggccactgtccttcctgccagcatcccttctccctcccctgccctgcactgaggtcacctggacccaacttacctcccgggcctcgatgctgctccagggacagcaagactggggggcctgggggcgtccatctccatgctcctgggctcagccctgctccagctgcgtggtggtagatgccctgggaatccctgtgccagcctgagttctcaggaccagggatcagggcacttaccacgccaaccaaccaaccgtgtgggggccgagagcagtgcagccccgaccttctgcagccccaccgagcccaccggctgt

SEQ ID NO: 857 - DNA, 37869 bp, Homo sapiens
actagctgttcttaaattttattttccaaaaaatggcattttccaggtgccccagtcctcattcctaaggtcccacctcagttggcacctgtgcgtgtatatggatacactttccccccagggccctgcctggtatgggccagggcagcccatgaactctgggcctcaccacgaggttctgggtgaggccctcgtcccgcctcagtgctggcccgagctgccgagccagggccgcagcccccgtcttgcctctgtctgccggctgctcccggggcctgatcctctggcccccactgggcctgggctgcacatggcagctacctgctcactgtcctcctcactccctggcacacagcttcagggtggaccaatcacccaacgtcagattctgaaagaaaaagccccggtgagaagggagggggacaggtgggtgcatacccacacctgcagccgcccagacaggccctgctgctcccaccacgcgggatccaggctggcagacactcaccggcccgcaggctaggtctcccgccacttcttcccgttcagcacctgcagcttctccaggctctgggtcactaagcacagtgcttgccctgaggaatgatgaccttgagcctctcccggccaggctcaggagggctgggtggtgctgccccggggtctcagctgcaggatgtgacctgcccctcacccgttatggccccagccccgaggtcagccttggggtagagagacacaaacccgctttccctggaaaggggtccctttgcctccctcggaaacaaaaggagcgctcagtcgtctggtccccggagactcacccatctcacggacacggtcctccagggctcccgagagctcggggaggctcatggcctgcagggacgcttgccagcccttggagtctgtggtgcaggtgcagggaccgagttagctgggggtctgcgtccccacaggccctgctttattctgagcccatgcaaccaggagaacctgcttggatcagaacctccctacccgcctgacagtgtctaagcaacctcccaaggccgaggcagggaagccctgttgtgcccttcctcccacaggctgagcaaacactacgaggcccgggtcagcccgagagaaggcaaagctctgccggtggggacccgggtctgggccctggctggaggctacagaagtcactggcggtctcagcacagcacagccagccaaggcacagggcctttctcgagtacctcctacccctgggggataggcagttttcctgtcacaggtgaggaagtgggcttgggtccccagggccccctcttttccttggactctgggatcatgtgcacacagggacctgggagagtggctgccggccggagaaccaggccaagcccactgggtcaaacctggcttcagggctcccccaccttcccctctgcccagtgcggagtcaggccactgctcttaccagctggggggacggctaggcccagagtggctgcaccagggggctggtcctgcctcactcgagatgacagctcagcttgacaggctctgccagacacagaaacaaatattggtgagagcagaggcctggccgctgcagagcccccacctcagaccttctaggggagggaggggctcagccctgtccttgcagctggccctcatgggctgggccagtgccccatgaggctgcactaaagagcaggagggcgaccggtgcagattcccggacccaactcctgcctgggtctgcctgcaggaaggaagggcctgatgaaatgggggtggggtggctccagaccctgaaatccacccctcagttacaaaatcaggaggaaaggatgtgtgggggcccaggggccaggtggctgaccactggagacccagcccagggcagctcagagccactcaccgcagctggtccaggacgagggcagcatcccgggccagggcccacgtctcccgcagccgggcctggaggtcctcgcgggcgcggtcctgctccagcaggcagctctccaccacggcgcgcagctcctgctcctgacacacctggccccgcgtggcctctacctcctcgcagcgctgcaggggggtggggggcgcggggaggctgggaggtggccggtcaagccagacccttggccacggccctgtcctgtgtgtggggccctctccccactgcatccacctgacccctccacacagcacccaccttttctgtcagagatggagccaactcacgggtgtcaccctgcccccccatcccccacccagccactcaccttgtgcagctggatggcgagctcctgcatctcagcctccagccggtcggcgtaggccagctccagggcatccccgggtgggcgggcactgctgtgccagcgggcaatggcggacgtcatcttcctcttgggcccaaacagcctgcggggggaatgtgaccaggatatgcctcagcgtcccaagagcgcttacatgagtgggagtttgccccaaccccgggctgagggccagagcggcccttctggacgcacgtgatgccaatttccttcaggtcgctctcagtgagggtcagaaagatgcggaggtccacgtcctgctcctcaaacacctgcaggtacttcagacacccgatctgctccagcagtgcggcaaggtcctggcaggcacaggggacaggttgggggaggtagtggctgacgacgaagcagagacgttttcctccactcggagccccaccacttccccaggctcagaaccaagacagtgccttgtgtgtggcgcccaggctgtcccctcctactctggtggctcaggcagggcaggatgttgcaggcaggtgagtcctcacactatggtcggccacgtggggacaatgtatgttcatcaccagaaactggcctcctcctcccacacatgctcagttctgtgaagggaccatggagctgctgatctcgacaatgctttgtaggcggagagcgctgccctctaattctagagtctcagtgtcggatgttctgatttccacttgtctaagcgcagctcttctccgagttcacctgtctggagttcaccgagctccctggatgtaagatccgtgtttctgatccactgagatggtcaggctgtttctcacccatcgtttctgctctccttctggaatgccactgtatggggtggtgtcggtgtgcttgaggggatcacagatttctgttaattttttttactcattctttctgttcctcaagcgagatgatctcaggtgacctgtgttcacaagttgtctgactcttctgcctgctcaattctgctgtgagctcgtctagtgatattttcatttcatttacttttcaactccagaaatcctacttttgagagtttattgcttttaatggacaaacaaatgttactctgacattttcttcaagctattttctgaaagaaacatacttaggacactaccctgaccagactccactcaacgtatgttgaagggaccgagacgtgtgcctgctcactgagccaggggctgcagggagaagccggcaaatccaaggctctactgaacagcaaagccagtgctttaacaaataaccagccaggccgggcatggcaccaggccaggtgtggtggctcacgcctgtaatcccagcactttgggaggtcgaggcgggcggatcacgatgtcaggaatttgagaccagcctggccaacatagtgaaatcccgtctctactaaaaatacaaaaaattagatgggcatggtggcgggtgcctgtaatcccagctacttgggaggctgaggcaggagaatcgcttgaacccaggaggaggaggttgcagtgagccgagatcgcgccactgcactccagcccagatgacagtgcgagactccgtctcgaacaaacaaaccaaataaccaaccagagcttccctctgcctctcctctccgtgcctcttctgcccacacagggtaggagaactcagcagacacaggtgagacagctgagctgtgagtcacacctctgatccctaaggtaatgtgtggtcagagggaccacagaaaggaggaggatggtggcagctgtaaccatcaccaagcacacactgtgtgtagttcctgtctctgcttcaaccacatcttgtcagactcctgcaggcagctctgaggtcaagtgtgcttttcttctccccaggctcagggaggccaactccagtatggaaagcagggagacaggtcctttccgtggagaggaacagagtagaagcgctgcagcggggctgccagccatggagccggctgtgagcctgtggagcctaacaggccatggggatgccaccgccattctgttctcctagcagcgcctggcacgtcatatacacaacacatgcctcctaagtcacaaaaagtgccgtctctgagtgtaacctccagtttcacaagcggtcttacctggggtcctgagtagggggccctctgagtctgggggctggactcagcgagaaagccttccctgtcagttgcagcgcggggaggccactggctgtcaggattcttggtcttcatgtaacttttagcttgtttgcgagctgagcttttacaggcatgatccgagtcctgcagtgagaggcgtgcatctgaaagagtgcgcgggctaacttgagagccttggtgaaacccccacccgccacacaggggcttgagaggcttcgtgaaaccccccacccgccacacaggggcttccggtgcgttcgctgtcgtctgagaagccagaccctggacacagcacgtcccagtgcagcacacacgtgcagcagctgcttcttacatacatgctcatcttaaagtaactgggggatgtcaggcatcccagccagggaccggctatgggagaccaagaaagaaagaatccgtacctcgttgctctccacagaagcttcgctgctgagcccctgggctctggccaggccctcgctgctgctgctgctctggacgggccccaggttggcacagaaagcatgttcctctgagggcgggaagacagggcgtccgcctgcagccctcaccgaggtgctgcgcatgggcgtgccccgggctgagccgcctccaccagggcactccttggggcctgcagcggttgcttccttatatttcaaacttcctgcctgtcctaaaccctcccctctatacagacgggcagggcttctgtcttttttgttcactgataaatcccaagcacccggagcagtgcttggcacacggtgggcactatggaaacagctgctgcacggaggtgcagttataacagacattcctactggggcctgccctgaaagcctcaggggctcccaagcaaggagctaaacctgttgctgtggaacggctcccttaagccgcacggggatgctggaccagaagcttctcccattcctcacaagaaccagggccgtccacacctacccctttcctgtcctctgctggatggctgtgtccagcgccaggcccaggggataagtggggatgggcacacaggagctccaggacctgcctgagccacgggccggatgggtgggggtgcacgtaccccgactgctgctgctgctgctgctctccacatcccgctcattgatgggggaggtgacatcccggcagcagaggccctcttcttccagggggttctcgccactgctgttgaaggtgacatagccacggggaggagcctgctctgtgtacagaatggggcccataagcccagggaactccaaagtgaaacctcctcagaggccgaggcccaggatggaggcaggtgacttcccagtcatgacctcacctacttgcccctgcgacctggcatggctctatctgtggtgtgtgggtggaaaagatgctctgagggtcagtcagtggcccaagcaagtgcctggtggggcgagggctggcagccaggtcaagcctgggccctctccatttcttttccaaggggaaaacgtagcaaatggtcagctgtatttacagatgcctgaccagagaaaactataccatgagtgttccttttagcaggaggtagctaatgacctcacacagacacccatcgaccacgtgtctttatgtccctgtgacctttaaccacaggcgcttagcgggcctcctctggtcagtcaaccccggcgaaaaagagacctggctgagcaggaaggaaaaaggccttgaggtaaaaattaacaacaataatatgaaattacctaactctacctgcctctaaaaccaagcagaaaaaggggcatgtataccaggcaatttcactccagttttgcccctttacataaaaagactgacttgaccagtcacggtggcacatgtctgtaatctcagctacttgggaggctgagacaggaggatcgcttgagctcaggaactggagccttcagtgagctatgatcgtgccactgcactccagcctgggctacagtgaaaccctgtctcaaaaaagaacccaaaggactggttgatgggaccatggggaacttactttcctctttacgtattttcctagttatggagaagtttttctaatcagcacatgctatttatcattgccccctaaactgtttttgagacagggtcttgctgtgttatccagactggaatgcaatggcaccatcatgggtcactacagccttgacctcctgggctcaagcaatccttccacctcagcctctcatgtaactggggctacaggcatgggccaccatatctggctaattttcaaaattttttgtagagatagggtcttgctacattgcccaggctggtctcacaactcctgagcccaagcaatcttcctacctcagccttccaaagtgctgggattacaggtataagccactgcacctggcccccccaattttttttttttttttttgagacggagtcttgctctgtcaccagactggagtgcagtggcacaatctcggctcactgcaacctccgcctcccgggttcaaccgattctcctgcctcagcctcccgagtagctgggattataggcacgtactaccatgcccagctaatttttgcatttttagtaaagatgggatttcaccatgttggccaggatggtctggatctcttgatccacctgcctcggcctcccaaagtgctgggattacaggcgtgagccactgcgcccggccccaaatttcttaattactggcaaataaaatatatgcacttatagaaaatttaaatttcacaaggtatgagaaaacaaaaatcccctgaaataccacacctgagaccaccaccatgattacttctctgtggatacatacaaagaaccgcacacaagcggcttcagacatgtatgattttgttaaagcatttgttgtacagctatatagattaattaccaactcagccccaggatgacagcttccttcctgtccccaccacacctcaggctgtagcaggtggcagggaccttttggaaggaagagactctgccactcagaacgaccagcccggtgtcccagagccagtgctcacagctcagcggacgggacacgggcgggccctcatgctgtggtggggctggccagcagctcgagagaggccttcccagtggcccagtcagctcacccttcccaggatgatgggagaaggtgggtctccagttcccaacccagcacccaggcttgggaagacagaagtctgcacatctgcttgttcctggggtctagaagggaattcaattactggtggacccctggctgaaacactgtctactctcactcttccaagtcctggcctcaaagaggccttgctcccgagaaggaccagccaccaggcctgtgagaccagcagccttggcctggctatgagtgggtgacagccatcaaaggaagacataactcacacctccagctgagctctgggacagaccacagcaatagagagtaggcaccaaacccaactcccctaaaaagaaaccccagcactccccaagagcaaaacgctcaacaccctggggctgggaatctgagaatgaacgagactggaaaacccaaaggctaggattcttcaccagcaagtcaacaagcgggccctctctcaggagggtctgagtacaacttcatcgccctgagaaaacagcagggcctgttttcttggcctcctgcccccagcagcgcacccgacccagctggtatgggcagggcagggaagtgaacttcacgctttgcctcctccctgtatgagccaacccacctatgtgatgaatgaaatctgaccttagctacatttctgctgcaggagagaaagttctattcctaaatttaaccaacgaaaaggaaactccaggagataaagcaaaaaacaagagctagtccgtgaccaatgcatttccatcacaggactcaatcctgagtctccctgagcatgaaagctgggccacctgtcccgctgccacctgaggtccagcgacccacatttcaggagcctaagagctattccattcttgccaacacaaaatcctggtatgcaatgagaaagagccctcgggaaacgcgggccactcaccatagcgaggccgtggggctctgccgcccaggccaatgcctgtgatcctggccagggctcgcggtccctcgtggatgctgacacccttcttccggcaaggcctctgtctctgaggagcagggcaggactcgtcagaagagctcagatcttcgtacttttctgtgatcaaacaccaagattaagatagtgtgttcagtaatggactcatttactaatccttacggcaaactgaaagaaagtgactgtcgccggttttgttaaattaaggagaagggtatctgccagggcatcacttctgagaaatgccctaacaggccggggcgctgctccaatgggccacagggagctgcaaagttagtgaggatgggaagtttcatttttcttgagacagagtctcactctgtcccccgagctgaagtgtaatggcatgatcttggctcactcactgcaacctccgcctcctgggttctagcgattctcacgcctcacccttccaagtagctgcggttacagatgcgtgccaccatgcccagtgttttttttcttttctttttcagtagacacaggcttttgccatgttggccaggctggtctcaaactcctgatctgcctgccttggcctcccaaagtgctgggattacaggcatgagccaccatgcccagccaggagtttattatctctgttggggtttgccaaattgttcataagtctgtattgttcataatcagaaattctgttctaatttgaataagtaaaacccatctcttcattaaaatatatggtaatataagtcacaactactttttcctaatcccttcctttggaaacaacttttttttttttcttttgagaaggagttttgctcttgctgcccaggctggaacttccgcctcctgggttcaagcaattctcctatctcagcctcccgagtagttgggaattataggcagatgccaccatacccagctaatttttatattttagtagagatggggtttcatcatattaggctggtcttgaactcctgacctcaggtgatccacccacctcagcctcgcaaagtgctgggattataggcacgttaccactgtgcccggctggaaacaacttattaagcaattctgtattttcttttttttttctttatttttttgagacggagtcttgctctgtcacccaggcaggagtgcaatggtgcgatcacggctcactgcaagctccacctcctgggttcacgccactctcctgcctcaggctcccaagtagctgggactacaggcacccggccaccatgcccagctaatcttgtttttgtatttttagtagagacggggtttcaccatgttggccaggctggtctcgatctcctgaccttgtgatccgcccaccttggcctcccacaaagtgctggcatcacaggagtgagccacagcgcccagccacaattttgtattttctaaagcatggcatgtgtttgctatgattataaactgtttcaaatcacttcccagtctgagctttcagagctcaaaccagagcttttattattttgtagcttttcagtttttcatatttgatttgtataaggctctgatctgattctacttttaagagatacgtgagttgtatacaggaggaaatgatgagatctccttgtggagtgggtaagctggggcagaaatgaagggaaaggtcctttgcattaccacctgagctgtgtttattatgaaacaatcccaatgccagggaagaggctgggctgagcctgacactgagaaaggagctgctcgctcaggtgcaaactgacaggacaactcagggcaggccagcaaagagggagagctcaggccctgaacgtgggccactctgtccttccccatgacgaggctcaagctctggcgactgagctagccatatggacacacacctcctcacactcaaagatctatagcactccagggagactgtgcttccatccaagctgaaggggagggagctgtaagacaaatgcaaagaggcagcaataagcaagggaacggcagctgcgtgaatctcagcacccaacacaccctcagagcagcttaaaaagaacaggcagatggaaaccacaaaagagccagggctgcaatcctgctatcaacgtggaattcagggcaaaacacattaaatatgacacggaaggacacttttttttttttttttttgaaacagagtttcactccgtcacctaggctggagtgcagtggcacaatctcggctcattgtaacctccgcctcccgggttcaagtgattctcctgcctcagcctcccgagtagctgggattgtaagtatgtgccaccatgcctggctaatttgtgtattttgagtagagacaaggtttcaccatgtaggctggactggtctcgaactcctgacctcaggggatctgcccgccttggcctcccaaagtgctcggattacaggtatgggccatgcccagccagaaggacacttctaatactaaaagccataattcacagtgaatctataacaagttatgaaaatctgtcaccaaaaaatgcaccaacttccttcataaatcagaaacacgctaataggtaattttgtagaaaatgaactaagagtacataatcctaaataagatagactcacagatatgctaaactgtatacagataatagagaatacaacttctcaagcaaaacacggaacactaaaaaatattgatcagggccgggcgcggtggctcacgcctgtaatcccagcactttgggaggccgaggtgggcggatcacttgaggtcaggacttcaagaccaacctggccaacatggtgaaaccctgtccctactaaaaatacaaaaaaaaatgagccaggcgtggtggcagatgcctggaatcccaactactcgggaggctgaggcaggagagtcgcttgaacctgggaggcagaggttgcagtgagtcaagatcgcacttgggcactccagcctgggtgacagagtgagactacatctgaaaaaaatatatatatatatagatagatcagtagatgataaataagatgacaaggaagttatgtaaatgtaagaattataaacactctctgatcagacacattaaagttaatcagaataacatgagaaattaattgcaagatcaaaaaggcccttccatctagaaattaacaaacaaaaacaatcataatacttctattagacaactcctgggtgaaggagaaaatataaataaaaattacagaatttctaaaaataacaaggaaagtattaaatacagaacccccagaatacacttaaagcagcaatcagcaaaaattcacagcctctaacatttagcaacaaaagggcaacaatgaaaatgaaagaagtttccaactcaaaaaactagaacaacaaagtaagccaaataaaaataaaagcagaaattaaacagacaatcagtaggtctcattaataaatcaaaatccgatgggtttttcttgtttttccactaaacagacaaagtactagtatttaacttaagaaaaaaaggaagaggctgcgcacggtggctcacacctgtaattctagcagtttgggaggccgaggtgggcagatcacgaggtgaggagatcgagaccatcctggctaacacagtgaaaccctgtctctactaaaaatacaaaaaaaaaattagccaggtgtggtggtgggcaccctgtagtcccagctactcaaaaggctgaggcaggagaatcgcttgaacctgggaggcgggggttgcagtgagccgagatcgcgccactgcactccagcctgggcaacagagcgagactctgtctcaaaaaaaaaaaaagaacaaacacaaatattcaaaataagaagtgaggccgggcgcagtggctcatgcctataatctcagcactgtgggagactgaggtgggaggatcgcttgggcccaggagtttgagaccagcctgggcaacatactgagacactgtctctattttttttaatagaagaaatttttgccgggtgcagcggttcatgcctgtaatcccagcactttgggaggccgagtcgggtggaccaccttatgtcgggagttcgagaccaccctgaccaacatggagaaaccctgtctctcccaaaaatgcaaaattagccagacgtggtggcacatgcctgtaatcccagctactagggaggctgaggcaggagaatcgcttgaacccgggaggtggaggttgcagtgagccaagatcgtgccattgcactccagcctaggaaacaagagcgaaactccatctcaaaaaaaaaaaaaaattaaaaaatataagaaatgagatccagcaattccactactgggtatttatccaaaagaaaggaaatcagtataccaaagagatgtctacaccctcatgtttactgccgcagtattcacagtagcctagatagagaatcaacctgtgtccatcagtggatgaacgaagacagaaaatgagtttatatacacaattgaatattattcagacataaagaatgaaatctgatcatttgtggcaacatgaataagcctggaagagactatgttcagtaaaataagccagacatagaaaagaaagacaaatgccagctgttgtggtgactcacacttgtaatcccaacactctgggaggccaaggcgagaggatcacttgagcccaggagttcaaaaccaacctggtcagtatagcaagaccccgtctctacaaaaaaataaaacattagccaggtgtggtggtaggtgcctgtagtgccagctactcgggaggctgagataggaggatcacttgagcccaggaattggaggctgcagtgagccaagattatgccaccacactccagcctgggtgacaaagcgagaacctgtctcaaaaaccaaacaaacaacaaaaaagactacatgactacatgatgtcacccatttacaggatttttaaaagctcatgtcaaacatgtagagtagaatagtgattatcagaggttgggggtggggaggtagtgggagagattggtcaataggtgtaaaattacagatcgaagaaagaagttctggtgttcacagtagagtgactatacggaacaacagcttatacctcaaaatagctactagaagacatgattttaaatgttctcacctcgaaatgataaatgtttgaggtgatggataagctaatcaccttaatttgatcattacacagtgtatacatgtatcaaaacatcacacactgtaccccataaatatgtagttattttgtgtcaattaaaaatgagataaatattttccaggtcaggtgcagtagctcatgcctgtagtcccagcactttgggaggctgaggcgggtggattgcttgagctcaggactcttgagaccagcctggtcaacatggcaaaaccacctctctacaaaaaatacaaacgtaagctgggcgtggtagggtgcacctacagtcctagctactcgtagagctgaggtagaaggatcgttttgagcctgggaggcggaggttgcattgagtcgagattgggtcactggactccagcctgggtgacaaagcaagaccctgtcacaaaaaataaatcaatattttccatgccaaaaaaagataataacaggagaaaataaccactgaaacagagtattttattttgttttattttatctatttacttttctttgagatggagtctcgctctgtcgccaagctggagtgcagtggcgtgattttggcttactgcaatctccccctcccgggttcaagtgattctcctgcctcagcctccagagtagctggcgcacaccaccacattggcttatttttgtatttttagtggagacggggtttcaccatgttggccaggctggtcttgaactcctgacctcaagtgatccacacgcctcagcctcccaaagtgctgagattacaggcatgagccactgcacccagcctgaaacagaattttttttttttttttttttttgagacagagtttcgctcttgttgcctaggctggactgcaatggcacgatctcggctcacctcaacctctgcctcccgggttcaagggattctcccacctcagcctcccgagtagctgggattacaggcatgcaccactacgcccagctaattttatatttttagtagagatggggtttctccatactgatcaggctggtctcgaactcccgacctcaggtgatccgcccaactcggccttccaaagtgctgagattataggcataagccaccgcgcctggccctgaaacagaatattttaaaaggagaaaaaaattggccgggtgcggtggctcacacctataatcccagtactttgggaggcccaggtgggcagaccacctgaggtcgggagtttgagaccagcccggccaacatggagaaaccctgtctctactaaaaacataaaattatccaggcatggtagcgcatgcctgtaatcccatctacttgggacgctgaggcaggagaatcacttgaacccgggaggcagaggttgcggtgagtcaagatcgagccactgcactccagcctggggaacaagagtgaaactctgtctcaaaaaaaaaaaaaaaaaaagggagaaaatattatcttgtagacctctgcagataagtctgaaatcctagatgaagtgatctctcaggaaaatataatttaccaaaactgaccccataagaaaagaaagtatgaggaggccaatctctatagaagaaatagaaaaactgttatcgaggaaccacctcacagaaagagaccagatggtttcatgggaggattctatcaaaacttctaagaccaggtagcactaatgctacgtgtattgtcctagaacacaaaaaaggaaggaaaacttccaaattatttttatgaagtaaacactgatacccatacctgatagacagaacaaaaatagaaaagtatagaccacgccgggagcggtggctcacgcctgtaatcccagcactttgggaggctgaggcaggcggatcactggagatcaggagttcgagaccagcctggccaacatggtgaaaccccgtctctactaaaaatacaaaaattagctgggtgtagtggtgcacgcctgtgatcccagctactcgggaggctgaggcagaagaattgcttgaactcaggaggcggaggttgcggaggttgcagtgagctgagatctcgccactccagtccagcctgggcaacagagcaagactccatttcaaaaacaaaaaaaaagaagaaagaaaactatagaccagtatcacttatgactgaatatccatagaaaaatactaaatattaataaacagaattcaaaaacacattaaaatagtacaacatgtgggatttatgccaagaatgtaaggttgattcattattaggaggttcatgaagacaatctaccatatgaaaattcaccatcgtctccaaagatatgggaacacaattcaatagttactcctgtaaaacaccactcaggaatagaagaactgaggaatactttgttaataagctaaaataacatatgccttcccttttacagtcagcctctcatgtaacgtggcatttccactaagatcaggaccaaggtaaggaggctcactatctccactatgttgaacaatgagctagaggtgttagcaactaaacaaaagaacggtgcaattcaacaaagtcagagtcatgagaatcagcaggaagcagtgtatccatcgatacttaaagattatatgttagtacacctgtaaagccctaaagaatcaataacaaaactaacctgaacaatgtaagaattctgtaaggtagcagaatataaaattagtttgcagggctgagtgcagtggctcacacctgtaatcccagcactttgggaggctgagatgggtggatcacctgaggttgcgagttctagaccagcctgaccaacatggagaaaccccatctctactgaaaatacaaaaaattagccgggcatggtggtgcacgcctgtaatcccagctacctgggaggctgaggcaaaattgcttgaacctgggaggaagaggttgcggtgaggcaagatcgcttcattgcactccagcctgagcaacaagagcgaaactcccgtatcaaaaaaaaaacaaaagtttgcagaaatccactgccttcaaatgcactgacaatatgcagtgaaacgatataatgacaccactaaaggacttattcacgtatccaaccaccacctgttctccaaaaacctactgaaataaaaaataaatagcactgaataattaataccctgagagttggggggaaaaaaaggatataatgatagggaaaaccccatttacaatagcgacaaagatgatcaaacacttaggaataaacttaagtcacatgcaaaatgtagatgaagaaaaatttaaaaccctcctgcaagacccaaaagtacattggaacaagaagtcatcccttgttcttggataagacaacaacacaaagatatagttaatttatacattgtcacaatctcagtaaaaatatcaatactgtttttaaggagctagacaagttgatattcaagttcatatagaagaatgaacaagccatagctcaggaaacagtgaaaacagaaaactaagaggggcctgcccctactcggtagtcaagcatactacagaaagcctctacattcacaacagcctggttttgtaccactctccatcgtaaccatccttatctcctgttagagcaggggcctcaaccttgacatgtaagcagctgggggaggcagagccaaatctcagagaaggtgggagccggggaagcgggggacatctttctctgccaggtcacctaaagctcaaggcaaccagagaccccagcagggcgcggctggcaggtgtgggtacctgggctccgatagaggctcttgggcagagagggcgagtaagtgtccatcaaggccacgatcttcatgtgtccgtactgcttggccagcatccgggctgtggctccactgtggtctctcgcgtccaccttgactccctgtgaatgtccgtgaaagggggttaggggcctctccttcaaagcacctgcccttcctgggctgctggctgggaagacagaagggcatatgctggtttctgactgcctccctgtgtgggaaacatcacatctgcatgagaaagaggcaggcttgtctgcaccgcagccacaagttttgctctcactctcttcttagggacaaggatgaggagggctgggggctggggagtcatctcccacgctcatgacctcccttgcagggggctggcagccaccatgcggagatcccagccttcaccttctgcgcctgggctgtgtcccactcacttcgcttgtcttcaaagaaagcagccttttaaaccagtcagaatgaaagcaccatcctctgaagcagaattcgtaactttgatccaaagctctataatgtatttacaggtcttgcagcgcaacaattccacttccatgaccctaaggaaataaccctaaatacagaaaaggctttagtgcacaaagatgtttggcacaggccgggtgcggtggctcatgcctgtaatcccagcactttgggaggccgaggtgggcagatcacgaggtcaggagattgagaccatcctggccaacatggtgaaaccccgtctctactaaaaatacaaaaattagccgggcgtggtggtgaacgcctatagtctcagctactcgggaggctgaggcaggagaattgcttgaacccgggaagcggaggctgcagtgagctgagatcatgccactgcactccagcctgaagacagagtgagactctgtctcaaaaaaaaaaaaaaaaaaaaaaaaaggatgtttggcacagcatattcacaataatgaaaacctacctagagaaaacttgaatgctcagggggataagcagtcagttctgttattgccatagatggtgatatttacaaacagctgtatgatcaagttgaaaaaggatcatggccaagtgaggtggctcatgcctgtaatcccagcatttgacaggccaaggcaggtggatcgctcggctcaggagttggacaacaacctgggcaacacagcatgaacccacctctacaagaaaaaaaaataaactataatcaatacagcatgtttttggtgtcactgtacactgtaactgtccttctctcctgtcagaccaggcagctgggggaggcagggaagccagagccaaagctcagaggaggaggcgggaccccggaaagggggagcatctttaataaaaaattagcagggtgtggcggcacatgcctgtagtcccagctactcaggaggctgaggcaggaggatcacttaagtcccagagcttgacgctgcagcgagctgagatcgcaccactgtactccagcctgggcaatagagcgagaccttgtctcaaaaaaataaaaaaggatcatgatacaaaactacatatacattacaactccggcaaaatgagaccaaaaaaattacacagaaaacaatattggaaggtaacatacccaaaatgttgctatttttaagttatttactatttttgatggggatttttccaattttccaatcttctatgtttttaaaatgtactaccataagcatgtttgcttttttttttttaataggatcttgctctgttacccaggctgaagtgcagcggcgcctaaggaaataatgcaggacatacactacaatttagaattttcactgtggcattcagcatagtgagaatcagaaggaacttaaaataagagattaatgagctacgtgagagcatatccagaaaacagagcgcctcccgcccatttacgtggtgggtgggagtacctgcggtgacacggactagggtgcacaaaacatcattaagagaaaaaaggcacagccaggcgccgtggctcatgcctgtaatcccagcactttgggaggccgaggtggacggagcacaaggtcaggagttccataccagcctggccaacagggtgaatcctcatctctactacaaatacaaaaagaaattagccgggcgtggtggtgggcacctgcagtcccagctactccggggggctgaggcaggagaatcgcttgaacccaggaggtggaggttgcagtgagccaagatcgcaccactggactccagcctgggcgacacacggagactccaactcaaaaaaaaaaaaaaaaaaaaaaatcacaacccttaaggagttttgctaccacccatacggcaactgtctctcccgttagaccagggggcctcaaccttgacccccatatgtagttggtgggggaggcagaggtggtctctgggcagggatacaggacaaaaaactgtgttttcacaaagtataaggagttttactttctagagtgccccccatcctacttttgactctgattaaaaattacctatgagactttgtgccttaaaaaataatttataggccgggcacagtggctcacgcctgtaatcccagcactttgggggaccaaggtgggtggatcataggtcatgagttcgagaccagcctgggcaatgtggtgaaaccccgtctctactaaaaaatacaaaaattagccaggtgtggtggtgcgtgcctgtatcccagctactcaggaggctgagggaggagaaatccttgaatccaggaggcggaggttgcagtgagctgagatcgcgccactgcactacagcctcgacgacagactgagattccatctcaaaaaaataataataaataataacaataatttataagctgggcacggtggctcaagcctgtaatcccagcactttggtaggccgagacgggtggatcacctgaggtcaggagttcaagaccagcctggccaatgtgggaaaacgtggtaaaaccccatctctactaaaaatacaaaaattagccgggcgtggtggcacacgtctgtactcccagctactcaggaagctgaggaaggagaattgcctgagtccaggaggtggaagttgcaatgagccaagatcacgccactgcacaccagcctgggcaacagacgaagcaagactctatctcaaaaataaaaaataatttcttggctgggcacagaggctcacacctgtaatcccagcacttttggaggctgaggtgggcggatcacttgaggtcaggagtttgagaccagcctggccaacaaccagcctggtcaggagtttgagaccagcctgtatctactaaaaacacaaaagttagctgggagtggtggcacacacctgtaatcccagctactcgggaggctgaggcaggagaatcgcttcaacacgggaggcagagattgcagtaagctgctgcactccagcctgggcgacagagggcgactccatctcaagaaaaaaaaaaaattctagtttaagtttgatagaaggaaccctaaggtttaaccagaataaaacagtagcctctttactgtaggattttaactcgttatatatttttggttttgtttttgaggcagaatctcactctgtggcccacgctggattacactggctcattgcaaccctgacctccccagctcaagtgatcctcccttctcagcctccctgggattacaaacacacaccacaactggctttttttttttgagacggagtctcactctgtcacccaggctggagtgcaatggcgcaatctcggctcactgcaacctctgccttccgggttcaagtgattctcccgcctcagcctcccaagtagctgggactacaggggcacgccaccacgccccgctaatggggtttcaccatgttggccaggctggtcttgaactcctgacctcaggtgatccacctgccttggcatcccaaagtgctgggattacaggcatgagccaccatgcctggccaattttttttttttttttttttttaatttagagacaaggtctcactgtattgcccagactggtctccaactccagcctcaagcgatcttcccactttggcctctaaaagtgctgggattactggcatgagccactatgcctgatgtgaaaataaatttttaactacttaggctttaagagacttttttttcctattttataatgtccatattactaaagagacacatgatcaaaactcattttaacatgaaggtgggatcagaaagtttagaaaccctggaacaagactatccggaaggcacgaatcaactttctcttaaagagagaggcccagacagatccatatcctcttctcctgactgagctgctggggcttggccccactggcagaagggaaatgggggacaaggaaagcagccacagccctttcctcccctagcaaagagcacaagatgcccagacttgccccattctctacctccagaaatggagcccagctctggagggacaggctgggaaaccgggtgggccccctcctctggctccaggtggtctaactactgggcggcaggaaaaacgtgggagagaggagcttccaggcagggcttgcccaccagcatcgctggcaggcaaaccacccaggccatcgggccacctgctgccagtcctgccccatcccccaaagcagtcactaaccaacactttgattcttgtcaagtgctggaggaagaactcagtgttgagttcctgagtctgataattttgtgtgactgggaaagagaacatttttgcttttaggaaatacataatgaaattcttactctcaggaaatacatatttaggggaaaaggggcattatgtcacaatttacatttaaatgattcagaaaacatatgcatgttatacataaagagactgataagaaaatgaggtgaaatgttaacatttggggaatgtggtaaaggcatgcaaattgttggccaagcaccgtggttcctgcctgtaatcccagcgctttgggaggccaaggtgggaggaccacttgcagccaggagtttgagaccagcctaagcaacttagtgagaccccaactctacaaaaaaatcaaatcagctagtgtgatagcatgcgcttgtggtctcagctactcaggaggctgagttgcaaggatcccttgaacctgggaggttgaggctgcaacaaactatgatcgcgccactgtgctccagcatgggcaaacagagtgagactctgtctcaaaaagaaacaaacatacaatcaaaaattataagagtacatatctcttatgatctccagttctaccttacttaaaatgactctaaacttacaagtagaggctctttatggttctgggctattgattctatgatgtgtcttaaggaagtctagttcatgtcagcaggattatctgtcaaagaattatctggccgggcatggtggctcaggtctgtaactccagcactttgggaggccaaggtgggaagattgcttgaggccaggagttcaagaccagcctgggcaacatagtgagatttttgtctctacaaaaaaaaaacagccaggcgtggtagtgcgtgcctgtagtcccagctactgaggaggctgaggcagaaggattacttcagcccaggaggttgagactacaatgacccatgatcaggccactgcactctagtgtggtgacaaagcaagaccctatataaaaaaaataaataaaaaatacaaaaataattatttgcagaaaaagaaacccaaatggccagggagccaaaaagtctaacatcctggccaggcacagtggctcacgcctgtaatcccagcactttgggaggctgaggcagacagatcatgaggtcaggagttcgagaccagcctggccaacatggtgaaaccctgtctccactaaaaatacaaaaattagctggatatggtggcacacacctggaatcccagctactcgggaggctgagccaggcgaattgcttgagcctgggagtcagaagttgcactgagctgagatcacaccactgtactccagccttggggacagagcaagaccccaccccaaaaaaaaaaaaaaaaaaaaggccaggcacggtggctcacgcctgtaatcccagcactttggaagaccaaggcgggcgggtcacaaggtcaagagattgagaccatcctggccaacatggtgaaaccctgtctctactaaaaatacaaaaattagctgggcatggtggcgagtgcctacagtcccagctactcgggaggctgaggcaggaaaatcgcttgaacctgggaggcagaggttgcagtgagccgagatcgcgccactgcactccagcctgggtgacagagagagactccatctcaaaaaaaaaaaagaagtctaacaccctaaggggaggggtgtgaaccaggaccactatggaacaaagcaagtttacactacccactaccgactgaacccacctcacacaacaaagactctactttgaagaacacatcctaagctcctgaagaaattcccatatgtgcttaaaaagacgtgtaagaaatgtcaacggtaggccaggcgcagtggctcatgcctgtaatctcagcactttgggaggccaaagtggtagatcacttgaggtcaggagttcaagaccatcctgaccaacatgccgaaaccctgtctactaaaaatacaaaattagctgggcgtggtggcacacgcctgtaatcccagctactcaggaggctgaggcaggagaatcgcttgaacctgggaggcagaggttgcaatgagccgagattgcgccactgcactccagccagggctacagagcgagactccatctcaaaacaaacaaacaaacaaacaaaaaaactctgattcatccctacagggaataccatgccaccataaaaaaaaaaaaaaaaaagagaggccaggcacggtggctcacgcctgtaatcccagcactttgggaggccaaggtgggcggatcacgaggtcaggagatcgagaccatcctggctaacgcggtgaaaccccgtctctactaaaaatatgaaaaattagctgggcatggtggcgggcgcctgtggtcccagctactcgggaggctgaggcaggagaatggtgtgaacccggaagtctgaggttgcagtgagccgagatcgtgccactgcactctagcctgggcaacagagcaagacgccatctcaaaaaaaaaaaaaaaagagaggggctgggtgcgttggctcgtgcctgtaatcccagcactttgggagaccgaggcaggcgaactgcctgagctcaggagttcaagaccagcctgggcaacgtggcaaaaccccatctctacaaaaaaaatacaaaaattggctgggcgtggtggcacgcacctgtaatcccagctacttgggaggctgaggcaggaggatcacttgagaccaggaggtcaaggctgcagtgagctgagactgcaccactccactccagcctgagggacagagcaagaccccatctctttattgatttattgatttatttatttatttatttatttatttatttagagatagtctcactctgtcacccaggctggagtgcagtggcaacatcttggctcatcgcaacctctgcctcccaggttcaagtgattctcctgtctcagcctcccaagtagctgggattacagcgtcagccacctgtattttgtatttttgtatttttggtagaggcgggtttcaccaccttggccaagctggtctcaaactcctgacctcaagtgatctgtctgccttggcctctcaaagtgctgggattacaggagcgagacaatgcacctggccccgtctctttatacaccaatatagaaaaatcttcatgattaagttttttaaaaaatgcaagatgggagcagctgcacatggggcaggaccatgagcatgtgtgggtgtattcccagagtcgcccgtggggagggtgccaaggagacgcaggcagggtgggggacaggcctgcggtgcacccaccttctggtctgcatgtgtaccatgtgcatgttgtgtcccaaaattctttgttaaaaagagataccatgtgaatttttcactatttaagaaattcccaccaataagtgagaaaaaaacaaactatccaatagaaaattgggcaataaacatagacagctcgtaagagaaatacaaatggccagccgggcacagtggctcacacctgtaatcccagcactttgggaggccagggcgggcagatcatgaggtcaggagatcgagaccatcctggctaacacggtgaaaccttgtctctactaaaaatacaaaaaattagccgggattttttgtatttttagtcccagctactcgggaggctgaggcaggacaatctcttaaacctgggaggtggaggttgcagtgagctgagatcatgccactgtactccagcctgggcgactgagtgagactcagtctcaaaaaaaaaaaaaaaaaagaaatacaaatggctaagaaatcaatttaaaaatgttcaactggctgggcgcagtggcttatgcctgtaatcctagcactttgggaggctaaggtgggtggattgcctgagttcaggagttcaagagcagcctgggcaacatggtgaaacctcatctctactaaaatacaaaaaattagccaggtgtgcgggcgggtgcctgcagtcccagctactcgggaggctgaggcagaagaactgcttgaacttgggaggtagaggttgcagtgagccgagatcacgccactgcactccagccttccagcctgggcgacacagcacaagacttctgtctccaaaaaaaaaaaaaaagaaaaaaatttcaactactctaacaaggacaaactaaaatgagacgctacaattcacccgccagattgacaaaaggttgactgacatcaggactggtgaggacaagagaaaatggacacctttgtctatgactggtgggcaggacaacagacaaccttggtagtgggaattcatcaggaccgcctgcacttccccccattgggtttaacagccttataaagatataatccacataccaacaagtcacccacttacaatgtacaattcaacggcttctcgtatattcacagttgttcaaccatcaccacaaacaattttagcacatttttatcaccccaatcttcccattccccaagacccaggaaaccactcatctattttctgtctatgtatttgcttattctggacatttcctatgagtgaaatcacctagtgtgtggcctgttgtgtctggcttctttcactgagccgaatgttttccttttctttttctttttgaggcaggatccactctgtgacccagaatggagtgtggcggcgcaatcatagctcactgcaacctccaactccagggctgaagcgaccctctggcctcagcctcccaaagtgttgggattaccggcgtgcgccaccgcacccagcccagcctaacgcatcagggttcacccctgccgcagcatgcagcagtactgcattactttgtagggccgaataatatcctgctatacagatatatattttgtttatcaattcctcagtagatggacttgtgggtttttctactttttggcaattatgaataatactgctatgaatatttatgtacaaggttctgtgtggacaggcttgcacctgtgatcccagcactttgggaggctgaggtgatcgcttgagctcaggaattcaagactagcctgcacaacatactgagacccccaactctaccaaaaaaaaaaaattaaataattagccggggcatggtagcatgcacctgtagtcccagctacttgggggctgaggcaggaggatcgcttgagcccaggaggctgaagctgcagtgagccacgatctcgccactgaactccagcctgggatacagggcaacaccatgtctcaaaaaaataaattaataaaataaaacagaaatacaacatacagaaataactgcaaatgtattaaagctatgtgtaaaaggatattcccggaacactgtttataattgcaaaatgttaaaaactaagtttctactaataagaaactcattaaattaactgaggcagattgtacacggaatactgtacaaagataagatgtctataagatgtctctaagttacagactatacgtagaatcccactttgttcaaaacacaaagcaatgtgcacacacttgcctacagacacatctttccacagcagaggaaaagtcctagggcagctctttctcaaaccaagtgggcatcagggaggttgaaaaagagaggaggatctctgccttcttattctatataatttttctaagtgacaggattatgagtgctatttacttttaaaatatttttccataattttcagatagtattttcaaaattattacaggaataggtgtctatttctactcaccactgtatccttaatgcctaagcaccactcaacaccgggcgtcaatagataatgaaaatgtgttgaataaatgaatgaaagttatttctgtgcaaaggaaaattctgtaatagcttatacttcagtaatatgattcctcatttgccgtgactacattacatgctaataatcagggtcacttacgtgattcagaaaatactgcacgattatctcatggccagcagcagctgcttccatcaagggagtaaatccacatatcggctccctgcaagatgtgggccacagtcagatgattggaagagacaagttccgccaggcaaaaactccctgctgaagataaaccctgagcagtgcacgagtcaccgatccctaagcgtagaacactgtccctttccagaattaacaggtgacatgagaacagtgaatataacacatcagctccatttactcttctggtgtctgtccccagggctggtctttgtcctaaagacagatgtctgcctgtcgtcccacctgttggctattcccactggctacctctgaaatctccacctcaatcatattcaaaaagctgttctaattcctcacagaaagccagcatctcccatccattcatccaaatcctggcttcaagttcaacgtcctccatgaacccactctgaaaagttcaagtactaatgatctaagctatctttgccacgcttagctcctgaagcttgcttttcatgcttggttatgctaactcggcactgtcttcagagggcttccaaatccctccttgtctcatgctggtttggaagtcaggaaccatgcatgggaaatgctggttttcatccatcttaagacacacagtgttcatattttaacatctctcaagtcagaaaacatctttaaatcaacaggcgagttgaatgttaattagtagcatattttttctttcttagtggcatacaaaattatcaggtgtcttagaatgaatgacagccagggtgggtgctgcattggtacccgctgcgtttgttcaaaggtgattattatcatgacaagctttagacaacaatcccacttccaacttataaaactcatgactggttttttgtttgtttttgagacagagttttgctcttgttgctcaggctggagtgcagtggcacgatctctcagttcactgcaacctctgccttctggtttcaagtgattctcccgcctcagactcccgagtagctgggattacaggcacctgccaccacgcccagctaatttttgtatttttagtagagacggggtttcaccatgttggccagactggtctcgaactcctgacctcatgatctgcccgccttggcctcccagagtgctaggattacaggtgtgagccactgagcccggccaaaactcatgactgttgtttttgtttttttttttttgagatggagtcttgctctgtcacccaggctggagtgcagtggtgcaatctcggctcactgcaagctccacctcccgggttcacaccattctcttgcctcagcctcccgagtagctgggactacaggcgcccgtcaccatgcccagctaattttttcgtatttttagtagagatggggtttcaccatgttagccaggatggtctcgatctcctgacctcgtgatctgcctacctcggcctcccaaagagctgggatcacaggcgtgagccaccacgcccggcctcatgactgtttcaaagcatcacctcacctcatccatacaaaaagcaagaaaatggaaggaatttgcatgtaatgtatgacatttaaatgccattcagtatgttaggcccctggcatacaataaaacatgtaattcttacaactgtatgacccaggtgggtttcagataaagaaaaggaagctgagagggcttgaagagatgcatctcacagatgtacgaaaaggcctgtgcctggaaggactctggtcctacccctcatcttgagcctctcgtgccgaagcagggtggccctaaactctggttagctgcctccagagccaccctccttagagtcagatgacacctaggccactcctgtggccactaaagatgtggcaatcacctcacgttggcattggctccactgtccaagaggaacctgaccatgtgctggtgcccggcgctggtacagtggaagagggctgtccagccctggatgtctttcatttctagctctgcaccttgcttcaagagaacacagaacgtgcgttacggcctcatctcctctgcgtggggcgggcgccctccaggcggccatgctgcaagaatcagaagtgattacacgagcacacacgaacaccgtggcctgcagtggttcgcatctctgtcagggtggccacggagcccctcaggtttctgggcctgagttccctcgtagctcacctggagaagaaagtaggcgatgctctcgttgccacagctggaggccagcatcagtggagtctgcccttctggggtcggcacattcacactcacccccgcctcaagcagcaggtgcacgattgtgtcgtggccaatgtaggaggcatacatcagcggggtccagccaccaccattcttcttattcaaatctaactctctcctaaacaaacgcaagatatgctagacatggccagccgcctcgcatgtggggttcaccaaagctggtggcgaggctaggccaggcgggatgagttgacaggaagcagaagttatctgccaccctggacgttgtggggattggaggcaggcaggcagaaaaatgctgacagttgctcgtacactgccttgtgaggccctgagccttcgtctccttgctctgatttcgcatcctcctagcccaaggccagctatgctctttcacaccaccagataggcagatggcactcaaccagggaatatgtggcaatgtgtgaaggcatttttggttctcacaactgggcagggaagggctgctggaggccaaggctgccgctaaacatcccacagtgtccaggacagcccccacagcaaagaatgatccagcctggattgtcaacacagccacagttgaaaaaccctgaccaccacaggcctggcatctactagcccactgctgggtggagaggagcagtgaggaaagaagggactccaccgtggacaagtcccaccgccactgattcatcctttgtcacctcaccttaaagaaacattcttgaaaaatctgtgaccaaagaatcccatctttctcactgattgctgttaaaattctggcaatgcattttcccatgggaaaaaactgtgggcttcctagctgcgactctggggttgggacaagggagtcacatttaaaataatacccacttgcatggttacctgggatcctacatggttaacgcccacaggccttctttcccttccccagttcttgcctgcagaggggataacaactggtgactgaaccccaggatctgtcccttttacgggattcacttttttgttgtttttttgagacagagtctcgctctgtcgcccaggctggagtgcagtggcgcgatctcggctcactgcaagctccgcctcccaagttcacgccattctcctgcctcagcctcccaagtagctgggactacaggcgcccgccactacgcccagctagttttttgtatttttagtagagatggggtttcaccgtgttagccaggatggtctcgatctcctgacctcgtgatccacccgccttagcctcccaaagtgctggattacaggcgtgagccaccgcgcccagccgggattcacatattagaccacagcaggcaactaccttccattgcctggcagccctcagtgactctgggatgcacacctgggcagccattccagaaggtcctgataccagggttcagtggcagcccctggccaggggggctgcatggagatgcctctgcagcagggctcgaatgcacccagctcgtcctaacactatcttcctttacacaacagcagagcatctccctggggctctcttaccactcctcgttcagccccaccccttccttctgatgcccccagctcccctcaggccccatcctgtgcttactatcagcaagcctccacctcagctagtgtcaaaatcccatcacaacacaaacgcctccccctgctcctctatggagcggttatggactctgcatcttaacaggacacccaaagacttaagagcctgagaattccaaacgtgaccctttgaggggccgtactgactgcatacccagctgcctatgcctagagcctcctgtggagggagcgcaacagaccaccctgtaccaaggtgcaccagcactccatgggctgggtatgtctaagtgagggccacaacttgggaaccggagacctggggcttcagcaatgctttgctttggctcactgggaactggaagaggcacgcagagagaggaagagaggtcgctgcaccacaatatcaaatgagaaccaggagacagagttaggctgtgtgtggaacataagggggtggaagtgaggagacgacccttttccaaaaacaagatgatcacatcctactatgggcaagacgcagccatggaccctgccaggggctttatattgtctctaactattgtacacagattagcaaagggcaggtgggcagtgacgtcgggaggtcattccccagaggcactgaaagcccagcctctctcctcctccatggcagaagctagaggggaacagggatcacagggatcgaatgaaccctccgggaaaagaaggccagggatcactttcttttttcttttttttgtttttgagacagagtctcactctgttgcccaggctagagtgcagtggcgcaatctcagctcactgtaacctccacctcccgggttcaagcgattctcctgcctcagcctcctgagtagctgggattacaggtacatgccaccacacccagctaacttttatatttttagtagagatggggtttcatcatgttatccagaatggtctcaaactcctgacctcaagtgacccgcccatctcagcctcccaaagtgctggaattacaagtgtgagccaccgcaccaggccatcactttctgtctttatttttattttgcttgtttgtttgggcatttctgcaattagtgaataaaattagtctggttaaagaatgactgtttataagcttctgatcaaagtttactccctctttttcttcctaggaataaaaacggcctctttgtcagggctcagcatcaatacttactgacagctgcctgagataagcaggttaacctattctacacgcattaaacatccacaactgtgtgcaaagccccatcacgtgggatcgaagccatcactgcgctgctcaaaatgtgagaggaagttccccgagatctcttaccgctgcacacactccttcaccacttcatactggccaatggaagcagctgtgtgaagatccagggggacatccagctcctccccgctgacctgtgtcccgagcccgtgccacatggacaagctgcggttcaggagttccggctcgctggcttcatcgctgagctcggacatcactgaggaggaaggcccaagggttagatctttcctggctggttgttccagggcatgaaacaggctggtcctgcccctgctacaccactgcactagcagactgataacccagtgcagtcaaccccgggagtaactcagacaaatttatttgctgaaataatgtatgctttgggcagtcccaaccatgctaaatctggtgagcctgctatcacaccagtaaagaggagcacatatggtgaggcattaactgtggagtacctgctcctccttccaaccgcaggcaccaggtaaaagagaattctccaccaactctaggaacctgacaacctcttggatgggcagtgaagaaatgctaattgggttgtttaacccaatcagttccttgatgtggtggggaagaaccctggatttggggtttgatcaaaattcagcttggacccggtgcggtggctcacacctgtaatcccagcactttgggaggccaaggtgggcagatcacttgaggtcaagagttcaagaccagcctggccaacatggtgaaatcctgtctctactaaaaatacaaaaattagctgggcatgaaggccagctactcgggaggctgaggtaggagcatcacttgaactgaggaggcggaggttgcggtgagccaagatcacgccattgcactccagcctgggaaacagagcaagactttgtctccaaaaacaaaacaaaaaaaaaaaacaacaaaaaagcagctctgctacttagcaactccaatccctagtgcctcactgtctaacggggacatatctaaaaaggctgctattatgatacataaaagaatggataaacaaacggtggcacatccatataatggatgctactcagcattaaacacaaggatccaacagttgacatgcaacacgtgaatgaatttcaaatgatttacgctaaatggaagaagcctgcctacagtataatttcacttacatgacattctggaaaaggcaaaattaaagggttggaggttggggcagagagggaatttgggggacgatagacctgtatgactgtgacggtggatctgtgactccatgcctttatgaaaccacagaactgaacaccaaaatgaattttactgtatgtaaattttatttatttttttgagacagtctcgctctgttgcccaggctggagtgcagtggcatgatttcagctcactggaacctctgcctcctgggtttaagggcttcttgagcctcagccacctgaatagctgagattacaggtgtgcgccatcatgttaggctaatttttgtatttttagtagagacgggggtttcaccatgttggccaggctggtctcgaactcctcacctcaggtgatccgcccgcctcagcctctcaaagtcctggaaatataggcgtgagccactgcacctggcctgtaaattttaaatataaattaatttttctggaatggttatgaaattgaaaatttcaaaaaagtaaaaataaatttttctgaaaaaaatagaaagcaattccccaacagacaaaccaggatgtgactggtggcacgcagcaaccgtcaactgaataggaatccacttaggcatcctttgaagagagagctatggggggaaatataacaggccggtgaactggtgaggtaacactttccccgagatgggcctacatgggtaacggcacaccaggaatccccaaatcaaggcaaggtcatcagcttcctagtagaatccttaggtacaagagtgccaggaaacaagggtaggaaagggagcaaaggcgaaaacaaaggccttgtcaggttgtgatgacctacaggtgctatggtagttaatagatgcgatgaggacctcagtttctattaaagaatgcttccaagccccaggtgacagccaagatggctaaagaaacaagccaccaatgtgggagacgaacacttcacagacccttggtgaagagtgtgtgtaggtgcggtggggcaagcaaagccctccttcctggagccaccacctcttcagctagcagagcccaagatcgtgcagtgcccttccctcactttgcaggtgagaatcccaccctaacagccctggccaacgaagcctggataagaaaccaaacgagctgagggtcagttcagagtcccttccatacctccctcaagccttcactgggcatgtctcttccacgccaaaggcctcctgcagggtgaggccgtgttctctatttactggagacttgcatatctgacatccccagaggtctgaaggacaatgagaaccagaccaagcgtgacggaccacttgaggccaggagttcgagaccaccctggccaaaatggtgaactcccatctttactaaaattacaaaaattagctgggtgtggtggtgggcgcctgtagtctcagtactcaggaggctgaggcaagagaatcgcttgagcctgggaggcgattgcagtgagccgagctcaagccactgcactccagcctgggcaacagagcgaaattctgtctcaaaaaaaaaaacaaaaaaaaaacactaaagtgaaaactaaaatgtcccatcccgagtggtgtggtgtaaagtagcattagagataagacgttttagttttcattcaactttttggttctgtccattctgaaaatgctaagtatctgttacctttacagtgaatcctaaagaaaatgtggtacttagacacaatggagtactattcagccataaaaaaagaatgagatcctatcatttgcaaaaacatggatggaagcggagatcgttatgtttagtgaaataagccaggcacagaaagataaatattgcatgttctcaattatttgtggttatctaaaaatcaaaacaactgaactcatggacatagaaagtagaaggatggttacttctagtgtaaccaaggctgggaagggtagtggagggtggggatgcttaatggatacaaaaaaaacagaatgaataagatctagtatttgatcaagccactgcactccagcctgggcgacaaagcgagactccgtctcaaaaaaaaaaaaaaaaaaaaaaagatctagtatttgaccgcacaacagggtgactatagtcaatataatctaattgcacattttatttatttattattattttttttgagacataatctcactctgttacccaggctagagtgcagcggcgtgatctcggctcaatgcaacctccgcctcctgggttcaagcgattctcctgcctcagcttcccgagtagctgagattacaggtatgagccaccatgccagcctagttttcgtatgtttagtagagacgaagtgtccccatgttggccaggctggtctcaaatccttgacttcaggtgatccgcccgcctttgcctcccaaagtgctaggattacaggcgtgagtgagccaccgcgcccggctgcacatttaaaaataattcaaagagtataatcatattgtttgtaacacaaaggataaatgcttgaagggatggagacccccattttacatgtgattattacgaactgcatgcctgtatcaaaatctctcatatacgccataaatatatacacctactacgtacccacaaaaattaaaaaatttttaaaaatcttaacaaatgtgatgctggtggtaactgtcacgcccacagaggaggtctgtgaaagcacccaggcaccccctctcgccccgtggaaccgcatcgcaaaggtagctcactggccccggggcgggtccctggccgacaaacccgtaactcacagcagtgacgcttcccgacgccccccggccacatccccacaggaacgctacggcgcacagggcattactgtgcccccaccacaaccacataaagaaaatgtgggggctcggtcctccagtcacgcggcgagcaagtgcagcgcgggacgcccgagcgccgggtctaggcgggctgcaggtgccggcaagtgctggggccgggccgccgcggaacccacctgtgctgggcctcaggccttgcgccgccctcgggctgccgtcgccaaccccccccaaacagctcgccgccacgctccctcgccggggcaccgcccccggcacccgccccggaagtagttgcgggagggcgcggagcacgccgggaagctcgcgggtcggcaccgggacagctcccgggcgccgtggaatgcacacgtcccgcacccggaccttccggtcag

SEQ ID NO: 858 - DNA, 60840 bp, Homo sapiens
cgggtcctggagctctctcggcccggcaggtttcgctcccgcccctccggccttccacagctgtcctggccgcagggtgttcaaggcgggacacaccaggctagagatccgcgatcgggccccgcctcaggtactgcgctccaggccaggcgggcgcgggtaagcgctcagctcccgagccaggcgggcttccagggcacttcccctaggctgcattcccaaaggctcccgagggcgagggtgagcaaagctgcggggacctgtgtgtgcatgcgtgtgcgattgcctctacgtgtgtgtacgtgtgtgtgcatgtgcgcacgggtgtgtgtgcgtgtgtgcacgtctgtgcacaccaggggaattgcgtgcgtggagctgggcaggtgcgtgtttcagggtgtgtgtgcaaagttggaggcgtgtgcaaaagcagtcccgtgtgggagggaaacctgcgtgtgtacatgtgtgtgatagagacagtgcctgtgaaatgtggtgaaggctgtgtgtgtatgtcagggtgtctgggaggaaaatgggagggcaggtgcaaggagactcgggggtgggctgtaggccagcaagtctgtggcaagctgcggggtgcatgcgtgaatagaaccgtgggagtgtaagaattgcaaatgtgtgtgtgtctgtgtgggtggccgtaaggcttctgggggccctcagtgtgaaggggtgggggtagaggaaagtttgggggtgctgactgctcttggaaggctgagcgtggtctggggccatggctaatgacagggaagctgttggggcttggcctggagtaatttggggggaatatcagccttctcaatttgaaggctggggagctgtgtgggtggggccaggggctgccccttacacttggtgggtggtgtccctgcttcccgaggtgggagctgcaacctcaccagtcactcctcgccccaggctctgtgcacacccctgcctggtgacctccattggtgctccagcgtgaacatggtgcaaagataccagtctcctgtccgagtctacaagtacccgtttgagctggtcatggcggtgagtgactcctgattcttgggcccccatgtgacagttggaggggcttgagatcagctatggcggtaggaagacggagctccttagactcccagatcagaaggaattagtgagttactcagctgacctggtgggtttaacttctatccagtgacctctctgtccaaccatcctatcctcggcccagtgaccaaaacacaaagtctttcttccttctccttgttgaagctgacctgctcccttactttagactctcctgatagaaaacaaaggtatcaggggccaagccactgctgtcatttcatataatggcatatcacagtgataaatggaatggtggtgataatgacaacagctgtttattgaatgtttacagcactgtcttaacagatgatgtttcttccaattcccgatagctgttattttcccatgtaacctccatgaaactgaggctttgacaggtgaagggatgacactaagttctgtatctacgcagaggtggagtcggggctgagatccccacaaaggagactctagaacctcacatttgaccacagagccctccttctgctcacagacccccttccctcccctttaaggaagctgacactgggacgagagagagaatgagtgggtaggtttgctttgtgatgtactctgtgttgtgcagcaagtcagttggaggcctagaattggctgccagatccttggcccccaggatcactggtcttttcaccctgggggcagaagctggacataggtggatgtggaattccttcttggctgcatccctctgcctctgagcacttcacttccctgctcagtaacatggggacaatgctacaaggttgcggggaggagtaaatgagatagttcttggtgctccttgctgtgtgccgggcacacagtaggagctcacaaaatatgctgtcgctgttattacaccgaagtcttgtaaattaatgtattgaaagtgtaagaaacattagcatccacccccatctgtcccaccccagcactgactgcttaaccccagccttctatccagggactttcatatctcttggtggctgtgtgtgcctgtgtgtccagtcctgtcttattctatgaatctacatgcgtatatgtttattgtcacacagaggatttaaaagcatcaccaaaatcatccacataccttgtgctgttacaggcagatggttctaggacagcaaagaggcaggaactggcttagggtcatattctagctccccaattgacgagctgagtgactgtggggcaagtcacttcacctccatgagcctccactccccatcaccaatgggaatctcctggcttccaaatcctggtgtcatgctgtggattaaatgagtcaatgtgtataaagctcctggtacggggctgacgcagatcaaatgctcactgagatccagctatgatcgttactgtttttgcaagtgcctgagtgactttgcttctgcgtaatgggagtggaacaccaggggatggtgaagagatccagggacgtgaattcagatgctttagggttctgctgtgctctgccatgctctggttgtatgtttttagaaagttgctgaacttaagccgggtgcagtggctcacacctgtaatcccagcgctttgggaggccgaggtgggtggatcacaaggtcaggagatcaagacaatcccgtgtaacacggtgaaaccccaactcaactaaaaatacaagaaaaattagccgggcgtggtggcgcgcacctgtagtcccatctactcgggaggctgaagcaggagaatctcttgaacccaggaggcagacgttgcagagagccgagattgcgccgcaacactccagcatgggtgacagagcgagactccgtctcaacaacaacaacagcaacaacaacaacaacaaagttgctgaacttttctgagccccattttcttttactttttccagactgagtctcactctgttgcccagactggagtgcagtggtgccatcttggctcactgcaacctctgcctcccaggttcaagccattctcgtgcctcagccccctgagtagctgagattacagatgcacaccaccatgcccaggtaatttttgtattttcagtatagacggggtttcatcacgttggccacgctggtctcgaactgctgacctcaagtgatccactagcctcggcctcccaaagtgctgggattacaggggtgactcactgcatccggcccctattcatatagccttaagtgctatattcatgggcatggcttattttcaagtgcaatgattgtaaatattttcagaaccctaaacgtgacaaattaagttggaatttattaagcacatgcagtagatggttttccatcctatagttaatgtgtctcagattcatggcagagaaccatgggtccttggactgtcagagaagggtggggacagtttctctcttcttatgaatgaatgaacaagtgcttgggtcttagaacatgtgagctgccagagccttaaactaagggtgattatttatgtttatcgaccacttattgtcacttggtaggactgggccctgtgcgaggcaaacagacacacacacacacaatcacttttcatcttcatgacaaccttatgaggcgcatataggcatacagtcatccccatttcacaaatcaagaaaatgggggctgggtgcttattcatagaataagacaggactggacacacagtcctgcactcgagcctgggcaacagagcgagactctgtctcaaaaaaaaaaaaaaaaagaaaaagaaaaaaagaaaagaaaacaaaaacaacagaaaaactatatgaatagcactagtaatgtactcgcattgcctgtattgggtatgttaaacatattttgtaagcttcaggttccacaaatgaaggcacggctccatttactcccttcgctgttgagtctctaggtactgacacctgtgggtagagtgaaaaaaaggctttcaaatctatattatctgtggccaggtatggtggatcatgcctgtaatcccaacactttgggaggctaaggcgggcggaccacctcaggtcaggagttcgagacgagcttggccaacatggtaaaaccttgtctctactaaaaatacaagaattagctgggtatggtggcaagcacctgtaatcccagctattcgggaggctgagagaggagaatcgcttaaacccgggaggcggaggttgcagggagccgagatcgtgccattgcactccagcctgggggaagagtgaaactctgtctcaaaaaaaaaaaaaaaaaaaaaacttccttatctgtacctgcgttaatttaagtcatttgtattttccagagggactgccacaaccctgtcattctatcttccatacagtccttgtctgtgaaatggtcccaagccacagcaacactgccaacaaagccactttgccgactgtttacaaaacattattgtccccaaaatagctgcataactcaacgtaacttgcacactgtggaagcacaaaaggggttttctatgcttaatgttcgtctttgtttcgcagttaaacacttgccctcagattgggtcagatgccggggaagtttcagatgaactcagctattttcactgcatccgagtgaccagaaaagctggcctttcagtttttctgtttaacaaaactgacttcagaatcaaaatgctcctagcttcttcaaaactccactgacaatgacacaaatgactgaaattgggcttgagtaattgattacaaaattgtgctttgaggtaacctttctagacctggctttaaacatttttaaaaattaatactctcacttaaaaaatttatctagtcaaataaacagagatttctctccaaatcccttcccacgaattttgcttctaaagagaaggattctagggtatctttcctcctcccaactattttttttttaagatggagtctcgctcgctttgtcatctaggttggagtgcagtggcatgatcttggctgactgcaacctccgccttctgggttcaagtgattctcttgcttcagccccctgagtagctgagattacaggcatgtgctaccacacttgactaatttttgtatttttagtagagacggggtttcaccatgctggccagactggtcttgaactcctgacctcaagtgttccgcccgccttggcctcccaaagtgctgggattagaggcgcgagccactgggcccaggcttttgctcccttttttctttctttttgagacagagtctcgccctgttgctgaggttggagtgcagtgatgcaatcatggctcactgcagccttgaactcctgggctcaagccatcctcctgccttagtctccagagtacagccttagctgggagtacaagcatgcaccaccatacccggctagtttttaaattctactatataaaaatttataaatacttttatagaaatgaggtctcactatgttgcccagcctggtcttgaactcctgggctcaagtgatcctcccaccctggcctcccaaagggctgggattataggcatgagccactgcgctcagccttcctttctttcttgatagcattccgtatcattgggttcaaaacaatgagcttttattatcttggtaaacagagaaaaacaattaagacaatggaggcagctggagtatccagtgttggagagggtccgtcagtcctttgaatgcccgggtcccagaaggtgtgtggggtggtggtgtctttgtggaggtccttgcatagaggacacaaaggccatgtggctcaggtcgcctgagtcccgaaggccatgctctgcccagtccattgtgagtcgagtctaggttatttgtctcttttctcaagtgggtggtaaagaaccagggccgggcatggtggctcacacctgtaatcccagcactttgggaggccgaggcaggtggatcatgaggtttggagatcaagaccatcctgaccaacatggagaaaccccgtcttccctaaaaatacaaaattacctaagtgtggtggtgcatgcttgtaatcccagctagtcgggaggctgaggcaggagaatcgcttgaacctgggagacaggttgcagggagccgagttcgctccattgcactccagcctgggtgacagagtgtgaccctatctcaaaaaaaaaagaaccagacccacaggctctctctctgctcgaggcctcagcacattccccaattcttcttcttcactcccgacctcaggtgatcttcctgcttcggcctcccaaaatgctgggattacaggcgtgagccactgtgccccacctcttcttcttttttcgatacggggtctcactgtcacccaagctggggtgcagtggcctgatgttggctcactgcaacctttgtctcccaggctgaagagattctcctgtctcaccctcctgagtagctgggattacagatgggcaccaccacgcccggctaatgtttgtatttttagtagacatggggtttcaccgtgttggtcaggctggtctcgaactcctggccccaggtgatctgcccactttggactcccaaagtgctaggattacaggtgtgagccactgtgcccagccactataatatatatttttaaaactacctcattcaggtgtgattgacacataaaaagctatatgtctttaacgtatacatcttgaatgtgtctggtgataagaagacacctgagggtacaatatttttaaggttcatccacatcttagcatgtatagattctgccttgtttttatggctaaataaatacttcactgtgtatgaatagaccacattttctttatcattcattagttgatggatatttaagttgttttcagtttggggggactattataaatagtgctgctataaatatttatgcacaagtttttgtatgaacatattctttccaaataaatctctgttgttggccaggcgcggtggctcacgcctgtaatcccagcactttaggaggccgaggcgggcggatcacgaggtcaggagatcgagaccatcctggctaacacggtgaaaccgcgtctctactaaaaatacaaaaaattagccgggtgtggtggcgggcgcctgtagtcccagctactcgggaggctgaggcaggagaatggtgtgaaaccgggaggcggagcttgcactgagccgagatagcaccactgcactccagcctgggcaaaagagcaagactccatctcaaaaaaaaaaaaaaaaaaaaaaaaaaaaagaaatctctattgtgaatggtaccggttattcaatgggtttttgaagattctattttaaattttatttaaggccagttgtggtggctcacgcatgtaatcccagcactttaggaggccgaagcaggaggactgcttgagctgaggagtttgagaccagcctgggcaacatagggagtccccatctctaccaaaaataaaacaattagctgggtgtgatggtttacacctgcagtcccagctacttgggaaactgaggcaggaggatcacttgagcccaggagattgaggctgcagtgagctgtgatgttgctactgcagtccaccctgggcaacagagtgagaccctgcctcaaaaaataaaattaaaaaaaatgttaaaaatgttaaaaatatttaacaaactcatacacagcactgaagttccgccaccatgcctggctaattttttctattttttagtagagacggggtttcactgtgttagccaggatggtgtcaatctcctgacctcataatccgccctcctctgcctcccaaagtgctgggattacaggcgtgacccaccgcgcccggcctcttttttttttttttttttttttttgagatggagtcttgctctgtcacccaggctggagtgcagtggcatggtctcggctcactgcaacattcacctcccgggttcaagtgattctcctgcctcagcctcctgagtagctgggagtacaagtgcccgccaccatgcccagctaaatttttgtatttttagtagagacagggtttcattatgttggcaaggctggtctggaactcctgacctcaggtaatcacccgacttagcctcccaaaatgctgggattacaggcgtgagccaccgtgcccagccccagacactgctctgagtctattcacttattaattcctcatagccaccccatgagatgagttctgtgggcagcccattcgacagaggaggagactaaggagaggcttatccagggctccaaagcaaacatgtagcaggtggggactcaacttcaggcagttcggcccctcaatttacaccccaactatgagctctaccatttttcagagctggatggaggatctgaagttactgagctggcgtctgggccaagtgcatggtcccagcggaggcagttaccatcaggatgcctttaccccttcgggaccctgcaagggagaatacagcccaagcctgcaggccctggcccctggcacaccggccaagcccgggagtgtttattcagcgctacctgtggccagccctttaggccagctcagaggcaggtccattatagcagcctgatctgtagcagaagaggaaattgaggctcagcaaggtccaggagactgtccctcagtgaccagtgtttatggtcccacagagccacaaaccgggtgacttagaacaacataagttcattgcctcactgttctggaggccagaagcctgaattcaaggtgtgggcaggcccacactccctctggaggctctagaaggggatctgctcctggcctctctcccagcctcggacagttccttgacttgggacagcagaactccagtcctcacataatgactcactgtgtccagatttccgtttttttataaggacaccagtcatattggatttataaggacactccaatggcctcgcttcaacttgattacttgtaaagacctgttctccaaatgaggtcacatttacaggtaccagggcttaggacttcaacatatctattttaggggttacatttcacagctgggatttgaactcagggaatctgaccccacagccagagctcacagccagactttccggattctggctctgacttttctttctttcgttttttttttttttttttttttttttttttgacagagtgttgctctgtcgcccagactagagtgcagtggtgcaatcttggctcattgaaacttccacctcccagggtcaagcgattctcccacctcagcctcctgagtagctgggattacaggtgcccgccaccatgcctggctgatttttgtatttttaatagagatggggtttcaccatgttggccaggctggtctccaactcctgacctcaagtgaccctgaggtcacttgaactcctgacctcaggtgatccacctacctcggcctcccaaagtgctgtgattacaggcgtgaccacacctggcctccttccttccttcctttccttctttccttccttcacctctcccctccccccctcccccttcccctcccttcccctcccctctccttcccttccctttctccctctctattttattttattatatttcttttttgagacaggggcttgctctgttactcaagctggagtgcagtggtgcaatcatggctcactgcagccttgacctcctggaggtcaagtgattctcccacctcagccttctaaatagctgagaccacaggtgttcaccaccacgcctggctaattttttttttgagacgaagtttcgctcttgttgcccaggctggagtgcagtggcgcaatctcggctcactgaaacctctgcctcccgggttcaagcaattcttctacctcagcctcccgagtagctgggattacaggcatgcaccaccacgccaggctaattttgtatttttagcacagacggggtttctccatattggtcaggctggtctcgaactcccgacctcaggtgatccgcctgccctggcctcccaaagtgttagggttacaggcgtgggccacggcgcccggccgcacctggctaattttaaaaaatatttttgtagaggtgagctctccctatgttgcccatgctagtccgaaattcctgggctcaagccatcctcctgtggtctcccaaagtgctgggatcacagatgtgagccactgtacctggccttgactttccataaacatttgtgcaccagcagcagtactgtggctttaggaatgacctggtccccttttgtccagccactgcccaggtgttcctgtggggctccaaagcccagtagcgtcaggtcatctctgttttgcaaacctaaataaggaagatggcttggagtagaacttcctaagcaaaaggcttttcctgtggaggaagggttacggaggtaaggttctgtccttcagcaattacatgttaaaatatttaaagacctggccttgttgtattgttaaacagcttgtaatttagccaatgcgttattaataagaagcagcctgtgaaggtaaattattgtggcttaggccaaaagcagttacagttggattcgctgttacggaggtagttttaacaaagcggccggggccttatttaaatgagtttaaattagctccctggagcctgtcatctgatcctgttgctaacagattaaggcaagcaatgttttctaccttgaatgctgctctgatttgcgctgggagaacagaggtgatccactgccctgcatagttgtcttctgatttccgagggccctgaaataagtgtaaggccctcgtgcattcatttctgtgtgcatttatttatgcattcatgcatgtgtgcattccacaaatattttttgagtttttgctgtgtgccgaaggctgtgcgaggtggattcctagcacttctttttttctccaatgtcagaggctcaaatgtgcactgatctagtactttcttttttttttttgagacagagtcttcctctgttgcccaggctggaatgcaatggtgccatctcgcgcatggcaacctccgcctcccaggttcaagcgattttcctgccttagcttcccaagtagacgggattacaggtgcctgccaccatgctcggctaagttttgcatttttagcagagatggggtttcaccacattggtcaggctggtcttgaactcctgacctcaggtgatccacccaccttggcctcccaaagtgctgagattacaggtgtgagctactgtgaccggcctgatctggtactttttgaaatgcattgttattctgttcatttgtttccttgtttacttgtttatatgggtatttttcattaagggaagctccaggaagaaaagactgtgtctgtcttgtctggttctttttctttccttttttttttttttttgagactggtctcaggttgtcacccaggctggggtgcagcggcacgatcacagctcactgcagcctcaaccttgcaggctcaagcgattgtcccacctcagcctcccaagtagctgggactacaggcacacacaaccatgctaggctaatgtttgtatcttttgtatagaagggtttttaccatgttgcccaggctggtcttgaactgctgggctcaagtgaactgactgcctctcaaagtgttgggatcacaggcgtgagccactgcacctggcccatctggttcttttgatgtggttcctgcccttatcgagccctcagcatagtctattgggggagggggtgacagacaaatgccatgtagaaccattcatcatggggaaaaacagggcattgtaggaacacaaagaaggacccactggaggccataggagggtcatttgagccagccaggctgagagttgcggggaagcagggagtggggaggtgggggatgttaagcagggtttagcctatgcaaaggccaatggggcagaacttgtctctcaaagaagtgaactagcttaatgggaccccagtgcaagttagaaagtggctggcagcgtcatcaggggccaggaagcagagacgttggaggtctggaggcattcctgagacacttggaaaatttaaaatagtgtttcccctctgcgcaaaatcctgacataccatgtaaatgtcaagctgctctaggctggcctcgctaagtcatccgccctcccggagccatcaggggaaccagctgatcctaggagtccctgggccccgctcctgacacgtgagtgagactctgcagtgggtttgtgcacacatgggtggcacgggctgtcgttctcccagtgccggagaggccagtcattctgagggtgagtcctcatgtggaggggacacggcttcccagcccaaaagtacatccaagtgtgcagaagtaggaaccagtaagaactagacctggctgggtgcggtggctcgtgcctgtaatcccagcactttgggaggccgaggcgggtggatcacgaggtcaggactttgagaccagcctggccaacatggtgaaaccccgtctctactaaaaatacaaaaattagctgggcgtgacggtatgtgcctgtagtcccagctacgcggggggctgaggcaggagaatcgcttgaaccgggaggtggaggatacagagccgagattgcaccactgcactccagcctggtgacagagccaaaaaaaaaaaaaaaaaagaactagctgactttggtcctgttgcagccatgggttagggaacttgttaaaaacaggcaaaactggccaggggcggtggcttacgcctataatcgtagcactttggaatgctaaggcaagaggattgtttgagcctaggagtttgagagaccagcctcggcaacacagtgagaccttgtctctacaaaaaattaaaatatgaactgggcatggtgatgtgtgcctgtaattccagctacttgggaggctgaggcaggaggatcagtggaggccaggaggtcgaggctgcagtgagccgtgatcttgccactgcactccagcctgggtgataaagcaagaccttgtctcaaaaacaaacaacaataacaacaacaaccaaaaaaactggcaaaactctccctctccagctttgttgttcatggctgattcattgtttaatccctgtggataaaccctgttctgacaactgagggggagttactcatttattcacctgcccaataagtatcttccagaacctagctctctgaaggtagagctttgggctgcgcacctgctgatgtcccctgggagtgtagatgtaggtccactcactctgagactagggagaccggtacttatgtgacttaatctcccagggatatatagaaagatggttccattttcctattttatttccctggcacctggccattcactcattccttcctcctttcattcctttgagaaatattggctgaacgtctacaatgtcccaggtgttgtacaaggcaccagggaattcagtggtaaatgaaacctacatagagacggtggcattgagactgtaaacaaacaaacgcagacataatgtcctattccaaaccatgacaaatgcttctgatagggctgtagaccatctaggaggtggcttattctttttttttttttaattgcccgggctggagtgcagtggtgcaattatagctcactacagcctcaacctcctgggttcaagcgattctcccacctcagctacctgagtagctgggactataggtgccaccgaacctggctaattttaaaatattttgtggagataggggttttgctgtgttgcccaggctggtctcaaactcccggcttcaagtgatcctcttgccttggcctcccaatgtgctgggattataggtgtgagccactgcacctggcttcactctatagttttttattgtgatgaaatacacgtaacataaaacttcccatttaagcatcttaagtgtacagttcagtggcataagtacattcacgttattgtgcaactgtctccactgtccatctccagaaccccttcatcatcccaaaccggactctgtacccatgaaacactaactctccactccctgctccccactgctgctattaaccactattctatttgctgtctctgcaaatttgaccattctaggtacctcatagaaaaggaatcatacaatagttgtccttttgtctctggctcgtttcactggacacaatgtcttccaggttcagccgtgtcgtggcaggtgccaggtgcctcactcctctttaaagctgaagaatacgtcattgtatgactccatcacctttcatttatctgttcatctgttgatggacacgtgggtgttttcccccttttgatcattgtgtaaatgatgctgctgtgaacatttgtgtacaaatatctgttttaagtctccattggtttgctcttgtccattaagaaaaaatcaacaatgtggtacctggcattgtccctttaattgctgcagcaactccagagcccacactcttaatggcagtgctatgctgttgctcattcattcgtcctgtaaatgtctattgagtgttgactatgtgctaggcatttttgcaaagcactgcaaattcagggatgtcaggggctggtgatgctacttcagcagttgtgatgtgtgaaggaataaaacaggcatacatgagtcagcatccttttcctctttttttctgagaaaaactgagcctcagagaggttgctttgagagcatccagctgtcaagtggcagagctggggtcacatgttgaccctgtgctgtgtctctgcccctcccccacgcgccgcccttgtcctgtcactgagtccaggtgccctggctgcagacgctgttctgaccctgtgtctccatctcatgtgtgtcccgggctggctttgctgggatgagcagtggcttttcagctccagggccatctgggtacagctgcaatgatggattgtctgcaacagtcatgtcagggcttccggaacagtgtcagcctggttctgccaggcccacttcccttcatcagctgggtgacactgctgccattggatggctgatgactcattcagcaagctctagttgagcacccctacgaaaagttggggggtctaccccatggcacagtcttcagaagtgaaaaggaaggaagcactgatgcacgatgcaacacagatgggctgaaaacattgtgctgagtgagagaggtcagaggcagaaggccatgtcttatgtgatttcttttttctctgtctcttttttttttttttttttttgagacagagccttgctctgctgttcaggctggaatgcagtgaggcaatctcagctcactgcaacctccacctcccgggttcaaacgactgttgtgcctcagcctcctgagtagctgggactccaggtgcatgccaccatgcccagctaatgttttgtatttttagtagagatggggtttcgccatgttgaccaggctggtcttgaactcctcacctcaggtgatctgccccctgaggcctcccaaagtgctgggattacaggtgtaagccacctcaccaggccttatatgacttcatttcttggaactatccggagaagggaatacatagacacagaaagtagatgagtcggatgagtggttgtctaggactggggtggcaggggagggggcggagatggggttgacttctgaaggatacagggcttcttttgaaggtgataaaaatattctggaataggtattggtgatggttttaagttcatgaatgtactgaatgaaacacactggactgcatactttatattttattttttgagacagggtctctctgttacccaggctggagtgcagtggcaggatcatagctcactgcaatctcaagccatcctcccgccccagcctcccgagtagctgggaccacaggcacgcaccatcatgcctgcctagttttttatttttatttttagagatgaggtcttgctatgttgcccaggctggtcttgaacgcctgggcttaagcgattctccgacctcgacctcccaaagtgctgggattacagggtgagccaccgtgcctggcctgacctgcatacttaaaaagggtgggctatatgatatgataattatattttaattttttaaaaaaacatttatttttatttaaacagtttttggggtacagcttttttttttaacatggataaggtctttagtggtgatttctgaaattttagtgcacctgtcacacaagcagtgtacactgtacccaatgtgtagtcttttattcctcactccctcccagtcttcccctcccaagtccccaaaatccattatatcattcttatgcctttgcatcctcatatatatatattttgagatggagtctcactctgtcacccaggctggagtacagtggtgtgatctcggctcactgcaacctctgcctcctgtattcaagcgattctcctgcctcagcctcctgagtagctgggattacaggtgtgtgccaccatgcctggctaatttttgtatttttagtaaatatggggtttcaccatgttggccaggctggtctcaaactcctgacctcaagtaatccgcccacctcagcctcccaaagtcctgggattagaggtgtgagctaccgcgcccagcttgcgtcctcatatcttagctctcacttataagtgagaacatatgatatttggttttccattcctgagttacttcatttagaataatgacctccagctccatccaagttgctgcaaaagacattattttgtcacgcctgtaatcctagcactttgggaggcggaggtgggcggatcacaaggtcaggagatcaagaccatcctggctaacacggtgaaaccccgtctccactaaaagtacaaaaaaattagctgggcatggtggtgggcgcctgtagtcccagctacttgggaggctgaggcagaagaatggcgtgaacccgggaggcagagcttgcagtgagtcgagatcatgccactgcactccagcccgggtgacagagcgaaactccatctcaaaaaaaaaaaaaaaaaaaagacattattttgttcctttttatggctgagtagtattccgtggtgtatatataccacgtttctaaaatccacttattggttgatgggcgtttgggttggctccatatttttgcaattgtgaattgtgctgctataaacatacatgtgtatgtgtctttttcacataatgacttcttttcctttgggtagatacccatatttcaattttttaaaaaagagttggaggaggtgagtagattgatatcacatctgtgctgaggtcccctagacttgcagggggaaggaaaggggttgatagggagactcctgaagagtatgacaggcgatgggggcaccttactcagtggctgcgtagtggccaggcccccaaatcaggcctgcagaatagaaaagggaagggagagcattgggctggaagatgttggtgcagcttggatattctttctgcattcttactggacgttttggcgtaagtggcattccagcttcctttgaatttggatgaggaagaacaggaaggaaggaaggaggggaggagggatcatctgtcaagtgattagcagaaatagctttttgtactttacagaatctcactcatttttaaaatttaaatttacttaaatggtgatgtagaatgaaccatgtgccaggcactgctctaagcacattgcatgagctgactcctttattcttctgacaagtagcaaggtagctacttttcttacttccccttttacacacaaaggaattaaggaactgagagcttgatgattttttcacacagctgatgagaggcagagcagagatcccaacccaggccccagagcccactctcttaagggcggtgctatgctgttgttcattcattcatcctgtaaatgtctattgagtgtggactatgtgctaggcattttgcaaagcactgcaaattcagggatatcagcggctgatgaccctatttcagtagttgtgatgtatgaagcaataaaataggcccacctgagtgctagttgggaggttctatgattattgcactttacaaatgaaagaggggttacccagcctggaattgggcaagtctgggtgggaattcagggctatttagctccagcctcccatctccagatgctaattgtgtcaatatggattttccaggatggggacccgtaagaggcagccctgcttggtccctgcctgccccactgtggccctgcagctgtgggctctgggctttggaccatctccttttctgagcaggcaggcttggatgtcctctccagccacctggcagaagggctgtaactgaatccttctgtggccttgtgttcctgagagcaccaaaccatgtgtttgtttagcagggagaggctcaggtctcatttgtgggtggtcaagccaactgtagggacaggagccggcagctgaggctcttaggcagggacaaaactagtggtgtgagctggtttccaacacagaaaggtcccgtcagctgtttgatcccgtaggaccttgggaggtatgaaaggcacaggggctgggccctgtttggtctctgccagggcctctcccagggcagggtgcctgcggcccacagtttctcaaggtcacagcaatgtttaacaaggaaagaaaataaatgtaattattccagaatacaaaaagaaacctgcaggcccaggtgcagtggctcacgcctgtaatcccagcactttgggaggctgaggcaggcagatcccttgaggtcaggagttcgagaccagcctggccaacatggtgaaaccccatctctactaaaagtacaaaaattagttgggtgtggtggtgggtgcctgtaatcccaggtacttgggaggccgaggcaggagaatcgtttgaacccaggaggcggaggcggcagtgagctgagatcgtgccattgcactccagcctaggcgaaagagtgagactccgtctcaaaaaaaaaaaaaaaaaaaaaaaggaaaaaaaaagaaaagaaaaagaaacctgcagagttaaaatgaacacatgctgaattaaatgcctaccaagggcaacttcatgccaggctgtcatctggacctcaactgtgatgagctcatgtatatgtaaatcacggaaagtggatgcattttaatgtgtgtgatgtgattgacatgggtagagcccaggacctgtgaaggcctcacaaccatcctgcgaagagaggtgctctataaccttccggggctccctggtcccttctaggtaaggtccctctccacttggcaggcgtttgaattttattcagccagtgtttttattttatttatttatttattattattatttttgagatggagtctctgtcgctcaggctggagtacagtggcatgatctcggctcactgccacctcctcctctcaggttcaagcaattctcatgcctcagcctcccgagtagctgggattacaggtgcgcaccaccacgcctggctaattttttgcatttttagtagagacagggtttcactatgttgtccaggcttgtcttgaactcctggcctcaagtgatccacctgcctcggcctcccaaagtgctgggaggataggtgtgagccactgtgcacagcctttattttattttttaaagaaacaagatcttggccgggcgcggtggctcacgcctgtaatcccagcactttgggagggcgagacgggcggatcacgaggccccgagatcaaaaccatcccggctaaaacggtgaaaccccgtctctattaaaaatacaaaaaaaatttgccgggcgtaacggcgggcccctgtaatcccagctaacttgggaggctgaggcaggagaatggcgtgaacccgggaggcggagcttgcagtgagccgagatcccgcgactgaactccagcctgggcgacagagtcagactccgtctcaaaaaaaaaaggaaaaaaaagaaacaagatcttgctctgccacccaggctggagtgcagtggcataatcatagctcattgcagccttgaccttctatgctcaagcgattctcctgcctcagccacctgagtagctggtattacaggtacgtgccaccacacttgggtaattttcttttttaaaaatatttatgtatttatttttgagatggagtctcgctctgtcacccaggctggagtgcagtggtgcaatctgggctcactgcaagctccgcctcctgggttcaggccattttcctgcctcagcctcccgagtagctggaactacaggcgcctgccaccacgctcggctaatcttttgtatttttagtagagacgggtttcaccgcgttagccaggatggtctcgatcgcttgacctcgtgatctgcccgccttggcctcccaaagtgctgggattacaggcgtgagccactgcacctggttaattttcttattttatgtagagatgaggtctcactattttgcccaggctggtctcgaagtcctgggctcaaacaatcctcctgccaggattacaggtgtgagccacttcacccgacctcagccagtgtatttaatatcttctccaagtcagatgcaggaaggggatcttcaggcaaagaggctggaccctcagaggtgcccatggtcaagctggggagacagacacattttcaaatgcatggggactgtctgaggaacaagggcacagggagggtcagaaatgggttgagtatgagctgagggtatgaaccaggcttccgtcctgtgtgggagtgtcttgagtgttgggctgtccttcagagatcaaggcactgtttggttctagaagcaacacagtgcaccaaccccatggtctgactgcaagggggtcaaattgcagcttgatccctcacaagctgtgcgactatgggcaagtgacttaaactctctgagttttggcttctccatctgtcaaatgcggagggtgagcgctacctacttcatcaggagcagcacacggtatgcagtgagcccagtgtatgcctcggctattgccattactgcaatgatggttaggcttgggcagctgaaaattgtccaaatgtgtccttttggtactcatcggcaccttttggtcatctgaaattaaaggaaagttttctgcctgaccagccacccgctataaacattcaccccaggagaaggcaaggcagttctcccggggcctggagatgaggcattgattgtccctggagagcccttgcgctgggaggagctgcttttcttgctcctgtcattttccctgcagcaggaggatgaggtttgaaagcagcagacagaacctgaggttggtttctgccgaggtccctccatccccttccctgcatccccttctctgccatccagggaggtgaacctccttctcatgccccaccggccccatcctcagcccaccccgatcctcacttctccaggtcccctgctttgcgagttacaggccagtgggactcagcatttccaagccaccgatgcttgtgacgtagccagagattctgaggcaggacacagtgattcagggttgtcgtctgggtcagacaggctcatgcgccaatcccaccactccccggccatgtgctgctgggcgagtcactctgtcttcctgagcctcaacttgctcatctgtaaaatggggaaatgctagttcccatctcaccagggcattgtaaggatgaagcgaggcagttaacactttataaagtccttaacaacagtgtccaacaatcgtgaaagtcctctgatgctggacaactggctctgggatggacgccttccagacggagcctcagctcgaatgtccccccgaaacatgtggctctgtcactggatactgggagaagtaccttcctttcctttcgaagtcagagaaagtcatgccccagcagaccagcctcccctccgtgcctgttatctgggggctccagaccgggcctttctaacaagaggtttgttaggatgggaagtgagtcaggaactctggcctttgactggctgcgtgtgctgagtctgtggctttatcccctccctgacaccctccttgaggctctttgggccaagtgcgtgttatgttcttctttgctggttagcattgttagcgccaagggtgtgccgaggaccaagcccggcacaggtatgaggttgtgctttggaaaagcaggcgatcctccttcacaagtctcctgttacaaggcacgataaacgctttcaaagaaataaaatggtaaaaggaaggagaactgaggaagaggcagtcgtgcctaggagggggaagggagggtgtcccgggaagaaggaccagcatggatgaggccctgaagcctgagcgtctccttggcccaaatccaggcctcctacccctccagaaagccccatgtctcatgcctcccatccccttcactgtcaagaaattgatcagcgttccaagcatctggaacagcaagtgcaaagtccccatggcagggacacgtcgatgtattgttctaaacgcagcaaagctggcgtggctggagccagatgagggggctgggatgggaggtgggtgggcagggcagatcacacagggcccgaggaccaccataaagagtgcaggtttattctcggcatcaaggcccgttctttctttctttatttatttatttgagatggagtcttgctctgtcgcccacgctggagtgcagtggtgcgatctccactcactgcaatctctgcctccctagtagctgggattacaggcatgcaccagcacgtctagctaattggttttttttttttttttttttttttttttgtatttttagaagagatggggtttcaccatattggccaggctggtcttgaactcctgacctcaaatgatccatccacctcggcctcccaaagtgctgggattacaggtgtgagccaccgcgcctggtctcgtcaaggcctgttctgtgtatatcctcccccgaaatcatttcgtttgggaaacaggagggagactgagcagtagaaggaaggggagaaggtcaggggtggtgtggccgctgcctggcaggattctgaaggacagagggtggaaaagggaggagaagatgtgaccgcttggcccggggggacagtgcctggctctgtttctgagctgcccatgacaacaagcccagctgctgagcaaacggttcttggagggagtggggactgggcccaactgggattcaaatccaggttcaccatcccgtgctgtgtgacttggggtaaattagtgagcctctctgggcaagtacatgagacatatacgcactttccaaatgatgaaacaggcccagagaaaggaaggggcttgcctcgctggaaggaggtggagctggacttctaaccaggcagtctgaacccctccagcctccactggctttactctgctctctgtcctccgtggggagatgatttcctttgaaagtgggtccagcgtggctgagatctacagggcagacacagttctcagggggtctccttgccagctcgctgagtccagaccccaggatccccatggtgcattctctgggggaacgaggcctccctattccaacgctgatgtgtttgtcgcagcaactgacatggagatatggcaggaggcagctctgtcctcctggccctggtggaggacaggcaggctggccttgcccagcctggggtgacaccaagggctcctgggcatgtatccatttcttcctcggcccccccctccccccgcctctcttcctgggagccaggagggaagggggaggaggtgtctgtcctcagatgccggcactatttttggagcctgccttgatcccaattccggggcacgtgggctgtgacaggcgctaggagcagaccccgctggaataaggaataaggtcagccacagatgctgggatacgcccccaccaccctgaccctggcccttctagaactgggcacggacccttgccctccctgagcgtaggttcatgggcttgggggcccctcaagctaccttcacccagctctacacccccgcctgggaggacctccgcccgcacagaagcaagcagccccagcacagagcctggggctgacctgaattggctccgaggacagtgaggggcccttccctgtgaagggcacagtggcatggaatccagcttaacctcctgtgctcgtggccaaatcctgtgtgagacacacggagagactgtggaggaaataatcctggccatcccttctccagcacccacagcagtttgctcagttctcaggacgactgtgtgcaacagggcactgagaggttaagtaacccacccaaggtcacacagcttgtaagtggtagagctgggatttgtacccaggcagggctcgagtctgtgctgtcagccagggtgagaccctctaatggctcacaggaagcacattactgaatatttacatgaacatatacaaaaaaaattatgtaatagatatattcatatataaaataaactccttaaactactcatatatttatttatatatttatttttattttgagatggagcctggctctgttgcccaggctggagttcagtggcacgatctccgcttactgtaacctctgcttcctgggttcaagcgattctcctgcctcagcctcctgactagctgtgattacaaacatgtgccaccatgcccagctaatttttgttgttgttgttattttttagtagagacagggtttcatcatgttagccaggctggtctcaaactcctgaccttaaatgatctgcctgccttggcttcccaaagtgttgggattacaggcatgagccactgctcacagcatgcccatatatttatatatggaatatattatgtatccatatatgaaataatatatttacatgggtacatttatatatacattatatatttatagatatgtatagatatgatctatatttatttatattctatctatgtttataaaattatattatacagaacaccttatatttacattgtgtatagaaagatatatgcacactatataaattgtgtatatttatattaacatatattcatatatatttatatatacacttaaataatatatgtatacatgtggccaggcgcggtggctcacgcttgtaatcccagcactttgggaggccgaggtggacggatcacccgaagtcaggagttcaagaccaacctgaccaacatggtgaaaccccgtctctactagaaatacaaaaattagcagggtgtagtggcgtgtgcctgtaatcccagctacttgggaggctaaggcaggagaatcgcttgaacctgggaggtggaggttgcagtgagccgagatcgcgccattgtactccaccctgggtgacaagaacaaaactctgtctcaaataaataaataaataaataaataaataaataaataaatagtatatgtatacatgtggattcatatgtgtgtatgtgtacatataaacacatacacttggagagagaaagacacttttttaaagaaacagttttattgagatacaattcacatatcatacaactcattcatttacagcacataattcagtggctttcagtagattcataatattgtgcaagcttcaccgcaatcagctttagaatagtctcattacctcgaaaagaagctctgtctgccttaaccctcatccctcaacacccccaccatctctttcctcaccactcctggtccctggcaaccactaatctactttctgtctctctctatttgcccgttctgaacatttcatataaaaggattcatgcaatatatggtattttgtgattggctacttgcactcagcataatattttcacagttcatccatgttgtagcatgaatcagtaccttgttcctttttaaggctgtataatattccattttatggctagaccaccactgatttattccctcatccgttgatggacatttgggttatttccactttgcctattacgaataatgttgctataaatatttgtgtatttttttgtgtggacttatgttttcatttctcttgggtacatacctatgagtggaattgctggatcatatggtaactctttgtttaattgtttgaagaactgccacactgttttccaaaggggttgtatcatattacatacacgtgggagggtttgggggcttcaatttctccacatcctcaccagcactagctattattatgtcttttaaaagttattatagtcatcctagtggatgtgaagtggtatttcattgtggtttggatttgcatttccctagtgactaatgatgttgaacatagtttcatttgcttttttgtgttggtatattttccttggggaaatgtctgttgagatcttctgccattttaaaattgggtcatctctttattgttgaattctaacactcgtttatacattctagatgcaaatcccccattttctacacacacatgtacacatatgtatgtatgtataatttgcaaaaattttctcccattctctgggttaccttttcactttcttgcttgtatcctttgaaacacaaaagttttaaaatttgatgatatccagtttattttttcttttattgtttgtgcttttgatgccataagtaaaaaaccattgcttaatccaagttcataaagatttattcatatgttttcttctaagagttttgtagtttttaaaaaatgcttttaaaaaattattattattattttatttgtttatttttttgagatggagttttgctcttgtcgcccaggctggagtgcaatggcacaatgtcgcctcactgcaacctccgcctcctgggttcaagtgattctcctgcctcagcctcctgagtagctgggattacaggtgcatgctactatgcccagctaatttttttctatttttaggagagacagggtttcaccatgttgaccaggctggtctctagctcctgaccttcggtgatccacccgcctcagccccccaaggttctgggattagaagcgtgagccaccgcgcccggctccaacttcattctgttgcatgtgtatatccaattgtcccggcaccatttgctgaagagattattcttttctcatcagattgtcttgacacctttgtaaaaaatcagttggtgataaacgtaagggcttatttctggatgctaaattcttttccactgagctgtatgtctccccttatgccagtatcacactgttttgattactgtagcctgatatatctatatatttatagatacaatatatatttatatacatactatctatatttataaaattatattatatagaaacaccctatatttacattgtgagtagatagatatgtgcacagtctatataaattgtattattttttcttttattgttgaatagcctgatgttggtataaatatttgtgtataatttttttgtgtggacttatgttttcatttatcttgggtatatacctaggagtggaattgctggatcataaggtaattctatgtttaactgtttgaagaactgccaagccattttccaaaggggttgtaccgtattacgttcatatgacagggtttgggggtttcaatttctccacatcctcaccaacacgtgctgttatgtcttcttcttcttcttttttttttttttgagacagagtttcgctcttgtcgcccagactggagtgcaatggtgtgatttcagctcactgaaacctctgcttcttggtttcaagtgattcttctgcctcagcttcccaagtagctgggattacaggcacctgccaccacgcccggctgctttttgtatttttagtagagatggggtttcaccatgttggccaggctggtcttgaactcctgatctcaggtgatccacctgccttggcctcccaaagtgctgggattgtatgcgtgagccaccacacctggcctgctaccacgtcttttaaagtaaatcaggaaatatgagttctccaattttgctctttttcgattgcttttggttatcttgggtctgttgtatttccatatgaattttgggataagcttgtcaatttctgtaaagaagtcaactgggatgtggatattgtgttgaatctgtagactagttggggaatattgccatcttaacaatgttaagtcttctgttccatgaatatgggatgcctttccatttatttagggctttaatttttttcagcaaatgttttgtagtgttcagagtatacattttacacttctttttgttgaatatattcctaagtattttattctttttgatgttgtaaatagaattttttcattttattttcagtttgctcattgttagtacatagaaatacaactgatttttctatattggttttatatcctgcaaccttgctgaactcattgattagttctaatctttttgtgtgtacgtgtgtggatgctttaggattttctatataaatgttcatgtcatctgcaaatacagatagttttacttcttcctttccaactggatggcttttatttcttttacttatctagaacctctagcacaagctcgaatagacacgaagaatgcacattgctaccttgttcctgattttaggggaaagcactcattcaccagggatgttaactgtggcttttagcagatggctttaccaggcggaggaagtgcccttctattcctagtttattgaatctttttttttttttttatcatgaaggggtgttggatttttctcaaatgcttttcctgagaaataccttattttaaaatgtccccagagtccctgtgcttccttctgagggcaaaaactcaaatgcagaggcaaaacttatgtgccaaatcattgtccaggctctgctgtgttgggctctaacaggtgctagctggtggaacgattgttggtaatgacggcaaaatccctgccccttccagtggccagggctgcctttcccgtctgataagtgacacagcagataaggaggtcgcgctgggggggggggtccctctgccccccccaccacggccgctcactgccgctctgcccccaggcctacgagaagcgtttccccacgtgcccacagatcccagtcttcctgggcagcgaggtcttgcgcgagtcccgcagcccggacggggctgtgcacgtggtggagcggagctgccggctgcgcgtggacgccccgcggctgctgcggaaggtgggcggccctggggctggggggcggaggaggggacctgttgcggaggtgcgggagggctgggcgcgggagctggggaccagggcggcggggtccaggaggtggagcaggggcgtgtgagttgatatttggatggaggttccaggatgagggtggcgggaccagggcccaggaggggcgagggctggaaggctgggctggggagtagcgggaactgggcggggttcgcggggccagggccggagctgggtggtgaagatgggttggcggcagggcggaagtcgggggttggtgtcctgggtccgggctgggtgggcggtggcgcaagggacctgggactcagggcagggggtgactggggcaggcccgccggactcgctctccattcctgtgtgctccacgccgcccacccacctccgcctccccgccccttcccttgcagatcgcaggtgttgagcacgtggtcttcgtgcagacaaacatcttgaactggaaggagaggacgctcctcatcgaagcgcacaatgagaccttcgccaaccgcgtggtggtgaacgagcactgcagctacacggtgagcccaggccaccctcagcgcccacgcccggcacccacctgcgcccggcacccacctgtgcccagagctgtgtccccacattccttgagcctctgccaagccctccctcctggggcattgtcaagaaagatgcaggatgcttggttgcctttgcattccgatgaacaacccataatttttttagtatgtctcaaatattgcttgggatatacttatactcaaatgttatttgttgtttatttgaaattcaaacgtgactggacatcctgtgttttatctgttaaatctgacaaccctatcctctccctcctctttcccctccctcctttccttccttctttcattaaattatgcctcagtttcctcacgtgtgaaatgggcttaataatcatgcctactacacaggtagtatgtggcgcctttagaccagtgcctggcacatattaagttctacgtaaatgttacctttgactataattaataataatcataattattctctagtatatactgattgagcacctactatgtgccaggcaccctgccaagtgatgagcacccagcagtggaccaggctgcctgaccactgccctcacggagggtccattccagtggaacaaaacggaatcagtgtgtgtgcatttgtcacagctaaggctggatccagcagggagatgtgtgggagtcagagaaggtggtaggggcactgaagctgagtgctgaaggatgagaggagctgctcatggaggactgggaacagcattttgggggtgggaacagcatgagtgaggtctgccaaggtgaggccatggggcctagatcttgatgactttagaggctggaatgaggcacctgcaggcattcactgatgggacccagctctgccactttcttgctgagtgacgttgggccacactgtctgtatctgtaaaatcgggacattggcagatcctgccttgctggatcgttttcacgatgataactccaggatagcaatggtagaccattgtacgtgtttttttttttgtttgtttgtttgttttgtttttttttttgtttgtttttttgagagacagtctcgctctgtggcccaggctggagtgcactggcataatcttggctcactgcaacctccgcctccttgttaaaaggattctcttgcctcagattctcacgcctcagattcccgtgtaggtgggattacaggcatgtgccaccacatccggctgatttttgtatttttagtagagatagggtttctccatgttggccaggctattctcaaactcctggcttcaagtgatccacccaccttggccttccaaagtgctgggattacagacatgagccaccgtacccggctccattgccttttctttctacgcctccaactcctcttgggtcctccaggagcttgggctcagggtgttcagatcttctggggaggggcaagcaacagttgttgaaacccctcttagtgtgtgtggtgtttctcagaatgagttctatcaatagctgagtcagcagcacctggggctgcttgcgaaatgcagattcctgggccccaacctggaagtgtctaggggcaggcccaggaatctgcatattttaacagactccttggtaatgtttctgcccacagacgtttgaggaggactaggtctggatccataaaggagctctgccaatgaagttttctttttgcaaacatacagatctataaatgtttattgatatataaggatatgtaatatatctttatatagataacatataatatacaactatttaaaaaatctatatctaaattttatgtgtaatattgatatataatttatttatagattatataaatgatacactgaacaattgtatttattttattattttttttttggagatggagtcttgctctattacccaggctggagtgcagtggcatgatcttggctcactgcaacctccgcctcccaggttcaagcgattctcctgcctcagcctcccgagtagctgggattacaggcacccaccaccatctctggctaatttttggatttttagtagagatggagtttcaccatgttggccaggctcgtctccaagtcctgacctcaaatgattcgcccaccttgggctcccaaagtgctcggattacaggcgtgagccgccatgcccgacctaaacataagtatttctaactaattttctatgtatgtgtataatattgaaagggcagggctgcagatttgagacccacattctcccggcttctcatgagaaggctttttgttccctgacagtttgaactttgcatcgttctctgggtgggggccccttggtcctgctaccccatccagggttgccaggcttgatctgctttccactgcaggctctgcctgggcccaggtcagtgggagagccctaggggagggcagggtgcccccgacattgagtccctggcatgacccctgcctggctttcaggtccaccctgagaatgaagactggacttgcttcgagcagtctgcctcactggacattcggtctttctttggctttgaaaatgccttggagaagatcgccatgaagcagtacaccgccaacgtcaagagggtaagcggtgggttgcgttagttactggaggaaggtgcacacacctgctctgccatcaacagctgcatgacccctggcaagacccttacccttcctgggctcagtgttatctgttaaatgggtactctagtaatgaccaaatcaccacgagataatggatggaaagtaactggtctgtaacaggggcaccctaatcctcgctctggcaccatgagatgtccaggcttatgtggtgaattatctggacaacagataattctgtggtgctttttttttttttttttttttttttagataaaatgatcattgcttgctctaaagacctcagatccatccctgagtaaaaacccgttcttgtgatgaaacagatgaaattaactttaataacaaatttttaaacaatgtgttatcaatataaaacttaattctccgaggttggaggcccagttgagcccaggaatttcagagcagtctaggcaacatagtggactccatctctaaaaaaataaaataaaataaaattaggtgggtgtggtggtgtgtgcctatagtcccagctgctcaggaggctgaggcaggaggatctcttgatcctgggaggttggggctgcagtgcgctgagatgacactactgcactccagcctgggcaacacagcaagacactgtctcaaaaaaaataaacaaaaacaaaaacaacccccaacccaaaaaactgattactgagctattttgcattctttgtttcgtaccaagccttggaaattaggtgggtgttggacactcgcagcttctctccatcccgaccagacacatccagccactcaatagccacgtgtcggggctgggacctgagccggctgggggtgactccctgtggtgatcctgtgacccccctccatcctgccccgtgctcatgtgtcttgggtctctctggcttccaggggaaggaggtgattgagcattacctgaatgagctcatctcccagggtacctcgcacattccgcgctggacgcctgccccagtccgtgaggaggatgcccgcaaccaggctggaccgagggaccccagctccctggaggcccacgggccccgtagcaccctggggcccgctctggaggcggtcagtatggacggtaggtggtacagcccaggccagtcagccctaggaggctgctgcaggtcctcttgctccatggggggccctggggcatgttggggagaattgcctgccgtcccccctgggaatgggtctgggtcttggaacgacaccgcctcctgcctccactgagtgcttttctctctctccatcctggtccaagagcagaactcatttgtttcttttcttttctcttttcttttcttttcttttttgagacggagtccccctatgtctcccaggctggagcgcagtagcacgatctcggctccctgcaacctccgccccccgggttcaagtgattcttctgcctcagcctcccaagtagctgggattacaggcatctgccaccacacccggccaattttttctatttttagcagagatggggtttcaccatgttggtcaggctggtctcaaactcctgagctcaagtgatctgcttgccttggcctcccaaagtgctgggattacaggcgtaagccgttgcacccggcaaaaactcatttatttctagatcaggaattaacctctggtgccttgacattgcctctttctctggttttactatttactaacttagcaattattatgaatttactaattattacgattgctattgctattttaaattatacgagtaatgcatgatcatggtagaaaaaaattcaaactgtaaggaagatgtaagaagtacgattcttttcctctccctaaaggctaacaatagttttgtgtttctatgtcctgaagctgtttaggtgcatatatgcacataaaatgtatatatacccacacacatatgtgtgtacatgcatacatacatgtgtgtcttatgttgaatacgtgagaacatatacattccatttgatattttgcttttttttcacttactaatgttgcctgaaaaactttctgtatcagtgcctatgtcttcttttcatacttcatagtatggtgtggttgcaccataactaatttattaataaatattaattatttatttagagacagggtcttgctctgttgcccagcttggtatgcagtggtgcaatcgtgtctctctgtaaccttgaaatcctgggctcaaacgatcctcctgccccagcttcctgagtagctgggactatataggcacaggccaccatgtctagataatttatttttacttttattttatttttaattaattaattaattatttttgaagtggagtctcactgtgtcacccaggctggagtgcaatggcacgatctcagctcaatgcaacctctgcctcccggcttcaagcaattctcctgcctcagcctcctgagtagctgggattacaggcatgtgccaccacacctgactaatttttaaatctttagtggagacagggtttcaccatgttgaccaggctggtcttgaactcctgacctcaggtgatccacctgccttggcttcccacagtgctggaattacatgtgagccactgcccatggccttgattattttgaattagtctatttagctagttccctattgaaggaaacaaccctatttaggtcgtttcagtttttaaaaatacaaacaacatggtacatgtgagtacttaataatttttttaaaatgtctgtaagtatatacaaagcataacattttaaaagtggaattgctggttcaaagtttacatgcaagtaaaattttggtagatttaaccattaggcttccaatgaggttgtaccaatcattgttcccactgaatgtgtaattgcatctattcctgacttcactccagctccccacaaaagtcttagtaaacatctcaaacttctgaaagggaataaaagtagtcacttgttgattagtgacaagttttttcattatgagcaagatcaggcatgatttttcatgtttagtgactgttttcctttttttttttttttttaataatacatacttgttcttgtcctttgtccattttcttatttgcccattgctttcttattggtttgtaagagctctttgtatatgaaggcaactagccttttgtcacagttcaagcttttatggacatggaaaatgtttacaatataatgttaaaaggaaaaatcctaggatacaaattgtatgtacaccacaaatccagttctagccatgtgtaagatgtgtactcaggttgataatgtttttcctttagggccactgccgtgcagggacttccctaactctgacacacttgggtggcagtgccatggaactaataatacatctggggctctgtttagggagaatgaaattcattcatacaacatgtattattctttttcttttttttttatctgtcacccaggctggagtgcagtggtgtgatctcagctcactgcaacctccgcctcctgggttcaaacgattctcctgcctcagcctcccaaggagctgggactacaggcgtgcaccatcattcccggctaatttttgtatttttagtagagacagggtttcaccatgttggccatgctggtctcgaactcctgacctcaagttatcctcctgccttggtctcccaaagtgctgaaattacatgcaacaagtatttattctgcaccgactgtgtgtgctggttggctgttgttgtatgtgcacattttttttttttttataacagcgcccgctcctgccccctcctgtgcacgctctctgtggcctggtcccctgtaccttccccattttgcacaggtcgctccttccttctccatctgtgctgtccgccagcagcacaggcactcagggtggcgggcagaggacatcctcatgccccttctgccctctcctgaatcactgagtctttgtgctcagaagtagaaaaagccttcacatctgcccggggccggaaggatgctgggagctccggcctctctcgtttttctccctcatcccatcctcactccctccctgattccagcatctctgcctctgaccacacaaggtctggacaattcgccctctgccaacattctcccacctctgtttacctagatggctcctggcacagcagttggcgtgaccccccactgtgggcttttctgttttgggggtgctgctggccgttcattcagcctgttttcttatttagccatctgtctacaaagaactggctctgcccacggaggctgctgctttgtgtgacgtctccgcccactgctgagatgccacgaggcctctgcacgccagcatctgccaccctcatggctaagagtgggggaacaggactcaagcttggggcctggcctctgcacactggcaacattccgactacaaccgcccagttgtgggggacaaggctgcacagtgggaatgttccctgtggttcccaggctgctaaagagagcatggctgtgttgcaaggtccaggctctgttaaaagctgctgtctgtcaaaaccccacaatggggcctggggatggggcaaagcaaagagaactggtgtttatcagccacctcctttgtgctgggtgcacaacatgcatttactcattcgagttactccacctctctaggcctcagttttatcttctctctctctctcttttttttttttttttttttaagacggagtctcactctgttgcccaggctggagtgcagtggtgcaatcttggctcactgcaacctccatctcccaggttcaagcgattctcctgactcagcctcctgagtagctgggattacaggtgtgtgccaccacgcctggctaatttttgtattttaatagagactgggtttcaccatgttggccaggctggtcccaaaatcctgacttcaagtgatctgcctgccgtgggctcccaaagtcctgggattacagtcgtgagccaccactcacagcagttttatcttctctaaagtggggataatagtgacgcctgcctcacaggggtgtggagagagctcagtgagaccaggtggcttctgagaaggtagtgagtgtaagcccatattgttaagaatccttagaacatccccagagggtgggaattatcttcaattcccagggtcaaagaggagaaatcccatctcacagtgagatccaggtttgcctgatgatgcgttttcagaacccccttggacatgggctggagaaatgaatgcattcagagtccggtggctgctgtctggggcgggggcttagcctggtttggaaccacgttttagagtcagtgaggcagccagtaaggaatggcacacagaccacatggtaaagagacgcagcgtctccctcttgtcctgaagctcccccttctcctccaaggggacaagctggatgcggactacattgagaggtgcctgggccacctcacgcccatgcaggagagctgcctgatccagcttcggcactggttacaggagacccacaaaggcaaggtgggtgcagggggtaccctggagcagtggatgaatgggcaatgactggtactcagcctccgtgcatgggaaggaaaggcgagatgataatgctgacacattatctcttgcttatttatttatttattcatttatttctgtgagacaaagtctcactctgtcccccaggcagtggtgtgatcctcactgcaaccttcgcctcctgggttcaagcaattctcctgccctagcctcctgagtagctggggttacaggcgcacaccaccacgcctggctaatttctgtactttttgtagagatggggtctcaccatgttgccccggctggttctgtaattttatctgctgggtcaggggataccgttctgtgggctttttacttctttgtctctcagattcccaaagatgagcacatccttcggttcctgcgggctcatgacttccacctggacaaggcccgggaaatgctgcgccagtccttgagctggcgcaagcagcaccaggtggatctcctccttcagacctggcaaccccctgccctgctggaggagttctatgcagggggctggcattaccaggacataggtgcgtgcctccacccacatcatgtatagggcatactttggtcactgccaaatgcactttatttattattttgagatggggtctcactctgtcacccaggctggagtgcagtggtgccatctcggctcaccataatctccgcttcccgggttcaagcaattctcctgcctcagcctccccagcagctgggattacaggcacccgccaccacagctggctaattttttgtatttttagtagagatgaggttttgccattttgaccaggctggtcccaaattcctaatctcaagtgatctacctgccttagactcccaaagtgttgggattacaggcatgagccaccgcacccggcccaaatgccctttaaatgccatgcttcatgctaacatcttactatttttccttttgactcttccaggcatctagaaatgctttgaagtgacaacctagctaggaagaaccagagctggaaggctttggggcttgaggaggagacatttctccactgggctgagtgagcccacaattactcacaataattgtgatcgtaaaggtaacaggtgcatacattttgtatgcatttccaagggcagttgtagcaaattggcacaatcttggtggcttaaaacagtagaaatgtgttctttcacagttctcgaggccagaagtctggagtcaaggcgtcaccagggccgtgctccctctgaaagttctaggggagaatccttgcctgctttttccagcttctggtggacccaggtgttccttggctggtggcagcttcactccagtctctgcctctctcttcacatggccttcccctctgtgtttctgtgtcctcgcctcttctcataaggaccccaggagattggatttagggctcaccccaaatccagtgtgattttatcttgagatccttaactaattaactaattacacctgcacagactctagttcttttttttttttttttttgagacagagtctggctctgtcacccaggctggagtgcaatggtgtgatctcagctcactgcaactccgccccccgccaggttcaagcgattctcctgcgtcagcctcctgagtagctgggactacaggcgtgcaccaccatgcttggctaatttttgtacttttagtagagatggggtttcaccatgttggccaggctgttcttggaactcctgacctcaagtgatccgcccgccttggcctcctgaagtgctgggattacaggagtgagccactgcacccaggcatgggtcacattttaatgtccccatggatatgagttttgggacacgattccacccattacaaatatcttttctggatttttaagttaaattgccactgaagcctgtgcctacgacactttccaatgtcctttatctaaacgttcatctagggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaataaacgttcatctatatcaagtagggtaaacgcttgactctcctaaagaaccggctggcatggtttctcttaacgatcaatcttcctaatttatggaatccaaatttatgaactccccttattgctgaaatttacttgtaacccccaaatcagtattcacagaactttttcagtcatgctgagacatattcagagtggcgaagtattggagtcgcccatcacgcatgctgtctgctgaagttgaatgacgcggctcctgcctttttgtttcagttctcataccctaaacgagtgtcctttttgtggcctatttaatgccacattgttgcatttttgggcttttctttggtgactttgctgtttaaaatgcctcttcgtgtagtgcagaattgcgcctagctttcctaaggatgagcaagtggccacgtgctccatgcagaaaacacccaaagtgctccactagcttcaggcaggcaccagctacagggctgctggccgtgagttcaatgctgacagatcagcaatatgcattcaagtgtccttaaacagaaacacaagccgggcgcagtggctcacacctgtaatcagagctctctgggaagccaaagctggaggatcgcttaagcccaggagttcgagaccagcctgggcaacatagtgagctcgcccccctccaccacatctccacaaaaaatacaaaaaaattatctgggcatggtgctgcatgcctgtggtcccagctacttgggaggctgaggtgggaggattgtttaagctggggaggttcaggctgcagtgagtcgagatcatgccactgcactccagcctgggtgacagagtgaaaccctgcctcaaagaacaaagaggccaggcatggtgggctcacgtctgtaatcccagcattttggaaggccgaggcggcagatcacttgaggccaggggttcgagaccagcctggccaacattgtgaaaccctgtctctactaaaaataccaaaaattagccaagcgtggtggtgcatgccggtagtcccagctacctgggaggccgaggtgtgagaatcgcttgaacctgggaggcagaggttgcagtgagctgagattgctccactgaactccagcctgggtgatacagtgagactctgtctcaaaaaccaacaaatcaaccaactaacaaaccaacagacaaaaaacaccacataaaacaaggttatatattgattggttgacaaaaagtattatggggccagctgcggtggctcatgcctgtgatcccaacactttgggaggctgaggtgggtgtacacctgaggtcaggagtttgagaccagcctggccaagatggtgaaaccccatttctactaaaaatacgaaaattagccgggtgcggtggtgggcgcctgtaatcccagctactcgggaggctgaggcaggaaaattgcttgaacctgggaggccgaggttacagtgagccgagatcgcaccactgcactccagcctgggtgacagagcaagactctgtctcaaataaatacataaataaaaatgttttgtagagaagaggtctcattatgttgcccaggctggtctcaaaactcctgtgttcaagcaatcctcctgcctctgccccccaaaatgctggggtaataggtgtgagccactgtgctggcccttatcctcattgtaacacttctgtttttctgcctttcacaataaggggcgtcagcccctcttggaagcaggcagggtgttagtaagtgaaggctggatcgggccttggtgggttgcagcctgaggaggtgaagctctcacctgcagctgtgacctgcccctcggaagcagtcctctaaataacgggctcttctttctgcttggccccatccacaaagatggccgccccctctacatcctccgcctgggccagatggacaccaaaggcttgatgaaggccgtgggggaggaggcgctgctgcggcatgtgagtcaggggcctcgttcctggacgccgtgcctggggccgggcctgggaaggactgtgtggggtaaagcagcgaggcggacgttgagcagcactgtctctcccttccaggttctctccgtcaacgaggaaggacagaagcggtgtgaggggagcacaaggcagctgggccgtcccatcaggcaaacacctgggctgggcacaaatcccccctaaacagcaaagacggagggtggagaggggtccactgtgcatatgtgctgggctgggcagcgtgccaggggcttcattctcccccagtttctacagtggtcttctgggccttgaggcagggcccgtaagcatccccgttttctatgcatggggaaactgagattcagaatggtggcccccatcgaagcttgtgagccggtcaggacagagctggatttgaacctggggtcctgtctggcttctagctcgaagactttatcctcccactccactcaacagtctccttgactttgctttttttttttttttttttcttttttgaaacggagtctcgctctgtcgcccaggctggagtgcagcggtgcaatctcagttcactgcaagctctgccttccgggttcaagcgattctcctgcctcagcctccagagtagctgggactacaggcacccgccaccacgcctgactaatttttttgtatttttagtagagacagggtttcactgtgttagccagaatggtctcggtctcctgacctcgtgatccgcctgcctcggcctcccaaagtgctgggattacaggcgtgagccaccactcacagcctgactttgctttttgagatcagctctccaccacgagttctcccttggctctgtcatggcacatccaggaacccagtgtcctctgcaggaacccactgtcctctgactcccccgcatttctgttcctgaactgtttcccggagccagtacttacggtggcatcgcccccaaaggcagcaaacctttctgagcagcagcttcctcttctgtaaagtggcttttttttttcctttgagacaggctctcactctgtcacccaagctggagtgcagtggtgcaatcacagctcactgcggccttgacctgctgggctcaagcagtcctcccacctcagcctcccaagcagcggggactataaatgtgcaccaccttgcccagctaatttttttttttgcagagatgaggtctcaccctgttgctcaggctggtctaaaactcctgggctgaagtgatcctcccaccttggccttccaaagggttgggattacaggcgtcagcctctgttcccagcctgtaaagtggcttttacaaatggattctcaaaaataataagggtttaaaaataatgcaaacacggatcttgcacttgctatgtagcaggtgcccttctaagcaccttgattcatttcctcctcctaaacagccctgtgagacacgggcaggcaggagctgctgcttcagcttttcagccccaaatatcccgatctttgtgaaaattaaagttcctttgctgtttgcagattttttttttttttttttgacagagtctcgttctgtcgcccaggctggagtacagtggtgcaatcttggctcactccaacctccacctcctgggttcaagtgattctcgtgcctcagcctcccaggtagctgggattacaggtgcctgccaccacgcctggctaatttttgtatttttagtagagatggggtttcaccatgttggccaggctggtctctagagattttctaaggacacgtatgttggggtggaagtgggaatcaatccattagtgtcctggccggaagcataattcaccccagatggctcaaatgagggagtgtcatgaagggatgctttggagaggtgtgtgcaggtttaagcgaacaaatctgggaggtggaggctcccgggcaccagccgctgcagtcaaacagttattttcctaatgaatgaatactaatgaaatggaggcacagagaggttcaggacttgaccaagatcacacagcaagtggcagaactgggatttgaaccttggccatctgactgtggagtgcatgctctcagcacctctgctctatttagtagttagcatcttttcaacaattaactcatttatgcctgaggttgcaatgttttgaatttttgcaatcagaccttggtgatgaccttgagcagtaggatagaaataactcccacacgcttagcattgcaataatggaatgctaggcctaaatggccacttgtgataaccagctataattgagggcatgtggtgtgcccgtccttgcagagagctttgtatataccatctcacttgatcctaacagcagttgcttcagatgaggactgttactacctttgccactgtcctatgagtaagtgggtctgtgccctgacctaaggctctcaggggtgcaggtgagacttgaatttgggcgctcagccctgaagtccacagtctgatcctcttcatcgcatgggctccctactgtggcaggagcccccatctgctcccagccctatctctcggagcctccctgttcatcccctgtggggagggtgttggtggccttgggaggcagcagagccaggtggagctggggctatttctgccacagctcctggacctgcctgctagacctggagggactcaacatgcggcacctgtggcggccgggggtgaaggccctgctgcggatgattgaggtggttgaggacaattacccagagaccctgggtcggctgctcatcgtgcgagccccccgagtcttccccgtgctctggacactggtaagagctggagcctgggccaggactctccctgggggtgggtgggatgggaggggttccgtctgcaagcagctctgctctcttttcctgtttcatttcatttagtaactttttggagatgaaactcacatagcataaagctcacactttttaagtatagactccagtggtctttcctgtattcactgagttaagcaattgtcaccactagccaatcccagaacatttctgtcgccccaaaaagaacccccatgcccattatcgtgggtctcaaattcctgggctcaagcggtcctcttgccttggcttcccaaagtgtttgtgttataggtgtgagccactgcgcctgacctgaaatatactctatattgtaacccggtgggtacacgcgtgcatgcacccatgtgcgcgcacacatacacccacgcccacacacacactcctctgaaacaagggtgcagccagccacttgcatagtgtgggcaaaagcctggaggctggacccagcttgatgctttggaggaactgaagaaacagtccagggtggctgagcaaaaaagagcaaaagggacgacagcacctgaggaggctggaagatgtacaggggcaatagggacccatggagggttcagtagcaggggagggtgggggacagacttaggggccaggaagttctctagcttttgtgggtgcttcaaggctctgttcaggtgaggctagggggcaggagctgcttctgaagctttttatcctgaattgtcctaatctccgggaaaattaagtccacctgctgtttggggtggttttgggagtgcgagcacatcagccggggtcctggctggaagtggacctcacccagatggttcaaatgaggggtgtcctgaaggggctccttgcagaggtgtgggcaggggaaggagagaccccaagcaccagtgactgcagtaagcctggccacccccaagaggagggaatgtccttgcagaatcctggggaaagctgggacaggggtgggggcagggagctactgggggtcagcctcagcctcctggggcccagcacagcacagagcgcagtggggctggggacaggagagggccctgcacggggggattgcagtttcctcacctatctcttggcttgtggcattccctgtagaactggcctgttatctgccatgccaagggctccttccttctttctctctctcccacttccttccttctttatcaacatgtggcttagagctcagtgttaaaatggattccatctggaataaacaaactgtggaatactgttccatccatgtaatggaatagcattcgtccataagaaggaaggaagcactgatcctccaacacggagggacctcgaaaacctgatgctcagtgaaaggggccagacacggaagtccatgtactgtgtgatctcctttatatgaaatgtgcagaatagggctgggcgaggtggctcacgcctgtaatcccagtactttgagaggccgaggtgggtggatcacctgaggtcaggagttcaagaccagcctggccaacatggtgaaaatacaaaagtacaaaattaaaatacaaaaattagccaggcatggtggtgggagcctgtaatcccagctacttgggaggctgaggcaggagaatcacttgaacctgggaggtgcagcttgcagtgagccaagattgcgccattgcactcaagcctgggagacagagcgagactctgtctccgaaacaaaaacaaaaaagaaacgcccagaataggcaaatccacagagacagagtgtagatgggtggttgccctgggttgggggaggggagatgggaagtgacggtggggtgggaatggggtttccttctggggtgatgaacatgtctaggtagaggtgctggctgcacaagctagtgagtgcactgaaagccactgaactgtgcactttataatgattaattctatgttgtataaattatatctcaataaaaaaatacatccatggtcaggcgtggtggctcacacctgtaatcccagcactttgggaggccgaggcaggtggatcacgaggtcaggagatcgagaccatcctggctaacatggtgaaaccccgtctgtactaaaaatacaaaaaaaaattagccgggcatggtggtgggtgcctgtagtcccagctactcgggaggctgaggcaggaggatggcgtgaacccgggaggtggagcttgcagtgagccaagatcatgccactgcactccagcctgggcgactgagcaagactccgtctcaaaaaaaaaaaaaaaaaaaccatccatcttgccttatgtcctggtttcagatcagccccttcatcaatgagaacaccaggcggaagttcctcatctacagtggcagcaactaccagggacccggaggccttgtggactatctggatagagaagtgatccctgacttccttgggggagagagtgtggtgaggcttccatgtccacagacagacctgggcttgaggagggggcatgcctagctgggaggctgggattcccggagtggggctgggaggtggaggggggctgggtgcggcatgtgcactctgcctagggcaggtcttgctggctctcagcagccacagggcttgctttagaagctgcttcaaagagaggtgatgctgttctgaggttgggccttactctgggtccttcaaacatagtgagtgagatagaagtttctggaagcctaaagattaggccagtcaaaggcttacgcattctatattcccatcaaagacattgccaagcagcagtgagttaacctgctcattcactgcaggggaggtgactcgaatgtatctgcagctctggaccctggagctgggactagcctccaacccacagccacacagcctgaaacgatcaggaacccccttcaagggaggcagtgtccaggccccttttattgcctcccctggggtgaaatgacaggctggggtgatcctaggtcacaactctgtcatctcatatggcccccagtggcccgggccctctttgtttctaacagaaataccagacagtgagcttgcgtcatttctggattttaaaaaagtcttttcctaggaatttttccaggcttgcctgttctctccgtttgtgatgtgcggcacacacgacttatttttagcaaacggttctgcagatctgagagtggcttatggaaagacactgaacagtgtcctgctaatcccagtgtttctacaagtgaaacggggtgggggtaatcattgtttggtggtggcagggggagttctgccaaggcctggccatctagggtgcctttggtttggggaaatctctcgatgagcacggtgcagtgactgttccacccccgcctgtgacggggagaggcagctgctatggggtgcggtgtggagaggccccccagcctggctgtcagtccggcaccggggtaaagggacatgagcatggggctgtgacgaacgtgggtttgtgccctggctcactcactttctgctgtgtgatcgtgggcgagtggcctgacttgcccgagcctccattccttcctctgtgaaacgggaagaataatagtctctactgcattggtggacctggggattaaatggggtcatggaagcccacagcccattcagtaaggggttgcaattatgagtggctttgggggtcacacatcacccttctgtgggtcaggccagccaggcctcaactggccctgacctgctgccctttatctctgacctgcagtgtaatgtccccgaaggagggctggtccccaagtccctctacatgacagaagaggagcaggagcacacggaccagctgtggcagtggagtgagacctaccattcagccagcgtgctccgcggagccccccacgaggtgccagggcctggccggggagggcccgctgagctggagtgtctgtcgtcttaggtcaggtgaccccaaaacacagcttgagatgaggattcttttttcttttctttctttctttctttctttttttttttttttttgggatggagtctcgctctgttgcccaggctggagtgcagtggtgcaatcttggctcactgcaacctccacctcccaggttcaagcaattctcatgcctcagcctcccgagtagctgggattatagacatatgccactgcgtccagctaatttttgtatttttagtagagacgggttttcgtcatgttggtcaggctggtcttgaaatcctgaggtcaggtgatccgcccgcctaggcctcccaaagttctgggattataggcgggagccacggcgcctggcctcttttttttttttttttttgagaccgagtctcactctgtcaccaaggctggagtgcagtggcgcaatgttggctcactgcaacttctgcctcccaggttcaagtgattcttctgcctcagcctcccgagtagctgggattacaggtgccagccagcatgcctggctattttttttttgtttgtatttttagtagagatggggtttcaccatgttggccagactggtctcgaactcctgacctcaagtgatccacccacctcggcctcccaaagtgttgggattataggcatgagccaccaagcctggccgagataaggattcttatgccagtgatctgttgcaggcgaggtctcaggagaaaactgaggagaggagggcactcctgtaaggaatgagcgtgtgcctgggaaaggagaccccagggggcacccacagcccctcctgccactgtgttccccaccccagctctactctctcggccgtgactctcagacctcgcctgtctccacacaggtggccgtggagatcctggaaggagagtcggtcatcacctgggactttgacatcctgcgaggggacgtggtgttcagcctgtaccacaccaagcaggcgcccaggctgggcgcccgggaaccggggaccagggccagcgggcagctgatcgacaaaggctgggtcctgggcagggattacagccgtgtggaggctccccttgtctgccgggagggggagagcatccaggtttgcattttctggaccactcattcgctcaccaagcagcactgagtgtccactgcgtgccaggcttctggggatacagcggaggacatactgggctgctggtccccagcctcagggaccctgcaggacagggcagaggaaagacacacagggtctcatgtaatgaagtgctcacctgcccaatggcagccggtgcaaaatcgagaaagcacggggtgctctgctgagaggtggctggtgtcttggggaggagcacagggtctggaacctgagtttccccatctgggaaatgggacttctaacaggatccaactgtatttgtttcttggggctgcagtaatgagttaccacaaactacatggcctaaaacaacaaaaatttattgtctcacagttcaggagttcacaagtccaaaaccaaggtgttggcagggccacgctccctctgaaggctgtagggaggggttcattctatgcctctgtcctagccttaggtaactcctggcaatcctgggtgtcattggtgggtagatgcatcaccccaatctctgcctctgtctttaaaggggtttcttctctgtctgtctctcttctgagtctcaaatctccctcccctctctcctgtaaggacactagccatcacagttaggccccatcttaaatcctgtttttttttgagacagggtctcactctatccatgatcaggaaacttttgcgggactgggaatgtagtgatatgatcacagctcactacagcctctacctcctaggctcaagcgatcctcccatctcagccttctgagtagctgggactacaggttcccgccaccatgtccaactaacttttgtattttttgtagagatggggtcttgctatgttgcccaggatgatcttgaatgcctgagctcaagcgatcctcctgcttcagcctcccaaagtgctgggattagaggcgtgagccaccatggctggcctcaccctaaatccttaaccacaaagactctatttccagataaggtcacgttctgaggttctggctggacatgaattttgggggtacactgttcaacccactgcattaactcaagcagggggaaggatgagcatattggaatttgaagttcaggttgcctgcatacattcaagtggcttcagtatggacgaagaccttgagttgtggctggatctgggagggggtgagaggggatgatgttccaggtggaaggaacagaaagaacaaaattgaagccgcagggagaaggcaggtggacacgagggtagcttgagtgctggggaggggttggaagttagtttggatagaaggggaggtgctaaggtcctgaggtcagtagtcagatttctgatgtgcactgtggtttcagaactgatgcaaaagaaactgtaggtcttgggccgggtgcggtggctcatgcctataatcccagcactctgggaggccgaggcaggtgaatcatctgaagtcaggagttcgagaccagcctggccaacatggtgaaactccgtctctactaaaaatacaaaaaaaaaaaaaaaaaaaaaaaaaaaaagcgaggtgtggtggcgggtgcctgtaatcccagctactcgggaggctaaggcaggagaatcgcttgaacctaggaggcagaggttgcagtgagctgagatcatgccattatactctagtctgagtgaaagagtgaaactccgtctcagaaaaaaaaaacaaaactgtagtcttggaacagaacttgaacgtgtaactggaatatgagctgcccctgttgatccccacattctccaggaggctggcattgcaggtggaatgtcactctctgactcccgaaatgacacatgcacacacgcagcaccagctccacgagcactggcagttgctgtcgatctcaccgaagttcccggtggggagagggtggagggccgtcctgcatgtccctcacagccactgctgggtcccactgaacttctcaacccagagcaacccaaagtggctcttcttgtaaaaacaaacacttccctttctcactctccctgatccctccacaaattctctctaagcacctgtgagctcccggcccaaatccctttcctaatccccttggtttgcaaatcccactcagcagagcaaaagccccacaaaatccaggtgtttaagcacctctgttgtcctgaagttgcacccccacccccaggcgtcagctcctccccagattaagagggaggctctggtcccagggatatggggataatagcaaggatggcttccagaggccctgacaggaggagttgctggtggactggagaaagggacagagggagaagagccccaatttccaggcctggtgatgagaagcccatgaaggctcagcctccttgacctgtcctctggagggcgcagggcctcagggcagggctgatgtgtttcagggctcccatgtgacccggtggcccggcgtctacctgctccagtggcaaatgcacagcccccccagcagcgtggcctgcagcctcccgggtgtggacgatgtcctgacggctctgcacagccccgggcccaagtgcaaacttctctactactgtgaggtgctcgcctctgaggacttcaggtaggagggctccggagcggggtcctgggcaggaaggaccctggggctgattgacaatgcagatgcctggcctcctgtctcccagctgggtcagcttctcccggggtgggaccccagcatgggtatggttggagttctcaggtgacacagccccgcactagggtgtgaggagagcccagctctgcgcgtctaactctgcttccgaagcagggattttccttcaaatgaaaccttgggcagaagctcaactttttggagcagttggaggggaggagaaggggagtcttaaacccttccatgtgggcttcccctcactcctagaattccatgggaatattttagaatattctaaaagggtgctttttagacaaccctccccaagttgttgctttcagagagacagggaactgtaatggttaagacctccagcacttcctggttgctgtgtgacctcgggcaaatcacttttcctctttgagcctcaggtgcttcatcccttaaatgggaaccactggagccccagtcttgtgggtttgtcatgaggatgagatggctgggggaagctgcctgtcacctgggcatgcggtgtgcatgccacagcagaaatgaaggagaaggtctggaggcggagcaggcagtttcttcaaggttttgcattctgtaaaagcacttatgattttgcaccctgcttcatgatggatctgcactggttttcatctaaaaatgatgctttaaattctttcccgtgggggtaaaattaaggctcaaggaaggtgctgagtctagacctcaaattccaggtggagctccaaggatcccaggagcatgggcacccagagtgaagaacactggggcagagtctttatccaaggaggggtcccatagtttgtcagggggctggcgattcactctttgtgaagctgcatgttttggccatcggtcctcagtgtgaggcgacaggctgaggcccagggggacacagaggaatagacacaggcattggaaggttgtctctgggagggctgattctgaggccgggcatgtggaggccagaggggtgggctgggccagacgctgcacaccaacctgtcaagggtggtcaccatgagaggaccttactgccctgtcctcttgtagcctcatgagaaaatcagttcaaaggctgtttcctggtcgccctcagggggcaggtggtggctcggatcgtggggggaccacacagatagggtctgccatcatgaagcagagaccaaaggctcacacccaagtataactatgggcagcgatggatgccatggccaaggccactgtgttagtccgtttccacactgtgagaaagaactacctgaggccgggtgtggtggctcacgcctgtaatcccagcactttgggaagccgaggtgggtggatcatctgtggtcaagagtttgagaccagcctagccaacatggcgaaaccccgtctttactaaaaatacaaaaattagccgggcatgcctataatcccagctactcaggaggctgaagcaggagaatgccttgaacccaggaggtggagattgcagtgagctgagatcgcgccactgcacttcagccttggcgacagagcgagactgtctcaaaaagaaaaaggaaaaaaaaaaaacctacctgagactgggtaatttataaagaaaggaggtttaattgactcacggttctgcatgactggggaagcctcaggaaacttactatcatggcggaaggcaaagggtcaggagagagagagagcagaggaagccacacacttttacaccatcagacctcatgagaactcattcactatcgcaagaagaccatgggggaaactgcccccatgatccaatcacctcccaccagatccctccctcaacacttggggattacaatttgagatgagatttacttgggccatagagccaaaccgtatcagccacccagccaggaggtgctcagggacgtaacctagagccttgccagagcacaggacgggcctggcctagggttgggagagagggtgggggaagtaatatggaacgtgacactggactgagatctaagtagtgtggtggtcacacaagtcaccagggggtctttttatttatttatttttggagacagagtctcgctctgttacccaggctggagtgcagtggtgcaatcctagcttactgtagccttgaactcccgggctcaagcaatcctccaacctcagcttcccaagtagctgggactataggcatgggctagcttgcctggctttttttttttttttttttttttttggagacagggtttcactctgtcacccaggctggagtacagtggcacgatatctactcactgcaacctccgcctcctgggttcaagcaatcctcatgcctcagcctcctgagtagctgggattacaggtgcgtaccaccacccctggctaatttttatatttttagtggagacaggtttcgccatgttagccaggctggtgtcgaactcctggcctcaagcaatccacccacttcggcctcccaaagggctgggattacaggcatgagccactgtgcctggccacttttaaaattttttgtagagatggggtctcactattttgcccaggctggtctcaaactcctggcctcaagcgatccccctgcctcagcctttcaaagtgttgggatgacaggcgtaagccatggcacctggcgaggttctgcatctctaacaagctccgggcactgctggtgctgccagttcccagaccatgctttgagtagcaaggccctaaagctgcactgtcctatctggtcgctgctagtcacctgcagcaatttaacttagcaaggagaatgaaataaaaggaacaattcagtgcctcagtcgcatgggccacatttcaagtgatgagcagcccatgtggccagtggctggtgtgttggactgtgcaggtgtacagcacgttcatcgcaggaagttcttggagggtgggcatggtgcctcacgcctgtaatccaagtgctttgggaggccgagtcacgaggatctcctgatcccaggagtttgagaccagcctgggcagcatagtgagagccccgtctctatacaagaaaagaaagttctcgaggatggcgctgccctgaggtttggagtaggagttaaccagacagctgggggaggagagaatgggcttctgcctcaggctcagcgcacacgaaggccactgcaagagctaggaggaggaccatggaatttgagtgcaaagagtaaggagggagtgagactggagacagggccggggactccctgggctgtggcggccttagggccatgcaagggcctcaggccaggggagcccctgatgggtctgtggcaggctgggctccatctggggagatgggagtgtggggaattcggtagtgcttttctcttcatggcgtcacttgcttttccctttgcatcggcctggggccctggggcctgatttgcagcatcaacagcttttccactgctgtgtgtcagcccaagggccttgtcactgtgagagggtaacgtgtgccacgcccttcctccccaggggctccatgtccagcctggaatcctgcaccagcggcttctcccagctcagcgccgccacctcgtcctcctcctccggccagtctcatagcagctccctggtctccagatagccgggcccagtgtttcagggccgcccgctcgcctccagtgtccagaaatgtccagaatgagaagccagctaactgcagggcctgggaccatgtgggctggagccccaggcctagatgctgcccaagttggggtgtctggagcggatggcaaggatccagaactggcctgtgggtggtgtcagggctcttgaaattgcaaggacagaaccatctccttccggcttcgtgtaaggaagaccaagccaaggccaaggtgtctaccataccacacctttgggacatccgggcttagcgacgtcagccaggcccatctcctctctgtccacctcttgctctgctttcgccatgcaggggaccatcactatcaggtgcccttctcctccctgcagcttgcctgcataagagagcctcttcctcccaaaggctccagcccacttcccagagctgagtcttagcctggaagggggagcgattgccaggtcaattcctgaaccaatcacagttgccaggcacactggagaatgctgattggccagcagggtcatgcccaatctggaccaatcaccgtgatccagggttgcagtgaggtgcagtgattggccagcctggatcacatgcacatctctggaaccaaccacctgctctcaaaagcactagtgggtgcctcgaggagtactggggtcccccctaagaagaaggaggaaggatgctggggaggcagaaatgaagggtgtttaccttggcatctgattgcataacgttctgttatgcagtatcaagatgtgcttggtgagcagttaagtgagttacaggcgctgctctttgtggggaacagcacatcctgaagtgaaaatccatgttccctgcacttggccagcatggcctaagcctgaccatccctgattggagagggtgggagagccctgggtttctgctaagttccaggcagtgatggggtgactgaggctgtctgtataccccactggagatgcctttctctcctagggaactgtttaattatgactgtttttggttgtaagccacagagacccatgcccaggtgcttcaacacaaaagcatgatcattcatgggtgcatagaactggccagtccaggagggcttgcttcaggtaaggctagatccagggtctcaacatggagtctcgattccccccgcgagtggaggctgctgtgtttgccctggggcagatatgactctggaactaggttcaatattgacatgagttcccctagttactacacaggagcgtcttgggtctccttggggcctgaggacatttctcctttcctttcctggactccccaaaaggcagccagtcaggggtcaccaacttgaagcctgatctggcctgcttttagtgttgcttttttgcctttagaatggtttaaaaattgaggcatttcgcatcgaaatcaggatttctggcttcccttaggcatttgggagcaccagcagaatggggtcactattgttgcatgaagacaacacctctgcacccctggatgtggccacgccagtccctaccccattgacttgcgcccagcccacattacacatcctcatgacctgcgtggcaggagtctcactgacatggctctgtcagcagtggctggtacccttgtctcctggccttgcttagagttggggctcatctctgctgcagtaactgagccaaggggtggttttgtggccacaagaatcatctttatgcaggctcagcaatgcagggccaggaaacttatatctacgccagcctcaaccccaaacccaaggaagagagaaagtgtcatcttttcagatacatccttcttcctgctgggagagagccttgcccaccttcctgttggctctctgtccgcttctcaggtatctgaacaaaatagattgctttgcactctgcgtcaaggtgtgtgtgcacatgtgtgcataagagaccgactgattggaaggagacgttctcaaaactaattgctcccatatcaccaggcatttattgctgagagcaacttgcaatattttcaactatctttaagtgaatttctagcttttctcttaaaaactaggtgttatcctacaagtatgctgggataagctgccctggcagtctttatacatttattgtctagccccagagaaggacacagaagccttttacggaaggaagctggaactgcctgttccagaggcgggtggggggaggggagtctgctatcagctgtccacccttaacagtgggggtgaggaacctcaggccctttcagttctgctcttgagagtgctctctccctagggaaaaccagcccaaactggcttaagcaacaaagcaaattccctgggtcctgtactagggatggctgaaggtgggtgctgcttcagatatggctggatccaggagcttaatgtcctcaggcctctcaactgcacccaggcctcttgactctgcatctctttgcatgctgacctcattctttcttccacctggcgggaaagatggctgccagcagccccaagcctataatttcaggattcacactctaagagatgcttttccatctcaaatctcatggaaggctctgattggcccagctcgagtcacatgcttattcctgtgggccacactggcaaggaactagggtcccgtgattgacattccctgcagaagccgcagcaggattggggagggccattcccccaatggacaagagaagctggaccacagaaccagcaggtatccatggtggcatctgctacggccggctctcctcccatgtggaggtctcggggacccacgtggaagcattatcaaggtcattcttcttgccttcgggaggactggaattaaaaataatccaaggaagggattgccaagcttttggcttttgaatttcccctgagccacaaaggctggaagtgccttggcttgggcttcttgcatcattagttcattaatccattgtgaccaggacagaagcaacccacaagcagcattactgttggtgtttgggcacctgggccttgaatttaggccaggactcaaaccccagccttcctttcactagctgtgtaaccttgaccaggtgacttaacctctctgtgcctcagtttcctcatctgtaaagtgaggatagcagtgcctacctcaataggttgtagtgggacgaaatgagggagtagctgtaaagctttcagcacagctcccagaacacagaaagcgctccattaatgtcagtggtcattctgattacttaatgcttcgcatccaaagactcgttttcttcctgaggtcgcctatccctgtttttcgttattgcacccagagaaaagtaggtgtcaagaattattgccctctgagttgggtgtgcagtctttctcttttagaaactgcttgtgtgggcggggcgtggtggctcatgcctataatcccaacactttgggaggctgaggccggctgatcgcttgagtgcaggagttcaagaccagcctgggcaacatagtgagaccctgtctctacaaaaaattaaaaaatgagccaggcgtggtggtgcgtgcctatagtctcagctgctcgggaggctgaggcagaaggattgcttggaggtcaaggctggagtgagccatgatctcacccctgtacttcatcctgggtgacaaagcaagaccctgtctcaaaaaaagaagaaagaagctgcttgtgttttctgggtaagtccacccatctgagggagtgtattctgagtggtatttcccttggcagttagaaaatgttttttcccagaggttgaagtatggagagtttgagactctttttttctaccctgcactctctggaattccccctccctgctgtaaaatttattgtccaatgagaatagtataattgttttcaacaaagtctctttgagccagtgaaacacgatgggtttttttgtttgcctgatcacttgctccaaccagcagcattaaatgttttccatttggataaacttgcatcgtcagcttcctaaaaccctggaggtttcccgtgggctcgttcaagaactttccagctgttgtttaaaagactttagagctagcttgttcagcctgtggcctgcaggctgcacgcggccccggactgctttgaatgtgctccaacacgagttcgtaaactttcttaaaatact
